United States Patent 6,610,836 (NUCLEIC ACID AMINO ACID SEQUENCES RELATING TO KLEBSIELLA PNEUMONIAE FOR DIAGNOSTICS AND THERAPEUTICS) - sequence listing, part 2

SEQ ID NO: 878 - DNA, 1689 bp, Klebsiella pneumoniae
gcgcgcgctggccgcactggaaaaacggctggaaacgctggagggcaaatgacgccaggagaattacggcgcctgtatttcatcatccacacctttttgagctacgggctcgatgagctcatccccaaaatgcgcatcacgctgccgctgcgtatctggcggcggatgctgttctggatgccaaaccgccatcaggatcagcctcttggcgcccgccttcggctggcgctccaggagttggggccggtgtggataaaattcggccagatgctttccacccgccgggatctctttccgccgcatattgccgatcagctggcgctgttgcaggaccgcgtggcgccctttgaagggaagctcgcgcagcagcagatagagaaagcgatgggggggctgccggtcgagacctggtttgatgatttctccgttgagccgttagcctcggcgtccatcgcccaggtgcataccgcgcgtctgaaggagaatggcaaagaggtggtgatcaaggttatccgcccggatattttgccgatcattaaagcggacatgaagctcatctaccgcctggcgcgctgggtaccgcgtctgctgcctgacggtcgccgtctgcgcccgcaggaggtagttcgcgaatatgaaaaaacgctgctggatgagctgaacctgctgcgggaatccgccaacgctattcagctgcggcgtaatttcgaagacagcccgatgctgtacgtgccggaggtgtaccccgactactgtagcgaaagcatgatggtaatggagcgtatttacggtatcccggtgtccgatgtggaggcgctggaggcccagggcaccaatatgcagctgctggcggagcggggcgtgcaggtcttcttcacccaggtgttccgcgacagcttcttccatgccgatatgcatcctggcaacatattcgtcagctacgagcatccggaagatccgcagtatatcggcatcgactgcggtattgtcggctcactgaacaaagaagataagcgctatctggcggaaaactttatcgcctttttcaaccgcgattatcgtaaagttgccgagctgcacgtcgattccggttgggttccgcccgataccaacgttgaagagtttgagttcgcgatccgcacggtctgcgagccgatctttgagaagccgctggcggagatctccttcggccacgtgctgcttaatctgttcaataccgcgcggcgtttcaatatggaagtccagccgcagctcgttttactacagaagacattactttacgtagaaggggtaggccggcagctctatcctcagttagacttgtggaaaacggcgaagcctttcctcgagtcgtggatcaaagatcaggtcggcattccggcgctggtgcgcgcgtttaaagacaaagcgccgttctggatcgaaagaatgccggaaatacctgagctggtgtatcagagcctgcagcagagcaaacagctgcagaccagcgtcgatactattgtgcgggatatgcatgtgcgtcatgtgcgccagggccaatcccgttacctgtttggtataggcgcggttttattgctcagtggtacgctgctctttatccatcgccctgagtggggaatgatgcccggttggctgatggccggcggtgtggtgacctggcttattggctggcggaaaacccactga

SEQ ID NO: 879 - DNA, 1566 bp, Klebsiella pneumoniae
atccaagctgggtggctaatcatggcggattcacaacccttgtccggcgcccctgagggcgccgagtacctgcgagcagtgctgcgcgcgccggtttatgaagcggtgcagaaaacgccgctgcaaaaaatggataagctctcgtcgcggctggataacgttattctggtgaagcgtgaagatcgccagccggtacacagctttaagctgcgcggcgcttacgcgatgatgtccagcctgactgccgaacagaaatcccacggggtgatcaccgcttcggcgggcaaccatgcccagggcgtggcgttttccgcatcgcggctgggcgttaaggcgctgatcgtgatgccggtagcgaccgccgatatcaaagtcgatgccgttcgcggctttggcggcgaagtgctgctgcacggcgccaactttgacgaagcgaaggcgagagcgattgagctggcgcaacagcagggttttacctgggtgccgccgttcgatcacccgatggtcatcgccggacagggaaccctggcgctggagctgctgcagcaggatgcccatattgaccgcgtattcgtcccggtgggcggcggcggtctggcagcgggcgtggcggtgctgatcaagcagctgatgccgcagatcaaagtgatcgcggtggaggcggaagattctgcttgcctgaaggcggcgctggacgcaggccatccggtggatctgccgcgcgtcggcttgtttgccgaaggcgtggcggtcaaacgcatcggcgatgaaacgttccgtttatgccaggagtatctggacgatatcatcaccgtcgatagcgatgctatctgcgcggcgatgaaggatctgttcgaagatgtgcgggcggtggcggagccttccggcgcgctggcgctggcggggatgaaaaagtatatcgcccagcataacatccgcggcgagcgtctggctcatattctgtccggggccaacgtcaacttccacggcctgcgctacgtgtccgagcgctgcgagctcggggaacagcgcgaagcgctgctggcggtgacgatcccggaagagaaaggtagctttttgaagttttgccagctactggggggccgctcggtgacggagttcaactaccgctttgccgatgccaaagacgcctgtatttttgtcggggtacgcctgagtcgtggcctggaagagcgcaaagagatcctccagttactgaacgacggcggctacagcgtggtggatctctctgatgatgagatggctaagctgcatgtgcgctatatggtcggcggccggccgtcaaaagcgctgcaggagcggctgttcagcttcgagtttccggaatcgccgggggcgctgctgaaattcctgcatacccttggcacccactggaatatttcactgttccactaccgcagccacggcaccgactatggtcgggtactggcggccttcgagttgggcgagcacgagccggactttgaaactcgtctcaatgagctgggctatgagtgccacgacgaaacgcataacccggcattccgctttttcctcgcgggttag

SEQ ID NO: 880 - DNA, 183 bp, Klebsiella pneumoniae
agcgagaatggaaaaagtgcgaatttagaactgcgtatccatacttttcgcggcatatcgttacatttagccgaaaatggacgtttgatcgcaaaacagagctatgttggcaaagagggcgccgaagagcgcggcaggcgtgagaaaactgaatttttttcatttttgatttttttcatataa

SEQ ID NO: 881 - DNA, 315 bp, Klebsiella pneumoniae
atatccttagggatatcaaccagcaccggacctggacggcctgagtttgccacctggaaagcctcggcaataacccgcggcagttcgtccagagactgcacaaggaaactgtgcttagtacaggccagtgacaaaccgagaacgtctacttcctggaacgcatccgtgccgatgaagggtgcggccacctggccggtgatagctacgatgggaatagagtcaagcagggcgtccgccaggccggtgatcagattggtcgcgcccgggccggacgtcgcgatacacaccccggttttaccggttgctcgcgcataa

SEQ ID NO: 882 - DNA, 1110 bp, Klebsiella pneumoniae
cgtcacccaggcgtttatcgtcgacaccaaaggagtgtggcggtgagaaccattctggtcaccggcggcgcgggcttcattggttcggcggtggtgcgggagattatccagcacaccgccgatcgcgtggtggtggtggataaactgacctatgccggcaatttaatgtcgctggcgccggtggcgcaggatgcgcgtttcgcctttgaacaggtggatatctgcgaccgcgccgagctggatcgcatttttcgtcagcatcaaccggatacggtgatgcacctggcggcggaaagccatgtcgatcgttcgattgacggcccggcggcgtttatcgagaccaatatcgtgggcacctatacgctgctggaggcggcccgtagctggtggaataccctggctacggcgcaaaaatcggcgtttcgcttccatcacatctccaccgatgaagtgtatggcgatctgcacggcagcgatgatttctttaccgagaccacgccctatgcgccaagcagcccctattcggcttcgaaagccagcagcgaccacctggtgcgcgcctggctgcgaacctatggcctgccgacgcttatcaccaactgctcaaataactacggcccgtatcactttcccgagaagctgatcccgctgacgatccttaacgcgctggcgggcaagccgctgccggtgtatggcaatggacaacagatccgcgactggctgtacgtggaagatcacgccagagcgctgtatctggtggcgacccgcggcgaaccgggcgaaacttacaatatcggcggtcataacgaacgtaaaaatatcgaggtggtggaaaccatttgtcagctgctggaagagctggcgccggataagccgcagggcgtggcgcactatcgcgatctgatcgccttcgttgccgatcgtccgggccacgatctgcgctatgccattgatgcctcgaagattgcccgcgagctgggctggacgccggcagagactttcacctccggtatgcgtaagaccgtggcgtggtatctgtcgaacgaggcctggtggcgtcaggttcaggacggaagctatcagggcgagcgtcttgggctgcaaagctaa

SEQ ID NO: 883 - DNA, 555 bp, Klebsiella pneumoniae
ccattcgcaggcttcttacgcgccggggagacctgcgcgtcggcaaggctatggtttcagttaataacaataaccgggagtacccggaatacggcaaacacaagaggatatatgactgagaaaaaagcggagctccagcgtggactggaggcccgacatattgaactgatcgcccttggcgggacgattggcgtggggttgtttatgggggcggccagtaccttgaaatgggctgggccttccgtgctgctggcgtatattatcgctggcctgttcgtctttttcattatgcgctcaatgggcgaaatgctgttccttgagcctgtcactggctccttcgcggtgtatgcgcatcgctatatgagccccttcttcggctatctgaccgcgtggtcctactggtttatgtggatggcggtgggattctcggagattaccgcccatcggggtctatgtgcagttctggttcccggagatggcgcagtggatcccggcgttaattgccgtgggactggtggcgctggcgaaccttgcggcggtccggctatacggtga

SEQ ID NO: 884 - DNA, 2283 bp, Klebsiella pneumoniae
aataagagaggaacaaaaatgacaattattaaccacaccctcggttttcctcgcgttggcctgcgccgcgagctgaaaaaagcgcaagagagctactgggcgggcaacgccactcgcgaggaactgctggcggtaggccgtgagctgcgcgcccgtcactgggagcagcagaaacaggcgggcgttgatctgctgccggtgggggatttcgcctggtacgaccatgttctgactaccagcctgctgcttggcaacgtgccggctcgtcatcagaacaaagacggatccatcgacatcgataccctgttccgcattggccgcggccgcgcgccgactggcgaaccggccgccgctgcggaaatgaccaaatggtttaacaccaactatcactatatggtgccggagttcgtgaagggccagcagttcaaactgagctggacccaactgctggatgaagtagacgaagcgctggcgctgggccacaagatcaagcccgtgctgctggggccggtaacctatctgtggctgggtaaagtgaaaggtgaaccgtttgaccgcctgaccctgctgaataccatcctgccggtttaccagcaggtgctggccgaactggcgaagcgcggcatcgattgggtgcagattgatgaaccggcgctggtgctggagctgccgccagcgtggctggaggcctttcaaccggcttatgacgccctgcagggccaggtgaagctgctgctgactacctattttgaaggcgttagcgacaatctcgcgaccattgctgcgctaccggtccaggggctgcacgtcgatctggtgcacggcaaagatgatgttgccgaactgcacaaccgcctgccggccgactggctgctgtccgcgggcttgatcaatgggcgtaacgtctggcgcgccgatctcaccgaaaagtatgcgcaaattaaagacctcgtcggtaagcgcgagctatgggtcgcgtcatcctgctctctgctgcatagcccgatcgatctgagcgtggagacgcgccttgatgcggaagtgaagagctggtttgccttcgcgctgcagaaatgcggtgagctggcgctgctgcgcgatgcgctgaacagcggcgatacggcggcgattaccgagtggagcgcgccaatccaggcccgtcgccattcgacccgcgtgcacaacgcggaggtggaaaaacggctggcggcgatcactgctcaggacagccagcgcgccagcccctatgaggttcgcgcgcaggcacagcgccagcgctttaacctgccgaaatggccgaccaccaccatcgggtcatttccgcaaacgaccgagatccgcggcctgcgcctggacttcaaaaagggtaaccttgacgccagtcattatcggacggggattgcggaacatattaagcaggcgatcgtcgagcaggagcggttaggtttagacgtactggtgcacggggaggccgagcggaacgacatggtggaatacttcggtgaacatctggacggttttatcttcacgcaaaacggctgggtgcagagctatggttcccgctgcgtgaagccgccggtggtgatcggcgacgtcagccgtccgcaggcgatcaccgtcgactgggcgaagtacgcgcagtccctgaccgacaagccggtgaaagggatgctcactggaccggtgaccattctgtgctggtccttcccgcgggaggatgtcagccgtgaaaccatcgcgaaacagattgcgctggccctgcgtgatgaagtggcggatctggaggcggcggggatcggcatcatccagattgatgagccggcgctgcgcgaagggttaccgctgaagcgcagcgactgggatgcctatctgcagtggggtgtggaagccttccgccttaatgctgcggtcgccaaagacgacacgcagatccatactcacatgtgctattgcgagttcaatgacatcatggactccattgccgcgctggacgctgacgtgatcaccattgaaacctcgcggtccgatatggagctgctggagtcgttcgaagcgttcgagtaccccaatgagattgggccgggagtatatgatattcattcgccaaacgtgccgagcgtggagtggatcgaagcgctgctgaagaaagccgcgcagcgtatcccggtggagcgactgtgggttaacccggactgcggcctgaaaactcgcggctggccggaaacccgcgccgcgctggcgaatatggtgcaagcggcgcgaaatctgcgccagtccgcctaa

SEQ ID NO: 885 - DNA, 900 bp, Klebsiella pneumoniae
tcatctctggggggaatgatgaaaggtattattctggcgggcggttccggaacgcggctacatcccatcacccgcggcgtatcgaagcagctgttgccgatctacgataagccgatgatctactacccgctgtcggtattaatgctggccgggatccgtgagatcctgattatcaccacgccggaagacctacgtgatttccagcgcctgctcggcgatggctcagagtttggcattgcgctgcactatgccgtacagccgacgccggatggtttagcccaggcgtttatcatcggtgaagcctttcttaacggcgaaccggcgtgtctggtgttaggcgacaatatcttcttcggccaaagctttagcccgaagctgcgcagcgtcgctgcccgcacggaaggggcgacgatttttggctatcaggtgatggatcctgagcgctttggcgtggtggagtttgatgataacttccgtgcgctatcgctggaagagaagccgaagcagccgaagtcaaactgggcggtcaccggtctctatttctacgatggcaaggtgacggagtatgccaaacgggtcaagccatccgagcgcggcgagctggaaatcacctccatcaaccagatgtatctggaggatggcgcattgaccgtcgaactgcttggacgcggctttgcctggctggacaccggcacccacgatagcctgatcgaggccagcatgttcgtgcagaccgtcgagaagcgccagggctttaaaatcgcctgtctggaagagatcggctggcgtaacggctggctggacgacgacggcgtcaaatgtgcggcgaagcggctggaaaaaaccggctacggccaatatctgctggatctgctccgtgcccgtccgcgccagtattga

SEQ ID NO: 886 - DNA, 1911 bp, Klebsiella pneumoniae
ttaaaaatgggacggcacgcaccgtcccatttaataaacacagatgggagtaaaaagagcatgcctaagtaccgttccgccaccaccacacatggccgcaatatggcgggcgcccgcgcgttgtggcgcgcaaccggaatgaccgatgccgatttcggcaaaccgattatcgccgtcgttaactcctttacccagtttgtccccgggcacgtgcacctgcgcgatctcggcaaactggttgccgagcagattgaagccgccggtggcgtggccaaagaattcaacaccatcgcagtggatgatgggatcgctatgggccacgggggtatgctctattcactgccatcccgcgagctgatcgccgactcggtggagtatatggttaacgcccactgcgctgatgccatggtttgtatctccaactgcgacaaaatcaccccggggatgctgatggcctccctgcgtttgaatattccggtgatctttgtttccggcggcccgatggaagccgggaagaccaagctgtcagataaaatcatcaagcttgacctggtggatgcgatgattcagggggcggatccgaaagtgtccgacgagcagagtaatcaggtggaacgctccgcctgcccgacctgcggctcctgttccgggatgttcacggcgaactccatgaactgcctgaccgaagcgctgggcctgtcgcagccgggcaacggctctctgctggcgacccacgccgatcgtaaggagctgttcctaaacgccgggaaacgtatcgtggagctgaccaaacgctattacgagcaggatgacgcttccgcgctgccgcgcaatatcgccagcaaggcggcctttgagaacgctatgacgctggatatcgccatgggcggctccaccaataccgttctgcacctgctggcggcggcgcaggaagctgaaatcgacttcaccatgagcgatatcgataagctctcccgcaaagtgccgcagctgtgtaaggtggcgccgagcacgcagaaataccatatggaagatgtgcatcgcgccggcggcgtgctgggcattctgggcgagctggaccgcgccgggctgctgaatcgcgaggtcaaaaacgtccttggcctgacgctgccgcagaccctggaacagtacgatgtgatggtgacccaggacgacgcggtgaaaaaaatgttccgcgccggcccggcgggcatccgtaccacccaggcgttctcgcaagactgccgctgggataccctggatgacgatcgcgccgaaggctgtatccgttctctggaacacgcttacagcaaggacggcggcctggcggtgctgtacggcaatttcgcagaaaacggttgtatcgtgaaaaccgccggcgtggacgatagcatcctgaaatttaccggtccggcgaaagtatatgagagccaggacgatgcggttgaggccatcctcggcggtaaagtcgtggaaggcgacgtcgtggtgatccgctacgaagggccgaaaggcgggccggggatgcaggaaatgctttaccccaccagcttcctgaagtcgatggggctgggcaaagcgtgcgcgctgatcaccgatggccgtttctccggcggcacctcagggctctctatcggtcacgtctctccggaagcggcgagcggcggcaacattgcgctcattgaagatggcgacatgatcgcgattgatattccaaaccgcagcatccagctgcagctgagcgatgcggaaattgcggcgcgtcgtgaagcccaggaagcgcgtggcgaccaggcgtggacgccgaagaatcgccagcgtcaggtctcctttgcccttcgcgcctacgccagcctggcgaccagcgccgacaaaggcgcggtacgcgataaatccaagctgggtggctaa

SEQ ID NO: 887 - DNA, 390 bp, Klebsiella pneumoniae
tacccgccgggaccaccaccagcgctggaactaacgccagccccagcagcgcgccctgatagcctcccaacacgtagcaagcatagtaagccgccacgccgatcaggctcccggcaatcagcgagaaggcgttacccgccgcatcgcgaaagcctttcatcagcgccagcaggaaattcgcccaggcgatccccatctgcaccagcgccaccaggcgtaccagcccctgatagtgcgtatggccgaacagcccctggcttatcggcgccgccgccagtaaaaataccagcgccagcagggtggaaaagccaagcaccatcgccgacgaggtgcccaccacctgcttcaggcgcgggggatcgtcgtgatgctgcgccaccagcttcgtga

SEQ ID NO: 888 - DNA, 651 bp, Klebsiella pneumoniae
ccctcgcggggcggcgcgttacgcgaaggcctggtgtacggcatgctgcatctctccgttgagcaggacatccgcagccgcacgctgcgtaatattcagcgtcgttttatgatcgacaccgaacaggcccagcgcgtcggcggccttgccagtcatctgctcagtcagttggatggcagctgggagctggatccgctaagccgtgatttactccttagcgcctgtgcgctgcatgagattgggctgagcgtggattttaagcgcgcgccgcagcacgccgcctatctggtcaataacctcgacctgccgggctttaccccggcgcagaagaagctgattgccacgctgctccttaaccagactaacgctatcgacctctcttcgcttcatcaacagaatgccgtcccgccgcgggtggctgagcatctgtgtcgtctgctgcgactggcaatcctgtttgccagccggcggcgcgacgatctgttgcccgccattcagctgaccgctcaagacgaacaactgacgctgatattgccgggaaactggctggatgaacatccgctgggtcgggagatggtcgatcaggagtgtcagtggcaaagctacgtccactggatacttcgggtcgccagcggcgatacgctgaaataa

SEQ ID NO: 889 - DNA, 726 bp, Klebsiella pneumoniae
attatggctataggtatatttgtctgtagcggctcgcttctcgttggtgcgctggcgggcgcttcactgaatcgttttattccagaacatttcaaaaaaaccttaccgttgatcgccggactgatctcaatcagtatgggcatattctttgtcaataaattgcataacctgccgccgattgccctggctattattgtcggcacgattatcggcggcttgttgaatattgaaaaatggattgaacgagccggaacaacgctgcgcagccccattgaacgtatctttccggcgcagtccagcgccagcgtcggtgcggaagattttatgaatcagtttatcgccgtgctgatcctgttctgcgccagcggtaccggcatcttcggcgccttaaccgaagggatgaccggcgacccgaccattctgctgaccaagtcgatcctcgacttttttactgccgcgattttcgcctccacgctggggtatatcatcaccgtgatctttattccccagctaattgttttcgttatcctgtttttcgcggcaacctttatcatggcgttaatcaatccgtcgatgatcgccgacttcaccgcctgcggcggcatcattatgctggcgaccggtttccgtctgtgcgggatccgtgccttccctaccgccaatatgctgccctcgctaatactggtgatgcccttctccgccgcctggcagcagtttatcgcctga

SEQ ID NO: 890 - DNA, 984 bp, Klebsiella pneumoniae
acttactatatgacaggaattttattgcggaaattgatatattcacaacgtcacgttgcattttatgaaatacaaaaccggggagtacgcgccgtggatttacgcgatctgaaaacctttctgcatctggcggaaagccgccattttggccgcagcgcgcgggccatgcacgtcagcccgtcgacgctttcgcgccagatccaacgcctggaagaggacctcggccagccgctgttcgtgcgagataatcgcacggtgacccttaccgaagccggggaagagttacgtacctttgcccagcaaactttattgcagtatcagcagcttcgtcacgtcatcgatcagcagggcccttcgctctccggcgagctgcacatcttctgctctgtcaccgccgcctatagccatctgccgccgatcctcgaccgctttcgcgccgcgcacccctcggtggagatcaagctctcgaccggcgacgccgccgacgctatggagaaggtcgtcactggcgaagccgacctggcgattgccggtaagccggagactctgccagggtcggtggcgttttcgatgctggagaacctcgccgtggtgttaattgccccggcccttccctgcccggtacgcaaccaggtgaccgtcgagcgccccgactggtcgacagtgccctttatcatggccgaccaggggccggtacgtcggcgcatcgagctgtggtttcggcggcataaaatcagcaatccgtcgatctacgccaccgtcggcgggcacgaagcgatggtgtcgatggtcgccctgggatgcggcgtggcgctgctgccggaagtggtgctggagaacagtccggagccggtacgcaacagggtgatgatcctggagcgcagcgatgagcaaacgccgtttgagctgggtgtttgcgcacaaaaaaagcggctgcatgagccgcttattgatgctttctggaaaattcttcccaaccactaa

SEQ ID NO: 891 - DNA, 963 bp, Klebsiella pneumoniae
aggactttcatgatcgaaattaaacatctgaaaacgctgcaagcgttgcggaacagcggttcactggcgggtgcggcagcggccctgcaccagacccagtccgccttgtctcaccagttcagcgatctggaacagcgccttggctttcgtctctttgtgcgtaagagccagccgctgcgttttactcctcagggggaaatcctcttacagctggccaaccaggtgctgccgcagatcgctcgcgccctgcaggactgtaacgaaccacagcagacccggctgaggctggctatcgaatgtcacagctgtattcagtggctgacgccggcgctggagaatttccgcgcccgctggccacatgtggaggtcgacttccattccggcgtcaccttcgacccacagcctgcgctgcagcagggtgaactggatctggtgatgacctccgatattctgccgcgcagcggcctgcactactcgccgatgtttgattttgaggtgcgtctggtgctggcgcccgagcatccgttagctatgaagacgctggttaccccggaggatctggccgcggaaacgctgttgatttatcccgtgcagcgcgggcgcctcgatatctggcgccacttcctgcagccggccggcatcagcccgcagctgaaaagcgtcgataacacgctgttgttgatccagatggtggctgcccggatgggcatcgccgcgctgccgcactgggtggtggaaagctttgaacgccagggcctggtggtcaccaaaaccctgggtgaggggttatggagccggttgtacgcggccgttcgcgatggcgaacagcgtcaaccggtcaccgaagcgtttattcgctctgcgcggaaccacgcctgcgatcatctgccgtttgtccggagtgcggagcgacccagcggcgatggacccacagcgaggccaggatcaccaacgctccgctaa

SEQ ID NO: 892 - DNA, 789 bp, Klebsiella pneumoniae
accgtaaacatgggcgtagacgatacacaaccgctaatttcgcatctgattgagctgcgcaagcgtctgctcaacagcatcattgctattctggtgatcttcctggcgctggtctatttcgccaatgatatctaccagctggtctcggccccgcttatcagtaagatgcctgtgggcgcgacgatgatcgccaccgatgtcgcttcacctttctttacgccgataaagttgaccttcatggtgtcggtgatcctgtcggtgccgattattctttaccaggtatgggccttcgtcgcgccggcgttgtataagcacgaacgccggctggtggtgcctttactggtatccagtaccctgctgttctatatcggcatggctttcgcctattttgtcgtgtttccgctggcgttcggcttcctgacccatgcggcgccggaaggggtgctggtctcgaccgatattcgcagctatctcgacttcgtgatggcgctgtttatggcattcggggtctcctttgaggtgccggtcgccattgtgttgctctgctggatgggcgttaccacgccggaagacttgcgtaaaaaaaggccgtatgtgctggtgggtgccttcgtggtgggcatgctgctgacgccgccggacgtattctcgcagacactgctggccattccgatgtactgtctgtttgaagtcggggtgttctttgcccgcttctacaccgggaagcgcctgacgcgcgatgacgacgccgcggccgaagctgaagccgcagagcacagagaagagtaa

SEQ ID NO: 893 - DNA, 966 bp, Klebsiella pneumoniae
tggtcgataatgacggtaacaagcatgttagacaaagttttgaaaattgccacacggcaaagcccgcttgcgctatggcaggcgcagtatgttaaagcgcgcctggaacaagcgcatcccggactgaaggtcgagctggtgccgatggtcacgcgcggggatgtcatccttgatactccgctggcaaaggtggggggcaaaggcttatttgtgaaagagttagagctcgccatgctcgaagggcgcgccgatatcgccgtccattcgatgaaagatgtgccggtggaattcccggagggcctggggctggtgactatctgcgagcgcgacgatccgcgcgacgcgtttgtctccaatcgctatgcctcgattgacgaactgccggccggcagcgtcgttggcacgtcaagtttacgccgtcagtgccagctggccgccacccgtccggacctggcgatccgctctctgcgcggtaacgtcggtacccggctgagtaagctggataacggcgagtacgacgccatcatcctcgccgccgccggcctgaagcgcctgcagctggaagcgcgtattcgccagccgctgtcgcctgagcaatctctgccggcggtcggccagggcgcggtcggcatcgaatgccgtcttgatgatgcatggacccgggggctgttagcgcctctcaaccatacggaaacggcggtgcgcgtgcgcgccgagcgggcgatgaacacccgcctcgaaggcggctgccaggtgccgatcggcagctatgcggaactgaaggacggggaactgtggctgcgggcgctggttggcgctccggatggttcacagctggtgcgcggcgaacgacgcgggccagcggaacaagcggaagccctcggcatctcgctggcggaagagcttctggataatggcgcccgcgagattctcgcggcggtttatgatggagaagccccgcgatga

SEQ ID NO: 894 - DNA, 1173 bp, Klebsiella pneumoniae
ggagtcacaatggaacaggttgtcattgtcgatgcaattcgcaccccgatgggccgttcgaagggcggcgcatttcgccacgtgcgcgcggaagacctctccgcgcacctgatgcgtagcctgctgtcgcgcaatccgtcgcttgaggcaagcgcgatagacgatatctactggggttgcgtgcagcaaaccctcgagcagggttttaacatcgcccgaaacgcggcgctgctggcggagatcccgcattcggtaccagcaaatacggtcaaccgtctgtgcggttcttccatgcaggcgctgcacgatgcgacccgtatgatcatgaccggcgatgccagcgtctgcctgattggcggcgtcgagcacatgggccatgtgccaatgagccatggcgtcgatttccatccgggcctcagccgcaacgtggcaaaggcggcagggatgatggggctgactgcggagatgctggcgcgtctgcacggtattagccgcgagatgcaggatcagttcgccgcgcgctctcacgctcgtgcctgggccgcaacccagtccggcgcattcaaagcggagattatccccaccggcggccacgatgccgatggcgtactcaagtcctttaactatgacgaggtgatccgcccggaaaccaccgtcgagacgctgtccacgcttaaaccggcgtttgacccggtgaccggtacggtaacggcgggtacctcttccgccctttccgatggcgcagcggcgatgctgctgatgagcgaaagccgcgctcgcgagctggggctgaagccgcgcgctcgcgtccgttcaatggcggtggtcggctgcgacccgtccattatgggttatggcccggttccggcctcaaagctggcgctgaaaaaagcgggcttatccaccagcgatatcgacgtttttgaaatgaatgaagcatttgccgcgcagatcctaccgtgtattaaagatctgggcttaatggagcagatcgatgagaagatcaacctcaacggcggggcgatcgcgctcggtcatccgctgggctgttccggggcgcgtattagcaccacgctgatcaaccagatggagcgcaaagacgctcagttcggcctcgccaccatgtgtatcggcctgggacaagggatcgctaccgtgtttgagcgggtttaa

SEQ ID NO: 895 - DNA, 645 bp, Klebsiella pneumoniae
aaacagacaatcagggagtttctcatgaccattgagtggtggttcgcctacctgctgacatcaattattctcagcctgtcgccgggttccggagcgattaataccatgaccacctccattaaccacggataccgcggcgcggcggcgtcgattgccggtttgcagactgggctggccattcatatcgtgctggttggcgttggtctcggcactctcttctcccgctcggtgctggcctttgaggtgctgaaatgggccggcgccgcctacctgatctggctgggtatccagcaatggcgggcggcaggggcgatcgacctgaatacgctggcgaaggcgcagacgcgcggcaaactgtttcagcgcgcggtgttcgtaaatctcaccaatcccaaaagcattgtttttctggccgccctgtttccgcagtttatcctgccgcaccagccgcaggtgatgcaatatatcgttctgggcgtcaccaccatcgtcgtcgatatcattgtgatgattggctatgcgaccctggcgcagcgcatttccgcatggatcaaagggccaaagcagatgaaggcgttgaacaaagtctttggttcactgtttatgctggtcggggcgctgctcgcctccgcccgccatgcctga

SEQ ID NO: 896 - DNA, 507 bp, Klebsiella pneumoniae
aagcataaaatcaacattttattaacgaatggaaccggtgttatgtctgaacttactgccgaagcagccctgaaactggtaggggagattttcgtctatcacatgccgtttaaccgcgccctcggtctcgaactggaacgatacgaaaaagcgtttgcccagcttagctttaataatcagccgatgatggtcggcaactgggcgcaaagcattctgcatggcggggtgatcgcctccgcgctggacgttgccgctggcctggtctgcgtcggcagtacccttacccgccatgacaccatcaacgaagaagagttgcgccaacggctttcccgtatgggaaccatcgacctgcgcgtggactacctgcgtccgggccgcggcgaacgttttaccgccaccagcaccctgctgcgcgccggcaataaagtggcggttgcccgcgtggaactgcataacgaagctcaggtctatattgccagcgcaacggccacctatatggtgggttga

SEQ ID NO: 897 - DNA, 729 bp, Klebsiella pneumoniae
acgggggaaataatgcgtttttaccgacctctgggccagatttccgcgctgacgtttgacctggacgataccctttacgataaccgcccggtgattgaccggacgatgcacgagtcgctggcctttgtgcgcagctaccatccttcgctcagccagttcgacgcccatgagcttaatcagctgcgtcagacgctgctggctgctgaacctgagatttatcatgacgtgaccgtctggcgccaccgtgcgctggagttaggtatgcgtaatgccgggctctccgccgaagcggcgaaagcgggggccgatgcggcgatggaacacttcgcccactggcgcagccgcgtcgatgtcccgcaggaaacccacgatacgctggcgaagctggcggagaagtggccgctggtggcgattaccaatggcaacgcccgcccggaactgttcggtctgagcgactatttccgcttcgtgctgcgcgccggaccggatggccgctccaagccgtttgccgacatgtaccaccttgcggcggagcgtctgaatgtgccgctcgggcagattctgcacgtcggcgatgatctgactaccgacgtggccggcgctattcgctgtgggatgcaggcctgctggatcaaaccgcaaggcgcggacctgatgcacaccgcggacagccgcctgctgccgcatattgaaatttcacggttggcatctctgacctcgctgatataa

SEQ ID NO: 898 - DNA, 1146 bp, Klebsiella pneumoniae
tcgaagagaatcgatgtgaaagtactaactgtatttggcacgaggccggaagccatcaagatggcgcctctggtccatgcgctggcaaaggatcctcattttgaggcgaaagtatgcgtgaccgcgcagcatcgggagatgctcgatcaggtgttgaaacttttctctattgtcccggactacgatctcaacatcatgaagccggggcaggggctgaccgagatcacctgtcgcatccttgaagggctgaagccggtgctggagtcgtttaaacccgacgtggtgctggtgcatggcgataccaccaccaccatggcggcgagcctggcggcgttttaccagcggataccggtgggtcacgtagaggccggcctgcgcaccggtgatttaagttcgccgtggccggaagaaggcaaccgtacgttgaccggccatctggcgacataccatttcgcccccacggaaacctcgcggcagaacctgctgcgggaaaatattgccgacagtcggatcacggttaccgggaatacggtcattgacgccctgttctgggtgcgggatcgggtgctgggcgatgaagcgctacgggagaccctgctgcagcgctatcctttcatcagccacggtaaaaagatgattctggttaccggccaccggcgggaaagctttgggctcggttttgaacagatctgccaggcgctggccgagatagcccatacccaccctgaggtgcagattgtctatccggttcacctgaatcctaatgtcagcgagccggtgaatcgtattcttggccatattgacaatgtgatgttgattgaaccgcaggattacctgccgttcgtctggctgatggatcgcgcctggctgatcctgaccgattccggcggcattcaggaagaggccccctcgctgggtaagccggtgctggtcatgcgcgatatgaccgaacgtccggaagcggtggccgccggcaccgtgtgtctggtgggcaccgacagccagcgcatcgtcgcggaagtgacgcgactgctggaggatgatgctgcataccaggcgatgagccgcgcgcataatccctatggcgatggcgaagcatgtcgtcgcattttgtctgcacttaaaaataatcaggtaacgctatga

SEQ ID NO: 899 - DNA, 213 bp, Klebsiella pneumoniae
cgtcaatcgatgaggttattaacctcaccgccttcctccccgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctag

SEQ ID NO: 900 - DNA, 1593 bp, Klebsiella pneumoniae
attgatcacgttttaaaccatttgtcagtccgctgctcatcacaaccacaccgacgacgaatggtgacggtttttgttgaaatactgaaatcctccgtactattgtacctcgggtttttgaacatcaggcgatatgtcttgtacctctatattgagacactgaaacagagactggatgccatcaaccaattgcgcgtggatcgcgcgcttgctgccatgggacccgctttccagcaggtttacagtctactgccaacgttattacattatcatcacccgctgatgccgggttaccttgacggtaacgttccccgtggcatttgcctctacacgcctgatgaaacccaacgccactatcttgaagaactggaactgcatcgcggtatgcagactcaggagccgccgaaaggcgagctgccgatcaccggtgtctactcgatgggcagtacttcctccgtcggccagagctgctcttccgatcttgatatctgggtatgtcaccaggcctggctggatagcgaagagcgtcagctgctgcagcgaaaatgcagcctgcttgagagctgggctgcctcgctcggcgtggaagtcagcttcttcctgatcgacgaaaaccgtttccgtcataacgaaagcggtagcctcggcggcgaagactgcggttcgacccagcatatcctgttgcttgatgagttctaccgcaccgcggtgcgcctcgccggcaagcgtattctgtggaatatggtgccgtgcgatgaagaagagcattacgatgattacgtgatgggactgtatgcccagggcgtgctgacgcctaacgaatggctcgatctcggcggcctcagttcgctgtcggcggaagagtacttcggcgccagcctgtggcagctgtataaaagtatcgactccccctataaagcggtgctgaaaacgttgctgctggaagcctactcctgggaataccccaataaccgcctgttagcgaaagatatcaaacagcgtttgcacgacggggagattgtctccttcggcctcgacccgtactgcatgatgctggagcgcgtgaccacctatctgcaggccatcgaagatgaaacccgcctcgacctggtgcgccgctgcttctacctgaaagtttgtgaaaaactcagccgcgaacgcgcctgcgtcggctggcgtcgcgaagtcgtcagccagttggtgaatgcctggggctgggacgaaaagcgtctgatgatgctcgacaaccgcgccaactggaaaatcgatgaagtgcgcaaggcgcacaacgaactgctcgacgccatgatgcagagctatcgtaatctgatccgcttcgcgcggcgcaataaccttagcgtctccgccagcccgcaggatattggcgtgctgacccgtaagctgtatgcggcctttgaagcgctgccggggaaagtgacgctggtaaacccgcaaatttcgccggatctgtcggaaccgaacctgacctttatccacgtgccgccgggccgcgccaaccgtaccggttggtatctgtacaaccgcgcgccggacatggaatcgatcatcagccatcagcccgctggaatataa

SEQ ID NO: 901 - DNA, 282 bp, Klebsiella pneumoniae
cgcgatcacgtctatctcttcggtccagaaagaggtcggcaacggctcaacgttatgccagtaatctaccggcagatagaaccacagcttcggtttattcacaccgtccaccagcagccagcagttaggcacctgagtcacaggcacccaggctttgaactgcggattgaccttgaacgggtacggatggtcatcaaggaagacgttaaccagctcgccggagtgaatcagcagagcatccatttgaaaacgggccaggacgtcgcgggtacgttcttgtag

SEQ ID NO: 902 - DNA, 393 bp, Klebsiella pneumoniae
ttcaactctttccctgtcaggccggatcctccggcctttcttttttgcgtcgcctctcgcaggaaattccttttaaactggacgtttgtacagcacaattctattttgtgtcatcaggttatcgcagggggcgtcgtggatctctccattattatcagcgcggttatcgcactggcagccgggttaatggttggctggctggcgaccaaagcgcgtgccgatcaaattcgggccgatctcatcgaggaacggcgagagttggatattgagctgagcgccgcccgccagcaactggcgcatgatgcccactggcgtgaggagtgtgagctgctgaacaacgagctgcgcagcctacgggatatcaatacctcgcctcgaggccgatctccgtga

SEQ ID NO: 903 - DNA, 1203 bp, Klebsiella pneumoniae
ctctcaacattggaagccataatgacggaacaacaaaatcaatccgccgtggttgaagagaccagggaggccgtggagaccacaccacagccagagaacactgagaagaagaaggcaggcaataaaaccagcctggcgctcagcgcgatcgctatcgccattgcgatagccgccggcatcggcctgtatggcctgaacaaacaacaggccacgcggcaaaacgcaactacctctgaattagcaagccaggtcgcggcgctgcaaaaagcgcaggaaaatcaaaaaagtgaactggaaggtgttatcaaacagcaggccgaccagctaaacgaagccaaacaccagcaggagacgctggccaaacagttggatgagctgcagcaaaaagtggcggtgatttccggtagcgatgccaaaacctggctgctggcccaggccgacttcctcgtcaagctggcgggacgtaagctgtggagcgatcaggatgtcaccaccgccgccgcgctgctgaaaagcgctgacgccagcctcgccgacatgaacgacccaagcctcatcggcgcccgccgggcgatcaccgacgacatcgccaccctctccgcggtaagccaggtggactatgacggcatgatcctcaaggttaatcagctggcgaatcaaatcgataacctgcggctggccgataataacgatgacgattcgccgatggacgctgatagcgatgagctttccagctctatcagcgaatggcgcgtcaacctgcagaaaagctggcagaactttatggacagctttatcaccgtgcgccgccgcgatgaaacggcggtcccgttgctggcgccgaatcaggatatctatctgcgggaaaatattcgctctcgcctgatggtcgccgcgcaggcagttccgcgccatcaggaagagacctggaaacagtcgctggataacgtctcgacctgggtacgcgcgtattatgataccgatgacgccaccaccaaagccttcctcgacgaggtggataagctcagtcagcaaagcattaccatgacggtgccggaaacgctgcagagccaggcgttgctggaaaaactgatgcagacccgagtgcgcaacctgatggcgcagcctgccgttaccgcgggcggcgcgccttcgcccgcacctgctgcgccggccgtccccgctgcgccgcaaggagagtaa

SEQ ID NO: 904 - DNA, 1860 bp, Klebsiella pneumoniae
cgcctgttttcttttcaggcaaatggggtcaacgtggcacaggcggaagtattaaatcaggaatcgctggctaagcaggttttacaagagaccttcggctaccagcagttccgtcctggccaggaaacgattatcgagacggcgctcgaaggccgggactgcctggtggtcatgccgaccggtggcggcaagtcgctgtgctatcaggtgccggcgctggtcatgggcggtctgacggtcgtggtctcaccgctgatctcgctgatgaaggaccaggtcgatcagctgctggccaacggcgtggcggcggcttgtctgaactcgacgcaaagccgcgagcagcagcaggaggtgatggccggctgccgcagcgggcaggttcgtctgctgtatatcgcgccggaacggctgatgctggataactttcttgagcatctggcgaactggaacctggcgatgctggcggtagacgaagcgcactgtatctcgcagtggggccatgacttccgtccggaatatgccgcgctgggccagctgcgtcagcggatgccgcagatcccgtttatggcgttgaccgccaccgccgatgataccacccgccgcgatatcgtccgcctgctggggcttaacgatccgctgattcaggttagcagcttcgaccgtccaaacatccgctatatgctgatggagaaattcaagccgctcgatcagctgatgcgctacgttcaggatcagcgcggcaaatcgggcattatctactgcaacagccgttcgaaagtggaagacaccgccgccaggctgcaaagccgcggtattagcgcggcggcttaccatgccggtctggaaaacgacgtgcgcgccgaggtgcaggagaaattccagcgcgacgatctgcagatcgtggtggcgacggtggccttcgggatgggcattaacaagccgaacgtccgctttgtggtgcattttgatattccgcgcaatattgaatcctactatcaggagaccggccgcgccgggcgtgatggcctgccggcggaagcgatgctgttttacgatccggcggatatggcgtggctgcgccgctgtctggaagaaaaacccgccgggccgctacaggatatcgaacggcataagctgaatgcgatgggggcgtttgccgaagcgcagacctgtcgccgtctggtgctgctgaactattttggcgaagggcgtcaggagccgtgcggcaactgcgatatctgtcttgacccgccaaagcagtacgatggcttaatggacgcccgcaaggcgctttcaacgatttaccgggtcaatcaacgcttcggaatgggttacgtggtggaggtcctgcgcggggccaacaaccagcgcatccgagagatgggccacgataagctgccggtttacggtatcggccgggagcaaagtcacgagcactgggtgagcgtgatccgccagctgattcaccttgggctggtgacgcagaatatcgcccagcactccgcgctgcagctgaccgaagccgcgcgaccggtgctgcgtggcgaagtgccgctgcagctcgccgtgccgcgtatcgtggcgctgaagccaaaggcgatgcagaaatcctttggcggcaattacgaccgtaaactgttcgccaagctgcgcaaattacgtaaagcgatcgccgacgaagagaacatcccgccatatgtggtcttcaacgacgcgacgcttatcgagatggccgaacaatcgccgctgaccgccggcgaaatgctcagcgtcaacggcgtggggacacgcaagctcgagcgtttcgggaagccgtttatggcgctgatccgggcgcatgttgatggcgacgatgagtag

SEQ ID NO: 905 - DNA, 654 bp, Klebsiella pneumoniae
tttctctcttcattattttcctgcgagttaactatgctgatgcttttcctcaccgtggcgctggtgcatatcattgcgctgatgagcccggggccggactttttctttgtctcacaaacggccatcagccgctcgcgaagagaggcgatgatgggtgtgctggggatcacctgcggcgtcatggtctgggcgggagtggcgctgctcggcctgaacctgatcctcgcccgtatggcgtggctgcataacattattatggtcggcgggggcctgtatctatgctggatgggctaccagatgctgcgtggcgcgctgaaaaaagagacggtggcctcggcggagccgcaggtggagctggcccgcagcggacgcagcttcgtgaagggattgctgaccaatctggcgaatccgaaagcgattatctacttcggctcggtgttttcgctgttcgtgggtgacagcgtcggcgccggcgcgcgctggggcattttcctgctgattatcgttgagacgctggcctggtttatggtggttgccagcctgttcgccctgcccgggatgcgccgcggctatcagcggatggcgaagtggatcgacggtatcgccggtacgctgtttgcgggcttcggcatccacctgattatctcgcgttaa

SEQ ID NO: 906 - DNA, 723 bp, Klebsiella pneumoniae
tggatttattcatttatgaaaccaatcggggaagaacagcaggaggttgccagcgcgttgaacgatcgcgcagtggtggactatctgttgcaacatcctgaattttttattcgtaatgccgcccaggtcgaacatctccgcgtcccgcatccggtacgcggtacgatttcgctggtggagtggcacatgatgcgggcgcgtaaccatattcatgtgctggaagaaaatatgtcgctgctgatggagcaggcggtcgctaatgaaagcctgttccagcgcctgctgcagctgcaaacgcggctggcggcggcggagagcctcgacgatatgctcaaccgccttcaccgctgggcacgcgagctggggctggcgggcgccacggtgcgcctgtttcctgactgctggcgcctcggcgcgccctcgaagtttacccatctggcattaaaccggcaggcgtttgagccgatccgtattcaacgtctgggccaggcgcgccactatcttgggccgctgaacggcccggagctgctggtggtgctgccggaggcgaaggccattgggtctgtggcgatatcgctgctggggggcgataatgccccgggggtgatgctcttcagcagccgcgatgcgcagcattatcagccagggcaggggacgcagctgttgcaggagattgcccagatgctgcccggcctgctggagcgctggattgaacgcgcatga

SEQ ID NO: 907 - DNA, 672 bp, Klebsiella pneumoniae
cgtggtgattcacgaaaacagtatcgaaaatatgacgcgcgatctgaagctggcctgatggagagctggttaatcccggcggcgccggttaccgtcgttgaggagattaaaaaaagccgttttatcacgctgttggcgcataccgacggcgtggcggcggcaaaagcttttgtcgagtccgtcagaacggatcaccctgatgcccgccaccactgcgtggcgtgggtcgcggggccgcctgatgattcgcaacagctggggttttcagacgatggcgaaccggcgggaacggcgggtaaaccgatgctggcgcagctgatgggaagcggcgtcggcgagataaccgctgtcgtcgtgcgttactacggtggtatcctgctgggcaccggcggtctggttaaggcctatggcggcggggtgcatcaggcgctggcgcagctgacgacgctgcgcaagacgccgttaacggcatatactttgcagtgtgagtatgggcaactggccggcgtcgaagcgctgctcgcccaattctccggaaacgtcgttgaaagcgaatatctggcgtcagttcggctgcgcgtggcgcttccccaggccgaagtggcggctttttcagcaagactggctgattttagtcgtggttcattgcaattactgaagattaacgaataa

SEQ ID NO: 908 - DNA, 273 bp, Klebsiella pneumoniae
cgtccaggttctccagcgcggttcggctctcgacctgaatcagcagacaaagttcgtcatttgcctccgccatataattctccacccttccccagcgcgccgctctcgccacgccggcgccaacgccgcggctcccgatggggggataacgggtcgctgagaccacctcccgagcctgctcggcggtatcgaccatcggcaccagcaaggttctggcgccaatatccagcacctgttttatcaggctgcggttgccctcgaccgggcgaatga

SEQ ID NO: 909 - DNA, 357 bp, Klebsiella pneumoniae
tcccccacctcgcgcagcgacagcaggcgcacgcccagctcgctacgaccaaaaaaggtctgtacaaagctatttttcggtcgcaggagcatctccagcggcgccccctgctggaccacctcgcccccgtccatcagcaccaggtggtccgccagacgcagcgcttcgtcaatatcatgggtcaccagcacaatcgtccgtcccagcagacggtggatgcgcagcatctcctgctgcagcgcctcgcgggtcaccgggtcgagggcgccgaagggctcatccatcaacagcacctccggatctgccgccagcgcccgcgccacccccacccgctgctgctggccgccggagagctga

SEQ ID NO: 910 - DNA, 291 bp, Klebsiella pneumoniae
cgggcgtgctccaccgcggcgcgcatcgccacggcgcgatcttcggtcagggtaccgacgttaattaacagcgcatcagcgatagcggcaaattgcgccgcttcgcggggatcgatcaccatcgccggcgaggcgccgacggccagcagaacattggcggtaaaggtctgcaccacgtcattagtcatgcagtgcacaaggggggaatgggcgcgcagcagatggcgcaggtgcgcgacaggcgcgggattcaacagctcaggcatagtttgctcccgccagacgaggtag

SEQ ID NO: 911 - DNA, 2244 bp, Klebsiella pneumoniae
atatccagctcgccggcgacaatcgccccgcgcaccaccggcgtggtgccgagctggattttattaatcgtttttacgccgtggctttccagcacctgctggatcatattgcccagcagcgcgccttcggtatcaattttcgagccgaccttcaccggctccgccgcctgcagcggtaaacttatcagggcggccagcgccagcgcgccggaccatgtcgttgccatcttcatcccgcttccctcagttcttttgcgcttcgcttacagaagcttaagagaaaagcgtagcccatttgccagcgatgcgaaaaagaaaaggccgattaatcggcctttaaagcgtgacgttggacttaagagcgatgccttacagcagctcaaactcgctctgcttcacgcgggcggagtccacgccgataaagacattgaatttgcccggctcagcaacgtatttcatttgctgattccagaacttcagcgcgtcgacgtcgattgggaagctaacggtttgcgtttcgcccggtttgagggtgacctttttaaagccgcgcagcattttcaccggccggctcatggaggcggtgacgtcctgcaggtagagctggatcaccgtcgccccttcgcgattgccggtgttggtcacctgcacgctggcggtcacgctgccatcgcgcggcatggtggccgacgacatgttgacatcggagacgctaaaggtggtgtagctcaggccgtaaccaaacggatacagcgggccattggcttcatcgaagtaacgcgaggtgtacttgttcggcttctccggattatacggccggccggtattcaggtggctgtagtaggttgggatctgccccaccgagcgcgggaaagacatcggcagcttgcccgacgggttgtagtcgccaaacagcacgtcggcgatggcgtggccgccttcggtgccagcaaaccaggtctccagcagcgcatcggcttgctgatcctctttcaccagcgccagcggacgcccgttcatcagcaccagcaccagcggtttgccggtggctttaagagcggcaatcagattgcgctggctctgcggcagagtgatatcggtccggctggaggcctcatgcgccatgccctgcgcctcgcccaccacggcgaccaccacatcggattgcttcgccgccgcgaccgcttcgtcgatcatttcctgcggcgagcgtgggtcaacctgcaccgcgttctcatacaaattgaggaaatcgacaatgcctttgtcatcggtaacgttcgcccctttggcgtaaatcactttgccgttatcgcccagcgcttctttgatgccggtcaggacggtcaccgactggtcggccaccccggccgcggaccagctgcccatcatgtcgcgcttgctgtccgccagcgcgcccaccaccgcgatagtgccggattttttcagcggcagcgtatcaagacggttcttcagcagcaccaggctctcgcgagccacttcgcgcgactctttacgatgcagacgactttccgcattggtgtcctgcgggtcagaatctttcggtcccaggtggctgtagggatcgttgaacagtcccatatcatatttcacgttgagcacgtgtcgggtggcatcatccagctcggccatggtcaccttgccggacttcaccagccccggcaggtacttgctgtaatactcgtcgctcatgctcatgttgatgccggacttcagcgctacgcgcaccgcgtcttccgggtcggaggccacgccgtgcttaatcaactctttgatggcgccgtggtcggaaacggtgatgcctttaaagccccactggtcgcgcaggacgtctttcagcagccaggaatcagaggtcgccggggtgccgttcagcgagttcagggccaccatcaccgcgccgctgccggcatcaagcccggctttgtacggcggcatatagtcgttgaacaggcgctgcgggctcatgtcgaccgtgttgtactctttcccgccctctaccgcgccgtaggcggcgaaatgcttgacgctggtcatcaccgaatagcggtccgccgggctcttgccctgcatcgactccaccatcgcctggcccatcatcgtggtcagataggtgtcttccccgaacccttcggaagcgcgtccccagcgcgggtcgcgggagacgtcgaccatcggcgcccaggtcatgttcaacccgtcatcggcggcttcataagctga

SEQ ID NO: 912 - DNA, 972 bp, Klebsiella pneumoniae
ataaatttatcacccgataagctcgggttattgtgcaggaccaccgtagcgaacccgatgatgaacgaaccctggcagcggctgcccgcgctctctcttaaacagcttcagtattttgtcaccctggcccagctgcgccattttaccgataccgccagtcggctggcgattagccagccggcgctgagcagcgccctgcggcagattgaaacggtactcggcggcaaactggtcaaccgtaccgctgcgacggtcactctgactgaactgggggcggcgattttaccccacgcccagcggatcctcagcgtggcgcaggcggccttttccgatatgcagcagattgtcgaggcgggcggcgacgggacggtgcgtatcggtctggtgccgtcggtcagttcgctgctgtttccgctgctgccgcagaccctggctgaggcctttccgcgtctgcgcattgaatttcacgatcagaccaacgatgcgcttatccaggcgctgcagcgcggcgagattgatttcggcatcggggcgatcgacagctcactgcccgcagaactgctggtctatccgctacgcgaagatcccttcgtggcggtgctgcaccgcgacgatccgctggccgcgcaggcacatctgccgtggaaacagctggtggggcgggatattgctgtgttctcgaagggcaatatccagcggctggtggcggcattagtggagagccatcgcctgacgctgaccacccgctaccaggtggactatatcgaaaccctgtatggtctggtgcgctcgcgcttagcggtggcgattctgccggcgctgtacaccacccatctgcaggacccggcgctcagggtcgcccacctgcagcagccggcgctcgcccgcacagtggccctgatgcgcggcccgcaggcgctgcctccgctaattgaagactgtttttctctgctgcaggccgccttgcgctag

SEQ ID NO: 913 - DNA, 762 bp, Klebsiella pneumoniae
acaaccttatcaattcaagggatgaatatgagccagaatatttatgacgacccgcagttttttgccggctatgcgaccctcgatcgctcggtgaaggggctggaaggcgcaccggagtggccttccctgcaggcaatgttgccgccgataaccggtttgcgggtggtggatctcggctgcggctacggctggttttgccgctgggcacagcagcagggagccagccagataaccggttttgatatctcccagcggatgctggcgcaggcgcgggagatgacccgcggggatgagattgtctaccgctacgccgatctgcaaaccctgacgctgcccgccaacagctgcgatctggtctacagctcgctggcgctgcattatttaccggacattgccccgctcttcgccaccctgcagcaggcgctggttcccggcggcaccctggtcttttccgccgaacatcccatctataccgcccccttgcagcagggctggcgggtggatgagcaggggcaaaaaagctggccggtcagtcactatcagcaggagggtgagcgcgtcagcaactggtttgccgagggcgtcatcaagcaacatcgcaagctctcaagctggataaacgcgcttatcgccgcgggttttgtgctggagcagttggatgagtggggtccgagcgccgaacagattgtccaacagcccgccctggatgaagagaaagaacgtccgatgatctttttactgcgcgcgcgtaaaccgggctaa

SEQ ID NO: 914 - DNA, 1146 bp, Klebsiella pneumoniae
cgtggattatccactctgtctaacgttatacccggaggcatcatgaacctcagacaacagcaacagcaggcgttcgatcgcagcggagaacctcttatcgtcggcaacgtcagccactgcccgctgccgcccgagaccctcgccgcactgggccccgattctccctatgtggtgcaggtatacggctcaggcctgaccggcgaggtttatcgtctgcgcatcgccggcaaggagtacaatttaaagaaacgtcgcgccgtcgccggcgttgccaacctcaacggccagctgtcgtttttaaatgaggtacagcgtcggcaggcattgcaacagctgaaggatgacccggtcaccgcgccgcgcttcacccacatcgtcccaacgctgtatgccgattatcgcctcggcatcctgctctccccctggatcgacggcgagccgatacaccagttaaccccgccgctgatcgcccagctatttactactctggaagcctgcgaagagcaggggctgatggagtgggatctctgtagcgggaatctgctggtggaccggcaggagcagctgtggctgttcgattttggctatatgtatcccttcgacccgctgagagaattcaacagcaatggtctggccgacccgctgttccactttgtcgaacgttttgagactcgcttcttttttagctggctgatgacccggatccctgacgccgaacagcagctggcgcactatcgcgagatgaagcggctggcggtcgaaagctaccgccggaagctcgtctggcttcgcgcccggcgcgctgacccgctggtgctggctcactttcagcagttgacggcgcgctgggagtcggcgctgggggactctgccgcgctgagccggctgtttgccgtagaggcctttcgctcacatgtgctggatattgaagacgacctgcatggtcagtcctgtaccttactcaccctgcaacgcattgactgggtgataaaccagctggaacagcattatcgctttatcgccgacgaaggcggcctgttttacgataacgaagggaaatcgcagcaggcgctgctcagcagctatgcgcagaagcggcagcaggcgcagcagtacctgttgaatgccgccgccgcgaaggattaa

SEQ ID NO: 915 - DNA, 771 bp, Klebsiella pneumoniae
attaaaatatcgatttgcagagatcttgtaatgcacccagttattaacttcagtcatgttacaaaagagtatcctctgtaccatcatattggctcaggaatcaaagatttaattttccatccgaaacgcgcttttcagttgctgaaggggcggaaatatttagctatcgaagacgtatcctttacagttggcaaaggtgaggctgttgccctgattggacgtaatggggcaggaaagagtacctcgcttggcctggttgccggcgtgattaagccaactaagggaaccgtcaccactgaaggacgggtggcatcgatgcttgaactcggtggaggatttcatccggaacttaccgggcgtgagaatatttacctgaatgctactctgctgggccttcgacgtaaagaggtccaacaacgtatggaacgtattattgaattttcggaactgggagaattcatcgacgagcccatcagagtatattcaagcggaatgctagctaagttaggtttttcggtcatcagtcaggttgaaccggatattttaattattgatgaagttctggcagtaggtgatatcgcttttcaggctaaatgtattcagaccatcagagattttaagaaaagaggcgtgacgatactgtttgttagccacaatatgagtgacgttgaaaaaatctgcgatagagtcatctggatcgaaaatcatagactcagagaagtggggtctgccgatcaaatcattgaactgtacaagcaagcaatggcttaa

SEQ ID NO: 916 - DNA, 1035 bp, Klebsiella pneumoniae
aacgggatatccacaccccggaggaaaaatatgaagtttttggtcactggtgccgcaggttttatcggcttccatatcgcgcagcgcctgctgaatgaagggcatgatgttgtcggaatcgacaacatgaacgactattatgacgtcagcctgaagcaggcccgtctggatcgcctggcttctctggcattccatttccagcagctggatctggccgaccgtgaaggtatggcaaagctgttcgccacagagcagtttgatcgtgtgatccacctggccgcccaggccggtgtgcgctactcactcgaaaacccgtatgcctacgcagacgctaacctgatggggtatctgaacattctggaaggctgccgtcataccaaggtgaaacacctggtgtacgcctcctccagctcggtttacggcctcaaccgtaaaatgccgttctccaccgaagattccgtcgatcatccggtctccttgtatgccgccaccaagaaagctaatgagctgatggcgcacacctattctcacctgtacggcatcccgaccaccgggctgcgcttctttacagtgtatggtccgtggggtcgcccggatatggcgctgttcaagttcacgaaagcgatgctggaaggaaaaagtatcgacgtttacaactacggcaaaatgaagcgcgacttcacctatatcgacgacatcgtcgaggcggtggttcgggtgcaggatgtgatcccgcaggccaatgccgactggaccgttgagagcggttccccggccaccagctccgcgccgtatcgggtatataacattggcaacagctcaccggtggaactgatggactacatcaccgccctggaagaggcgctgggaatggaagcgaagaagaatatgatgccgatccagccgggcgatgtgctggacactagcgcagacacccaagcgctgtatgacctggtgggttttaagccgcaaacgtcagtgaaggaaggcgtgaagaacttcgtggagtggtataaggactactatcagatctaa

SEQ ID NO: 917 - DNA, 1881 bp, Klebsiella pneumoniae
atttattcatctgggcaaacgtttgctgtgcccctagagtatccgcattatccttgtgccggagtggttatgtccagcaatgctcaagtccgccgtcgcgccgtgcaggccgcgcgcggtgaatccccgtttgatctgctgctgatcgatgcgcagatcgtcgatatggccacgggcgaaattcgccccgctgacgtcggtatcgtcggcgagatgatcgccagcgtccatccgcgcggcagtcgcgaagacgcccatgaagtgcgttccctggccggtggctacctgtcccccggcctgatggacacccacgtgcatctcgaaagctcacacctgccgccagagcgctatgcggaaatcgtcctcacccagggcaccaccgcggtgttctgggatccgcatgagctggccaacgtcctcggcgtcgctggcgtgcgctatgcggtggacgccagccgccatctgccgctgcaggtgatggtcgccgccccgtccagcgtcccctccacgccgggtctcgaaatgtccggcgctgatttcgccggcgcggagatggagaccatgctcggctggccggaagtgcgcggcgtggcggaggtgatggatatgcacggcgtgctgcacggtagcgagcggatgcaggagattgtccaggccggtctcaacagcggcaaactgattgaaggccacgcccgcggcctgagcggcgctgacctgcaggcctacctcgccgccggcgtcacctccgatcacgaactgacctcggcggacgacgcgctggaaaaactgcgcgccgggctgacgatcgagatccgcggctcgcacccctatctgctgccggatatcgtcgcggcgttaaaaacgctgccgcacctctcctcgcagatcaccgtctgcaccgatgacgtgccgccggatatactactggagaaaggcgggatcatcgccctgcttaatctgctgatcgagcacggtttaccggcggtcgatgcgctgcgattcgccaccctcaacgccgctattcgcctgcagcgccacgatcttgggctgattgccgccgggcggcgcgccgatctggtggtgtttgattccctggagaaactggtggcccgcgaagtctacataggcggtaagctgatggcccgcgcgggcaacctgctgacaccgatcgcgcccgccgcgggcgtcacgccgccgcgcgatactttgcagatcgcccccctccgcgccgatgactttattctgcgcgtccagggcattcgtcacggcatcgcccgcctgcgccatatccgcggcgcgcgcttcacccagtggggcgaagtggaagtgcaggttcgtgacgggaaagtccagttgcccgccggcttcagtctgatctgggtcaagcaccgccacggccgccatcaggcgacgccgcaaatcgccctgcttgaaggctggggtgagctgcgcggcgccatcgccaccagctactcccacgactcgcataatctggtggtgctcgggcgcgacgctaatgatatggcgctggcggccaaccagcttatcgcctccggcggcgggatggcgctggcgcaacagggcgagatccttgcccatgtggcgatgccgattgccggcatgctgtcggatctcccagccgcggaactggcgcgtcagttccgcgagctgcgcgatctgagcagccaagtcgccgactgggagccgccgtaccgggtcttcaaggccattgaaggcacctgccttgcctgtaacgccgggccgcatttaaccgatttgggtctgaccgacggcggcagccgccagatagtcgacccgttgatagcctgccgggagatcccggagccaaccgatcacaacaataatcctcagggagcctga

SEQ ID NO: 918 - DNA, 1362 bp, Klebsiella pneumoniae
ccgccgccatctcggtggtgggtacccgtctgcaaatcaatgaagacaatcgcgattacctggctggtaaggcgattgcctgcgcgaaagatatttcacgtctgctggggtggaaaagccccttcgaacaactcgcctcatcataaggagaacatcatgaccctaccgaaaattaaacacgtccgcgcctggttcatcggcggcgccacagcagagcagggcgccggcggcggcgattaccatgaccagggggctaaccactggattgacgatcatatcgccaccccgatgagcaaatataaacagtatgagcagtcccggcagtcgtttggcatcaacgtgctggggacgctgattgtggaagtggaagccgacaacggacagaccggctttgcggtgtcgacggccggggagatgggctgctttatcgtcgaaaaacatctcaaccgctttatcgaaggcaaatgcgtcagcgatatcaaactgatccatgaccagatgcttaacgccaccctttactacgcgggatccggcggcctggtgatgaataccatctcctgtgtcgacctggcgctgtgggacctgttcgggaaagtggttggcctgccggtctacaaactgttgggtggggcggtgcgcgacgaaatccagttctatgccaccggcgcacgtccggacctggcgcaggagatgggctttatcggcggcaaaatgcctacccactgggggccgcacgatggcgacgccgggatccgcaaagacgtcgccatggtggcggatatgcgcgaaaaatgcggcccggatttctggttaatgctggactgctggatgagccaggacgttaactatgccaccaaacttgcccatgcctgcgccccttataacctcaagtggatcgaagagtgcctgccgccgcagcagtatgaaggctatcgcgagctgaagcgccaggcgcctgccgggatgatggtgaccagcggcgagcaccacggcacgctgcagtccttccgcaccctgtcggaaaccggcatcgatattatgcagcccgacgtcggctggtgcggcggcttaaccaccctggtggagatcgcggccatcgccaaagcgcgcgggcagctggtagtgccccacggctcgtcggtttactcacatcatgcggtgatcaccttcaccaacacgccgttcagtgagtttctgatgaccagtccggactgcgccacgctgcgcccgcagttcgacccgatcctgctcggcgagccggtgccggagagagggcgcattcataaatcggtcctggataaacccggctttggcgtcgagctcaatcgcgactgcaacctgaagcgtccttatcaacactga

SEQ ID NO: 919 - DNA, 1062 bp, Klebsiella pneumoniae
tgcaacaaatcccgcctgcattttctcacaataatgaccctgcataataaaaccggagattccatgaataagaaggtgtttaccctgtctgctgtaatggctggtctgttatttggcgccgccgcacacgcagcagatacccgtatcggcgtgacgatttataaatatgacgacaactttatgtcggtagtgcgtaaggcgattgaaaaagatggcaaatccgcgccagacgtccagctattgatgaatgattcgcagaacgaccagtcgaaacaaaacgatcagattgacgtgctgctggcgaaaggcgtgaaggcgctggcgattaacctggttgacccggccgccgcaggtacggtgattgaaaaggcgcgcgggcagaatattccggtggtgttcttcaacaaagagccttcccgcaaagcgctggatagttatgacaaggcttattacgtcggtaccgactcgaaagagtcggggattattcagggcgatctgatcgccaagcactggaaagccaacccgaactgggatctgaataaagacggtcagatccagtacgtcctgctgaaaggcgagccgggccatccggatgcggaagcgcgtaccacttacgttattaaagagctgaatgataaaggtctgaagacccagcagctgcagctggataccgcgatgtgggataccgcccaggcgaaagacaaaatggacgcctggctctccggcccgaatgccaacaagattgaagtggtgatcgctaacaacgacgccatggcgatgggcgcggttgaagcgctgaaagcgcacaacaagagcagcattccggtgttcggcgttgatgccctgccggaagccctggcgctggtgaaatccggcgcgatggccggtactgtgctgaacgatgccaataaccaggcgaaagcgaccttcgagctggcgaaaaaccttgccgacgggaaagacgccgcggcaggcaccaactggaaaattgacaacaagattgttcgcgtcccctacgtgggcgtcgataaagacaacctgagccagtttaccggcaaataa

SEQ ID NO: 920 - DNA, 723 bp, Klebsiella pneumoniae
acccggggattggtaaaaccagcaagcagaaatactggggtgaagcggccccgacgccagcctctccggcggatccgcaataatcgacggcaggactattcagcctggcgcttctgtattacgctgcacgccggagaatgtttctccggcagattcaggagcgccgccatgcccgcagaggccccgttactcgacagtgatttagaaattcgcgaagcgctgcccgacgatgcgcacgccatcgccgcgctgtatgtctggcacgtgcttaatggccgcgcctccttcgaagagatcccccccaccgttgacgaaatgcgtaaacggatccagaccgtgcgcgacaacggactgccgtggctggtagcgctgtggcgcggggctatcgtcggctactgctatgccaccttctatcgcccgcgtccggcctatcgctacaccctcgaggaatcgatatacgtggaatccggaatgggcggacgcggcatcggcagcgcgctgctgtccaggctaatcgctgagtgcgagaaaggcccgtggcggcagatgctggcgatcatcggcgatggccataacaatgccggctcgctggcgatccataaaaagttcggctttaccgtggcgggtcagctgcgcagcgtcggctacaagatgggcgactggcgggatacgttgattatgcagcgcgcgctgggtgacggcgactggacgctgccggagtga

SEQ ID NO: 921 - DNA, 1590 bp, Klebsiella pneumoniae
atttacagatccgccgtcctttttacggaacttcgcgtttcatatcagggtttaattgcaagaaaatatgacacagcagaggaagttgcttgccgttacccttctgatgaccgggcaaatcgtttaccataccggtcgcacgccaccacggataatgaacagactatgcaagatagcgtcaaccagcccggatttttattccacgattatgaaaccttcggcaccagcccttccctcgaccggccggcgcagttcgccgccatccgtaccgacgcggagctgaatgtgctcggcgagcccgaagtgttttactgcaaacccgctgacgattacctgccgcagccgcaggcggtgatgatcaccgggatcacgccgcaggaagcgctggccaaaggggatgatgaggccacatttgcccgccgcatccacgatctgttcacggtgccgcaaacctgtatcgtcggctataacaacgtgcgctttgatgacgaagtgacgcggaatatcttctatcgcaacttctatgacccttatgcctggagctggcagcacgataactcgcgctgggatctgctcgacgtgatgcgcgcctgctatgccctgcgcccggaagggatcgcctggccggagaatgacgagggtttgcccagcttccggcttgaacatctgaccgtcgccaacggtattgaacaccagaacgcccatgacgcgatggccgatgtgtacgccaccatcgccatggcgaagctggtgaaaacccggcagccgcggctgtttgattatctctacagccaccgcaataagcgcaagctggcgacgctcatcgacgtgccgcagatgaagcccctggtgcatgtctccggcatgtttggcgccgcgcgcggcaacaccagcctggtggcgcccctggcctggcatccggaaaaccgcaatgcggtgattatggtcgatctggcgggcgatatggcgccgctgctggagctcgatgccgatgccttgcgcgagcggctttacaccccgcgcgccgagcttggcgatctgccggcggcgccgatcaagctggtgcatctcaataaatgtccggtgctggctcaggccaataccctgcgcccgcaggatgccgaccggctggggatctccattcagcgctgtctggagaatgcccagctgctacgggcgaatccgcaggtgcgggagaaagtggtggcggtctatgccgaagccgagccgttcgtgccgtccgaaaacgtcgacgcccagctttacaatgggttctttagcgatgccgaccgcgcggcgatgaaaatcgtgctggaaaccgaaccgcgcaatctgccggcgctggatattaccttcgccgataagcgtatcgaacgcctgctgtttaactaccgggcgcgcaacttccccggcacgctcgatgaacatgagcagcagcgctggttagagcaccgtcgtcaggtgtttacgccagagtttttgcaagcctatgccgatgagctgcagatgctgtatcaacagtatgcggatgataaagagaagctggcgcagctgaaggcgctgtggcagtacgcacaggatattgtctga

SEQ ID NO: 922 - DNA, 3078 bp, Klebsiella pneumoniae
gtgaagtttttcgccctcttcatttaccgcccggtggcgacgatcctcatctcgctggccatcaccctgtgcggcattctcggcttccggctgctgccggtggccccgctgccgcaggtggacttcccggtgatcatggttagcgcctcgctgccgggagcctcgccggagaccatggcctcgtcggtggccaccccgctggagcgctccctgggacgaatagccggggtcaatgagatgacctcctccagctcgctgggcagtacgcgcatcattcttgagtttaacttcgaccgcgatatcaacggcgcggcgcgcgacgttcaggcggcgatcaacgccgcgcaaagcctgctgccgagcggaatgcccaaccggccgacctatcgcaaagccaatccgtcggatgcgccgatcatgatcctgacgctgacctcggacacctactcccagggtgagctgtatgatttcgcctccacccagctggcgcagaccatcgcgcagatcgacggcgtgggcgatgtcgacgtcggcggcagctccctgccggcggtgcgcgtcgacctcaacccgcaggcgctgttcaaccagggcgtgtcgctggacgcggtgcgcaccgccatcagcgacgccaacgtgcgcaaaccgcagggggcgctggaggacagcgcgcaccgctggcaggtgcagaccaacgatgagctgaagaccgccgccgactatcagccgctgatcgtccactaccagaatggcgccgcggtgcggctgggagatgtcgccaccgtctcggattcggtgcaggacgtacgcaacgccgggatgaccaacgccaaaccggcgatcctgctgatgatccgcaaactgccggaagccaatattatccagacggtggacagcatccgcgcccgcctgccggagctgcagcagaccattccggcggctatcgacctgcagatcgcccaggaccgctcgccgaccatccgcgcctcgctggaggaggtggagcagacgctggtgatttcggtggcgctggtgatcctcgtggtgttcctgttcctgcgctcggggcgcgccacgctgatcccggccgtcgccgtcccggtatccttaatcggcaccttcgccgcgatgtatttgtgcggcttcagcctcaataacctgtcgctgatggccctgaccatcgccaccggcttcgtggtggatgacgctatcgtggtgctggagaatatctcccgccatctggaggcggggatgaaaccgctgcaggcggcgctgcaggggagccgcgaggtcggctttaccgtgctgtcgatgagcctgtcgctggtggcggtgttcctgccgctgctgctgatgggcggcctgcccggtcgcctgctgcgcgagttcgccgtcaccctgtcggtggcgatcggcatctcgctggcggtctccctcaccctgacgccgatgatgtgcggctggctgctgaaaagcggcaagccccaccagccgacgcgcaaccgcggctttggccgcctgctggtggccgtgcagggcggctatggtaaatcgttaaaatgggtgctgaagcatagccggctgaccggcctggtggtgctgggcaccatcgccctcagcgtctggctctacatttcgatcccgaaaaccttcttcccggagcaggacaccggggtgctgatgggcggcattcaggccgaccagagcatctccttccaggcgatgcgcggcaagctgcaggactttatgaagatcattcgcgaagatccggcggtggataacgtcaccggctttaccggcggctcgcgggtcaacagcgggatgatgtttatcaccctcaagccgcgcgaccagcgccacgagacggcgcagcaggtgatcgaccggctgcgcaaaaagctggccaacgagcccggggccaacctgttcctgatggcggtgcaggatatccgcgtcggcggccggcagtcgaacgccagctatcagtacaccctgctgtccgacgacctgtcggcgctgcgcgagtgggagccgaagatccgcaaagcgctggcggcgctgccggagctggcggacgtcaactcggatcagcaggacaatggcgccgaaatggacctggtctatgaccgggataccatgtcgcgcctcggcatcagcgtccaggacgccaacaacctgctgaacaacgcctttggccagcggcagatctctaccatctaccagccgctcaaccagtataaggtggtgatggaggtggatccggcctacacccaggacgtcagcgccctggataagatgttcgtcattaacagcgacggcaagccgatcccgctggcctacttcgccaaatggcagccggccaatgccccgctgtcggtgaaccaccaggggctgtcggcggcatccactatctcctttaacctgcccaccggccgctcgctgtcggaagccagcgaggccattgaccgcgcgatgacccagctcggggtgccgtcgagcgtgcgcggctcctttgccggtaccgctcaggtgttccagcagaccatgaacgcgcaggtgatcctgatcctcgcggctatcgccacggtctatatcgtgctgggggtgctatatgagagctatgtgcatccgttgaccatcctctcgacgctgccctccgccggggtgggcgctctgctggcgctggagatcttcgatgccccgttcagcctaatcgccctgattgggattatgttattaattggcatcgttaagaaaaacgccatcatgatggttgattttgccctggaggcgcagcgtaacggcaacctgacgccggaagaggcgattttccaggcctgcctgctgcgtttccggccgattatgatgaccaccctcgccgcgctgttcggcgccctgccgctggtgctctccgggggcgatggctctgagctgcgccagccgctggggatcaccatcgtcggcggtttggtgatgagccagctgttaacgctctacaccacgccggtggtctatcttttctttgaccgtctgcggctgcgtttttcgcgtcactcctctcaaccggtaagcgaataa

SEQ ID NO: 923 - DNA, 807 bp, Klebsiella pneumoniae
ctggcgacgtcggctatcgcctgcagcagcgccggggcgcgttcgcgggcaaatcgccgcagcaccaccgcgccgggggccagcggctcctgccacggtgggatatcgctaaacagatcgagcattactcctcctcatgttgggcctcgcgcgccagcagctgcgcttttcgcgccgttccccagcgataaccggacagggcgccatcttcacgcaccacccggtggcagggaacaatcaccgccagcgaattcgccgcgcaggcgccggccacggctcttaccgcccgcggctggccaatatgctctgccacctggcggtagctgcgggtctcgcccaccgggatctgccgcagcgcctgccagacctgcagctgaaacgcagtgccctgcagatccagcggcagcgataccagccgccggctgtcgtcgaggtgggcgaaaatctcggtcatctgctgacaaaaatcagggtcgccttcacgcagctcggcattgggaaagcgccggcgcaggtcgtcgagcaatgccgcatcgttatcacccggcagcaccgcgcagacgccgcgttcactttgcgccaccaggcaacgacccagcgcgcagtcgcccgtggtccaggttaccacggtggcggcgccgccgcggcgaaactggctggcggtcatccctaacgctgcgtcggcctggcgataatagctgctgctgtcgggaaaaccagccgccagcgcggcgcgggtcaccggtatcccctgctccagcgcttcccgcaggcgctgcgcccgccacgcttgttgccaggctttag

SEQ ID NO: 924 - DNA, 1449 bp, Klebsiella pneumoniae
ccgcagacgtctggctacggtatggataatacgcccccgcagcgggggagagtggacaggcctgtccggacgaacaggccattttgcgtgggagaccaggaatattccagcgtaatctgcagcgccaggatcaggacagacctgctgcgcggcagcgccgggcgagggctagcggaaaaccacctgcgcccagcgggccagcccggcggtcaccgagccaaaatcatcgccgccggccagcggaatacccggcagctgagcggccagcgcctttttgatcagcggcgaacgggcgctgccgccggtaagatagatcacatccggggtggtctggctgctgtcgagcgcgagccgcacctgttccataatgcgagtcaggggctgatccagcgcggcttccagaccctgctgggcgatggcggtggccagatcgtcctgaataaacggcagcgcggtttcgacgctggcggcgctggagagagcgattttgctctcttcggcgctgcgcaccagacgatagctgagacgctggcgccagaccttcagcagcagagccaccttgtcggcatcccgggcgctgcgcagcagatcgttcagcaggcggccgttggcggtgctgtagaaatcgctctgcgccggcacgtcgttgatcgccaccgcgttccaccacgggaggatcggcagcgcggtgcctttctccgtttcgccacccatgccgagaaggggcatcaggcatttgaaggccagggcaatgtcgagatcgttaccgccgatgcggcagccgctgtggccgagcaggctctgctgtcggtcggcgcgctcccgccactgcgggcccatcagcagcagggagcagtcggtggttccgccgccgatatcgacgaccagcacccgcttttcttcactgagggtcgcttcgaaatcgagcccggcggccaccggttcaaactgaaagaccacatcgcggaaaccggcgcggtgggcggcccgctcaaggatcccctgcgcctgggcgttcgcctcatcgccgccgaggccctggaagttaatcggccggccaatcaccgcctggtcgatctgctcgggcagctggctttcggcctgcaacttaatatgcagcatcatggcgcagaccaggtcttcaaacagggccacctgctgcggcttcagcccgctggcgccgaggaaggatttgggcgatttaacgaagtagacctcttctggatcttcaacatactgctgcagggaggcgagaccgaactgcacgctgttgcgcagcacctcgatgtcttcgtcgcggttggcggcgatggcccgacgcagcagcgcctggttttcgtcgctgtgggtggggacatcatgatggcgatagagccactcgctgaccgcttcgcgcgtcggcgcgcagagcatggagggcagcagggcgctgccgttttccagcgttaa

SEQ ID NO: 925 - DNA, 1743 bp, Klebsiella pneumoniae
tggcgcgcgtcgacttacaaccctttaattgacagcaggagaggcataatgaaaacgctgctgattattgatgccggactcggacaggcgcgcgcctacatggcgaaaaccctgctgggtgccgcggcgccgaaagcgcaccttgagctgattgataacccgaatgacgccgaactggccatcgtgctgggaaccgcgctgccggccgatagcgcgctgaatggtaaaaacgtttacctgggcgatattaaccgtgctgtcgcccatccggagctgttcctgggagaagcgaaagaccacgctaagccctacgttgcgccagcggcggtagccgttccggccgccgctcaggggcagaaacgcattgtcgcggtcaccgcctgtccgaccggcgtcgcccacacctttatggcggcagaagccatcgaaaccgaagccaaaaaacgcggctggtgggtgaaggtggagacccgcggctccgttggggcgggcaatgccatcaccccggaagaggtggccgaggcggatctggtgatcgtcgctgccgatatcgaggtggacctggcgaaattcgccggcaagccgatgtaccgcaccaccaccggtctggcgctgaagaaaaccgcccaggagctggataaagcggtggcggaagccaaaccgtaccagccatccggcaaacctcaggcggctgctgaagggaaaaaagagtcggcgggcgcctatcgccacctgctgaccggcgtctcctatatgctgccgatggtagtggccgggggcctgtgtatcgcgctctcctttgccttcgggatcaaagcgtttgaagtgaaagacaccctggcggcggcgctgatgcagatcggcggcggctcggccttcgcgctgatggtgccggtactggcaggctttatcgccttctccattgccgaccgtccgggtctgaccccgggccttatcggcggtatgctggcggttagcggcggctccggctttatcggcgggatcatcgctggtttccttgccggttatgtggcgaaagccatcagcacgaagctgaaactgccgcagagtatggaagccctgaagccaatcctgatcattccgctggtctccagtctgatcgtgggtttggcaatgatctatctgatcggtaaaccggtagccggtatcctcgcctggctgacccattggctgcaaaccatgggcaccgccaacgcggttctgctgggcgcgatcctcggcgcgatgatgtgtaccgatatgggcgggccggtaaacaaagcggcctatgcctttggcgttggcctgctgagtacccagacctatgcgccgatggcggcgatcatggcggccggtatggtgccaccgctggcgatgggtatcgcgacgctggtagcgcgcaataagttcgacaaagggcagcgggaagggggcaaagccgcgctggttcttggcctgtgctttatctcggaaggggcgattccttttgccgcccgtgacccgatgcgcgttctgccgtgctgtatcgtcggtggcgcggtaaccggcgctatctccatggcggtcggcgcgaaactgatggcgccgcacggcgggctgtttgttctgctgatcccgggggcgattacgccggtgctgggctacctgctggcgattgttgccggaacgctggtggcgggccttgcatacgcggtgctgaaacgccctgaggcgcaaacagcggaagttgaaaaagcggcataa

SEQ ID NO: 926 - DNA, 1647 bp, Klebsiella pneumoniae
ggctcaaatccgatgaataaaaagatggccgtaccacgctcacaggcggttggtcccaacagcactcggaccaacacccgccatgagcaagagacggatgtattgttgattggcggcggcattatgagcgccacactgggaacctggctgcaggagcttgagccagactggtctattaccatggttgagcagatgtccagcgtggcggaagagagctcaaacgggtggaataatgcgggtaccggccacgcggcgctgatggagctgaactacacgccgcagaccgccaacggcatcaatatcgacaaagcggtcgacatcaacgaagccttccatatctcgcgtcagttctgggcgcatcaggtgacgcgcggcgtcctgaacaaaccaaaatctttcattaacagcgtgccgcacatgagctttgtgtggggcgaagataacgtcaacttcctgcgtgcgcgctacgcggcgctgcagcaaagtgaactgttccgcggtattcgctattctgaagaccatcagcagatcaaagcctgggcgccgctggtgatggaaggccgcgacccgttgcaaaaggtcgccgccactcgctcagaagtgggaaccgacgtcaactatggtgaaattacccgccagctgatcgccggtctgcaaaagcatgataatttctccctacagctgggcaccgtggtgcgtcgcttcaagcgcaacgccgacaagagctggacggtcaccctggcggatgccgacaatcgtcgtcagaagcgggtcattaaagccaaatttatctttatcggcgccggcggcgcagcgctgaccctgctgcaggagaccggcattccgcaggccaaagagtatgcgggcttcccggtcggcggccagttcctggtctgcgaaaatccggaggtggtgaaccaccatctggcgaaggtctacggtcaggccgaagtgggcgcgccgccgatgtcggtgccgcacatcgatacccgtattatcgacggtaaacgcgtggtgctgttcggaccattcgccaccttctcgacccgtttcctgaagaacggttcgctgtgggatctgctggcctcgacgaatacctcaaatattttgccaatgctcaacgtcggcctggacaacttcgatctggtaaaatatctgattagccaggtgatgcagaaagataaagatcgtctggccgcgctgtgcgaatattatccggaagcgcggaaagaggactggcggttgtggcaggccggtcagcgcgtgcagatcattaagcgcgacgcgaagaagggcggggtactgcgcctgggcaccgaagtggtcagcgatgatgaaggcaccgtcgcggcgcttctcggcgcgtcgccaggggcctccaccgcggcgcctattatgctgcagctaatggaaaaagtgtttaaagataaagtcaattcgccggaatggcaggccaagctgaaggcgatcatcccaacctacggtattcgtcttgacggcaatccggcggagatcgagaaagcgctggcgtggaccagtgaagtgctggagctgaaatatcagccagctggggcggtggatgaggtaccgcaggcggagctgaagccgctgagcggcggcaagccgatggcggatatcgcgctctga

SEQ ID NO: 927 - DNA, 837 bp, Klebsiella pneumoniae
cctggggatcccctttgtttttattcagtcacggtggatatcacaatgcataacaaaaaaataaatcagcttttgatcggcgctatgctggcggccatggcgcctgccgtgagcgccgcggacatcccggcgtggaacggcagcgcgctggggtttgaagccgggcagcaagggctgctgggcgatatgctaggcattcgtccgatccttgaagaaaacggctttcattataatctcggctatcttaacgagatggcctacaacgccggcggcggttatgaccatgataaacacctggcctatattgaccaggtggcgctgacctttacccaggatctggagcgctggaccggcataccggatgcgcgtctcgaaggcaacatcgtcaaccgcaaccacgatgataatctcaccacgaaacggctgcaggatccgcgggtgagtttcaacgatctatcgcaggagagctggggcggcgggtcgattacccgccttggctggctcacctttgcccgcagctttgacgaccgccgcctgacctggcgcatcggcatgatgaacaaggtgcaaaccttcgaccagatcataccctgcgattttcagctgctgacccagtgcggtgggaaatcggccaactcgctgacctggaataactggaacattcatacctggggcaccaccctggagtacaagctgacgccgacggtcaccctgaaaggcggagtgatggagcaaaacccgcaggctaccgcgcgcagccacgcgtggagctggtcgacgaagggtagcaaaggcatcttactgccgatggagatcgaaaccccgtccgttgattaa

SEQ ID NO: 928 - DNA, 525 bp, Klebsiella pneumoniae
ttccatcgtccagtgtcctcagggcgagtcgcaaagtatcagtatatcaataaggagcagcagatgatgacctggcaggatctccaccatagtgaactcaccgttccccagctgtatgcgctgctgaaattgcgcagtgaagtctttgtcgtagagcagcagtgcgtatatcaggatgtcgacggcgatgatttggttggtgaaaatcgccatctgctcggctggcgcgatggcgaactggtggcctacgcgcggatcctcaaaagcgaagaggagtttgcgccggtggtgattggccgggtcatcgtcagccccgccgcccgtggtgcgaagctcggctatcagctgatggagcaggcgctggccagctgtcagcagcactggccgcaaaaggcgatttacctcggggcgcaggcgcacctgcaatccttttacgcccacttcggttttacgccggtgaccgaggtctatgatgaggatggcatcccccacattggcatggcgcgagaaaagcgcgctgtctga

SEQ ID NO: 929 - DNA, 318 bp, Klebsiella pneumoniae
aatacattccctgtaccggccacagtcgtatctggctgctgccagatggaggatgtggccttcgtcagcagccggatgagcggcatctacgtgaccgaccgcgagggaaaagagggctttaccgaactgaccctgcgcacccttgagagccgcacgccgttgctgcgctgccatcgccagtacctggtgaatatggcgcacctgaaggagattcgcatggaggagaatggacaggcggagctgctgatgcgcgccgggcaaacggtgccggtgagccggcgctatttaaaaagcctgaaagaggcgattggcctgtaa

SEQ ID NO: 930 - DNA, 1371 bp, Klebsiella pneumoniae
aacccgctccctcatcatgggtactgctattccgccgtcgaaccccttataatgtggggttttactaccgtggaggtttgcgtgctgtctgtttccactgcgctggcccgtttgcaagacggcctgggcgagtcatttccagactcgcccggcacgcgaattatcgatgttgcctttccgctgaatgatgccttcgatccgctactatggtgcggccagcaggcgcaatggccgcagttttactggcagcagcgcaatggcgatgaggaactggcgacgctgggggcggtaaaaacctttacctcgctcgacgcggcgaaccgctttttacgccagtccggccggcaggatctgcgtatctgcggcctgaatgcgtttgaaccgcagcagggcagcctggcgctgccgcgtctggagtggcgccggtgcggcggcagggccgtgctgcggctggtgctgcatagtgatatctccctgcgtgaggatgccgcgacggcccgcgcgtttctcgccagcctgacaaccactcaggcgactcccggcgccataccgccgttgctgagcgagcgccactcatccgactatcctcaatggcaggcaatgattgcgcgggcgactaaggcgatcagcgccggtgaaatggataaagtagtgctggcgcgggcaaccgacctgcagtttgccgccccgctggacgccgtgagcatcatggcggctagccggcgcagcaatcttaactgttttcatttcctgatggcgttcaatgcccggcaggcatttttcggctccacgccggaacggctgtggcgccggcgcggcgcgctgctgcgcaccgaagcgctggcggggaccgtcgcgaaccatcaggaagacgcgaaggcgcagcaactggccgactggttgatgaaagacgacaaaaaccagcgggaaaacatgctggtggtagaggatatctgccagcgcctgcagagtgaggcctcgacgctggacgtcctgccgccgcaggtggtgaggctgcgtaaggtgcagcatctccgacgctgcatctggaccgagctggcggcgcctgacgacagccgctgtctgctgcagctgcagcccaccgccgcggtggccggcctgccgcgccgggcggcgctggcgttcattcagcgtcatgaagcgttttcccgcgaatggtacgccgggtccgccgggtatctgtcactggcgcaaagcgagttttgcgtggcgctgcgttcggcgaaagtgaaccacgacaccctgcggttgtatgccggggcggggatcgtcagcggctctgatgcacagcaggagtggcaggagattgacaacaaagcggccgggctgcgctcgctgctgtgtccataa

SEQ ID NO: 931 - DNA, 828 bp, Klebsiella pneumoniae
acacaatccccagtgaagaattctgcttcagcgtcacgttttactccgtggctgcggggcgcccacgctggcgatttccgcttccgtcagcggacgatattcacccggcgccagcgattcatccagcaggatgtcgccgatgcgttcccgatgcaggccaaccacgtggttgcccacggcggcgaacatgcgtttcacctgatggtagcggccttcgctgatggtgaggcgcacttcggtcggagtgataacttccagcaacgccggtttggtgagatctttttcgttatgcagctggacgcctttgacgaacagctccgcggtcccttccgccagcgggctttccagcgccaccagataggttttttcacagtggtggcgcggcgaggtaatgcgatgcgaccactggccgtcatcggtcatcagcaccagcccggtggtgtcgatatccagccgtccggcggcgtgcagcttatgcgccaccggctcgtcgaggaaataaaggatagtcggatgatcgggatcgtcggtagaacagacgtacccttgcggcttgttgagcataaagtaacgcgggccattctgctgggtcagcgtatttccgtcatactccacctcgtgctccggctggagcttaaaagaggcatctttcacaatgtcgccgtccacggtaacgcggctgccgcgaatttcacgcccggcaatagcccggctgacgcccagctgctgagcgataaacttatcaagtcgcatgagatttttttagcctgtcatagtgctggagcgggcaaatcgcccgaaaaagaagaatttcaccggctagtataa

SEQ ID NO: 932 - DNA, 630 bp, Klebsiella pneumoniae
cggtcagcccctcgcccgccagccgttcgtcgggacgcaaatagtcccccacctcgcgcagcgacagcaggcgcacgcccagctcgctacgaccaaaaaaggtctgtacaaagctatttttcggtcgcaggagcatctccagcggcgccccctgctggaccacctcgcccccgtccatcagcaccaggtggtccgccagacgcagcgcttcgtcaatatcatgggtcaccagcacaatcgtccgtcccagcagacggtggatgcgcagcatctcctgctgcagcgcctcgcgggtcaccgggtcgagggcgccgaagggctcatccatcaacagcacctccggatctgccgccagcgcccgcgccacccccacccgctgctgctggccgccggagagctgatgcgggtaacggtcgcgcagcgtcgcctccagccccagcagcgccatcagctcgtcgatccggtcggcgatccttgcctgcggccatctttgcagctgcggcacggtggcgatattctgcgccaccgtccagtggggaaacaggccgatggactggatggcatagcccatccgccgccgcagggtcaggaccggctgctggcgaatgtcctcgccggcaaagcgaatag

SEQ ID NO: 933 - DNA, 1095 bp, Klebsiella pneumoniae
atgctcataccatgtatagaaggtggtgatgctgtgaaaaatgtattatttgtactccctttcttagggtatactggggcagatagggttatttttactcttttaaataacttggatagaacaaaaataaagccttttttactagtgcactcagataaagaagaaaaaagtggtctgattaaatatctaaaggatgacgtaacagtaatatctcttgggattaacgggaggattagccggaacctccatagaataatatatggtatgagaaaaaatattaaactttacaacatagacacagtccttattagtgatggaacatcaaacgcgagcatttcgccttttttatttttatttggtgatgctaaaataattgcaagagaatcaaatctttctagtctgtttgagacgaaaaaggtagttagatttctatataaaaatttttatagtaattatgatagaataattgtccaaagtaacgacatgtacgatgaccttacgaagcagatgaatatctcaagagacaaaattgtcaaaataaataaccccttagattatgattttattatatcaaaatcacaagagaaatccgcatatgagatgccgagtaataaaataaatttacttgcaattggtaggttaacatatcaaaagggatttgatttgttactcgaaggtatatccaagttaaaaaatgacaaatatcatctcactctagtaggacaaggtgaggatgatatgaaactaagagacatttgtaaaagactagatattataacaaaagtcacttttattgataaaacagataacccatatgcattaatgaaacaagccgatgtatttatttcaagctcaagatgggaaggatatcctaatgttgttattgaggctttagcatgcggattacctgttgttgccaatgattatcccgggggtataaacgaaataatcaatgatagtaatggctatatatgtgatataagaaatgatctagaagaaaatcttgaaagtgcactaaaattaagaaatgtatcttatgataagaaaaagatagatgtcatctttagagcatatgaagatactattatttcctaa

SEQ ID NO: 934 - DNA, 498 bp, Klebsiella pneumoniae
ttaccgataccgaaggcaaaatcctcaaagtgtatgatggcgagatcttctaccatcgttgatccgcgcaatctccacgtccgccccggcgagccagcggactctccggcgctgcgccagatcttcctgcgggcgcgcagtttatcgtggacctggcttcccgccgcggcgtggcggctggaagatttcgatgccgccaccgcggatgaacagctgtggctcgcggaatgcgacggccagccggtgggctttgccgccgtatggaccgccgataatttccttcaccatctgtttgtcgaccccgactggcagggcaaacatatcggcagcgcgctgctggcgcaggtcgaacggacctttaccgccagcggaacgctgaagtgcctgatggaaaataaaaacgccctgcgcttctaccagcgtcatggctggaccatcgaagcacagggcgcgtcgcccgagggcagatactggctgatgcgctcgccgcggccttaa

SEQ ID NO: 935 - DNA, 699 bp, Klebsiella pneumoniae
gaacgatcaccaccgcgtggagagcctgttcaaagcctttggccgtacgctgcgccaggcgatccgcgtccagggcgatgccctgccgtcttccaaaggggtgctgtaatgaatgtggtgatccttgataccggctgcgccaacctcaattcggtgaaatcggcgattggccgccacggctatgagccggtggtcagccgcgatccggaagtggtattgcgtgccgataaactgtttcttcccggcgtcggcaccgcccaggcggcgatggatcagctgcgcgaccgggagctgatcgacctgatcaaagcctgtacccagccggtgctggggatttgcctgggcatgcagctgctcggcaagcgcagcgaggagaacaacggcgtcgatctgctgggcattatcgaagaagcggtgccgaagatgaccgaccacggtctgccattgccgcacatgggctggaaccgggtgtatgccaaagctggcgatcggctgttccgcggcattgaagaaggggcgtatttctacttcgtgcacagctacgccatgccggtcaacccgtacaccatcgcccagtgcaattacggcgaggcgttcaccgccgcggtgcagaaagataacttctttggcgtgcagttccacccggagcgctccgggagcgccggggcgcagctgctgaaaaacttcctggagatgtga

SEQ ID NO: 936 - DNA, 1170 bp, Klebsiella pneumoniae
agtaagccaccggtgaccattcgctgtactcatcgcgtcggcctgctgctgacaggtctgctgctggttacgctggcgctgccgtttgtcacttatgcgccgaatcgcttactctccggggaagggcgcgggctgtggcaggtgctgccctggctcgccggcgttcagctggcggcggcccttgccgggatgctgctttgctggctgccgggcaggatcgtgccgtttctccacctgctgctggctgaactgctcttcccgctgcttatctggggcagcggccaggcggcgcttgagctctcccggcacggctcgccgctggcgcgcacctcgcccggcagcggcctgtggttgtcgctggcgctttgtctgctgctggccagcgaggccatccgtcatcttaccgtccggccgctctggcgctggctgctcaatgcgcaagtctggctgttgcccatcatcctgctcgctatcggggcgctcgatcagctctccttgctgaaggagtatgccaaccgtcaggaggtatttgatgacgccctgcgccagcatctgcttctgctgttcggcaccctgctgccgggcctgctgattggcctgccgctgggggtatggctgtggcggcgtccgcgctggcaggcgccagctttcaccgcgctcaatgtgatccagactattccgtcggtagcgctttttggcctgctgattgcgccgcttgccggtctggcgcgttatttcccgacgctgggcgagctgggcgtctccgggaccggcgtggcgccagccctgatcgctctcactctctatgcgctactgccgctggtgcgcggggtggtgaccggcctgcagcaggtaccgcaggatgccctggaaagcgcgacggcaatgggcatgagcgccgggcagcgctttcgtcaggtgcagcttccgctggcgatgccggtactgctgcgcagcctgcgggtggtcagcgtgcaaaccgtcggcatggcggtagtggccgcgctgatcggcgccggcggctttggcacgctggtttttcaggggctgctgagcagtgcgctggatctggtgctgctgggcgtggtgccgaccattgccctggcggtggtggtggatgccctgttcgccctgtggggcgcctggctaaaaggagaggccaatgattga

SEQ ID NO: 937 - DNA, 1095 bp, Klebsiella pneumoniae
ggcctgacgccaacggtgaggaacagaatggaaacactttcggcgttactggctgccattccgcagcccgatgtggcgggcatggcgcgcgctcagcagcatattgatggcctgttaaagccgcccggcagccttggccgtctggagacgctggcggtacagctggccggtctgcctggtttgcaggggcagctggcgctggcggagaaagcgattgtggttatgtgcgccgaccatggcgtctggcatgaaggcgtgactccttcgccgcagggggtgacggccattcatgccggcaatatggtgcggggcaacaccggcgtctgcgtgctggcggcgcaggccggggccagggtgcaggtggtggatgtcggcatcgatgccgacccgctgccgggcctgattaacctcaaggtggcccgcggtagcgggaatatcgcccggacggcggccatgagccgccagcaggcggagacggtgctgctggccagcatgcatctcacccgccagctcgctgccgacggggtgaaagccttcggcgtcggcgaattgggaatggccaataccaccccggccgcagcgacgatcagtgtcctgacgggcagcgaccctgacgcggtggtgggctgtggggccaatctgccgctggcgcagcggggccataaggtggcggtggtgcgccaggcgatagcccataatcagccgaacccggccgacgggctggatgtcctggcgaaggtggggggttacgatctggtgggcatgaccggggtgatcctcggggcggcctcctgtggcctgccggtggtgctggatggcttcctctcctatgcctctgccctggccgcctgccgcatggccccgtcggcgcacccttatcttattccttcacacctgtcggcggagaaaggggcgcagatcgccctcgacgcgctgggtctgcggccgtatctcgatatggacatgcgcctgggagagggcagcggcgccgcgctggcgatgcacctgttggatgccgccagcgtgatgtacaaccagatgggaacgctggcgcagagcaatattgtgttgcccgatagcgcgccgtcatcctga

SEQ ID NO: 938 - DNA, 630 bp, Klebsiella pneumoniae
cgccctgcgccagcatctgcttctgctgttcggcaccctgctgccgggcctgctgattggcctgccgctgggggtatggctgtggcggcgtccgcgctggcaggcgccagctttcaccgcgctcaatgtgatccagactattccgtcggtagcgctttttggcctgctgattgcgccgcttgccggtctggcgcgttatttcccgacgctgggcgagctgggcgtctccgggaccggcgtggcgccagccctgatcgctctcactctctatgcgctactgccgctggtgcgcggggtggtgaccggcctgcagcaggtaccgcaggatgccctggaaagcgcgacggcaatgggcatgagcgccgggcagcgctttcgtcaggtgcagcttccgctggcgatgccggtactgctgcgcagcctgcgggtggtcagcgtgcaaaccgtcggcatggcggtagtggccgcgctgatcggcgccggcggctttggcacgctggtttttcaggggctgctgagcagtgcgctggatctggtgctgctgggcgtggtgccgaccattgccctggcggtggtggtggatgccctgttcgccctgtggggcgcctggctaaaaggagaggccaatga

SEQ ID NO: 939 - DNA, 384 bp, Klebsiella pneumoniae
acgccagcgccgcccggcgcggcaggccggccaccgcggcggtgggctgcagctgcagcagacagcggctgtcgtcaggcgccgccagctcggtccagatgcagcgtcggagatgctgcaccttacgcagcctcaccacctgcggcggcaggacgtccagcgtcgaggcctcactctgcaggcgctggcagatatcctctaccaccagcatgttttcccgctggtttttgtcgtctttcatcaaccagtcggccagttgctgcgccttcgcgtcttcctgatggttcgcgacggtccccgccagcgcttcggtgcgcagcagcgcgccgcgccggcgccacagccgttccggcgtggagccgaaaaatgcctgccgggcattga

SEQ ID NO: 940 - DNA, 2226 bp, Klebsiella pneumoniae
cattgccagccagcgttgggctgccaaattgagtggataattttcaggaaacactgtatgacttcagtcacaacaaacaaaccggcaacaccggattctgatgaaatcgatctggggcgccttattggtgagttgatcgatcatcgaaaattaattattgctataacgaccgggtttacagtactttcagtactttatgcgctattagctactccgatctaccaggcagatgcactaattcaggtggagcagaaacagggaaacgcgatcttaagtagtttgagtcagatgttacctgatggccagccgcagtcagctccggaaatagccttattacagtctaggatgatacttggtaagactgtggatgatttgaacttacaggcacaggtaagaccaaaatattttcctcttgtaggccgcggtttagcacgaattatgggtgataaaccagggaatattgctattagtcgcatttatttacctagtcgaggtgatgatgaaagtgcgccaaaagttattcttactgtgaaagatgataaacattatctggttgagggcgatgattttagtgctaatggtactgtagggacgttacttaatgaacatggcatctctcttttagttaactcaattgatgcaaaaccgggcgataagttcactgttagccagttgacgagattgaaagctattactgatcttcaggagatctttagcgttgccgatcaaggtaaagacactgggatgttggagctaacattaagtggagataatcctgagctgatatctcgcatacttgatagcattagccagaactatttgacccagaatatcgatcggcaagctgcgcaggatgcaaaaagcttagagttcctaaatgaacaattgccgaaagttcgtagtgatctggatattgcagaagataagttaaatgcttatcgcaaacagaaagactctgttgacctaaccatggaggctaaatcagttctggagcaaattgttaatgttgacaatcaacttaacggcttgactttccgtgaagcggaaatatcacaactatataccaaagagcacccgacctataaagcattaatggagaagcgacaaacactgcaggaagagaaatccaagctcaataaacgggtgagtagcatgccatctacgcagcaggaagtattacgtttgagtagggatgtagagtccggtcgtgctgtgtatttacagttgttgaatcgtcagcaagaactaaatattgctaaatcaagtgctattggtaatgtgcggattatagataacgcaataactgaacctgatcccgtaaaacccaaaaaagtgttggtggttgcaattggcattattttgggcctgtttgtttcgatcagtctagtactggtaaaggttttcttacgtcgtggtattgaatcccctgaacaactggaagagatcggtgtcaacgtttatgctagcgttccagtttcggagtggttggcaaaaaataaccgtaaatctaagcaattacgtaagaatgaatctgatgctctgctcgcagtagagaatccggctgatttggcggttgaggccattcgtagtttacgcactagtctacattttgcgatgatggaagccaaaaataacgtgcttatgatttccggtgctagtcctaatgcaggtaaaacatttatcagcagtaacctagcggcaactatcgcattaaccgggaaaaaagtgctgttcatagatgctgacttacgtaaaggctatgtacacaaaatgtttggccgtaagcaggataaaggattgtcagagatcttagctggacaagtggctgcagaaacagtgatcgaaaaagttactggcggtgagtttgattatatcggtcgtgggcaaattcctccgaatcctgcagaattgctcatgcatccacgttttgaaaaattattaaaatgggcaactcaagtttatgatttaatcatcatcgatactccaccaattttggctgttaccgatgctgcaatcattggtcgttatgctggtacatctttattggttgcacgctttgaagaaaatactgcgaaagaaattgaagttagtatgaagcgatttgaacaaagtggtgtaattgtaaaaggctgtattctaaatggtgtcgtgaaaaaggctagcagctattatggctatggctataaccattatggttattcttattctgataaaaaacacgattaa

SEQ ID NO: 941 - DNA, 609 bp, Klebsiella pneumoniae
aatctttggcccgggcaacgcttacgtcacggaagccaaacgccaggtcagccagcgtctggacggcgcagccatcgacatgccggccggcccgtcggaagtgctggtgatcgccgacagtggcgccaacccggactttgtcgcctccgacctgctgtcgcaggcggaacacggcccggactcgcaggtgatcctcctgaccccggacgccgacatgggcagccgcgtcgccgaagccgtggagcgccagctggccgccctgccgcgcgccgaaactgcccgcgtggcgctctccgccagccggatcatcgtggcccgcgatctggcgcagtgcgtggctatctccaaccagtacggcccggagcacttgatcattcagacccgtcaggcccgcgagctggtggacagcatcaccagcgccggttccgttttccttggcgactggtcaccggaatccgcgggcgactacgcctcgggcaccaaccacgtcctgccgacctatggttacaccgccacctgctcaagcctcggtctggccgatttccagaagcggatgacggtgcaggagctgtcgcgcgacggctttgccgccctcgcctcaacgattga

SEQ ID NO: 942 - DNA, 723 bp, Klebsiella pneumoniae
agtgattggccaaaaaggaaaagaagaatgatgcatgaaatctggtggtcgctaccgctaaccctgatcgtcttttttctcgcccgcaaactggcggcccgctttaagttcccgctgctcaacccgctgctggtggcgatggtggtgattattccatttcttctgctgaccgggatctcctatgagcgttattttgccggcagcaaagtcctgaacgatctgctgcagccggcggtagtggcccttgcgttcccgctgtatgaacagctgcaccagatccgcgcccgctggaaatctatcattaccatctgctttatcggcagctgcgtggcgatgatcaccggcaccaccgtcgctctgctgatgggcgccacgccgcaaatcgccgcctctattctgcctaagtcagtcactacgccgattgctatggcggttagcggcagcatcggcggcattccggccatcagcgccgtgtgcgtaatttttgtcggcatcctcggcgcggtatttgggcatacgttgcttaacctgatgcgcattcgcaccaaagcgtcgcgcggcctgtcaatgggcaccgcctcgcacgccctcggcaccgcccgctgcgccgagctggactatcaggaaggcgcgtttagctcactggcgctggtgctatgcgggatcatcacctcgttgatggcgccgttcttatttccgctgatcctcgcagtggtaggttaa

SEQ ID NO: 943 - DNA, 1488 bp, Klebsiella pneumoniae
ggcttccggcccgcaggccggctcaccattctcaaaaggattgcccgatcgatgtccgttttgcataaaaaaagcgcccgcttgcgtgacgaagagcgcgcccgtctgatttggctcttgagcaccgataaagcggtgacttccgcgctgctgggcaaactgacgctggctgagcgctatgatgaagggacgctggccgatgacctggccgaagtggaaatgctggtctcgcatctgccgccgccggatctcgccgatgcgctggaagcgcttccctatgacgcccgcaccgcgctatggtgcctggtgcccgacgataaacgcggcgaagtgctgctggaggcctcagagaacgtctggggcgacctgatcgacaagatgagcgaccccgagctgctgcaggccatgcagccgctggatatcgatgaacaggtttacctgctgcagcatctgccgcgcaacctgaccggacggctgctggcgaccctgccggccgagaagcgcgcccgtattcgccagattatgcgctacgctgacaacagcgtcgggtcgatcatggagtttgaggtcattacggtgcgaccggaggccaccctggcggcggtgcagcgctatctgcggcgtctcggtaaaatgccggaaaacaccgataagctgttcgttaccacccgtaacaagctgctgctcggcgagctggagctgcagaccattctgctcaatgatgcgcagaagcgggtgggggaggtgatggagggcgacccggtcacctttcagccgcacgaagaggcggagaaggtggcgcgcaccttcgaacgcgacgacttgctcagcgccgccgtcattgatgccgacggcaagctgatcgggcgcctgaccatcgatgagatcgtcgatgtggtttatgaagaaaccgataacgatctgcggcggatgggcggcctgagcgatgaagaggatgtcttcgccccggtcagcaaagcggtgaaaacccgctgggcatggctggcggtcaatctgtgtacggcgtttattgcttcccgggtcatcgacggcttcgaacacaccatttcacagctggtggcgctggcctcgctgatgccgatcgtcgccggcatcggcggcaacaccggcaaccagacgatcaccatgatcgtccgggcgatggcgctgcagcagatccagcccggcagctttacctttctgatcctgcgtgaaatgggcgttgcgctgattaatggcctggtgtggggcgggattatgggggccatcacctggtggctgtatgacgatccgcagctcggcggggtgatgacgctggccatgatgctcaacctgctgatggcggcgatgatgggcgtgataatcccgatggtcatggtgaagttggggcgtgacccggcggtcggctccagcgtaatgatcaccgccatcaccgacaccggcggcttctttatttttctgggtctggcgacgctgtttctaatgtag

SEQ ID NO: 944 - DNA, 402 bp, Klebsiella pneumoniae
gccgggcggccatcgccacgctcaccagctggcccagcaccgcgcgcaccgcctgctcgaaggcatccagcgcccccggcaggcgcagccccggccgcgcctgcgccaggtcgcccagcgtgcgagcgacctgtcgcgggtcgcaggctaaatcaaacagctggccaattcgcgcatagcagatctccgctaccggctgcagtcccggggaaagggtcacccgcaggccctgcgcctcttcgtccggcgccagatgaatcagcccgcggtggccttccacgccaaagctgcggctgtagcccccatcgtgaaaacgctcgacgccggcaaccgcgcgcgcctgcagaaaaccaaccatccacgcccagtcatagggcggggtccagggtaacagcaccataa

SEQ ID NO: 945 - DNA, 960 bp, Klebsiella pneumoniae
aaggagaggccaatgattgaatttcaaggggtcagcaaagtgtttgccggccacccggcggtgaaggacctgaccctggagctgcgcgaaggcgctttctcggtgctggtggggacttccggctcgggcaagtcgacgacgctgaagatgatcaaccgtctgctggagccggaccggggcactattcgctttgccggcgaggacattcgccagcagccggtcctgaccctgcggcggcggatgggctatgccatccagtccatcggcctgtttccccactggacggtggcgcagaatatcgccaccgtgccgcagctgcaaagatggccgcaggcaaggatcgccgaccggatcgacgagctgatggcgctgctggggctggaggcgacgctgcgcgaccgttacccgcatcagctctccggcggccagcagcagcgggtgggggtggcgcgggcgctggcggcagatccggaggtgctgttgatggatgagcccttcggcgccctcgacccggtgacccgcgaggcgctgcagcaggagatgctgcgcatccaccgtctgctgggacggacgattgtgctggtgacccatgatattgacgaagcgctgcgtctggcggaccacctggtgctgatggacgggggcgaggtggtccagcagggggcgccgctggagatgctcctgcgaccgaaaaatagctttgtacagaccttttttggtcgtagcgagctgggcgtgcgcctgctgtcgctgcgcgaggtgggggactatttgcgtcccgacgaacggctggcgggcgaggggctgaccgtcaccatgaccctgcgggaagcgctgtcgcagtttgtcgcccggcgctgcgagacgctgccggtggtcgatgccgaaggcaggccctgcggtacgctgcattttgccgatctgctgcgtcaggagatgagccatgaaggcgcttcgtga

SEQ ID NO: 946 - DNA, 1218 bp, Klebsiella pneumoniae
aacgcgaagttccgtaaaaaggacggcggatctgtaaatctagaggatatgccgttgaaaggccgtttgtttattgctgtatctttgctcgcttcgagcgtttcctgcgcatttgccgtcgacttacctgctacggtcgcgccgccttccattcaggctggctcctgggtgctgatggattacaccaccggtcaggtcctgaccgcgggtaacgaacatcagcagcgcaatcctgccagtctgaccaaactgatgaccggctacgtggtcgatcgcgccatcgacagccatcgtatcacctttgacgatatcgtcaccgtgggtaaagacgcctgggcgaagggcaacccggtgttcgacgggtcatcgctgatgttcttaaagccaggggatcgcgtcagcgtccgcgacctcagccgtgggctgattgtcgactccggtaacgacgcctgcgtcgcgctggccgactatgtcgccggcggccagccgcagtttgtcgccctgatgaatcagtatgtcgaaaaactgcacctgcgggacacccatttcgaaaccgtccacggcctcgacgccccgggccagcacagttcggcctatgacctcgcggtgctctcgcgggcgattattcatggcgaaccagacgtctaccacatgtacagccagaaaagcctgacgtggaacgggatcacccagcaaaaccgtaacggtctgctgtgggataaaaccatgaacgtcgatggcctgaaaaccggccacacctcgggcgccgggttcaacctgatcgcctcggcggtggatggccagcgccggctgatcgccgtggtgatgggggcggacagtccgaaaggccgcgagcagcaggccgctaaactgctgcactgggggcagcagaacttcgacaccgtgcaggtgctgcagaaggggcagaaggtcggcaccgagcgtatctggtacggcgataaagagcagattaagctcggcaccgatcaggatttctggttagccctgccgaaggcggaagtgtcgcgcattaaagcgaaatatgtgctggataagaaggatcttgaggcgccgatcgccgccaatcagcgggttggcgagatttcactgtatgacggcgacaaggtggtggggcactatccgctggtcaccctcgaaagcatcaataaaggcggagtgttctcgcgaatgagcgattacctgcatcacgagctgtaa

SEQ ID NO: 947 - DNA, 1566 bp, Klebsiella pneumoniae
ggtaaatgtacttgcctcgccggtgttgcacagcgaagtcagctggtgccgcgagcgctttctatcttggtattccccttattctcattgagatacgacagcggggctgaaaatggatcttgtacaatgataaaaattgcgcgcattgccgtgacgttgggcttgctttcctcactgggagctcaggcttacgcggccgggttagtggtaaatgacaacgacttgcgtaacgacctagcctggctttccgatcgcggggtcatccatctgagcctgtcgacgtggccgctgagccaggaagagatcgcccgggcgctgaaaaaggccaaaccttcctattcttctgagcaagtggtcctagctcgaattaaccagcgactgtctgccttaaaagccgatttccgggtcaccggctacacttcaaccgacaagccgggcactccgcaggggtttggccagacgcagccggcggataattcgttaggcctggcgttcaataacagcggtgagtggtgggatgtccacctccagggcaacgtcgaagggggagagcggatcagcaacggatcgcgcttcaatgccaacggcgcctacggcgcggtgaagttctggaatcagtggctctcctttggtcaggtaccacagtggtggggaccgggctatgaaggtagcctgatccgcggggatgccatgcgaccgatgaccggtttgctgatgcagcgagccgagcaggcggcgccggaaacctggtggttgcgctgggtaggcccatggcagtaccagatctccgctagccagatgaatcagtacaccgctgtgccacacactaaaattatcggtggccgtttcacctttacgccgttccagtcattacaattaggtgcatcacgtattatgcagtggggtggggaagggcggcctgaatcactcagcaacttctgggatggtttaacaggcaaggataataccgccgcaaacgatcccaatgaaccgggcaaccaactggccggttttgactttaagttcaaactggagccaacgcttggctggccggtcagtttctatggacaaatgatcggagaggatgagtctggttttttgccttcagcaaatatgttccttggcggtgttgaaggacaccatgggtggggcaaagatgcggttaactggtacgtggaagcgcatgacacgcgtaccaatatgagccggaccaattacagttatacgcatcatatctataaggatggctactatcagcagggttatcctctgggtgacgcaatgggcggtgatggtcaactcgttgccggtaaggttgagcttattacggaggataaccagcgctggagtacacgcttagtatacgcgaaggtcaacccggagaatcagtcgatcaacaaagcgttccctcatgcggatactctgaaaggtgtacagctgggctggagcggagatgtttatcagtcggttcgtctgaatacctctttgtggtacacaaacgcgaacaatagcgacagcgatgacgttggggccagtgcagggatagagataccatttagtttataa

SEQ ID NO: 948 - DNA, 498 bp, Klebsiella pneumoniae
aggggcagtactggcaggtgcgggaaaaagtgttcgattatcaggggcgttttcgtcgcgccaacgagctgcgttaattaccggaaagctgaggttttgattgcccgggtgtcgtttggcggctataatgccgcccgcttttgcattcgcaaagcagataatccgcctgttgctgggtcgcctgtagcaggctttatatatagagagacatcaatgtttactatcaacgcagaagtacgtaaagagcagggtaagggtgcgagccgccgcctgcgcgcagctaacaagttcccggcaatcatctacggtggcgaagctgctccggttgctatcgaactggaccacgacaaagtatggaacatgcaggacaaagctgagttttacagcgaagttctgaccgtcgttgttgatggcaaagaagaaaaagtcaaagttcaggctgttcagcgccacgcgttcaagccgaaactgactcacatcgacttcgttcgcgcgtaa

SEQ ID NO: 949 - DNA, 1431 bp, Klebsiella pneumoniae
tgtggggacactccccaactcgccgcaccaggtgcggcgaatctgacctgtcatcagaacgagaacaccatgtttaaaccagaactcctctccccggcgggaacgctgaagaatatgcgttacgctttcgcctatggcgccgatgccgtctatgccggccagccgcgctactcgctgcgcgtgcgtaacaacgaattcaatcacgaaaatctgcagctcggcatcaatgaagcccacgcgctgggtaaaaaattctatgtggtggtcaacatcgccccgcataacgccaagctgaaaacgtttattcgcgatctgaagccggtggtggagatgggtccggacgcgctgatcatgtccgatccgggtttaatcatgctggtgcgggaacacttcccggagatgccgatccatctttcagtgcaggccaacgccgtcaactgggcgacggtcaaattctggcagcagatggggctcacccgcgtgatcctgtcgcgtgaactgtcgctggatgaaatcgaagagattcgccgccaggtgccggagatggagatcgagattttcgtccacggcgcgctgtgcatggcctactccggccgctgcctgctctccgggtatatcaacaagcgcgacccgaaccaggggacctgcaccaacgcctgccgctgggaatacaacgtggcggaaggcaaagaggacgacgtcggcaacatcgtccacaaatatgagccgatcccggtgcagaccgtggagcccaccctcggcatcggcgcgccgaccgataaagtctttatgattgaggaagccaaacgtccgggcgagtacatgaccgcctttgaggacgaacacggcacctacatcatgaactcgaaagatctgcgggctatcgcccacgttgagcgtctgacccagatgggcgttcactcgctgaagatcgaaggccgcaccaaatctttctactactgcgcgcgcaccgctcaggtttaccgcaaggcgatcgacgatgccgccgccggcaaaccgttcgataccagcctgctggagaccctggaggggctggcccaccgcgggtacaccgaaggcttcctgcgccgccatacccatgacgattatcagaactacgagtacggctactccgtctccgagcgccagcagtttgtcggcgaattcaccggagagcgtaacggcccgctggcggccgtggcggtcaaaaataagttcagcgtcggcgacagccttgagctgatgaccccgcagggtaacgtcaacttcacccttgagcatatggagaatggcaaaggcgaaaccatgccggtggccccgggcgatggctataccgtctggttgcctgtgccggacgacctgcccctgcagtatgccctgctgatgcgcaactttactggtcaaacaaccagaaatccgcacggtaactag

SEQ ID NO: 950 - DNA, 1419 bp, Klebsiella pneumoniae
acgatctgcactatcgacagcactgattttcatcataaccgccgcttcgttgcacgtcgcggcgcggccaccctgtaccctgaaaacgaggtcattatgtctatcaataataaacagtggctcggtttacccctgaacctgctctggggatacatcgccattgccgtatttatgaccggcgacggttttgaattagcctttctgtcgcactatatcaaagcgctcggcttctctccggcggaggcctcctttgcctttaccctctacggcctggccgctgcgctgtcggcgtggatttccggggtggtggcggaaattatcaccccgctgaaaacgatgatgattggcttcgtgctgtggtgcgtattccacgtgctgttcctcgttttcggcctcggtcacgccaactatgcgctgatcctgcttttctacggcatccgcggcttcgcctatccgctgttcctctactcgtttatcgtggcgattgtccataacgtcaaaagcgacaacgccagctcggccatcggctggttctgggcggtgtattccatcggcatcggggtcttcggcagctatattccgagctttaccattccgcacattggcgaaatgggcaccctgtggctggcgctggccttctgccttaccgggggcgtgattgccctggtttccctgcgccatattcaaacgccgcagcatatgcagaatctcaccacccgtgagaagttttccgagctgggacgcgccgcgacgctgctctataccaaccgcaatattctgctgtcgagcatggtgaggattatcaataccctctcgctgttcggttttgcggtgattatgccgatgatgtttgtcgatgagctgggcttcagcacttcagaatggctccaggtatgggcagtcttcttcttcaccaccattttctctaacgtgctgtgggggatcctcggggaaaaactgggctggatgaaggtggtgcgctggttcggctgcatcgggatggcgctctccagcctggcgttttactacattcctcagcactttggccatagctttgcgatggcgctgatccccgccatcgccctcgggatctttgtcgccgccttcgtgccgctggcggccgtgttcccggcgctggagccgaagcataaaggtgcggccatttcggtctataacctgtcggcggggatgtcgaactttctcgcgccggcgattgccgtggtgctgctgccgttcttcagcaccatcggggtggtgatcgcctataccggattgtacgtggtggcctttttcctctgcgcctttatccgcgtggagcagccggggttctcccacaaggaagcaaccgcccgcgagcaggttgaattcttcgtaggtgctgcggctggcatgcgcttcatgccagccttaatgaggtga

SEQ ID NO: 951 - DNA, 192 bp, Klebsiella pneumoniae
tcgggcggcacgggtaaatatgcattgccggcaaatatgtattttatgtcggcaatgcagcatttcttcacgattcttattaggcacagggccttacggcgcggtatgatggcgtttgccagcgaagttgcccacttaacctcgcggcgtacgttccataacgtgcaaaaatacttttcagaatgcccatga

SEQ ID NO: 952 - DNA, 183 bp, Klebsiella pneumoniae
aataatttaacttcagattataattgcatgcaaattaattcttccattacagaaaacattaataatttatttttttcgcatctaagaatttgttatatttttctagaacataatcatttatttcattacgaaatctatcaatggaaaattttacagcatgctttctacaatctccaggactaa

SEQ ID NO: 953 - DNA, 2310 bp, Klebsiella pneumoniae
agcgagataacaatgaaatggctctgcactgtaggcgtcgccgtgagtctggcgctgcaacccgcgctggcggatgaactgtttggtaaccaccccctgaccccgcaggcgcgggatgcctttgtcaccgacctgctgaaaaaaatgacggtggacgagaaaatcggccagctgcgtctgataagcgttggcccggataacccgaaagaggcgatccgtgaaatgatcaagaacggtcaggtgggggcgatttttaacaccgttacccgcccggatatccgtgtaatgcaggatcaggtgatgcagcttagccgcctgaagatcccgctgttctttgcctacgatgtgctgcacggtcagcgcaccgtgtttccgataagcctcggcctggcctcgtcgtttaaccttgatgcggtgaagaccgtgggccgcgtgtcagcttatgaagccgccgatgacgggttgaacatgacctgggcgccgatggtcgacgtctcccgcgacccgcgctggggacgcgcttccgaagggttcggggaagacacctatctgaccacgatgatgggccaggcgatggtggagtcgatgcagggcaagagcccggcggaccgctattcggtgatgaccagcgtcaagcatttcgccgcctacggcgcggtagagggcgggaaagagtacaacacggtcgacatgagcccgcagcgcctgttcaacgactatatgccgccgtacaaagccgggcttgatgccggcagcggcgcggtgatggtggccctgaactcgctgaacggcaccccggcgacctctgattcctggctgctgaaagacgtcctgcgcgaccagtggggctttaaaggcatcaccgtttccgaccacggcgccatcaaagagttgattaagcacggcgtggcctccgacccggaagacgcggtgcgcgtagcgctgaagtccggcatcaacatgagcatgagcgacgagtattacagcaagtacctgccggggctggtgaagtccggcaaggtgaccatggccgagctggatgatgccacccgacacgtgctcaacgtgaaatatgatatgggactgttcaacgatccctacagccacctgggaccgaaagattctgacccgcaggacaccaatgcggaaagtcgtctgcatcgtaaagagtcgcgcgaagtggctcgcgagagcctggtgctgctgaagaaccgtcttgatacgctgccgctgaaaaaatccggcactatcgcggtggtgggcgcgctggcggacagcaagcgcgacatgatgggcagctggtccgcggccggggtggccgaccagtcggtgaccgtcctgaccggcatcaaagaagcgctgggcgataacggcaaagtgatttacgccaaaggggcgaacgttaccgatgacaaaggcattgtcgatttcctcaatttgtatgagaacgcggtgcaggttgacccacgctcgccgcaggaaatgatcgacgaagcggtcgcggcggcgaagcaatccgatgtggtggtcgccgtggtgggcgaggcgcagggcatggcgcatgaggcctccagccggaccgatatcactctgccgcagagccagcgcaatctgattgccgctcttaaagccaccggcaaaccgctggtgctggtgctgatgaacgggcgtccgctggcgctggtgaaagaggatcagcaagccgatgcgctgctggagacctggtttgctggcaccgaaggcggccacgccatcgccgacgtgctgtttggcgactacaacccgtcgggcaagctgccgatgtctttcccgcgctcggtggggcagatcccaacctactacagccacctgaataccggccggccgtataatccggagaagccgaacaagtacacctcgcgttacttcgatgaagccaatggcccgctgtatccgtttggttacggcctgagctacaccacctttagcgtctccgatgtcaacatgtcgtcggccaccatgccgcgcgatggcagcgtgaccgccagcgtgcaggtgaccaacaccggcaatcgcgaaggggcgacggtgatccagctctacctgcaggacgtcaccgcctccatgagccggccggtgaaaatgctgcgcggctttaaaaaggtcaccctcaaaccgggcgaaacgcaaaccgttagcttcccaatcgacgtcgacgcgctgaagttctggaatcagcaaatgaaatacgttgctgagccgggcaaattcaatgtctttatcggcgtggactccgcccgcgtgaagcagagcgagtttgagctgctgtaa

SEQ ID NO: 954 - DNA, 1083 bp, Klebsiella pneumoniae
aaggggataactatgtcgcataacgctactccaaatacctctcgcgtggaattacgtaaaacgcttacgttagttccggttgtaatgatgggcctggcctatatgcagccgatgacgctgttcgatacgtttggtatcgtctctggtatgaccgacggtcacgtgccgacggcctacgcctttgcgttaatcgctatcctgtttactgccctgagctatggcaagctggtacgtcgttacccttctgccggctcggcgtatacctatgcgcagaaatccatcagcccgaccgttggctttatggtgggttggtcctcgctgctcgactacctgttcgcgccgatgatcaacattctgctggcgaaaatctattttgaagcgctggtgccttcgattccgtcgtgggtgtttgttatcgcgctggtcgcctttatgaccgcctttaacctgcgcagcattaaatccgtggccaacttcaacaccgtgatcgtggtgctgcaggtggtgctgattgccgttatcctcggcatggtgatttatggcgtgtttgaaggcgagggcgccggtacgctggccagcagccgtccgttctggtccggtgacgcgcacgtgatcccgatgattaccggggcgacgatcctgtgcttctcgtttaccggtttcgacggcatcagcaacctgtctgaagagaccaaagatgcagagcgcgtcattccgcgcgcgatcttcctgaccgcgctgatcggcggcctgatcttcatctttgccacctacttcctgcagctgtactttccggatatctcgcgctttaaagatccggatgcgtcacagccggaaattatgctctacgtagcaggtaaagccttccaggttggcgcgctgatcttctccaccatcaccgtgctggcttccggtatggcggcgcacgctggcgtggcgcgtctgatgtacgtgatgggccgcgacggcgtgttcccgaaaagcttcttcggctacgtccacccgacctgtcgcactccggcgatgaacatcatcctggtcggcgccgattgcgctgctgggcgattaacttcgacctggtga

SEQ ID NO: 955 - DNA, 285 bp, Klebsiella pneumoniae
cgccgggggttgatgttaactatatgttgcataccaccgccaaacaggactgaggtcagcacctccgcttatgatgattgcgcggcatcaagccgcgtgattatttcttccgatgaagaaatcagcactcgatcaaattttcatttttttttctgttttattgacttcttctccaggccttatgcgacgtggacttgcggattattacccttccgcaacctcaatttaacgtcaaaatcaacccttgtactcaaaagattccttactaaaatactcaccatatag

SEQ ID NO: 956 - DNA, 687 bp, Klebsiella pneumoniae
  unsure (135): Identity of nucleotide at the above locations are unknown.
tggagcaaaacccgcaggctaccgcgcgcagccacgcgtggagctggtcgacgaagggtagcaaaggcatcttactgccgatggagatcgaaaccccgtccgttgattaatggcctgccgggagcctataccctnggcgtcgtctggactaacgcgcccggcagagcgacctttatagcggtaaatccggcggcgccggggcgacccgatccgcaaggttacgccgagcacgacagcacttggtttatgtacgccggcctgaaccagcagatcacccgccacgccgacgacccgctgcggggaatgagcgtctcactgagcggcagcctcagcgaccagcgcagcaactatatccactccgccgtcgccgcctccatgcgctaccgcggtctgtttgacgcccgcccggaggactggattggcttcggcctgacgtggatcgacatgagcagccactacgcacgtaatcagcgctatatgaatcagataagcggcgccaccgactataacgatccggcttaccagccggtggccggtcattcgctgaacggtgagctctattatcgcttccgcccggtctcctggctggagctgcagccgggcctgcagtactggcaccgtccgggcggcgtcgcgcagacccaggacgcgtgggtagtggagtggaaaaccgtcgtgaccttctga

SEQ ID NO: 957 - DNA, 651 bp, Klebsiella pneumoniae
tattggcgaactgaaagcgtacctggcggcacagggcgtggagataagggtatgttgactgaacagctggactgggaaaaaacggacggcatgatgccggccatcgtgcagcacgccgtatccggcgaagtgctgatgctcggctacatgaacaaggaggcgctggagaaaaccgaagccaccggcaaggtcaccttttactcgcgcaccaagcagcggctgtggaccaagggtgaaacctcgggccatgtcctcaacgtggtgagcatcacgccggactgtgacaacgatacgctgctggtgctggtaaacccgatcgggccgacctgccacaaaggcaccaccagctgcttcggcgaaaccggccaccagtggctgttcctctatcaactggagcagctgctggccgagcgtaaacacgccgacccggagagctcctacacggcgaagctgtatgccagcggcaccaagcgtattgcgcagaaagtgggggaagaaggcgtggagaccgcgctggccgccacagtgaacgaccgcttcgagctgaagaatgaggcgtcggacctgatgtatcacctgctggtgctgctgcaggaccaggggctggatctcggggaagtgattgataatttaagagcacggcataggtaa

SEQ ID NO: 958 - DNA, 1458 bp, Klebsiella pneumoniae
tcgcccttgaccatcagcgccttgcttttaaattccggttgtcggcatggcgacgatccgctaaagtcgccccccttcttcaccggcatggggattttgcagacgatgtttattggttttgactacggcaccgccaactgttcggtggccgtgatgcgggaaaataccccccagctgttaacgctggaaaacggcagcgccctgctgccctccatgctctgcgcgccgacgcgcgaagcggtcagcgagtggctctatcgccatcatgatgtccccacccacagcgacgaaaaccaggcgctgctgcgtcgggccatcgccgccaaccgcgacgaagacatcgaggtgctgcgcaacagcgtgcagttcggtctcgcctccctgcagcagtatgttgaagatccagaagaggtctacttcgttaaatcgcccaaatccttcctcggcgccagcgggctgaagccgcagcaggtggccctgtttgaagacctggtctgcgccatgatgctgcatattaagttgcaggccgaaagccagctgcccgagcagatcgaccaggcggtgattggccggccgattaacttccagggcctcggcggcgatgaggcgaacgcccaggcgcaggggatccttgagcgggccgcccaccgcgccggtttccgcgatgtggtctttcagtttgaaccggtggccgccgggctcgatttcgaagcgaccctcagtgaagaaaagcgggtgctggtcgtcgatatcggcggcggaaccaccgactgctccctgctgctgatgggcccgcagtggcgggagcgcgccgaccgacagcagagcctgctcggccacagcggctgccgcatcggcggtaacgatctcgacattgccctggccttcaaatgcctgatgccccttctcggcatgggtggcgaaacggagaaaggcaccgcgctgccgatcctcccgtggtggaacgcggtggcgatcaacgacgtgccggcgcagagcgatttctacagcaccgccaacggccgcctgctgaacgatctgctgcgcagcgcccgggatgccgacaaggtggctctgctgctgaaggtctggcgccagcgtctcagctatcgtctggtgcgcagcgccgaagagagcaaaatcgctctctccagcgccgccagcgtcgaaaccgcgctgccgtttattcaggacgatctggccaccgccatcgcccagcagggtctggaagccgcgctggatcagcccctgactcgcattatggaacaggtgcggctcgcgctcgacagcagccagaccaccccggatgtgatctatcttaccggcggcagcgcccgttcgccgctgatcaaaaaggcgctggccgctcagctgccgggtattccgctggccggcggcgatgattttggctcggtgaccgccgggctggcccgctgggcgcaggtggttttccgctag

SEQ ID NO: 959 - DNA, 1464 bp, Klebsiella pneumoniae
ttcgccatgacaataactccacaacaactgatcgcactgctaccgctgctgatcgtcggcttgacggtggtggttgtgatgctctccattgcgtggcgacgcaatcattttctcaatgccacgctgtcggttcttggacttaacgccgcgctggtctcgctctggttcgtcggccagaacggggcgatggacgtcacgccgctgatccgcgttgacggctacgccatgctttacaccggtctggtgctgctggcgagcctcgcgacctgtactttcgcctacccgtggcttgagggttacaaggacaacaaagaagagttctacctgctggtgctgatcgccgccctggccggcattctgctggccggtgcgaatcatctggcggcgctgttcctcggtattgagctgatttcgctgccgctgttcggcctggttggttacgccttccgccagaagcgttcgctggaagcgagcatcaaatacaccatcctctccgcggcagcttcgtccttcctgctgttcggtatggcgctggtgtatgcgaactccggcaacctgtccttcctcgcgctgggcaaaagcctggcggacaacatgctgcacgagccgctgctgctggcgggtcttggcctgatgattgtcggtcttggctttaaactgtcgctggtgccgttccacctgtggacgccggacgtttaccagggggcgcctgcgccggtctccaccttcctggcgaccgccagcaagatcgctatcttcggcgtagtgatgcgtctgttcctgtacatgccggtgggcaacagcgaagcggtacgcgtggtgctgggcctgatcgccttcgcctctatcatcttcggtaacctgatggcgctgagccagaccaacattaagcgcctgctcggttactcttccatctcccatctcggctatctgctggtggcgctgattgccctgcagagcggtgaaatgtcgatggaagccgtgggcgtttacctggccggttacctgttcagcagcctcggcgcgttcggcgtggtcagcctgatgtccagcccgtaccgcggcccggatgctgactcgctgttctcctaccgcggcctgttctggcaccgtccgatcctgtcggctgtgatgacggtgatgatgctctccctggccggcatcccgatgaccctcggctttatcggtaagttctacgtgctggccgtcggtgtgcatgcgcatctgtggtggctggttgccgcggtggttgtcggctcggcgatcggtctctactactacctgcgcgtggccgtcagcctgtatctgagcgcgccggagcaactgaatcgcgatgcgccgtcaaactggcagtacagcgccggcggtatcgtggtgctgatctccgcgctgctggtgctggtgctcggtatctggccgcagccgctgattagcatcgtgcagctggcgacgccgctgatgtaa

SEQ ID NO: 960 - DNA, 342 bp, Klebsiella pneumoniae
caagagatgaccagtgaaaataaaggttataccttagcgctagagaatggccgacttcaccagaagcaggaaaaaatatttctcaaaccaatggtgttgtatattccacagcaggcggtggaggccgttaatgacctgctgagcaagttgccggacgacagggaagagggggagtttctgttgacggtcaccaataacaataacggcgtctcggttgataaaaccttttcctcgctggcggcgctgcgcgacccactcaccgcggctgatgcggtgaaggatctgatcaatatcgttcgcggctacgagtccgatgaagagaccaacgtctgcggctggtaa

SEQ ID NO: 961 - DNA, 195 bp, Klebsiella pneumoniae
cgccacccgacacctaacggtataaaaagtcggccggataagccgaagatgccgtccggcaatctgctcaggctgatcaacctaacaggacgcgctcaatattgtggcagcccagcgccttcagggtggcgacggtggcatcccactggatcagcgccgcgtcggctttctccgccaggattgcccgctggatag

SEQ ID NO: 962 - DNA, 2100 bp, Klebsiella pneumoniae
caccgggcgaccagccacatcgacgagaaaacagcgcgagcatgccgccgacagagcggcaagtcgccagcgcgtgtgagcagcaccttgttgtttgtttggttgtacacctcatggagatttggaatgttcaggttaaacccttttatccgggcgggattgtctgcgtccgtcgtatcgttggcgtttccggctctggccgatgtgaatgaagaaacgctggtggtgaccgcctcggccactgaacagaatgtcaaagacgcgccggcgagcatcagcgtcatcacccaacaggatttacaacgcaagcctgttcagaacctgaaagacgtgctgcgcgatgtgcctggggtccagctcaccaacgaaggggataaccgcaagggcgttagcatccgcggtctgagcagcagctataccctgatcctggtcgacggcaagcgcgttaactcgcggaacgccgtcttccgccacaatgacttcgaccttaactggatcccggtggatgctattgagcgtatcgaagtggtgcgcggcccgatgtcctccctctacggctccgatgcgctcggtggggtggtcaacattattaccaaaaaaatcggccagaaatggaccgggacgctgagtgctgataccactattcaggagcaccgcgatcgcggggatacctataacggccagttcttcaccagcggcccgctgatcgacggcgtacttggaatgaaggcctacggcagcctggcaaaacgcgccaaggacgatccgcagtcatccagtaatgccaccggcgagacgccgcgcatcgagggcttcaccagccgcgatggcaatgttgaattcgcctggacgccgaacgaaaaccacgattttaccgcaggctacggctttgaccgtcaggatcgcgattccgattcccttgaccgcaaccgccttgagcgggagaactactctctgagccataacggccgctgggatatcggcaatagcgagctcaagttctacggcgaaaaggtggataacaaaaatccagggcagagcgggactattacctcggaaagcaatgccatcgacggcaagtatgtcctgccgctgggcatgattaaccagctggtgaccttcggcggcgaatggcgccacgacaaactgaaagatccggtcaacctgagcagcggcggccagtcaacgtcggctagccagtacgccctgtttatcgaagacgaatggcgcatcatcgagccgctggcgctgaccaccggcattcgtatggacgaccatcagacctatggcgatcactggagcccgcgcgcctatctggtgtataacgccaccgataccgtcaccgtcaaaggcggctgggcgacggcgtttaaagccccgtcgctgctgcagcttaaccccgactggaccaccaactcctgtcgcggctcgtgcagcatcgtcggtaacccggatctgaaaccggaaaccagcgaaagcttcgagctcggtctctactaccgcggggaagagggctggcttgaaaatgtcgaaggcagcatcaccaccttccagaataatgtcgacgacatgatcgatgttctgcgcacctccagcgccagcgaagcgccgggctacccgaactttgtcggctggaaaaccgtcaacggcaagcgcgtgccgatcttccgctatttcaacgtcaacaaagcccgcatcaaaggggtggagacggaggtgaagatcccgtttggcgatgagtggaagctgacggtgaactacacctacaacgatggtcgcgatctgagcaatggcggcgacaaaccgctgcagacgctgccgttccataccgccaacggcacgctcgactggaaaccgctggacgattggtccttctacgtgacggccaactataccggccagcagcgcgcggtgagcgccaccggcaaaacgccgggcggctacaccctgtttgacgttggcgcggcatggcaggtgaccaaaaacgtgaaactgcgctccggggtgcagaacgtgggtgataaagatctgagccgggacgactacagctataccgaagaaggccgtcgctactttatggcggtggattatcgcttctga

SEQ ID NO: 963 - DNA, 933 bp, Klebsiella pneumoniae
ggacactggacgatggaattaacttttttggggacatccgccggggtgccgacccgcacgcgtaatatgacgtcgataatactcaatttgcaacagccgacccgcgccgaaatgtggttgtttgactgcggcgaagggacccagcatcagtttcttcacacgccctaccatcccggcaaactgaataagatttttattacccatctgcacggcgaccacctgttcggcctgcccggtctgctgtgcagccgctcgatgcagggaaactctctgcccctcaccctctacgggccaaaaggactcaaagagtttgttgagaccgcgctgcgcctgagcggttcgtggaccgactatccgctcaccatcatcgaagtcggccctggtctggtgttcgacgaagagggctatcgggtcaccgcgtatccgctcagccatccggtggagtgctatgggtatcgcattgcgcagcatgacaagcccggcaccctcgacgccgcccagctgattgccgatggcgtgcctcccgggccgctgttccatcaactcaagcgcggacagcgcgtcacgctggcagatggccgggtcatcgacggcagccgctatctggggccagcgaccccgggtaaaacgctggccatcttcggcgataccgccccctgcccgcaggcgctggagatggctcgcggggcggatgtgatggtccacgaaaccacccttgagcaggcgatggcggagaaagccaatagccgcggccactcttccagtcagcagaccgcggcgcttgccaaagaagcgggggtcggtacgctgatcgccacccactttagctcgcgctacgatgccgaaggctgtctgcgtatgctggcggaatgccgggagattttccctaacacgctgctggcggaagactttatggtctacaagatggcgtaa

SEQ ID NO: 964 - DNA, 2838 bp, Klebsiella pneumoniae
aaatatcttgcctcttttcatacaaccctgaaggtttcacgttatctgttcagagcgctggcggtattgctgtggctgcttattgcgtttgtctctgtgttttatatcgtcaacgcgctgcacgagcgggaagccgaaatccatcaggagcttaatctcaacgccgatcaggcccagcgctatatccagcgtaccgcggatgtaatgaaagagctgaagtatgtcgccggtaatcgcttgtcggcaggggacgcggtagcgcaagggcaaaacggcgatatggcggtgcccaactttgaacccctgtaccccgattccgactgcagcgcgatgagcgccacctggcgtaattcgctgcagtcgctggcatggtttatgcgctactggcgggataattttactgccgcctacgaccttaaccgcatctttctcatcggcagcgataacctctgcatggccaactttggcctgcgggacgtgccgattgagcgcgatcaggcgctgaaagtcctgcatcagcgcatagagcaatatcggaacgcgccgcaaaatgagcgcggcaacaacctgttctggataagccagggcgttcgccccggggtgggctatttttacgccctgacgccggtctatatggccaatcgcctgcaggcgatgctgggcgtggagcagaccatccgcatggaaagcttctttacgccgggcagcctgccgatgagcgtgacgatctttgacgataacggccagccgctgatttcgctggccggtgcggaaggtaaaatccagagcgaagcgaagtggatgcaggagcggatgtggtttggctacagttcgggtttccgcgagctggtgctgaaaaaaagcctctcgccgtcctccctgagcatcgtctattccgtctcggtagatcaggtgctggagcggatccgtatgctgatcatcaatgctatcgttcttaatatcctcagcggcgcgatgctgttcgcgctggcgcggatgtatgagcggcgcatttttatccccgcggagaatgacgcccagcgcctggaagagcacgagcagttcaaccgcaaaattgtggcttctgccccggtagggatctgtattctgcgcactgccgacgggaccaatattctcagtaatgaactggcgcacaactacctgaacatgctgacccacgaggaccgccagcggctgacgcagatcatctgcggccagcaggtcaattttgtcgacgtgctgaccagcaaccataccaacctgcagattagctttgttcattcacgctatcgcaatgaaaacgtcgccatttgcgtgctggtggacgtttccgcccgcgtgaaaatggaggagtcgctgcaggagatggcccaggcggcggagcaggccagccagtcgaaatcgatgttcctggcgaccgttagccatgagctgcgtaccccgctgtatggcatcatcggtaacctcgatctgctgcagaccaaagcgttgccgaaaggcgtcgatcgccttgtgacggcgatgaacaactcctccagcctgctgctgaaaatcatcagcgatattcttgatttctcgaaaatcgagtccgagcagttgaagatcgagccgcgggagttctctccgcgcgaagtcatgaaccatatctccgctaactatctgccgttggtggtgcgcaagcagctgggcctgtactgctttatcgagccggacgttccggaacaaatgtccggcgacccgatgcgcctgcagcaggtgatctcaaatctgctcagcaatgcgataaagttcaccgataccggctgtattgtcctgcacgtccagtgcgcgggggattatctgcagattagcgttcgcgacaccggagaagggatcccggcgaaagaggtattgcgcctcttcgatcctttctttcaggtggggaccggcgtgcagcgcaattttcagggcaccggccttggcctggcgatctgtgaaaaactgatcagcatgatggatggcgatattgctgtggaaaccgagccggggatgggtagccgctttaccatccgtattcctctgtatggcgtgcagaatacctcaccggtgagcagagacggtttcgctggcaagacctgctggctggcgattcataacacttcgctggcgatgttcgtcacctcgctgctcagctaccacggcctgacggtccgccgccatgccggcgaaacgccggacgccgaggatgtcttactcactgacgatgaggcgctgagcggatggcagggaagggccatggtcatcttctgtcgccgtcatatcggtattccgcaggagcggtccgccggcgaatggctgcacagcgtgacgactccccacgaactgctgccgctgctggggcgtattttccatgttgcgctcgccagtgcggaaaatagcccggcgctgatggccccggaggcgcaggccggcaataacgacgacatgatgatcctcgtggtcgacgatcacccgatcaaccgccgcctgctggcggatcagctgggttcgctcggctaccagtgcgtgaccgcgaacgacgggatcgacgcgctcaacgtcctcagcaagcagcacatcgatatcgtgctcagcgacgtcaacatgcctaatatggatggttatcgcctgacgcagcgcattcgtcagcttggcctgacgctgccggtgattggcgtaacggccaatgccctggcggaagagaagcagcgctgtctggaatcggggatggacagttgtctgtccaagccggtcaccctcgacgtactgaagcaaacgctgacggtatatgcggcgcgggtgcgtaaagggcgggaataa

SEQ ID NO: 965 - DNA, 315 bp, Klebsiella pneumoniae
gacgctgttgcactatttattacaggcaggaaacgccgccgatccggttgcttttttgcgccatcttgcgcaaaacgttcccggcggccgcataaggagacgctaatgaatattgcccagtttctggaacaacgcggccatcagcaaggattaaagcaaggtcttgaacaaggtctacagcaaggtatcgagcaaggtgagcagcagaccgcggagcgtatcgcccgggcgatgcttgctaacggactcgacctgtcgctggtggcgaaactgaccggcctcgccccggaatatctggcccggctgcagcattaa

SEQ ID NO: 966 - DNA, 360 bp, Klebsiella pneumoniae
tacgaggctgctattttgagtccaggtaatattgaggaaactatgcgtaaaacaaaaatgatgcttctgggcgtacttcttaccaccgctggcgccagctggacggctactgccgcggggatcgatcagtatgcgctgaaagagttcaccgccgatttcacccagtttcacatcggcgacaccgttccggcgatgtatctcaccccggaatacaacattaaacagtggcagcagcgtaacctgcctgcgccggacgccggcagccactggacctatatgggcggtaactacgtgctgattaccgataccgaaggcaaaatcctcaaagtgtatgatggcgagatcttctaccatcgttga

SEQ ID NO: 967 - DNA, 261 bp, Klebsiella pneumoniae
tttgaccatgcaacacttcatcgccggtggacagcatttccacattcaacattgctcactccttgcctgccaggtgagaaatactataacgcaaagcgggatgctgacgaggaggaaaatctggcgcagcaagaagatgccgcgccggaagagattagaagctggcgctggcgccgatgtatgggccgtcggcgatggtgttatcgcggttgccatctttgcccgccaggttcaggtaacggtagccggcctggatgctaa

SEQ ID NO: 968 - DNA, 1050 bp, Klebsiella pneumoniae
aacatcaatgctgccaatcgagtatttatcaggagttcaagtatgaaatttttagtcacaggtgcggctggttttattgggtttcatgtcagcaaacgccttttgaatgatgggcatcaagttgttgggattgataacattaatgattattatgatgtaaagttaaaagaatctcgtcttgaacaattagaatctccctcttttactttttataagttagatctcgctgaccgtgatggtatgtctaaacttttcgaaacggagcagtttgaacgtgttatccatcttgcggctcaagcgggtgtacgttattcactcgaaaatccatatgcttatgcagactccaatttaacgggctatctgaatattttggaaggttgccgtcacaataaagtgcaacatctattatatgcttcatccagttctgtctacggtctaaaccgtaaaatgccattctcaacagatgattcagtcgaccaccccgtttcgttgtatgctgccacaaaaaaagctaatgagctgatggcacatacttattcccatctgtacagcatcccgacgacaggactgcgtttctttacggtctatggtccctggggccgtccggacatggcgttattcaaattcacgaaagcgatgctggaagggaaaagcattgatgtttataactacggtaaaatgaagcgtgattttacctatatagatgatattgtcgaagctattgttcgtatccaggatgtaatccctcagcctgatcctgaatggacagtcgaggaaggatctccggctaccagctccgcgccatatcgggtctacaacattggtaacagctcaccggtggaactgatggattatatcaatgcattggagcaggcattgggattggaagcgaagaagaatatgatgcctatccagccgggtgatgtgttgaataccagtgccgagacacaagctctctatgaaactatcggttttaaaccggaaacgccagtacagcaaggtgttaaaaactttgtagattggtataaagagtactatcaatataactag

SEQ ID NO: 969 - DNA, 294 bp, Klebsiella pneumoniae
gataagggtgcgccgacggggccatgcggcaggcggccagggcagaggcataggagaggaagccatccagcaccaccggcaggccacaggaggccgccccgaggatcaccccggtcatgcccaccagatcgtaaccccccaccttcgccaggacatccagcccgtcggccgggttcggctgattatgggctatcgcctggcgcaccaccgccaccttatggccccgctgcgccagcggcagattggccccacagcccaccaccgcgtcagggtcgctgcccgtcaggacactga

SEQ ID NO: 970 - DNA, 222 bp, Klebsiella pneumoniae
tcaggcttcgcaaagcaaagacggcgcccggctggtatacagcagccgggttcgttgattgagcctctgaatgttaaggtaaaacggcacctgcggctgcaggaaaaacctgggcaggatatcgatccaaacaacgcgcttacattaatagacgatacccacaaccacaaaaaacctataacatcaaatagttacctattaaaatgggcgcatctgccgtga

SEQ ID NO: 971 - DNA, 765 bp, Klebsiella pneumoniae
ccgatgctcgccagtcagagaaaacagcagatcctccagatcctcaccgaggaaaaacaggtgatgtccggggagctaagccagcggtttaacgtctccgaggactccattcgccgcgatctgcgcgagctggcggcggagggaaaactgcagcgggtccatggcggggcattgccggtatccgccgccattgcgccaattgaaacgcgcaaaagcgtgcagatcgcctccaagcaggcggtcgcccgcgccgccgccgccctgatccagccgggacaggtggtgattgtcgatggcggcaccaccaccgcggcgatgatcggctttttacccgccgacctcagctgcacggtggttacccacagcccgggcatcgccgtggcgctggtggaccacccgcgaatcgaggtgatcctgctcggcggcagagtatttaaacattcggttgtcgccgtcggcgccgagacgctggcgggaatggcgcggatcaacgccgatctgttctttatgggggtgaccggcgtccacccgcgggcgggtttcaccactggtgattacgaagaggcaggcatcaagcgcgcgctgacggccagggcggcagaaaccgtggtaatggcctcccgggaaaagctcaacgccgcgtcggcctttgccatcggcgagctgagcctcgccagtacgctgattgtcgatggagaacccgacgccgcgctacgccaacagttggtgcagagcggcgtggagatcgtccccgttcagcggtag

SEQ ID NO: 972 - DNA, 1302 bp, Klebsiella pneumoniae
cggcgcatcgcgattcagttgctccggcgcgctcagatacaggctgacggccacgcgcaggtagtagtagagaccgatcgccgagccgacaaccaccgcggcaaccagccaccacagatgcgcatgcacaccgacggccagcacgtagaacttaccgataaagccgagggtcatcgggatgccggccagggagagcatcatcaccgtcatcacagccgacaggatcggacggtgccagaacaggccgcggtaggagaacagcgagtcagcatccgggccgcggtacgggctggacatcaggctgaccacgccgaacgcgccgaggctgctgaacaggtaaccggccaggtaaacgcccacggcttccatcgacatttcaccgctctgcagggcaatcagcgccaccagcagatagccgagatgggagatggaagagtaaccgagcaggcgcttaatgttggtctggctcagcgccatcaggttaccgaagatgatagaggcgaaggcgatcaggcccagcaccacgcgtaccgcttcgctgttgcccaccggcatgtacaggaacagacgcatcactacgccgaagatagcgatcttgctggcggtcgccaggaaggtggagaccggcgcaggcgccccctggtaaacgtccggcgtccacaggtggaacggcaccagcgacagtttaaagccaagaccgacaatcatcaggccaagacccgccagcagcagcggctcgtgcagcatgttgtccgccaggcttttgcccagcgcgaggaaggacaggttgccggagttcgcatacaccagcgccataccgaacagcaggaaggacgaagctgccgcggagaggatggtgtatttgatgctcgcttccagcgaacgcttctggcggaaggcgtaaccaaccaggccgaacagcggcagcgaaatcagctcaataccgaggaacagcgccgccagatgattcgcaccggccagcagaatgccggccagggcggcgatcagcaccagcaggtagaactcttctttgttgtccttgtaaccctcaagccacgggtaggcgaaagtacaggtcgcgaggctcgccagcagcaccagaccggtgtaaagcatggcgtagccgtcaacgcggatcagcggcgtgacgtccatcgccccgttctggccgacgaaccagagcgagaccagcgcggcgttaagtccaagaaccgacagcgtggcattgagaaaatgattgcgtcgccacgcaatggagagcatcacaaccaccaccgtcaagccgacgatcagcagcggtag

SEQ ID NO: 973 - DNA, 375 bp, Klebsiella pneumoniae
ccgccagccgccgatatgggctgcggctgcgatgcgccgcgccaccgccgacacaggattattatgatcgccaatcaccccgaacgagaacaaattcgcctggaaaatgtcctttccgcgctcggaaacccgctgcgactggagatcattcgtacgctggccgacggcagcgagctgagctgcaacgccctgcgccaggaggaggtggccaagtccaccatgacccaccactggcgcgtcctgcgcgacagcggtgtgatctggcaacggcctcaaggacgggagaacatgatttcgctgcgccgggaagatctggacgcccgttttcccggcctgctggatacgctgctgaaagttatggtgcaggcaggataa

SEQ ID NO: 974 - DNA, 378 bp, Klebsiella pneumoniae
ccctataacgcagtcgctttacgaatccgaatctcaattattaggggtgtaaaaatggaaacaactaagccttctttccaggacgtactggagtttgttcgtctgtaccgtcgtaagaacaaactgcagcgtgaaattcaggacgttgagaaaaagatccgtgataaccagaagcgcgttctgctgctggacaacctcagcgactacatcaaaccgggcatgagcgtggaagccatccagggcatcatcgccagcatgaagagcgattacgaagatcgcgttgatgattacatcatcaaaaatgccgagctgtccaaagagcgccgcgacatctcgaaaaaactgaaagtgatgggcgaagccaaagtcgaaagctaa

SEQ ID NO: 975 - DNA, 624 bp, Klebsiella pneumoniae
ggaaataacgccatgagaaacattaatgtcaccattaacacccgcaacgcctttgtccgtgaatcgctggtagccatggtcaatgacctcacccggggcgatctgcgggcgcgtttttcctggcgtaacaccgatctgtcagctgaagatatcattatctgcgaagtgatccccggggaaatatacctgtgtaataccctgattaagaacagaaaaagaggaagctcgctgattattctccatagctatgaccagctgccggaagatgagttcatgattaactgcctgaaaggggtcatttttgtttcgctaaaaacggccagtattccgcaattgctgacgatcattaaaaacgagctccagcattgtatgacccccacggctaccgacgccgcaggccgggaactcagctgcgccagctgtccgcatcgcgtgttatcacgatcgcagaccgccgtagcgcacggtattctcgaagggctggatatgagtaaaatcgccgccctgcagcgtgtgagtccccgcaccgccgcctatcataagaataagatcatggaaaaatacagcctgaataataatcatgaatttttccagtttatgaatcttttacgagagcgctggtag

SEQ ID NO: 976 - DNA, 276 bp, Klebsiella pneumoniae
ccgctcagcgctccatgccgccagcgcgctcaactcgcagccgtcatcgcattccaccaccgctaccgggcgctggccgtattccgcatcatccagcggcacgataaacacctgctgtacctgtggatgggcgagtatcacacgctcgacctcttccggttgaataccttctccaccgctaaaaaagaggttatccagtcgcccaacaaccgtcagccgaccgttatgcaatgctccgcgatcgcgcgtcgcaaaccagccttcattgttggttaa

SEQ ID NO: 977 - DNA, 3141 bp, Klebsiella pneumoniae
acacggagcgcgttcctgatgcaggtgttacctccaggccgcaccggcggcccgtcccggctgtttattatgcgtccggtggccaccactctgctgatggtggctatcctgctggccgggatcatcggctaccgctttctgccggtctccgccctaccggaggtcgattacccgaccattcaggtagtcaccctctatccgggcgccagcccggacgtggtgacctccgccatcaccgccccgctggagcgccagttcggccagatgtccggcctcaagcagatgtcgtcgcaaagctccggcggcgcctcggtagtcacgctgcagttccagctgaccctgccgctggacgtcgccgagcaggaagtgcaggcggccattaacgccgccaccaacctgctgccgagcgatctgcccaacccgccggtctacagcaaggtgaacccggcggatccgccgatcatgaccctcgccgtcacctcctccgctatcccgatgacccaggttgaggacatggtggagacccgggtggcgcagaagatctcccaggtttccggcgtcggtctggtgaccctcgccggcggccagcgcccggcggtgcgggtgaagcttaacgcccaggccatcgccgccctcggcctgaccagcgaaaccgtgcgcaccgctatcaccagcgccaacgttaactccgcgaaaggcagcctcgacggcccggcccgcgcggtgacgctttccgctaacgatcagatgcagtccgctgaggattatcgccggctgattatcgcttatcagaacggggcgccgatccggctcggcgatgtcgccagcgtcgaacaaggggccgaaaacagctggctcggggcgtgggccaaccagcagcgggccatcgtgatgaacgtccagcgccagccgggggccaacatcatcgacaccgccgacagcattcgccagatgctgccgcagctcaccgagagcctgccgaaatcggtgaaggtgcaggtcctctccgaccggaccactaacatccgcgcctcggtgcgcgacacccagtttgagctgatgctggccatcgccctggtggtgatgatcatctatctgttcctgcgcaacgtgccggcgaccattattcccggcgtcgcggtgccgctatcgctggtgggcacttttgcggtgatggtgttcctcgacttctcgatcaacaacctgacgctgatggccctgaccatcgccaccggcttcgtggtggatgacgccatcgtggtgatcgagaacatctcgcgctatatcgaaaaaggcgagaagccgctggccgccgcgctgaagggcgcgggggagatcggcttcaccatcatctccctcaccttctcgctgatcgcggtgctgatcccgctgctgtttatgggcgatatcgtcggccgcctgttccgcgaattcgccgtcacccttgccgtcgctattcttatctcggcggtggtctccctgaccctgacgccgatgatgtgcgctcgtatgctaagccacgaatcgctgcgcaagcagaaccgattctcgcgggccagcgagcgtttcttcgaacgggtgatcgccgtctatggccgctggctgagccgggtgctgaaccatccgtggctgacgctcggcgtcgcgctgagcaccctggcgctgtcgattatcctgtgggtctttatcccgaaaggctttttcccgatccaggataacggcattatccagggcaccctccaggcgccgcagtcggtctccttcgccagcatggccgagcgccagcggcaggtggccagcattatccttaaggatccggcggtggagagtctgacctccttcgtcggcgtcgacggcaccaacccggcgctgaacagcgcccgtctgcagatcaacctcaagccgctggacgaacgcgacgaccgcgtccagacggtgataagccgcctgcagcaggcggtggacggcgtccccggcgtggcgctctacctgcagccgacccaggacctgaccatcgacaccacggtgagccgcacccagtatcagttcaccctgcaggcaaactccctcgaggcgctgagcacctgggtgccgccgctgctcagccgcctgcaggcccagccgcagctggccgacgtcagcagcgactggcaggacaaaggcctggccgcctatatcaaggtggatcgcgacagcgccagccgcctcggcatctcaatggccgatgtcgataacgcgctgtacaacgccttcggccagcggctgatctccactatttacactcaggcgaatcagtatcgcgtggtgctcgagcaggataccgaggcgacgccgggcctggcggcgctggagaatatccgcctcaccagcagcgacggcggcatcgtgccgttgaccgccatcgccacggtggagcagcgctttaccccgctgtcggtgaaccacctcgatcagttcccggtgaccaccatctcgtttaacgtcccggacaactactcgctgggcgaagcggtggaggcgatcctcgccgccgaacagtcgctggattttccgaccgatattcgcacccagttccagggcagctcgctggccttccagtcggcgctcggcagcaccgtctggctggtggtcgccgcggtggtggcgatgtatatcgtgctgggggtgctgtatgagagctttatccatccgatcacgattctctccaccctgcccaccgccggggtcggggcgctgctggcgctgtggctggcgggcagcgagctggacgtgatcgccatcatcggcatcattctgctgatcggcatcgtgaagaagaacgccatcatgatgatcgactttgcgctggccgctgagcgcgagcagggcatgccgccgcgggaggcgatttaccaggcctgtctgctgcgttttcggccgatcctgatgaccaccctcgccgccctgctcggcgccctgccgctgatgctgagcaccggcgttggcgccgaactgcggcgtccgctggggatcggcatggtcggcggtctaatgctcagccaggtgctgaccctgttcaccaccccggtgatctatctgctgttcgaccgcctgtcgctgcacctgaagcgccgcttcccgcgtcaggaagaggaggcgtaa

SEQ ID NO: 978 - DNA, 1185 bp, Klebsiella pneumoniae
aattctggcgctggccgggatgagcgccggcgggcgcggggtggataccaccgatacggccgctgcggcgctgccggcggcccaggcgctggctcgtcggctggctaccgtggtggcggtcactggcgaggtggactacgtcaccgacggcgagcgggtgctcagcgtggcggggggcaatccgctgatgacccgggtggtgggcaccggctgcgcgctgtcggcggtggtggcggcgagcgcggcgctgccgggagaccggctggaaaacgtggccgccgcctgcgggctgatgaagcaggccggggagatcgccgcccgtcagggaggcccaggcagctttattccggcgtttctcgacgcgctgtatcaggaggtgcagggatgaaacgcatcaacgccctgaccatcgccggcaccgatcccagcggtggggccggtatccaggccgatctgaaaaccttctccgcgctgggggcctatggctgctcggcgatcaccgccctggtggcgcagaatacccgcggcgtacagtcggtctatcgcatcgaaccggattttgtggccgcgcagctcgactcggtgttcagcgatgtgcgtatcgataccaccaaaatcggcatgctggcggagaccgatattgtggaagccgtggccgagcggctggcgcgctaccgggtggccaacgtggtgctggataccgtcatgctggcgaaaagcggcgatccgctgctgtcggcttcggcggtggagaccctgcgtcaacgattgttgccgcaggtgtcattgatcaccccgaacctgccggaagcggccgcgctactcgatgccccccatgcgcgtaacgaacgggaaatgctggagcaggggcgggcgctgctggcgctgggctgcggcgcggtattgatgaagggcggccatctcgacgatgccgaaagcccggactggctcttcacccgcgaaggggaacagcggttcaccgcgccgcgagtgcagaccaaaaatacccacggcaccggctgtacgctctccgccgcgctggcggcgctgcgcccgcgtcacgcggactgggcagccaccgttatcgaggcgaaggcctggctgtcggcggctctggcgcaggccgactctctggaggtaggccacggtatcgggccggtgcaccatttccacgcctggtggtaa

SEQ ID NO: 979 - DNA, 1269 bp, Klebsiella pneumoniae
tacccgggcgccaaaatttcacgatccactcctgttgcgtcgacggaggacggtattgctgccgacgtcatccggtacccgggaaaagatgagcgccggcagggcgatgatcgccgccatgctcagataggtgtagagaaagacctgatgggtgctggcggcgtcgaggctcatatgctgctggccatacagccccagcagcagcccggcgatggtcacgccgatactcatcgacagctgcatcaccatcgacagcaggctgttgccgctgctggccagatcgtccgggagatctttcagcgtcagggtattcatcgaggagaagcggctggcgttgatcatcccctgcagaaacaggaccagcggcagcacgtaataccacccggccagggcgctaaacataaacagcaggctgaccgccgccaggcccagggtgctggcgaccagcacccgacggtagccaaagcggttgaccacctggaccacgatccgcttcatgcccatgctgccgagcaccatcgggatcatcatcagcccggcgtgaaagggggagaagctgaggccgatctgcagaaacaccggggtcataaacggcagcatgccgctgccgatgcgtcccgcgaagctgccgccgaggccgagggagaaggtgcggtttcgaaacaggttaaggctaaacaacgcccgggcgttaccgcgggcgtgccacaggtagagcagcagggcgcagaggccgacggccaccagccccgccagccaggcaggggaaatgccgagccctttctggccgtcgagcgccagggtcagggtcgccatcccggcggccagcagcagaaagccggagagatcgaagcgccgggtctgcatggtgtagttgggcatcagacagagggtggcgatcgcgccaacgatccccaccgggatgttgatgaggaagatccagtgccaggaggcgtactccaccagcaccccgcccagcgccgggccgagcagcgggccgacctggcccggcagggtgacgaaggtcatcgccgccatatactgatcgcgcgggacgatcttcatcaccgtcaggcggccgaccggcaccatcatcgcgccgccgactccctgcagcacccgcgccatcaccagctggtcgagggtgctggcctgggcgcaaaacagcgatccggcggtaaacagcacgatggcggtgaagaagatattgcgcaccccgacccggtcggccagccagccgctggccggcagcatcaccgccaccgttaa

SEQ ID NO: 980 - DNA, 315 bp, Klebsiella pneumoniae
gctcagggcgcggtggccagctcaagctccagcagccaggtgatcgcttcatcgcggtgggtgaggcacatctccggcgagggctgcaggctggcgcacaccttcgggcgcagaggggagccgaaaataaggcataaattgcgctcggaaagctggatacaacgggtgttagctggcttgccctgcggcatgccggggatcggcgatgatatagagggggcgatgcaacatgcgccacaatcagtacgacattccacaacccgactcccaaacgctcattttgcgccacagcctaaacgttttgccagaagatag

SEQ ID NO: 981 - DNA, 1698 bp, Klebsiella pneumoniae
catcaatatttgataccggacaatttcatgtcagtaagcgcatttaaccgacgctgggcggcggtgatcctggaagctttaacgcgccatggcgtgcagcatatctgcatcgcgccgggctcgcgctcgacacccttaaccctggcggcggcggaaaaccgcgcctttatccatcatacccatttcgacgaacgcggcctcggccacctggcgctcggactggcgaaggccagccggcagccggtggcggtgatagtcacctccgggaccgccaccgcaaacctctatccggcgctgattgaggcagggctcaccggtgaaaagctgatcctgttaaccgccgaccgtccgccggagctgatcgactgcggcgcgaaccaggctatccgccagccggggatgtttgcctcccatcctgcgcagacgatttctttgccgcgtccctcgcaggatattcctgcccgttggctggtctcaaccatcgaccaggcgctgggggcgctgcacgccggcggggtgcatattaactgtccgttcgctgaaccgctgtatggtgatatggatgagaccggcgtggagtggcagcagcagctcggcaactggtggcagagcgacaaaccctggctgcgccaggcgctgcagttagagagcgagaagcagcgcgactggttcttctggcgacaaaaacgcggcgtcgtcgtggcgggcagaatgagcgccgcggaagggaaaaaggtcgctgagtgggcgcagaccctcggctggccgctgatcggcgatgtcctgtcgcagaccgggcagccgctgccgtgcgccgacctgtggctgggcaacggcaaagcggtcagcgagctggcgcaggcgcagatcgtcgtgcaactcggcagcagcctgaccggcaaacgcgtgctccagtggcaggcgacctgcgagccggatgaatactggctggtggataatctgcccggtcgcctcgacccggcgcagcaccgcggtcgccgtctgctctcaagcgttgagcgctggctcgaattacatccggcggagaaacgccagccgtgggcgacggtgatcccacagcttgtcgggcaggcgtggcaggctgcggtcgccagcaacgagccttttggcgaagcgcagctggcgcagcgtattcggcgctatctgccggagcagggccaattgtttgttggcaacagcctggtggtgcgcctgatcgacgccctggcgcagctaccggccgggtatccggtctacagcaaccgcggcgccagcggtatcgatggcctgatcgccactgcggccggcgtgcagcgcgccagcgcccgaccgacgctggccatcgttggcgatctctccgcgctctacgatctcaactcgctggccctgctgcgccaggcgtcggcgccgctggtgctgatcgtggtgaataacaacggcgggcagattttttctatgctgccgacgccgcaggacgaacgccgtcagttctatttaatgccgcaggacgtggatttcagccacgcggcggcgatgttcggcctggcctatcatcgccctgatgactggccgtcgctggatgaggcgctggccggcgcctggcgcagggcgggggcgacggtgattgagctggcggtcaatgagaccgacggcgcgcagacccttcagcagctgctggcgcaggtaagtcgcctgtga

SEQ ID NO: 982 - DNA, 1143 bp, Klebsiella pneumoniae
gtgggcatagcaatgagaaaattgtgttatttcataaattcggattggtacttcgatttacactggatcgatcgtgccatcgcctcccgtgatgcaggttatgagattcacatcatcagccattttattgatgacaacataataaataaattcaaaacattcggctttatttgccataatgttactcttgatgctcaatcttttaatgcattagttttctttcgtacttaccatgatgtgcaaaaaattattaaaaatataaaaccggatctcttgcattgcatcactatcaagccatgtttgattggtggtgtgctcgcgaagaaatttaatctgccggtcatcgtaagttttgttgggcttggaagagtattttcttcagacagcatgcctttaaaattattacggcagtttactattgctgcatataaatatatttccagtaataagcgctgtatatttatgtttgaacatgaccgtgacagaaaaaaactggctaagttggttggactcgaagaacaacagactattgttattgatggtgcaggcattaatccagagatatacaaatattctcttgaacaggatcacgatgtccctgttgtattgtttgccagccgtatgttgtggagtaaaggactgggcgacttaattgaagcgaagaaaatattacgcagtaagaatattcactttactttgaatgttgctggaattctggtcgaaaatgataaagatgcaatttcccttcaggtcattgaaaattggcatcagcaaggattaattaactggttaggtcgttcgaataacgtttgcgatcttattgagcaatcaaatatcgttgctttgccgtcagtttattctgaaggtgttccgcgaattcttctggaagcatcttctgtgggtcgcgcttgtattgcttatgatgttggtggttgtgatagccttattattgataacgataatggaattattgttaaaagcaattcacctgaagagctggctgataaacttgcctttttgcttagcaatcctaaagcacgcgttgaaatgggtattaaggggaggaaacgtatacaagataaattttctagtgttatgattatcgataaaacattgcaaatatatcatgatgtagttcgatga

SEQ ID NO: 983 - DNA, 1485 bp, Klebsiella pneumoniae
gtaatgatagcaatggaaaataatatgcaaaatctgatcaattctttagcagagggaaataaaaaaaacgtttacattttttatttctttctgattatgttaacattttcaccggtaattttcttttcatatgcattttcagacgactggtcaacattctttgatgctataacaagaaacggttcttcgtttcagtgggatgttcaatctggtcgtcccgtttatgctgtgttccgttactatggacaaatgttaattaatgatatttcttcattttcgtatttgcggctttttaatatattaagtctggttgtcttaagtggttttatttacaacttcatagacagcagaaaaatatttgataaccccgtattcaaagtaatatttccgctgttaatttgcttactccctgcgtttcaagtttatgcttcatgggcaacatgtttcccgttcactatttcagtattgctggcaggtattagttataataaatgtttcccacattcgaagcagcggtcgtcattgccagaaaaattagcatccattgttgttttatgggtggcatttgcaatatatcaaccgacagcaattacattcttattcttttttatgcttgatagttgtataaaaaaagaaagtagtttaactgtgaaaaaagttgcgacatgttttatcattttagttatcggtgttgcaggcagttttataatgtcaaaagtacttcctgtctggctatatagggaatcattatcgagagccgagttaaccgcagatatcggtggaaagatgaaatggttcataaatgaatcactaataaacgctgtaaataactataacatacaaccagtaaaaatatattcttggttctcctcgcttgcaattttaatcggcttatacactattttggtgggaaaatcaggcagatggaaaacgttcatagtcatagcgatcgggataggttcctacgctccaaatttagcgacaaaagagaattgggcagcattccgctcgttagtggccttagaacttattatatcaactctatttcttattggcataaatagccttgtcagtagaatttttaagcaagcatttgtctggcctcttatcgctttaacaattatgataatagctcagtataatattataaatggatttattattcctcaacgttctgaaattcaggcacttgctgcggaaataactaataaaatacctaagaattacacaggaaaattaatgttcgatctcacagatcctgcttacaatgcctttacaaaaacacagagatatgatgagtttgggaatatttcattagcagcgccttgggcgctcaaaggtatggctgaagagatcagaattatgaaaggatttaatttcaaactatctaacaacgttataatttctgagaccaatcgatgtattgatgattgtatggttatcaaaacgtcagatgcaatgcgaaggtcaacgataaattattag

SEQ ID NO: 984 - DNA, 1245 bp, Klebsiella pneumoniae
atgaacaaagctaatctgcaggttggtatggttgctggtcagcacgtcgacaaaattgacctgctggccgcagatgatctgcgtcagccgctggcggtcctcgtgggtcagcatgttcaggtagttgtgcgccagttcattactgagaatattggtcccgtcggcagtgcgcagaatacagatccctaccggggcagaagccacaattttgcggttgaactgctcgtgctcttccaggcgctgggcgtcattctccgcggggataaaaatgcgccgctcatacatccgcgccagcgcgaacagcatcgcgccgctgaggatattaagaacgatagcattgatgatcagcatacggatccgctccagcacctgatctaccgagacggaatagacgatgctcagggaggacggcgagaggctttttttcagcaccagctcgcggaaacccgaactgtagccaaaccacatccgctcctgcatccacttcgcttcgctctggattttaccttccgcaccggccagcgaaatcagcggctggccgttatcgtcaaagatcgtcacgctcatcggcaggctgcccggcgtaaagaagctttccatgcggatggtctgctccacgcccagcatcgcctgcaggcgattggccatatagaccggcgtcagggcgtaaaaatagcccaccccggggcgaacgccctggcttatccagaacaggttgttgccgcgctcattttgcggcgcgttccgatattgctctatgcgctgatgcaggactttcagcgcctgatcgcgctcaatcggcacgtcccgcaggccaaagttggccatgcagaggttatcgctgccgatgagaaagatgcggttaaggtcgtaggcggcagtaaaattatcccgccagtagcgcataaaccatgccagcgactgcagcgaattacgccaggtggcgctcatcgcgctgcagtcggaatcggggtacaggggttcaaagttgggcaccgccatatcgccgttttgcccttgcgctaccgcgtcccctgccgacaagcgattaccggcgacatacttcagctctttcattacatccgcggtacgctggatatagcgctgggcctgatcggcgttgagattaagctcctgatggatttcggcttcccgctcgtgcagcgcgttgacgatataaaacacagagacaaacgcaataagcagccacagcaataccgccagcgctctgaacagataacgtga

SEQ ID NO: 985 - DNA, 1146 bp, Klebsiella pneumoniae
ttactgaaagcatctcaaaacaacaaaggagtcgggatgaattcgcaatcccaggccaaatcccctgagcgcctacgtgcgatggtcgccgggacgctggccaatttccagcacccaaccctgaagcataatctcaccgcccttaaggcgctgcaccatgtcgcctggctggacgataccgtccatattgaactgcaaatgccgttcgtctggagcagcgccttcgaagcgctgaaagagcagtgcagcgccgaactgctgcgcatcaccggcgcgaaggctatcgactggaagctgacccacagcatcgcaaccctcaagcgggtgaaaaaccagcccggggtcaacggcgtaaaaaacattatcgccatcagctccggcaaaggcggcgtcggtaaatcttctactgccgtaaacctggcgctggccctggcggcggaaggggcgaaggtgggcattctggatgccgatatctatggtccgtcgattccgaccatgctgggtgcggaagacagccgcccgacctcgccggacggcactcatatggcgccgatcatgaaatatggtctggcaaccaactccatcggttacctggtgaccgacgacaacgccatggtctggcgtgggccgatggccaccaaggcgctgatgcagatgctgcaggagaccctgtggccggatcttgattacctggtgctggatatgccgccgggcaccggcgacatccagctgaccctggcgcagaacattccggtgaccggcgcggtggtggtcaccacgccgcaggacatcgcgctgatcgacgccaaaaaaggcatcgtgatgttcgataaagtggaaatgccggtgctggggatcttggaaaacatgagcatgcatatctgcagcaactgcgggcaccacgagcctatcttcggcgccggcggcgcgcaaaaactggccgagaaataccacacccagctgctgggccagatgccgctgcatattacgctgcgggaagatctggataacggcacgccgacggtggtggcgcgtccggacagcgaatttaccgacatctaccgccagctggcgggccgggtggcggcccaaatgtactggcagggagaagtgatcccgggtgagattgccttccgcgccgtttaa

SEQ ID NO: 986 - DNA, 1395 bp, Klebsiella pneumoniae
tgcgctggagccgctgctgtgacctttaacgactggccctggcggcattggcgtcagcggcgcggagaggccctcgccttacgtctgaataaccagccgctgacctggcgggagctatgcgcgcgggttgacgcgctggcgtctggttttgccgcgcagggcgtaatggaagggcagggcgtggcgctccgggcctataaccagccggaaactctgctggcatggctggcgctgctgcagtgcggggcgcgggtgctgccgctgaatccgcagctgccagcggtgttgctgcaggcgttgttacccgcgttaaccatgcagcatcagctggtgctgaatggcgatgtgttgccggggaatttaccgatgttaaccctgcagttggtcgagggcgagcatgctgtttgctggcatggcgatcggttggtgtcgatgacgttgacctccggttcaatcggcctgccgaaagcggcggtacatagcgccagcgcccatctggccagcgcggctggcgtgctggcgctgatgccgtttgccgcaggagatgactggctgctgtcgctgccgttgttccatgtctccggtcaggggatcgtctggcgctggctgctggccggcgcgcgactcacggtacgtgacaaacagccgctggcgcagatgctgcacggctgtacccatgcttcgctggtgccgactcagctatggcgcctgctgaatgatgatgctgcggtttccctcaaggcggtgctgctcggcggcgcgtcgatcccggtcgaattgactgaacgggcgcgaaagcagggcatacgcagcttctgcggctatggcctcaccgaattcgcctccaccgtgtgtgccaaagaggccgacggcgctgcggatgttggcgaagcgctgccggggcgagaggtgaaaattgtcgccggcgagatctggctgcgggcgtcgagtatggccgcaggctactggcgggatggtcaattgttgtcattaaccaacaatgaaggctggtttgcgacgcgcgatcgcggagcattgcataacggtcggctgacggttgttgggcgactggataacctcttttttagcggtggagaaggtattcaaccggaagaggtcgagcgtgtgatactcgcccatccacaggtacagcaggtgtttatcgtgccgctggatgatgcggaatacggccagcgcccggtagcggtggtggaatgcgatgacggctgcgagttgagcgcgctggcggcatggagcgctgagcggttagcgcgttttcagcagccggtgcgttggctgcggttgccggaaacgttaaaaaacggcgggattaagatttcgcgccgggcgctgtgcgagtgggtcaggcagcagacgcatgcgaccgtatcgtag

SEQ ID NO: 987 - DNA, 1029 bp, Klebsiella pneumoniae
aaaaagatggcgcttattgacctttattttgtgagaaagaaaatgggaaaaaagaaaatattatttgatactcgttggataggtgagcatggtataggtagatttgctaaggaagttagagactcaaaattaactatacaggacttaaaactaccatggaaacctacaaatccgcttgatacaatattattgactatttatttaatttttaaaaaagatatctatttttcacctggatacaacgcgcctttttttttccttaaacgatctataatcacgattcatgatcttaatcatatagatattccttataacagttcctttcttaaaagaatttattataagtttgtgcttaaaagagcttgcagaaaagcgttatgtatactaaccgtatctgaattttctaagaagaggatttgtgaatggtcgggtcgaaacgcggatgaagtttttgtagtaggaaatggagtgtccaaagagtttcttataaatcacccaacacccaagaaagaacaaatattaatggttggtaacaggaaaaaacataaaaatgaattgaatgcactaatagctttttataagtcaaatataccctcatcggttaagctagtttttacaggttctattaccaatgaattagatataattatcgatcgtaacaggcttagggatagggtatcttttcttggtacagtatcaaatactaaacttgccgagttatatagagaatccttatttttgctatttccttcgttatatgaaggtttcggtctcccgatagtggagtcaatggcttgcggaactccagttataatctctaatagcacatctttacctgaagttgctggaggggctgctattattgtaaacccagatgatgtagaggatataaaagataaaattgaaaaattatatcatgatgcagaacttcaaaataaacttatcgaaaagggtcttttaaatattgaaagatatacctgggaaatgactcgcaataaatttgaaacaataatgaatagatatatttaa

SEQ ID NO: 988 - DNA, 249 bp, Klebsiella pneumoniae
cctttatcggcgggcgcagcagcgaccataacaccagcgagcgtttacgcggcttccacgatgcgcatcgcgagctggggcttagcgtgccgcaggcgaatattctggctcccggctattcgaaaggacacgttgaggactgcctgcaggagcggtttggcagcgcgaagacgttgttgcaggggatatttgttaactcgacgatatccctggaaggggttgtgcgctggctgtcgcaggtgggtctga

SEQ ID NO: 989 - DNA, 441 bp, Klebsiella pneumoniae
ccattaccggcgttgatctgctggcctatgccgacagtctcatcgcccgcttcagcaatccggcgctcaaacaccgcacctggcaaatcgccatggacggtagccagaagctgccccagcgcatgctcgatggcatccgcgtacatctggcgcgcgacagccgttggccgctgctggctctcggcgtggccggctggatgcgctacgtcagcggcacggacgacgccggtcagacgatcgacgtgcgcgatccgctggtcgacaagatccggcagcgggtggcccagagcgatgagcagcagcgcgtcgacgccctgctggggctggaggaaatatttggccgcgacctgccgcacaacgcccagtttgtcgccgggatccgcgccgcctggcaacagctggcgacgcacggcgcccgcgaggccgtcgcccgcgcgctga

SEQ ID NO: 990 - DNA, 294 bp, Klebsiella pneumoniae
tgctcgccggcttcaccggtaacgctaatcgcatgggccgccgaagaaaccatcatcacgcccgccagcgccataaaaatgctttttttcattatttactctatccagaaaattaaaatcaaagaagtcccgaaaaacctgaaaattctactgcgcacccatcaggaatcaatgacctggcgaaatgaattttcacaagagtgtaaccagttgcgtatttttacggcatcgagcgttgccagaaccacgaacagcctattcaacgccagtaatattcatgtttattatgattaa

SEQ ID NO: 991 - DNA, 774 bp, Klebsiella pneumoniae
ccagacacggcaaaggattataaaatgaaccactctgtctcctctatgaatacttccctcagcggtaaagtcgccgcgatcaccggcgcggcgtccggtatcggcctcgagtgcgcgaggaccctgctgggagctggcgcaaaagtggtactgatcgaccgcgaaggcgaaaagctcaacaaactggtcgccgaacttggcgaaaacgccttcgccctgcaggtcgacctgatgcaggcggaccaggtcgataacctactgcagggcattttgcagcttaccgggcgtctcgatatcttccacgccaacgccggcgcctatatcggcgggccggtggccgagggcgacccggacgtctgggaccgcgtgctgcaccttaatatcaacgccgccttccgctgcgtgcgcagcgtcctgccgcatctgatcgcgcaaaaatccggggatattatcttcaccagctcgatcgcgggcgtggtgccggtgatctgggagcctgtctataccgcgtcgaaattcgcggtgcaggcatttgtgcacaccactcgtcgccaggtggcgcagtatggcgtgcgcgtcggcgccgtactgccgggcccggtggttaccgctctgctggacgactggccaaaagccaaaatggacgaagcgctggccaacggcagcctgatgcagccgattgaagtggcggagtcggtgctgtttatggtgacgcgttcgaaaaacgtcaccgtgcgcgacattgtgatcctgccgaacagcgtggatctctga

SEQ ID NO: 992 - DNA, 285 bp, Klebsiella pneumoniae
tcgactgcggcgcgaaccaggctatccgccagccggggatgtttgcctcccatcctgcgcagacgatttctttgccgcgtccctcgcaggatattcctgcccgttggctggtctcaaccatcgaccaggcgctgggggcgctgcacgccggcggggtgcatattaactgtccgttcgctgaaccgctgtatggtgatatggatgagaccggcgtggagtggcagcagcagctcggcaactggtggcagagcgacaaaccctggctgcgccaggcgctgcagttag

SEQ ID NO: 993 - DNA, 756 bp, Klebsiella pneumoniae
gttaaggcggctaaggttgccgccgactgtcacaaaatcgcaatggctatgatgaaaaaccgaattcctttaatcctgctgcttaacatcgcgggtgtagcgctattttgctcctggtatctgccagccaaccatggcgcgtggttgccggtcgactccgcgatcttccatttctttaaccatggcgtcagcgtcagccatgcttatgcctggctgctggcgatcatcaacaatcgcgccttcgacgcctgttcgctgctggcgatgggctgcctgatgctgagctattggctaaaggcgccgactgcaggccgtcgtcagatcgccatcatgggcctggtgatgctgctggcggcggtgatcatcaaccagctcgcacaacacctgatgccggtacagcgcgccagcccgtcgctgttttttagcgatattacccgcgtcagcgacgtcgttaacttccccactaaggatgcgtcgaaggacagcttccctggcgatcatgggatgatgctgctgatcttcgccagctttatgtggcgctattttggccgtcgcgcgctgggcgtcgcgctgattatctttgtggtctttgctttcccgcgggtaatgattggcgcccactggtttagcgatattgccgtcggctccctgaccgccgtgctgatcggcgcgccctgggtattgatgaccccgctgagcgataaattgatcgcctttttcgatcgctacttacccagcagaatatcggccaaataa

SEQ ID NO: 994 - DNA, 741 bp, Klebsiella pneumoniae
gccatgaaggcgcttcgtgagccgctgtggtggcttatcgcgctgtttatcggcctgctggcagggctgccctacagcgcgccgctgttcagtcggctgttcccggagctgccgcggccggtctaccagcaggagagcttctgggcgctcactctcgatcacggctggctggtggtggcgtccagcctcgcggcaacggcaatcgggctgggggctggggtggcggtcacccggcccgccggcggcgcgtttcgtccgctggtggagaccatcgccgctatcgggcagacctttccgccggtggcggtgctggcgatggcggtgccggtgctgggctttggctggctgccggcgctgatagccctcgcgttgtatggcatactgccggtgctgcaggggacgctggccgggctgggttcgataccgccgggggtgtcaggtgtggctgaagggatgggaatgaccggctggcagcgtctgtataaggtggagctaccgctggcggccccggtgatcctggcggggatccgcacttcggtcatcgtcaatattggtaccgcgaccattgtctcgacggttggggccagtacgctcgggacgccgatcatcatcggcctgagcggctttaataccgcctatattgttcagggggctctgctggtggccctggcggcgattatcgtcgaccgcgcgtttgagcgtctgacccgctggatcagccgacaccgccacgcacaataa

SEQ ID NO: 995 - DNA, 1332 bp, Klebsiella pneumoniae
ttgcgtcgggccgcccggcggcccgcgcctgaggatattatgatgagcaacactctgctggagagcgtggtgaagaaaaaccgcgcccgcttaatcccctttatgctggcgttgtacgtgctggcgtttcttgaccgttctaatatcggtttcgccaaagagacctaccagctggataccggactcagcaatgaggcctacgcgctgggggccggtatcttctttgtggtctatgccttcctcggggtgccggccaatctgctgatgcgcaaatttggcgccaggcgatggatcggctgcaccacgctgctgtggggcgtgctgtcggcggcgatggcgtgggcggatacggaagcgaaattcctgctggtacgtaccctgctgggcgcggcggaggcgggcttctttcccggaatgatctacctcacttcacagtggtttccccagcaaaaccgcgccagcattatggggctgttttatatgggcgcgccgctggccctgacgctgggatcgcctttatccggtgcgctgctggagatgcatggatttatgggccatcccggctggttctggatgtttgtcattgaaggcctgctcgccgtcgccgcgggagcgttcaccttcttctggctggacgattcgccgcagcatgcccgcttcctgagcgcagcggagaaacaggcgctgataagcgagctggcgcgcgaggaggagaaaaagattgcctcgcgcctgtccgatgcgctgcgtaacgggcgggtctggcagctggcgctgatttatctgaccattcaggtggcggtctatggtctgattttcttcctgcccacccaggttgctgcgctgctgggcaccaaagtcggcttcgttgcctcggtggtgacggccatcccgtgggtggcggcgctgtttggcacctggcttatccctcgctactccgatcgcaccggcgagcgacgcaatattgccgccctgacgctgctggcggcggcggtcgggattgcagtgtccggactggtggcgccggtgctggctatcatcgcgctgtgcgtggcggcggtcggggtgatcgccgtgcagccggtcttctggacgatgccgacgcagctgctgtccggcacggcgctggccgcagggattggctttattaacctgtttggcgccatcggtggttttctggcgccgatcgtgcgcgtgcaggccgaaacgttgttcgccagcagcgccgccggactgttaaccctggccggcgtcgccattgtcggggtggtcattatcttttcattgagccttacccgcgcggtaccccagcgcggcagcgtacagcattga

SEQ ID NO: 996 - DNA, 894 bp, Klebsiella pneumoniae
tggtcaagggcgactatcattgaaacgctatataaaggagagcttatggtgctgttaccctggaccccgccctatgactgggcgtggatggttggttttctgcaggcgcgcgcggttgccggcgtcgagcgttttcacgatgggggctacagccgcagctttggcgtggaaggccaccgcgggctgattcatctggcgccggacgaagaggcgcagggcctgcgggtgaccctttccccgggactgcagccggtagcggagatctgctatgcgcgaattggccagctgtttgatttagcctgcgacccgcgacaggtcgctcgcacgctgggcgacctggcgcaggcgcggccggggctgcgcctgccgggggcgctggatgccttcgagcaggcggtgcgcgcggtgctgggccagctggtgagcgtggcgatggccgcccggctcaccgccaaagtggcggctggctggggcgaaccgctggcggaggcgcctggatatgtcttgttcccgacgccagaggcgctgtcccgtgccgatccgcaggcgctgaaggcgctggggatgccgctgcgacgcgcggaggcgctgatccacctcgcccgggcggcgctcagcggcgagctgcccctgacggcgccggcggatatcgacgccgggctgcgtcaactgcaaaccctgcccgggattggccgctggacggcaaactactttgccctgcgcggctggcaggcgaaagatatctttttgccggatgattacctgattaaacagcgctttccgggaatgaccccggccgccatcgcccgctatgcccgccgctggcagccgatgcgatcctacgcgctgttgcatatctggtataccgatgactgggcgccggcggcggaatag

SEQ ID NO: 997 - DNA, 1092 bp, Klebsiella pneumoniae
gggtacacttacagctggagacccgtcatgaaaccgatagttgccgataccgatgatcgccgctggcaggcggtctgcgaacgtgatacccgggccgatggtcagttcgtctttgcggtactgaccaccggcatctgctgtcgtccctcctgccgctcgcggcgcgcgcggcgggaaaacgtacgcttttttgccgacgtcgccgccgccgtggcggcgggattccgcccctgcaaacgctgccaaccggataaagactacccgcagcagcaaagggtcgacaaagtggcgcaggcctgtcggctgctggagcaggactcgcccctgaccctcgaggcgctggcaggccagctggcgatgagcccgtttcatttccaccgtttatttaaatccgtcaccggcatgacccctaaagcctggcaacaagcgtggcgggcgcagcgcctgcgggaagcgctggagcaggggataccggtgacccgcgccgcgctggcggctggttttcccgacagcagcagctattatcgccaggccgacgcagcgttagggatgaccgccagccagtttcgccgcggcggcgccgccaccgtggtaacctggaccacgggcgactgcgcgctgggtcgttgcctggtggcgcaaagtgaacgcggcgtctgcgcggtgctgccgggtgataacgatgcggcattgctcgacgacctgcgccggcgctttcccaatgccgagctgcgtgaaggcgaccctgatttttgtcagcagatgaccgagattttcgcccacctcgacgacagccggcggctggtatcgctgccgctggatctgcagggcactgcgtttcagctgcaggtctggcaggcgctgcggcagatcccggtgggcgagacccgcagctaccgccaggtggcagagcatattggccagccgcgggcggtaagagccgtggccggcgcctgcgcggcgaattcgctggcggtgattgttccctgccaccgggtggtgcgtgaagatggcgccctgtccggttatcgctggggaacggcgcgaaaagcgcagctgctggcgcgcgaggcccaacatgaggaggagtaa

SEQ ID NO: 998 - DNA, 426 bp, Klebsiella pneumoniae
gcccatcattattccctaacgataaggagcacctgcatgccattactgacatttgacctgattgaaggccgtacggaacaggaggtcaaaaccctgctggatgccgcccatcgcgccgtgctgcgcgccttcgaggtaccagaacgcgaccgttaccagattgttcatgaaaacaaagcccaccatatggtgattgaagataccggcctcggattgacccgcacgcgggatctggtggtggtgcgggtctataccagcccgcgcagcgaggcgcagaagcagcgcttcttcgccattttgcaggaggagctggcggaacactgcggcctgagcggcgatgatctgatggtgtcgattatcagtaaccagaaaggcgactggagctttggccgcggggtcgcgcagtatcttaccggcgatctgtaa

SEQ ID NO: 999 - DNA, 1167 bp, Klebsiella pneumoniae
gatggtggttatatgaaaacggacattaacattggtgtcgtggctgattggtttatcacttatgctggttcagaaaaggttgtcgctgagtttttaagtttatttcctaaatgcgagctttacgctgttgtggattttctctctcaagagaataaattacattttcagaataaagtaataacaactactttcattcaaaacttgcctaaagcacgtacaaaataccagtcatacttaccatttatgccactggcaattgaacagcttgatgtctctaagcatgatgtaatacttcttagtagccatgcagtcgctaagggcgtgcttacaggacctgaccaacttcacataagttatgttcattctcctattcgttatgcatgggatttgcaacatcagtacttgagagaggctggattgagtaagggagtgaaagctctcttggctcggtggatattacataaaataaggatgtgggattcccggactgcaaatggtgtagaccatttcattgctaattctaattttattgcgcgtcgtataaaaaaagtctatggcaggaatgcggatgttatatatcctcctgttgatgtcgacaacttcacatttcaagaagagaaggaagaatattattttacggcatctcgtttggttccgtataaacgtattgatttgattgttgaggcatttagttgtatgccaggaagaaaacttgttgttgtcggtgacggacccgaaatgagaaagataaaaaataaagcaacaaaaaacatagatattctaggctaccagtcaaatgaggctatgcgggagtatatgcaaaaagcaaaagcatttgtttttgcggccgaagaagattttggcattaccccggttgaggcccaggcgtgtggaacacctgttattgcctttggtaaaggtggatctttggaaacagtaagaccatatggagtaagcaatcctactggtattttatttgaaaaccaagatatacaatctataattaacggtgttgatttatttgaacgtgtatgcgatgaaattagtcctggagattgtagaaagcatgctgtaaaattttccattgatagatttcgtaatgaaataaatgattatgttctagaaaaatataacaaattcttagatgcgaaaaaaataaattattaa

SEQ ID NO: 1000 - DNA, 1824 bp, Klebsiella pneumoniae
cacggtattctgccgcctatgtatgcgcgcctccttctgaatctgctggctctgtttagccaggacgctaaggcggcaaccattcaagaaagcgtagccttcgcgattatcggcgaaccgaaatacgccgccggtttcagtcattttgattacgtcaatcccagggcgccgaaaggcggcaccctcaccctggcggcgatcggcacctttgataacttcaaccgttatgcgctgcgcggcaaccccgcggtacgcacggaggcgctctacgatcccctgttcaccacctcggatgatgagcccggcagctactacccgctgattgccgagcgggcgcgctatgccgaggactattcctggatggagatcgcgctcaacccgcgcgcccgcttccatgacggcacgccgatcaccgcccgcgatgtggcgtttaccttcaacaagtttatgaccgaaggggtgccgcagtttcgcctgttttataaaggcaccaccgtgaaggccatcgcgccgttgaccgtgcgtattgacctcggccagcccggcaaagagaacatgctgagtctgctgagcctgccggtgatgcccgaggcgttctggcgccagcacaaactcagcgacccgctgtcgaagccgccgctggccagcgggccataccgcatcagcgcctggcgaatggggcaatatattacctattcccgggtcgcagactactgggcggccgacctgccggtcaaccgcggtcgctggaatttcgatacgctgcgctatgactattatctcgacgacaatgtcgctttcgaagcctttaaagcgggagccgtcgatcgccgggaagagaccgtcgccaaaaactgggctacccgctacgtcggtcgcaacttcagccgcggctacatcattaaagatgagcataccaatacctcggcgcaggatacccagtggctggcgttcaatattcagcgcccgatttttgccgatcgccgggtgcggcaggccattaccctggcgttcgatttcgaatggatgaacaaggcgctgttttacagcgcctatcagcgcgccaacagctatttccagaacaccgaatatgccgcccgcagcctgcctgacgcagccgagctggccctgctgacgccgatgaaaaacgaactgcccccggagctcttcagccaggtttaccagccgccggtctcccgcggcgatggcttcgaccgcgccaacttactcaaagccgacgccctgctcaatgcggcgggctggacggtgaagaaccagcgccgggtcaacgccgccaccggcaagccgctgcgctttgagctactgctgccggccgggggcaatgaccgctgggtgctgccgtttcagcacaacctgcagcgtctggggatcgtcatggatattcgtcaggttgataattcgcagtacagcaaccgccgccgcagccgggattacgacatgatgccaagcctgtggcgcgccatgccctggccggggaccgacctgcaaatatcctgggcgtccgactatattcactccagctacaacgcgccgggggtgcaaagcccggtagtggataagctgattgcgcagatcctgcagtggcagggcaataagcagaaactgatccctctcggtcgggcgctggatcgtgtgctgacctggaataactacatgttgccgatgtggtatatggcgcaggaccgcaccgcgtggtggaataagttctctttccccgcgacccgccccatctattcgtccggcatcgatacctggtggtacgacgtgaacaaagcggccaccctccccgcggacagacgctaa

SEQ ID NO: 1001 - DNA, 876 bp, Klebsiella pneumoniae
gagatggcctacgtgacatcctcgatccccgtagtgaataatgcaccgctgctcgacgtgcgcgatttgtgcgtcgactttgttaacggtagcgcggtgacccacgccgtgcgcggcgtttccttccagctggggcatgagaagctggccattgtcggcgagtccggttcgggtaagtccaccgttgggcgcgcgctgctgcagctgcatccgaaaaaggcccgcgtcagcgccagccggatgcagtttgccgacctcgatctgcagcatcttagcgaagcgcagatgcgcggcgtacgcggcaaacgtatctcgatgattatgcaggatccgaaatattcgctgaatccggtggtctgcgtgggtaagcaaatcgccgaggcctggcttactcatcatcccgggcgcaaagatgaggcgaaagccagggcgctggagatgctggaggtggtgcgtattcgccagccggagcgcgtttatcagctttatccgcatgaaatatccggcggacagggacagcgcatcatgatcgccatgatgctgattaccgacccggagctgatcattgccgatgagcccacctccgcgctggacgtgtcggtgcgcctgcaggtgctgggcctgctggatgacctggttcagtcgcgcgggctggggctgatttttatcagccacgatatcaacctcgtgcgcagcttctgcgaccgggtgctggtgatgtacgccggacgggtagtggagtccatcgccgctaaagatctcgatcacgcccgtcacccctacactcagggattgattaactcgctgccggatatgcagcatcgtcgcccgatactgccggtgctgcagcgtcaggccagctggttaacggattaa

SEQ ID NO: 1002 - DNA, 1107 bp, Klebsiella pneumoniae
tcaattttatatttaatcccgcgcggcgtaacctttaggcagacaaaggagaaggttatgacagcactcactttacccaccaaacatcgttccctgtggcattttgtcccaggcctggcgctgaccgccgctatgaccggcgccgccctgtgggccggtagtttcccggccatcgccggcgcgggctttagcgccctgaccctcgctatcctgttcgggatggtcgtcggcaacacggtctacccgaaaatctggcagccctgcgacggcggggtgatcttcgccaagcagcatctgctgcgcctggggatcatcctctacggctttcgcctgacgttcgcccagattgccgacgtcggcgtgagcggtattttgattgacgttctgacgctctccagtacctttttcatcgcctgcttccttggccagaaagtgtttggtctcgataaacacaccagctggctgatcggcgccggcagcagcatctgcggcgcggcggccgtgctcgccaccgagccggtggtcaaagccgaagccagtaaagtgacggtcgccgtcgctacagtggttatcttcggtaccatcgccatcttcctctacccggcgatgtacccgctgctggcgcactggtttaccccggaaacctacgggatctatatgggctccaccatgcatgaagtggcgcaggttgttgccgccggccatgcggtcagcccggacgcggagaacgcggcggttatcgccaaaatgctgcgcgtcatgatgctggctccgttcctgctgttcttggcggcgcgtgttaaacagctgaccccggcaggcaacggcgagaaaagtaaaatcaccattccgtggttcgccattatgttcatcctggtggcggtgtttaactccttccatctgctgccgaaagccgtggtggatatgctggtgacgctggataccgtcctgctggcgatggcaatggccgccctcggggtcaccacccacgtcagcgcgctgaaaaaagccggggcgaaaccgctgctgatggcgctgatgctgttcgtctggttgattgtcggcggcggggtcattaacgtcgctatccacagcctgatggcataa

SEQ ID NO: 1003 - DNA, 390 bp, Klebsiella pneumoniae
gtttccgcatatggcgggcactgcttcgtcgctggcggggactttccgtttcggtatcggggcgattatcggcgcgctgctgtcgatggcgacgtttaccaccgcctggccgatgctggtctctattgccttctgcgcaacctgctctattttcttctcgctttacgcatcccggcggcgaaaaatcgcacgctaggtcacattttcaggggcgaaatcgcccctttcttgatgcatgtcaaccgcaatgggcttcagggttctgcgatttgtttcctttatgtaaaatcaattagtgtaaaaagtcgcattgttgcgataaaaaagttgttttggatcacagaaacgggtacatatagcgccaatcggctcgccgggtataaaaaataa

SEQ ID NO: 1004 - DNA, 1737 bp, Klebsiella pneumoniae
aaaaataaatacccgatggcgctgcgcttatcgagcctgcggcccggtagaccggataagccgaaaatgccgccatccggcaacatgtaccctacagtacaggcaaacagagatatgaaaaaaacctccttactgggagcgtgtattctcgcgctcgccatgtcgatggggagcggggaggcggtggcgaaaacgccgcccgaccagctgatcatcggcatgaatatgaataacctgctcacccttgacccggcggcgatgaccggtaacgaagtggtggggatcgtggtcaacctctacgactcgctggtggagcttgaccctgagcagctcaccaccgtcaggcccgcgctggcgaaatcctgggatatcagccccgacggcaaaaccctgacctttcatctgcgcgatgacgttaagtttcactccggcaacccgctgaccgccgccgacgtcgtgtggtcaatgcggcgcatcctgcacctcaacctggaccaggcctcagtatggaaatcctatggcttcagtaagaaaaatatcgacagccaggtcagcgcgccggaccgcttcacggtgcaaatcgtattacccaaagataacgatccgcagctggtgatttactcgctggcggcgctgggcaacctcggagtgctggacagtaaaacggtgcaaagccaccagcaggataacgactggggtaaccgctggctaaccacccatgaagccggttccgggccgtttatcctcgaaacctggcaggcgaaagatgtgcttcgcatgaagcgcaaccctgactactggcgcggcgaggcgaaaatgagccgcgtggtactgcgtcatttccaggagtcgcaaactctgcgcctgatgatcgaaaaaggcgaccttgatattgccaacaatatggcggtttccgatatcaacgccctgcgcagcgacccgcagctgaccgtcgatgcggtgcagcgcggcaccatgtactacgtggcgatgagcatgaaagaggcgcacttcgccaatccgaaagtgcgcgaggcggtgcgctatctgattgattaccaaggtatcaataaagcgctgatgccgggctacggcgtgctgcaccagcggcctatcaaagcgggaatgccgtccacgctacccgatcccggctacaggctggacgtggcgcgggcgaaaaagctgctggcggaagcgggatatcccaacggctttgataccacgctgcgggtactctccgatcagccatttcttaacatcgctatcgccgtgcagtcgacgctgatgcaggcggggattaacgccaaaatcatcaccggcactggtaaccagatctacggcgcaatgcgcgagcgtaaatttgacctgctggtaggtcgcggcggcagcgggatggagccgcatccgcactccagcctgcgcgcgctggtctataacccggataacagcgataaggcgcgcctgaccaacttccagggctggcgtaccggtttttacgacccgcaactgaatacgatgattgaccaggccctgctggaacgcgatccgcaaaaacaggtggctgactaccaggccatccagacacgctacgaccagctggttccggctttaattccgctttcgcagatggttgattcggtcgtcgtgcgcaacgaggtacgggagtatcagccgcacccctccgccaccacttttctgcgtgacgtctataaagtccgcgaaggagagaaaggatga

SEQ ID NO: 1005 - DNA, 489 bp, Klebsiella pneumoniae
tctggcgaatacgggcgcgcttctcggccggcagggtcgccagcagccgtccggtcaggttgcgcggcagatgctgcagcaggtaaacctgttcatcgatatccagcggctgcatggcctgcagcagctcggggtcgctcatcttgtcgatcaggtcgccccagacgttctctgaggcctccagcagcacttcgccgcgtttatcgtcgggcaccaggcaccatagcgcggtgcgggcgtcatagggaagcgcttccagcgcatcggcgagatccggcggcggcagatgcgagaccagcatttccacttcggccaggtcatcggccagcgtcccttcatcatagcgctcagccagcgtcagtttgcccagcagcgcggaagtcaccgctttatcggtgctcaagagccaaatcagacgggcgcgctcttcgtcacgcaagcgggcgctttttttatgcaaaacggacatcgatcgggcaatccttttga

SEQ ID NO: 1006 - DNA, 1521 bp, Klebsiella pneumoniae
ttttatactctggactctatgcaatgtagagtccacctattttctccagaatatttcccgccctttttatctacccgtgtcgatgagggaattatgacgcatttttcaaaaaacgtaagttgtagcgtggcgttggctttggcggacttcgttagctttgtgctttcgttgtacttggcattaggagtactttcggtaactctacctgatttccatcagcgagttccaaaaaaccaaatagaggggtggattggactgcactggttattaggggcgtgttgcgtagtatggtatggtgttcgtttacgtcattatttttaccgtaaaactttttggttcgaattaaaagagatattacgtactctggctatttttgcagtaatagaaatggctgtgatggcatttgccaactggtatttttccaggtatgcatggcttttgacttggctttttgcagctgcgttggtgccttttgtaaggatgtcagtcaaatatgtgctaaatacttttgggctttggatgcgtgatacctggattattggtagcgggaagaatgcacaggaggcatataaagcaattaatagtgaaaataatctggggttaaatgtagttggatttatcagcaatgctgaggataataaattaggcatgatgattgatggtattcaagttattcagtctgatactacttggataaaaaatattgataaaagggcacagttcattgttgcagttgagtcccaccaaagtgatatccgtaataaatggttgcgcgaatttatgattcgtggatatcgctatgtatcggtaattccaactctacgcggtatgccattagatagcactgacatgtcattcatctttagtcatgaagtaatgatatttcgagttcagcaaaatttagctaaatggtcatcgagaattcttaagcgtacatttgatattgttggggctctgggaataattcttcttctttcgccattattaatttatattagtagaaaggtaagaaaggacggcggtacagctatatacgggcatgagcgtgtaggtaagggtggtaaaccatttaaatgcctcaaattccgttcaatggttgtaaattctaaagaagtattagaagagctgttggcaaatgatccagaagtaaaagcagaatgggatgcaactttcaaactgaaaaacgatcctcgcattactagtattggtcattttttacgtaggacaagtttggatgaacttcctcaattgttcaatgtgcttaaaggggagatgagtttagtagggccacggccgatcattacagcggagttagagcgatataacgatgaggtcgactactatctattaagtaaacctgggatgactgggctatggcaggtgagcgggcgtagtgatgtcgattatgatactcgtgtgtacttggatgcgtggtatgtaaaaaactggtctatgtggaatgatatcgcaatcttgttcaaaaccataaatgttgtattaaaaaaagatggcgcttattga

SEQ ID NO: 1007 - DNA, 1773 bp, Klebsiella pneumoniae
cagcaacagtatatggtgactctacgtcagccctaccgagaaaaagtctcccagatggttagctgggggcactggttcgccctgttcaacatgttgttggctatggtgctcggcagccgctacctttttgtcgccgactggccgacgacgcttgccggacgactgttttcgtacgtcagtctcgtcgggcatttcagctttctggtgtttaccagctatgtgctgatcctctttccgttgacctttatcgtggtctcgcagcgcctgatgcgcttcctgtcggtgatccttgccaccgccgggatgacgctgctgctgatagacagcgaggtttttacccgcttccatctgcacttaaacccggtcgtctgggagctggtcatcaaccctgaccagaatgagatggcgcgcgactggcagctgatgtttatcagcgtcccggtcatctttttgattgaaatgctcttcgctacctggagctggcaaaagctgcgcagcctgacgcgccgccgccattacgcccgcccggtcgcctggttcttctttttgtcgttcgtcagcagccacctggtctatatctgggcggacgccaatttctatcgcccgatcactatgcagcgggcgaatctgccgctctcctatccgatgaccgcccgtcgtttccttgagaaacatggcctgctcgacgcccaggattatcagcgtcgtctggtggagcaaggggcgccggaggcggtatcggtccagtatccgcttagcaacctgcgctaccgtgacctcggcgcgggctacaacgtgctgctgatcaccgtcgacaacctgaactactcgcggtttgaaaagaccatgccggcgctggcggcatttgccaaagaaaacgttaactttacccagcatatgagctcgggcaataccgccgacagcggcctgtttggcttgttctacggtatttcgcctggctatatggacggtgtcctctcggcgcgtattcccgccgcgctgattaccgccctcaaccagcagggctaccagctgggcctcttctcctccgatgggtttagcagcccgctgtatcgccaggcgctgctctccgatttctcgctgccgagcgcgaagacccagagcgacgagcagacggccaatcagtggatcggctggctggcccgttacgcgcaggatgagaatcggtggttctcgtggatctcgctcaatggcaccactttcgacgacacgcagcagcagggctttgtccgccgctacagcaaggcggcaggcgacgttgatgcccagatcgatcgggtgctgactgcgctgcgcgaagccggcaaactcgataatacggtggtaattattaccggcggccacggcaagccgctgaatgcgaaacacgacgcgttcgactggtcgcgcgagcagctgcaggtgccgctggttattcactggccgggcacgccggcgcaggagattgccaccctgaccgataacaaagatgtgatgactacgctgatgcagcgcctgcttcacgtttcgacgccggccaatgagtactcgcagggagaagatctgttcagcgccgcgcggcgtcgtaactgggtcaccgcggccaacggcgatacgctggccatcaccaccccgaccatcaccgtggtcctcaaccataacggcacctataccacctggagccgcgacggcgagaaaattaaagatcagaaaccgcagctcagtctgttgctgcaggtcctgactgacgaaaaacgctttatcgctaactga

SEQ ID NO: 1008 - DNA, 396 bp, Klebsiella pneumoniae
accgggcggtattcaaccaccgccgggtggccgacgcaactggcgccacacatttcgacgtcgttaacgtcgattgatgcgcttttgcgccgcggcgaaaaaatgcggaaaaaaagctgctgctacggtaatatgttgccctttcacgaacaaacagattttgagtttatgccgcaaatttcccgctatagcgatcaacaggtcgaacagttgctcagcgagctgacgaacgtcctggaatcacacaaagccccggtggacctttcactgatggtgttaggcaatatggtgaccaacctgatcaacagtagcgtcgcgccggcgcagcgtcaggccatcgcccgttctttcgcgcaggctttgcaatcttcgattaacgacgatccagcgcattaa

SEQ ID NO: 1009 - DNA, 1239 bp, Klebsiella pneumoniae
gatctaaggtatttttgccgggtaacgctacgcttacccggcctacgtttgtgtaggcccggccaacccattcctgccgggcaatacagttcaacaggactcacttcaatggcatacaccactttttcacagacgaaaaacgatcagctgctggaacccatgttttttggccagccggttaacgtggcccgctacgatcagcaaaaatacgacatctttgaaaagctgattgaaaagcagctctccttcttctggcgtccggaagaggttgacgtttcccgcgatcgcatcgactaccaggcgctgccggaacatgaaaaacatattttcatcagcaacctgaagtaccagacgctgctcgactccatccagggccgtagcccgaatgtggcgttgctgccgctgatctccatcccggagctggagacctgggtagaaacctgggccttctccgagaccattcactcgcgttcgtacactcacatcatccgcaacatcgtcaacgacccggcgaccgtgttcgacgacatcgtcaccaacgagcagatccagaaacgtgcggaaggcatctctcactattacgattcgctgatcgagatgaccagctactggcatctgctgggcgaaggcacccacaccgtcaacggcaaaaccgtgaccgtgaatctgcgcgagctgaaaaagaaactctatctgtgcctgatgagcgttaatgccctggaagcgatccgcttctacgtcagcttcgcctgctccttcgcctttgccgaacgcaaactgatggaaggcaacgccaaaattatccgcctgatcgcccgcgatgaagcgctgcacctgaccggcacccagcatatgctgaacctgctgcgctccggcagcgacgatccggaaatggcggaaatcgccgaagagtgcaagcaggagtgctatgacctgttcgtgctggcggctcagcaggagaaagagtgggcggactacctgttccgcgacggctcgatgatcggcctgaataaagatattctctgccagtacgtcgagtacatcaccaatatccgcatgcaggcggtgggcctcgatctgccgttccagacccgctccaacccgatcccatggatcaacacctggctagtctccgacaacgttcaggtggcgccgcaggaagtggaagtcagttcttatctcgtcggccagatcgattctgaagtcgatgccgacgatctgagcaacttccagctgtaa

SEQ ID NO: 1010 - DNA, 1461 bp, Klebsiella pneumoniae
  unsure (796),(829): Identity of nucleotide at the above locations are unknown.
ttaagttatctgacctgtccaatgaaattgatattaaataaaagcgtgctggcggcattgcccctggccatcgcgctggctggctgcgcgccatctcatgaggttgctaatccgccgcagcagcaaattccagcctcccatgtttccatggatctccctgccgccgtgaaaaatggctggccgcagactgactggtggaaagattaccatgacccacagcttaataatctgattcagcgagcgttggccaacgcgccggatatgcagattgccgaacagcgcatcaggcttgccgaagcgcaggcgcgaatgtcgcaggcgaatcttggcccggagatggatttctccgccgatattgaacgccagcgcatgtcggccgaaggcctgatgggaccgtttgctaccgacaccgacggcaataccggcccgtggtacaccaacggtacctttggcctgaccgctggttgggatctcgatctgtggggcaaaaaccgtgcgctggtgaaagcgcgtatcggcgagctgaaagcccaggttgctgaacaggcccagacccgtgagctgctctccggcagcgtggcgcgtctgtactggcagtggcagacggaagcggcgatcaaagcggtgctgcagcaggtgaaaaacgagcaaaataatatcgtgacggtcgacaaggccctgtatcagcgcgggatcactaactccgccgaaggggcggagaacgatattaacgtcagcaaaaccgaccagcagctggcggacgtgacgggcacgatgaaagagattgaagcgcggntgatggccctgaccaacagccagagccagtcgntaaacctcaaacccgccagcctgccaacggtcagcgcgcagctgccagataccctcggctatgagctgctggcgcgccgcccggatctgcaggtcgcccactggtatattgaagcgtccctgagcgaagtggacgcggcgaaagcggcattttatccggacatcaatctgatggcgttcctgcagcaggatgccctgcacttaagcgatcttttccgccattcggcgcagcagatgggcgttactgccgggttgacgctgccgatctttgacagcggccgccttaacgccaacctggatatcgccagcgcgcagaatagcctgtcgatcgcccagtacaacaaagcggtggtggatgccgttaaccaggtggcgaaaaccgccagccaggtcgaaacattaatggccaaaagccagcagcagcagcaggttgaaaaagacgctcagcgggtagtggatctggcgcaggcccgaatggcggcggggatcttacctggctccagagtcagtatggcgaagctcccggccctgcaggagcggatcaccgcattgcgcctgcacggccagtggattgatgctagcattcaactgacctcggctctcggcggcggctaccaccagacggtgaagtaa

SEQ ID NO: 1011 - DNA, 558 bp, Klebsiella pneumoniae
  unsure (77),(78),(79),(80),(81),(82),(83),(84),(85),(86),(87),(88),(89),(90),(91),(92),(93),(94),(95),(96),(97),(98),(100),(102),(103),(104),(105),(106),(109),(110),(111),(112),(113),(114),(115),(116),(118),(119),(120),(121),(122),(123),(124),(125),(126),(127),(128),(129),(130),(132),(133),(134),(136),(137),(138),(139),(140),(141),(142),(143),(144),(147),(148),(149),(150),(151),(153),(154),(155): Identity of nucleotide at the above locations are unknown.
agtcccgttcaggaccgattttcaacgaattcgactacattcacgtttgagtgcggtttgttgtgtcgggtgggggnnnnnnnnnnnnnnnnnnnnnntncnnnnnttnnnnnnnntnnnnnnnnnnnnntnnncnnnnnnnnnccnnnnncnnnccccctcccccccccccctctcctctccccctcccccttcctcctcctctcctctctccttccctccctccctctcttttttccttttcctcttccccctccctttccccccccttcctcccctcccctcctctctcctcctcccctcctcccccttcctctcccctcttcccctctccctctccctcccccttctccccttcttccctccccttcttttcccccccccctccctctctcttctccttcccctcttctccccctcttcttctttcccctcctctttctccctctcctcccctcctccttcttcttctctctccttcctttcttccctcttcttccctctcctcttcccctctttcttcctctcctccctcctccttctcctctctctcctctc

SEQ ID NO: 1012 - DNA, 198 bp, Klebsiella pneumoniae
tccgcagttcatttaactgcgtctatcttagtacaactgtacgagtatattcgaactatttttgctatcattacgattgggcaggttgcggcggcgcgcgtggtatcagaaccggagtttgggtatagtagccgccagccgccgatatgggctgcggctgcgatgcgccgcgccaccgccgacacaggattattatga

SEQ ID NO: 1013 - DNA, 2454 bp, Klebsiella pneumoniae
cgtcaaaatcaacccttgtactcaaaagattccttactaaaatactcaccatatagcgtttcttttatcgacaaccccctacatatagtatttatccacagagttagtcacaacggccttctgtggataaacgggggatattttctttcacggacaggtaaaatccacatgaatcagagtctgctggtgacaaagcgcgacgggaccaccgagcgcatcaatctcgacaaaatccatcgcgtactggattgggcggcagaaggactgaataacgtttcgatttcccaggtagagctgcgctcccatatccagttctatgacggcatcaaaaccgcggacatccacgaaaccattattaaagccgctgcggatctgatctcccgcgacgcgccggattaccagtacctcgccgcgcgtctggcgattttccatttgcgtaaaaaagccttcggtcagtttgagccgccggcgctctacgatcacgtggtgaagatggtcgagaaaggtaaatacgatcatcatctgctggaagactacacggaagaagagttccagcagatggacggtttcctcgaccactggcgcgacatgaacttctcctacgcagccgttaagcagctggaaggcaagtatctggtacaaaaccgcgtcaccggcgaaatttatgagagcgcgcagttcctctatattctcgtcgccgcttgcctgttctcgaactatccgcgcgaaacgcgtctggactatatcaagcgtttctacgacgcggtgtccacctttaaaatctcgctgccgacgccgatcatgtccggcgtgcgtaccccaacccgtcagttcagctcctgcgtgctgatcgagtgcggcgacagcctggattccatcaacgccacctccagcgcgattgtgaaatacgtttcccagcgcgccggcatcggcatcaacgccgggcgcattcgcgcgctgggcagcccgatccgcggcggcgaagccttccacaccggctgcattccgttctacaagcatttccagaccgcggtgaaatcctgctcgcagggcggcgtacgcggcggcgcggcaaccctcttctacccaatgtggcatctggaagtggaaagcctgctggtgctgaaaaacaaccgtggtaccgacgccaaccgcgttcgtcacatggactacggggtacagatcaacaagctgatgtacacccgtctgctgaagggcggcgatattaccctgttcagcccttccgacgtcccgggcctgtatgacgccttcttcgccgatcaggacgagtttgagcgcctgtacacccagtacgagcaggacgacagcattcgcaagcagcgtattaaagccgttgagctgttctcgctgatgatgcaggagcgcgcctctaccggccgcatctatatccagaacgttgaccactgcaacacccacagcccgttcgatccggtagtcgccccggtgcgtcagtctaacctgtgcctggagatcgctctgccgaccaaaccgctggaagatgtcaacgacgaaaacggcgaaatcgcactgtgcaccctgtcggccttcaacctcggggctatcgacagcctcgacgagctggaagagctggcggtgctggcggtgcgtgctctggatgcgctgctcgactatcaggattaccccatcccggcggctaaacgcggtgcgatggggcgtcgtacgctgggtatcggcgtgatcaacttcgcttactatctggcgaagcatggcaaacgctactccgacggcagcgccaacaacctgacgcacaaaacgttcgaagcgattcagtactatctgctgaaggcctctaacgagctggctatcgagcaaggcgcctgcccgtggttcaacgaaaccacctatgcgcagggcatcctgccgatcgatacctataagaaagatctggacggcatcgtcagcgaacccctgcactacgactgggaagcattgcgcgagtccattaaaactcacggcctgcgcaactccacgctctccgcgctgatgccgtccgagacctcgtcgcagatctccaacgccaccaacggcattgagccgccgcgcggccacgtgagtatcaaagcgtccaaggacggtatcctgcgccaggtggtgccggattacgaaaacctgcagaacgcctacgagctgctgtgggagatgccgaacaacgacggttatctgcagctggtgggtatcatgcagaagtttatcgaccagtcgatctctgccaacactaactacgatccgacgcgcttcccgtccggaaaagtgccgatgcagcagttgctcaaagacctgctcaacgcctataaattcggcgtcaaaacgctgtactatcacaacacccgtgatggcgctgaagacgcccaggatgacctggccccgtccatccaggacgacggctgcgaaagcggcgcttgtaagatctaa

SEQ ID NO: 1014 - DNA, 237 bp, Klebsiella pneumoniae
agcacatgtctgattgtgcggagctatcaggggcagatatcgttgtatgcagaagccgctcatttaatctacaatctctccagtatgctccaatgccagattcaattcgaaaagatttattacctgaaaaagcagttttctcgcctggagatattgagcgagactttttcagggcatttatatggtggccatgggacaaactattccgacgtgaatttattattcagcactcgttga

SEQ ID NO: 1015 - DNA, 450 bp, Klebsiella pneumoniae
gagatggcccaactaatgtttgattcaattttaatcgtatgcacggggaatatttgccgctcaccgattggtgaacgattattacgccgggcattaccaaataagaaaattgattctgccggagtcggagcgctgatagaccacgcagctgatgcttctgcaattcggacggctgagaaacatggtctgtcccttgaaggccataagggaaggcaatttactcctgctctaggagggcagtacgatttagtattggtaatggagcgtagccatctagaacaggttagccgaattgcaccagaagtccgaggcaaaactatgctgtttggtcactggttggaaggcaaagagatcccagatccttatcgtaaaagcgacgaggcatttgattctgtatatcagttaattgacattgccagccagcgttgggctgccaaattgagtggataa

SEQ ID NO: 1016 - DNA, 681 bp, Klebsiella pneumoniae
acgttttgccagaagatagcaaaactcgcgaaatccgcttgcctgaacgcccgggcgcgagtagttttacgcgatatttttgactcgttaagtgacaggattactgcaatgccaagagcgaatgaaattaaaaaaggtatggtgctgaattacaacggcaagctgctgattgtgaaaaatattgatattcagtcacccagcgcccgcggtgctgcgacactgtataaaatgcgtttctccgatgtgcgcaccggcctgaaagtagaagagcgcttcaaaggcgacgatatcgtcgataccgtcaccctgacccgccgtttcgtcgacttctcctacgtcgatggcaacgaatacgtgttcatggataaagaagactataccccttacacctttaccaaagagcagattgaagaagagctgcagtttattccggaaggtgggatgccagacatgcaggtgctgacctgggacggccagctgctggcgctggagctgccgcagaccgttgacctggaaattatcgaaaccgcgccgggtattaaaggcgcgtccgccagctcccgcaccaagccagccaccatgagcaccggcctggtgattcaggtgccggaatacctgaccaccggtgagaaaatccgcattcatatcgaagagtgccgctatatgggccgcgcggattaa

SEQ ID NO: 1017 - DNA, 1305 bp, Klebsiella pneumoniae
tctgttcgccatcggctcattgctcggcgggttcgatgccattcagctcggctgtggcggcggcgtctgcgccgttaccgcgctgcacgccgccagacagatccacgcccttgccggaggccggccatgaacgatacccgttttgaaagctgcattaagtgcacggtctgtaccaccacctgcccggtaagtcgggtcaatccgcgctatcctggcccgaaacaagcggggccggacggcgaacgcctgcgtctgaaggatggcgcgctgtacgacgaggcgctgaagtactgcattaactgcaagcgctgcgaggtcgcctgcccgtcggatgtgaaaattggcgatatcattcaacgcgcccgggcacagtacggccagcaaaagccgacccttcgcgacgccatcctcagccataccgacctgatgggtaccctttccaccccctttgcccccctggtcaacgccgccaccggcttaaaaccggtgcgccgtctgctcgacgcgacgctcaacatcgatcaccggcgtacgctgccgaaatatggtttcggcaccttccgccgcgcttaccgccagctcgccgcccgtcagaagcagtacagcgaacaggtggctttctttcatggctgctacgtcaactataaccatccacagttgggtaaagatctgattcgcgtcgtcaacgcgctgggtaccggggtgcagttgttatcaaaagaaaaatgctgcggcgtaccgctgatcgccaacggttttttcgacaaggcgcgtaagcaggcgcagagcaacgtcgccgcgatgcgggaaaacacgctaccgatcattgccacctcctcgacctgcgcctttacgctacgtgatgaatacccccatctcctcgatgtcgataacagcgatcttcgcgatcgggtcgagcttgccacccgctggatctggaaacagctggctgccggcaggacgctaccgctgcgcccgctgccgctgaaggtggtctatcacaccccgtgtcatatggaaaagatgggctggtcgctgtataccctcgagctgctgcggctgatccccggcctgcagctagaggtgctggattcacagtgctgcggcatcgcaggcacctacgggtttaaaactgagaattacgcggtatcccaggctatcggcgccccgctgttccgtcagattgaggagagcggggccgacctcgtcgtcaccgactgcgagacctgcaaatggcagattgagatgtccaccagcaaacgctgcgagcatccgctgacggtgctggcgcaggcgctcgtctga

SEQ ID NO: 1018 - DNA, 1167 bp, Klebsiella pneumoniae
aagagacaacagatgaaaagtaaaaaaatattgatcgtaggtgctggcttctctggtgcagttatcggtcgccaacttgctgagaagggacatcaagtccacattatcgatcagcgtgatcatattgggggaaattcctatgatgcacgcgactctgaaacgaatgtgatggtacatgtttatggaccccatattttccatactgacaatgaaacagtgtggaactatgtcaataagcatgcagagatgatgccctatgtgaaccgggttaaagcgacagttaatggtcaggtattttccctacctattaatttgcatactatcaatcagtttttctcaaaaacttgttcgcctgatgaggccagagcgctcattgctgagaaaggggacagcactattgctgatccacaaacttttgaagagcaagcgttacgctttattggtaaagagttatatgaggccttttttaaaggatatacgattaaacagtgggggatgcaaccctcggaactgcccgcatctattcttaaacgtcttcctgttcgttttaactatgatgataattattttaaccacaaatttcagggcatgccgaaatgtggttatacgcagatgattaagtccattctcaatcatgagaatatcaaggttgacttacagcgggaatttatcgttgaagagcgaactcattacgatcacgtattctatagcggtccattagatgcgttttatggctaccaatatggccgtctgggctatcgaacattagattttaaaaagtttacctatcagggtgattaccagggctgcgcagtgatgaactattgttctgttgatgtcccctatactcgcatcactgaacataaatatttttctccctgggaacaacacgacggctctgtttgttataaagagtatagccgtgcttgcgaagaaaatgatattccttactatcctattcgtcagatgggagaaatggctcttcttgaaaaatatttgtcactggccgagaatgaaaccaatatcacttttgtcggtcgtcttggaacctaccgttaccttgatatggatgtgaccatcgccgaagcattgaaaacggcagaagtctatttaaattcactcactgaaaatcagccaatgcctgtgtttacggtttctgtacgatga

SEQ ID NO: 1019 - DNA, 1524 bp, Klebsiella pneumoniae
cgtcggcagcaataccgtcctccgtcgacgcaacaggagtggatcgtgaaattttggcgcccgggtattaccggcaagctgttcctcgctatattcgccacctgcatcgtgctgctgatcagcatgcactgggcggtgcgcattagttttgaacgcgggtttatcgactatatcaagcgcggcaatgagcaacgcttaaccatgctcagcgacgcgctgagcgagcagtatgcccagcatggcagctgggcgtttctgcgcaataatgaccgctttatcttccagttgctgcgcaccttcgaacgggataacgacgaccgctcgccgccggggcacgccatgaagccggacgccgctccggacgggccgccgccggatggcccccctgacggcccgcgcccgaggccggaaatgccgccccacggctggcgcaccatgttctgggtggtagatcagtcggggcgcgtgctggtggggccgcgtgagcgcgtcccggaggacggcacccagcgcagcatcgtggtcaacggcgcggaggtgggcaaagtgatcgcctcgccggtagagcggctgacgcgcaataccgacattaacttcgaccggcagcaaaagcgcaccagctggctgatcgtcgcccttgccaccctgcttgccgcgctggccactttcccgttggcccgcggtctgctggcgccggtgaagcggctggtggaaggcacccataagctggcggcaggcgacttttccacccgcgtgacggtgaccggcggcgatgagctcggccgcctggcgcaggattttaaccagctcgccagcaccctggagcgcaaccagcagatgcgtcgcgatctgatggccgatatctcccatgagctgcgtaccccgctggcggtgctgcgcggcgagctggaggcgattcaggatggggtccggcgctttacccccgagtcgattccctctctgcaggccgaggtggctactctcaccaagctggtggacgacctccatcagctgtcgatgtccgacgagggggcgctggcctaccagaaaacctcactggatatcatcaccctgctggaagtggcggcgggcgcttttcgcgagcgcttcgccagccggcagctaagcattcaggtgtcgctcccggagcaggcgatgatcttcggcgaccgcgaccgcctgatgcagctcttcaacaatctgctggagaacagcctgcgctataccgacagcggcggcagcctgcacattaccgcccgccgcagcggccgcatgctggtgattgacttcgccgacagcgcccccggcgtcagcgatgagcagctggcccgcctgtgcgaacgcttttaccgggcggaaggatcgcgcaaccgcgccagcggcggctccggcctcgggctggcgatttgcctcaatatcgtagcggcccacggcggcaccctgcgtgccgaccattcgccttttggcggggttagcattaaagttgagttacctctggaacatgatttaccgagagacgtatga

SEQ ID NO: 1020 - DNA, 1020 bp, Klebsiella pneumoniae
aatggcaagcactggatttttaaaaagtgtaagcaaaacgcggcgcaagtcttgtgccgcttgcgttgcagcgacggtgatgcgtattttgggagcaatctgaagcaggggagaatcggcatgttcaggctggaagatctgaccttatttgtccgcgccgcggcgctgggcagttttagcgacgcggcgcgcgaggccgggcagcagccggcgcaggtcagcgcggcaattaagcgtctggagacgatcctcaatattcgcctgtttgcccgttcgacccgcagcctgcgcctgacgccggagggggagacctggctgccctacgccacccagatgctcgataccctcgaggccggtctgcagaagatccagaccccggatgatgaagttcgcggcatgttgcagattgccgtgccgtcggacctcgggcgtaacctgctcctgaccctgttccgcgatttccgccaacgccacccggcgctgcgcctgcggctgctcttttccgatcagctgaccgacgtgtttaaagatccggtggacgttgcgtttcgctatggcaataacgacgatgcctcgtttatctcgctgccggtggcgccggaaaatcgtcgggtgctggtggcctcgcctgagtggatcgcccgccatggcgaaccgcagaccctcgaggaactcagccagcacaatgcgttgatctacattttgcgcggccgtccgttcgaccgctggtcgctgagcctcgacggcgtggttcagcagcagaaggtttccggcacggtgatgagcgacgacgccgaggtgatccgtcggctggcgatcgccggggagggcattgcctataaatcgatgctcgacgtcagcgacgatctgcgggcggggcgcctgcggcgcctgctgccgcgttatcagggggatgtggtgccgttgaatctgatttgtccgcaccgcaaacagctctctgccgcggtgcgtttgttatatgaagaggtgaaatcacattgtgaagggcttaatgcctga

SEQ ID NO: 1021 - DNA, 1227 bp, Klebsiella pneumoniae
gccttaaagcatgttaactgtgtcattctgcgttttgtcccgaaaaaattagcaacgaccatactggtctttaatacgaataatgtcgtcctcgccgaggtacgaccccgactggatctccagcacttccagcggaatgcggcccgggttttccaggctgtgctcggcgccaatcggaataaaggtggactggttctcggtcagcaggaactgcttgccgttgacggtcacctggccggtgccggcgagaatgacccagtgctcggcgcggtggtgatgcatctgcatcgagaaggcgccgcccggtttcaccgtaatgcggttgacgttgaagcgcggggtctggaccaccacgtcgcagcggccccagggacggtaaatctcgcggtggcgcttgtactcgctgcgctggttctgcttgaggaactcgaccgccttcttcacgtcctgggaacgctcacggttcatcaccagcacggcgtccttggtgctgacaatcaccaggttctccacgccgatggccgccaccagcttctcgtcgctgttgatgtagcagttttcgctgttgtgcacccacgcgtcgccgctgaggacgttaccctgcccgtctttcgggctgacctcccacagggcggaccaggagccgacgtcgctccagtcggcatcgagaccgaccaccaccgcgtcggcggttttctccatcaccgcgtagtccacggactcgtccgggcactcgcagaaaatgtcatgcggaatgctgatgaagtcgctgccgttgtcggcggcattgaccgcggcctggcaggcttcgaggatatccgggcggaatttggccagctcggaaaggtattttttggcgcggaacataaacatgccgctgttccagtagtactctccggaggcgaggtaggcctcggcgcgggcgcggtccggcttctccacgaaacgggccacctggtacggggtgtgggcgctgtcggtgagggccactccgcgctggatatagccgtagccggtttccggggcattcggcacgataccgaaggtgaccagatggcctccatcggcatactgctcggcgacacggatggcgttgtggaagaccggctggttattgatgatatggtcggcggcgaggaccagcatcagcgggtcctcaccgtgacgggtggcctcaagagccgccagggcgatggccggggcggtgttgcgcccgaccggctctag

SEQ ID NO: 1022 - DNA, 1476 bp, Klebsiella pneumoniae
aattatttcctttatattttcaaagtctttaatgataatggaaagttatgtctaaaaacaaaacgttgtctggaggggtctgcttggtttatcattagtaatctatttcctgctataagtgctcttttaatattttctttagcttcaagattaatatccccatcagagttaggaacagtagctctagcaacaactattgctacggtgcttactagtttatgtgcagtaggtttcggagatgcattaattcaatgtaaagagataaccaaaagacatctgaatacggtttttacagtatgcatttgtgtttcattatttgtctatgttatctctgtaaccttgattgagacaatcaacctagatgcctttactcatttatttagggtggtttatcccttaactgcgtctaaaataatactagattcttgtgcaatcgtaccattaagttatttaacacgaacaatggaatttaaatctattgcattaaggacgatgtattgctctcttgcctcttttattttatgtatccctattctttattacggaggaggggtgtgggcaattgtcgtcagccaattgacgacatcagctgtaagttttttaatattaattaaagcagccaatcttaaattaagagttgcttttcatcgtaaggaatttaatgaattaaaaaaatttggattgacgtcaacaattactaagttgattacgtctatcagtgttgataatctcatgattggcttttatggtaatgcaattacccttggtttatatgcttttagtcgacgtatttttggagttatttctgacgtattaaataatgccattgcgaacgtttcttatcctttatatgcatccaaacaagataatcttaatgagttaaaaatcattttcctaaaaacaacatttctttcagcacttatcagtttgcctgcattttgtggtttgatactgatttcgccgtatctgattcctatggtttttggtaatcaatgggagcccgctatctctgttgttcaagtatgtagtgctattggttttatttcctgtattggtgcattacaaatgtcattgataaagggattaggtcatacttcttggatactcaagtatcaaatagcacaacaagtttcaactgctatattggtactgatttttgcaaaggatggagcatatatagtaatgttagctatagcaataaaaactttttctatctggcctttttctatgcgctatgtatcaaaaatattgggagtaggtatagtcgattatatgaggaactttgttaaaccaattttagcggtttcggcaatgattacagtttgtgttataattgaatgtattacaaaagattatggctcgttagttattctgttgagcgttattttagggggcgttatttcctatatattaagtgcctttttattggcaagaaaggaaacctttgattttataaaggcaattaaaaaaagatag

SEQ ID NO: 1023 - DNA, 1434 bp, Klebsiella pneumoniae
ttcataattaatcaatcagttagcgataaagcgtttttcgtcagtcaggacctgcagcaacagactgagctgcggtttctgatctttaattttctcgccgtcgcggctccaggtggtataggtgccgttatggttgaggaccacggtgatggtcggggtggtgatggccagcgtatcgccgttggccgcggtgacccagttacgacgccgcgcggcgctgaacagatcttctccctgcgagtactcattggccggcgtcgaaacgtgaagcaggcgctgcatcagcgtagtcatcacatctttgttatcggtcagggtggcaatctcctgcgccggcgtgcccggccagtgaataaccagcggcacctgcagctgctcgcgcgaccagtcgaacgcgtcgtgtttcgcattcagcggcttgccgtggccgccggtaataattaccaccgtattatcgagtttgccggcttcgcgcagcgcagtcagcacccgatcgatctgggcatcaacgtcgcctgccgccttgctgtagcggcggacaaagccctgctgctgcgtgtcgtcgaaagtggtgccattgagcgagatccacgagaaccaccgattctcatcctgcgcgtaacgggccagccagccgatccactgattggccgtctgctcgtcgctctgggtcttcgcgctcggcagcgagaaatcggagagcagcgcctggcgatacagcgggctgctaaacccatcggaggagaagaggcccagctggtagccctgctggttgagggcggtaatcagcgcggcgggaatacgcgccgagaggacaccgtccatatagccaggcgaaataccgtagaacaagccaaacaggccgctgtcggcggtattgcccgagctcatatgctgggtaaagttaacgttttctttggcaaatgccgccagcgccggcatggtcttttcaaaccgcgagtagttcaggttgtcgacggtgatcagcagcacgttgtagcccgcgccgaggtcacggtagcgcaggttgctaagcggatactggaccgataccgcctccggcgccccttgctccaccagacgacgctgataatcctgggcgtcgagcaggccatgtttctcaaggaaacgacgggcggtcatcggataggagagcggcagattcgcccgctgcatagtgatcgggcgatagaaattggcgtccgcccagatatagaccaggtggctgctgacgaacgacaaaaagaagaaccaggcgaccgggcgggcgtaatggcggcggcgcgtcaggctgcgcagcttttgccagctccaggtagcgaagagcatttcaatcaaaaagatgaccgggacgctgataaacatcagctgccagtcgcgcgccatctcattctggtcagggttgatgaccagctcccagacgaccgggtttaa

SEQ ID NO: 1024 - DNA, 1251 bp, Klebsiella pneumoniae
tgtttatataatgtaattcaatttactactaatggtatttttatggctcatgaaaaaagtgatataattgtttcggtcgttattcctgtttacaacgccgaagagtatattgcagatactctaaaaaacattgtttcacagtcattgtatgaaattgaaattataataatcaatgatcattcgagtgataatacattagatatccttaaggagattgcatccagcgatgaaagaatacgaattattgataacgctgtaaatattggagctggcatatcacgtaatataggtctttcagaagcaaagggagaatatataatatttcttgatgatgatgattatgtcgatacgaacatgttgaagcacatgtctgattgtgcggagctatcaggggcagatatcgttgtatgcagaagccgctcatttaatctacaatctctccagtatgctccaatgccagattcaattcgaaaagatttattacctgaaaaagcagttttctcgcctggagatattgagcgagactttttcagggcatttatatggtggccatgggacaaactattccgacgtgaatttattattcagcactcgttgagctaccaagatttaagaacatcaaatgatctgttttttgtgtgtgcatctatgcttagtgccgaaaaggtaactattcttgatgaaatattgattgctcatacgattaatcgaaaaacatcattgtcttcaactcgctccgtttcctatcattgcgcacttgatgctcttgttgctctaagggattttctttttaaaaatggcatgatgcaaaagcgacaaagggatttttataattacattgtcgtattccttgagtggcacttaaatacgctatcgggtgaagcctttaataaactgtttcaagatgtcaaattattcatcagcagttttgatatcaataatgaagacttttatgatgagtttattctttctgcttatcgacgaatcgctgatatgtctgctgaagagtatcttttttctttaaaagatcgggttcttaatgaattagaggatgcccaacgaaatattttgaccttacaaaacgaagttgaggagataaaacagcagcttcaacaaaaggacgaaatgattgcttctatgaatagggagaatttagctattaaagcagataataaaattctcgaaaattacaatgaagaactaaagactgttcaaacaaagtttcttaaactactctcaagcaaagactag

SEQ ID NO: 1025 - DNA, 1149 bp, Klebsiella pneumoniae
aaggcatataacaaacagagggttaataacatgaaagttaaagtactgtccctcctggtaccggctctgctggtagcaggcgcagcaaatgcggctgaaatttataacaaagacggcaacaaattagacctgtacggtaaaattgacggtctgcactacttctctgacgacaagagcgtcgacggcgaccagacctacatgcgtgtaggcgtgaaaggcgaaacccagatcaacgaccagctgaccggttacggccagtgggaatacaacgttcaggcgaacaacactgaaagctccagcgatcaggcatggactcgtctggcattcgcaggcctgaaatttggcgacgcgggctctttcgactacggtcgtaactacggcgtagtatacgacgtaacgtcctggaccgacgttctgccggaattcggcggcgacacctacggttctgacaacttcctgcagtcccgtgctaacggcgttgcaacctaccgtaactctgatttcttcggtctggttgacggcctgaactttgctctgcagtatcagggtaaaaacggcagcgtcagcggcgaaggtacttctccgaccaacaacggtcgtggcgctctgaaacagaacggtgacggcttcggtacctctctgacctatgacatctatgatggcatcagcgctggtttcgcgtactcgcactccaaacgtaacggcgatcagaatcgtttggataaaggccgtggcgacaacgctgaaacctacaccggtggtctgaaatacgacgccaacaacatttacctggcgactcagtacacccagacctacaacgcaactcgtttcagcggcaacggagaatctgattctattagcggttttgctaacaaagcacagaacttcgaagtggttgctcagtaccagttcgacttcggtctgcgtccgtccgtagcttacctgcagtctaaaggtaaggacatcgaaggttacggcgaccaggacctgctgaaatatgttgacgttggcgcgacctactacttcaacaaaaacatgtccacctatgttgactacaaaatcaacctgctggacgaaaacgatttcactcgtcgcgctggtatctctaccgacgacgtggttgcactgggcctggtttaccagttctaa

SEQ ID NO: 1026 - DNA, 408 bp, Klebsiella pneumoniae
gtgggcaataaccccaagatcgtgggtgaccatcaggtaagtgagcttagcctcccgctgcaattctgccagcaggttaaggatctcagcctgcaccgacacatccagcgccgacgtcggctcatccagcagcagcacctgaggctcaagaatcagcgctctggctatcgccacgcgctgccgctgcccgccggagagctgatgcggatagcgctcgcgaaaggcgcggttgagaccaactttatccagcagcacattgatccgccggtcgcggtcgttgatacgatggatctgcagcggctcttcgaggatatcgccaatggtgtgacggggatgcagcgatccgtaggggtcctgaaataccatctgcacctgacggcagcgctcgcggctaatttcatgccctaa

SEQ ID NO: 1027 - DNA, 1182 bp, Klebsiella pneumoniae
ttaaagtgtaatcgaatgaaaattactatttccggtacaggttatgttggtttatcgaacggtgtcctgattgcgcaaaaccacgaagtggttgctctggatatcgtacaggccaaagtggatatgcttaaccagaagatctctccgattgtggataaagagattcaggaatatctggcagaaaaaccgttaaatttccgtgccaccacggacaagcacgacgcctatcgtaatgccgactacgtgattattgcgacgccgaccgattacgatcccaaaaccaactacttcaacacctctacggtggaagcggttattcgcgatgtcactgagatcaacccgaacgcggtgatgatcattaaatcgaccatccctgtggggttcacccgcgacatcaaagaacgtttagggattgataatgttattttctctcctgagttcttgcgtgaaggccgtgcgctgtacgacaacctgcacccgtcacgcattgtcattggtgagcgctctgcgcgtgccgaacgtttcgctgacctgctgaaagaaggcgcgattaagcaggatatcccgaccctgtttaccgactccaccgaagcggaagcgatcaaactgttcgcgaacacctatctggcgctgcgcgttgcctatttcaacgagctcgacagctatgctgaaagccaggggctaaacagcaagcagattatcgaaggggtatgcctggatccgcgtatcggcaaccactacaacaacccgtcctttggctatggcggctactgcctgccaaaagataccaagcagctgctggcgaactacgaatcggtcccgaacaacattatcgcggctatcgtcgatgccaaccgtacccgtaaagactttattgcggattctattcttgcccgcaagcctaaagtggtgggtgtgtatcgcctgatcatgaagagcgggtcagacaacttccgtgcctcttctattcagggcatcatgaagcgcatcaaggcgaaaggtatcccggttattatctatgaaccggtgatgcaggaagatgagttcttcaactcccgtgtcgtgcgcgacctggatgccttcaaacaagaggcggatgtgatcatttctaaccgtatggcggaagagctggctgatgtggcagacaaggtttacacccgcgatctgtttggtaatgattag

SEQ ID NO: 1028 - DNA, 801 bp, Klebsiella pneumoniae
attcaacgtaacggaggccattcaatgctggcaaaacggataatcccctgcctcgacgtccgcgacggccaggtagtgaaaggcgtgcagttccgtaatcacgagatcattggcgacatcgtcccgctggccaagcgctatgccgacgaaggggccgacgaactggtgttctatgatatcaccgcctccagcgacggtcgggtggtcgacaagagctgggtgtcgcgggtggcggaagtaatcgatattcctttctgcgtggcgggcgggatcaagtcgctggaagacgcggcgcagatcctctccttcggcgccgataagatctcgattaactcccctgctctcgccgacccgacgctgatcacccgccttgccgaccgctttggcgtgcagtgtatcgtggtggggattgatacctggtttgacgcagagaccggcaagtatcacgtcaaccagtataccggcgatgagagccgcacccgggtgacgcagtgggaaaccctcgactgggtggaggaagtgcagaagcgcggcgcaggcgagatcgttctcaatatgatgaaccaggacggggtgcgcaacggttacgacctgcagcagctggcgaaggttcgcgcggtgtgccacgtcccgctgatcgcctccggcggcgcgggcactatggaacacttcctcgaagccttccgcgacgccgacgttgacggcgcgctggcggcctcggtattccacaaacagattattaatattggcgaactgaaagcgtacctggcggcacagggcgtggagataagggtatgttga

SEQ ID NO: 1029 - DNA, 768 bp, Klebsiella pneumoniae
aatataagtaattcctatgatttgagcgatgaagcgatgttgagtgttattcctgcggggatattttcacggctgcggattttccttggccgcctgaagccgcacgcgctgccggtggcccgccggcatatcgtgctgggatccattggcgccggcaccggactggcggtgaccagcatgttcagccactggctgctcggcgaagtcaatctgtggtttattgccccgatgggggcctcggcggtactcctgtttggcgtaccgagcagcccgctggcgcagccgtggtcgattgtcggcggcaacgtgctgtcggcgctgatcggcgtcacggtgggtatgctggtccccgatgcggcgctggcctgcggtctggcggcggctctggccatcgccgggatgtattttctgcgctgtctgcatccccccggcggcgcggtggccctgacggcgatcctcggcggcgccggggtgcacagcgaaggctatcactttgtgctgaccccggtgctcctcaactcgctgatgctggcgctgctggctattgtgtttaataacctggttggccgccgttatccgcatccgctggcggcggaggaggtcaaatccagggcggtgccgctgggtatttcggtcacccgggaagatattcacgccgcgctgctggaaggccagttcctcgacattgatgaagacgatgtccaggagttgctggagaatatcgagcagcaggcgcggcagcgtatcgcgacggcagcccgccgctaa

SEQ ID NO: 1030 - DNA, 1911 bp, Klebsiella pneumoniae
tcattgggtaatataatgaacaatagcgttaaaatctataccagccaccataagcctagtgcttttcttaatgctgcaattatcaaacctctgcatgtcggcaaagctaattcttgtaatgaaatttgttgtccaggagatgacagtggcgataatatttcctttaagaatccgttttattgcgaactaactgcgcattattgggtttggaaaaacgaagagctggcagactatgtcggtttcatgcactatcgccgtcatcttaatttttccgaaaaacaaactttttctgaggatacctggggggtcgtgaaccatccatacattgatgaagaatatgagaagatctttggattaaacgaagaaacaattcaacggtgtgtcgaaggtattgacatcttgctgccaaaaaaatggtctgtcactgcggcgggaagtaaaaataattacgatcactatgaacgaagtgaatacttacacattcgtgattatcaggctgccattgccatcgttgaaaaactatatccagagtatagcacggcaataaaaacgtttaatgatgccagtgatggctattacacaaatatgtttgtcatgcgcaaagatatttttgttgactattctgagtggctcttttccattctggataatctcgaagatgccatctcgatgaacaattataatgcccaggaaaaacgcgttattgggcatatagctgaacggctgtttaatatttacataattaagctgcaacaagatggtgagcttaaggtaaaagaattacagcgtacctttgtcagcaatgaaacattcaatggtgcactgaatccagtttttgattctgcggttccagtggttatcagtttcgatgataattacgcagtcagcggtggtgcattaattaattccattgtccggcatgcggataaaaataaaaattatgatatcgtcgtactcgaaaacaaagtaagctatttgaataaaacgcggttagtaaatctaacctcggctcatccgaatatttctcttcgtttttttgacgttaatgctttcactgaaataaacggtgtgcatacccgagcgcattttagcgcatcaacgtatgcccgtctttttattcctcaactgttcagacgatacgataaagtcgtatttattgattcggataccgttgtaaaggctgacctgggtgaactgcttgatgtccctctgggcaacaatttagttgcagcggttaaggatatcgtcatggaaggttttgtaaaattttctgcaatgtcagcatcagatgatggcgttatgccggcaggcgaatatttacagaaaaccttaaacatgaataaccctgatgaatattttcaggcagggattattgtttttaatgtcaaacaaatggtcgaagaaaatacttttgctgaattgatgcgggtattaaaggcaaaaaaatactggttcctcgaccaggatatcatgaataaagtattctactctcgagtcacatttctgccattagagtggaacgtttatcatggtaatggcaacacggatgatttcttccctaatcttaagtttgcaacgtatatgaaatttttagcagctcgcaagaagcctaaaatgattcattatgcgggtgagaacaaaccatggaataccgaaaaagtcgatttttatgacgactttattgaaaacatcgctaacactccatgggagatggaaatctataaacgtcagatgtcgttagcggcttcgattggtttaacccatagcgagccgcaacaacaaatcttgttccagaccaaaatcaagaacgtactgatgccttatgttaataaatatgcaccaataggcacgtcaagaagaaacatgatgactaaatattattacaaagtacgccgtgctattcttggataa

SEQ ID NO: 1031 - DNA, 186 bp, Klebsiella pneumoniae
cgccgctgtttacaggtacttgcatatcttgtcatggtaaaccaagtgatcccaaccgcaagccagtgtaaaatcggcacttatgtagaacgggatatccacaccccggaggaaaaatatgaagtttttggtcactggtgccgcaggttttatcggcttccatatcgcgcagcgcctgctgaatga

SEQ ID NO: 1032 - DNA, 930 bp, Klebsiella pneumoniae
aaatcagccaatgcctgtgtttacggtttctgtacgatgaaatatacggcattgatagtgacattcaatcggctcggtaaactgaaaaaaaccgttgaagagaccctcaaacttgaattcactaatattgttattgtcaataacgggtccacggatgggacccaagcctggctttcgtcaattgttgatacacgagtcattgtattaaccctcaccgagaataccggaggggcggggggctttaaaaccggtagtcagtatatctgtgaacagctggcaagtgattgggtatttttctacgatgacgatgcttacccctatccagacacgttgaagtccttttcacagctggaaaagcggggatgtcgggtatttagtggactggtgaaagatccgcaaggaaaaccgtgtccgatgaatatgccgttctcgcgtgtaccaacctcccttggcgacactgtacgctatttacgctaccctgcagagtttatcccggcagctaatcgttctatgttcgtacaaacggtttcatttgtagggatggtcatacatcgtgatctgctcacgaccagtcttgaccacatccatgaacagctctttatctactttgatgatctttactttggctatcagctatcattagctggtgagcaaattatgtatagcccggagttgcttttttatcatgatgtgagtattcagggcaaacttattgcacctgaatggaaggtttactatctatgccgtaatttgatcctgtcgaagaaaatattccagaaaaatgccgtgtatagcaattcagcgatagcgatacgcatcctaaaatatatattaatcctgccatggcaacgtcaaaaatattcctatatgaaatttattcttcgtggaatttcacatggcataaaaggtattagtggtaagtatcattaa

SEQ ID NO: 1033 - DNA, 921 bp, Klebsiella pneumoniae
cccgaggacaaaatcatgaccgtttctctggattcgccgctttcgggtggtgcgggcgaaggccgtcagcggctgcaacgcgcggcggcgcgggccgtcgggtttatcggcaaaatggcgcgcaatccgctcacggccatcggcggaggaattatctttatgctgctggtggtggcgattttcgcgccgctgattgcgccttataacccgctggtacaggacctgaatagtgcgctggtcgcgccgaatgcgcagcactggttcggcaccgatgagtttggccgggatatctttagtcgcctggtgtacggctcccgcatcacgctctatatcgtgctgctggtctcagtgaccgtcggtccgctcggactgctgctgggcgtcagtgccggctatttcggcggtaaagtcgatatggtgctgatgcgcgtcaccgatattttcatctccttcccgagtctggtcctggcgctggcgtttgtcgccgctttaggaccggggctggagcacgtggttatcgccatcacgctgaccgcctggccgccgatagcccgtctggcgcgcgccgaaacgctctctctgcgccaggctgattttatttccgccgtgcgtctgcagggcgcttcatcggcccgcgtcctctggcgccatatcgtgccgctgtgtctgccctcggtcattatccgtatcaccatgaatatggccgggatcattctgaccgcggccggcctcggctttctcggcctcggcgcgcagccgccagagccggagtggggagcgatgatctccagcgggcgcacttatatgatggagtgctggtgggtcgtaaccattccggggctggcgattttgatcaatagcttagcgttcaacttcttaggagatggcctacgtgacatcctcgatccccgtagtgaataa

SEQ ID NO: 1034 - DNA, 948 bp, Klebsiella pneumoniae
gcgaagcgcaaaagaactgagggaagcgggatgaagatggcaacgacatggtccggcgcgctggcgctggccgccctgataagtttaccgctgcaggcggcggagccggtgaaggtcggctcgaaaattgataccgaaggcgcgctgctgggcaatatgatccagcaggtgctggaaagccacggcgtaaaaacgattaataaaatccagctcggcaccacgccggtggtgcgcggggcgattgtcgccggcgagctggatatctacccggaatataccggcaatggcgccttcttcttcaaagatgaaaacgacccggcgtggaagaatgcccaacagggctatgagaaggtgaagcgcctcgatcaggagaaacatcagctggtatggctcaccccggcgccggccaacaacacctggactatcgccgtgcgccaggacctggcggagaaaaataagctgacctcgctggccgacctcagtcgctacctgaagcagggcggcgaatttaagctggcggcttcggcggaatttattgagcgcccggacgcgctgccggcgtttgaaaaagcgtatggcttcaacctcaaccagaaccagctgctgtcgctggccgggggcgatacggcggtgaccatcaaagcggcggcgcaacagacctccggcgttaacgcggcgatggcctacggcaccgatggcccggtggcggccctggggttacagacgctgagcgacccgcagggcgtgcagccgatatatgccccgacgccggtggtgcgcgaggcggtgctgaaggcctacccgcagatcgccgactggctgcagccggtcttcgccagcctcgatgaaaaaacgctgcagcagctgaacgcccgcattgcggtggagggccaggatgcgaagcgcgtggcggcagattatctgcagcagaaaggcctgctgaagtaa

SEQ ID NO: 1035 - DNA, 618 bp, Klebsiella pneumoniae
catgaattaaattcatgtatcttcatctgtcaggagtcaactatgcacgttgtaagccgctacaccgccgcggaagccgcggcaacgatcgacccccgcggccgcgctatcgcccttagcgtggtcatcgccgccggggccttgctgttaatcatgcccccggttatcggggtgaccggcacgctgagtctgctgacggcgctgattgcggcctttagcgtcgggtggggattcacacgcggacaatcctggctttatcgctcacccctggcggcgacgcgctgggcctttctgctgtcagcggccggctggctgctggcgctggtggcctggtatggcgggcaggactggccggcactgctgccgggcgtggcgtgcggtggggcgggagcggctgtcgcctggcgcattgcggcgggtaggacggcgctgccggggatgcgagtcagcggcgccacggtgctgagcgtagctatcgccatcgcggcgacgctgctgacctggcatactgcggggggaggacgccatggcgtctgctttgccttcgccgtgctgcttgactgggcgctgctcggcgcgctgatggtgcggatccgccagcaggagagtgcggcctga

SEQ ID NO: 1036 - DNA, 528 bp, Klebsiella pneumoniae
cgtgtctccctctctggaatggtgagtaaaatgcgtctacttcttgcagttttattttgttctgtcatgttgccttctgcttatgctgaaaaactgcctgcgccgacaggaaaacctgtactgaccatttccggaaaaatcggaaatatgaatgtcggcgacaaggccgtttttgatctcgcaatgctggaaaaactggggatgaagacgatagaaaccaccaccccctggtacaccggcaaggttcgttttgacggtattccccttagtaaactcatggatttagtcggcgcgaaaagcacatcggcccgcgtgctggcgctgaacgactacaccaccattatcccgattgatgatttttataaattcccggtcattatggcgttaaaaatgaacggtcaatatatgcgcattcgtgataaaggcccgttatttattgtctacccttacgacagcagtgctgaattacagaaccagatctattattcccgatcggcctggcaagtttcaaagatgattatagaataa

SEQ ID NO: 1037 - DNA, 1548 bp, Klebsiella pneumoniae
caaggaataaaaatcgccatgttactaccctggctaatattaattccctttatcggcggcttcctgtgctggcagaccgaacgctttggcgtgaaagtgccgcgctggatcgcgctgattaccatgggactgacgctggtgcttggcctgcagctgtggatgcagggcggctattctctgacgcaatccgcgggtattccgcaatggcagtcggaattcgtgctgccgtggatcccacgcttcggcattagcatccatctggcgatcgacggcctgtcgctgctgatggtggtgctgaccggtctcctcggcgtgctggcggtgctctgttcgtggcgtgaaatcgaaaaataccagggcttcttccacctcaacctgatgtggatcctgggcggcgttatcggcgtgttcctcgccatcgacatgttcctgttcttcttcttctgggaaatgatgttggtgccgatgtacttcctgatcgcgctgtggggccacaaagcctcggacggtaaaacgcgtatcacagcggccaccaagttcttcatctatacccaggcgagcggtctggtgatgctgattgccattctggcgctggccttcgtccacttcaacgccaccggcgtgtggaccttcaactatgaagatctgctgaaaaccccaatgtctcacggcgtggaatacctgctgatgctcggcttcttcatcgccttcgcggtgaaaatgccggtggtgccgctgcacggctggctgccggacgctcactcccaggcgccgaccgccggctctgtcgacctcgcggggatcctgctgaaaaccgccgcctacggtctgctgcgctttgcgctgccgctgttcccgaatgcctccgccgagtttgcacccatcgccatgtggctgggcgtgatcggtatcttctacggcgcgtggatggccttcgcccagaccgatattaaacgcctgatcgcctacacttccgtgtcccacatgggcttcgtgctgattgctatctacaccggcagccagctggcctatcagggagcggtgatccagatgattgctcacggtctgtccgcggcgggtctgttcattctgtgcggccagctgtacgaacgtctgcacacccgcgatatgcgccagatgggcggcttgtggagcaaaattaaatggctgccggcgatgtcgatgttcttcgctgtcgccaccctggggatgccgggcaccggtaacttcgtcggcgaatttatgatcctgttcggcagctataaagtggtgccgacgatcaccgtcatctccacctttggtctggtattcgcgtccgtttactcgctgtcgatgttacatcgcgcttacttcggtaaagcgaagagcgaagtggcggcgaaagagttgccggggatgtccctgcgtgaactgtctatcatcctgctgctggtggtgctgctggtgctgttgggcttcttcccgcagccgatcctcgacacctcgcatgctgcgatgagcaacattcagcagtggtttgttaattctgtttctactacaaggccgtaa

SEQ ID NO: 1038 - DNA, 1278 bp, Klebsiella pneumoniae
caccgctccctctttttttataagctgcgaactttttttatgcctccagtttctgaccccgccgcttccggcaacctccgtcccatcctccgctccccgtctttactgacgcgcgaagtgctggccggcgtgctcaccgccctggcgctcatccctgaagtgatttcgttttcagtcattgccggcgttgacccgcaggtaagcctgattgcttcggtggtgctctgcctggcgatgtcagtcttcggcggacgcccggcgatggtcaccgccgccgcgggctcggtggcgctggtgattggcccgatggtgcatcagcacggcgtggggtacattttaccggctgtcattctggcgggtattattcaaattttgtttggtctgtgcggcatggcgcgcctgatgcgctttattcccccggcggtgatgaccgggttcgtcaacgcccttgggatcctgattttctttgctcaggtgccgcatttctggagtcgacaaccgctaatcgttggcctgttcgtcctgacgctgcttatcgtcctgtgggcgccgcgcgttattaaggctatcccggcgccgctgatcgccatcgtcgcgctcaccctctataccgcgaccaccggccagcagctgccgaccgtcggcgatgaaggctcgatgagcggtggcctgccggggttcaccgccctgaccgttcccctgaacctgaccaccctgcagataatctggccgtgcgccctcagcatcgcctttgtcggcctgatggagtccttgctgacggctaagctggtggatgatctcactcataccccgtcgaacaaatcgcgggaaagcgccgggctgggtatcgccaatatccttgccggctgctatggcggcatcgccggctgcgcgatgatcggccagactatcgtgaacgtggaaatgggccgggcccgcagccgcctctcaacggtaatcgccggcctggtgctgctcctgctggtgacagcgctcagccaggtgatggcgaagatcccgatggcggttctcgccggggtgatggtgatcgtggcggtgaagacctttagctggcgcagcattcgcccgggtgagctggcgcgtaatccgtggccggaaacgctggtgatgctggtgaccgtcgccgcgacggtgggaaccagcaatctggcgatcggtgtgctggcggggattgtcgcgatggcgatcatcccccgccgcctgcgggcaaaagcgcaggctacattagaaacagcgtcgccagacccagaaaaataa

SEQ ID NO: 1039 - DNA, 1770 bp, Klebsiella pneumoniae
atagagacaaaaaaagggccgaacagtcggcccttttttattgcggtaggattatgccgctttttcaacttccgctgtttgcgcctcagggcgtttcagcaccgcgtatgcaaggcccgccaccagcgttccggcaacaatcgccagcaggtagcccagcaccggcgtaatcgcccccgggatcagcagaacaaacagcccgccgtgcggcgccatcagtttcgcgccgaccgccatggagatagcgccggttaccgcgccaccgacgatacagcacggcagaacgcgcatcgggtcacgggcggcaaaaggaatcgccccttccgagataaagcacaggccaagaaccagcgcggctttgcccccttcccgctgccctttgtcgaacttattgcgcgctaccagcgtcgcgatacccatcgccagcggtggcaccataccggccgccatgatcgccgccatcggcgcataggtctgggtactcagcaggccaacgccaaaggcataggccgctttgtttaccggcccgcccatatcggtacacatcatcgcgccgaggatcgcgcccagcagaaccgcgttggcggtgcccatggtttgcagccaatgggtcagccaggcgaggataccggctaccggtttaccgatcagatagatcattgccaaacccacgatcagactggagaccagcggaatgatcaggattggcttcagggcttccatactctgcggcagtttcagcttcgtgctgatggctttcgccacataaccggcaaggaaaccagcgatgatcccgccgataaagccggagccgccgctaaccgccagcataccgccgataaggcccggggtcagacccggacggtcggcaatggagaaggcgataaagcctgccagtaccggcaccatcagcgcgaaggccgagccgccgccgatctgcatcagcgccgccgccagggtgtctttcacttcaaacgctttgatcccgaaggcaaaggagagcgcgatacacaggcccccggccactaccatcggcagcatataggagacgccggtcagcaggtggcgataggcgcccgccgactcttttttcccttcagcagccgcctgaggtttgccggatggctggtacggtttggcttccgccaccgctttatccagctcctgggcggttttcttcagcgccagaccggtggtggtgcggtacatcggcttgccggcgaatttcgccaggtccacctcgatatcggcagcgacgatcaccagatccgcctcggccacctcttccggggtgatggcattgcccgccccaacggagccgcgggtctccaccttcacccaccagccgcgttttttggcttcggtttcgatggcttctgccgccataaaggtgtgggcgacgccggtcggacaggcggtgaccgcgacaatgcgtttctgcccctgagcggcggccggaacggctaccgccgctggcgcaacgtagggcttagcgtggtctttcgcttctcccaggaacagctccggatgggcgacagcacggttaatatcgcccaggtaaacgtttttaccattcagcgcgctatcggccggcagcgcggttcccagcacgatggccagttcggcgtcattcgggttatcaatcagctcaaggtgcgctttcggcgccgcggcacccagcagggttttcgccatgtaggcgcgcgcctgtccgagtccggcatcaataatcagcagcgttttcattatgcctctcctgctgtcaattaa

SEQ ID NO: 1040 - DNA, 1113 bp, Klebsiella pneumoniae
cgcccacaaaaacgccgtaacgctgcgcgttgccgccctgaaggagcaagcatgagcattgaagatttagcccgcgccaacgtccgcgcgctgaccccgtatcaatccgctcgccggctgggcggcaaaggcgacgtctggctcaacgccaacgaattccctaccgccgtagccttccagcttaccgaacagacgctaaaccgctatccggagccgcagccgaaggccgtgattgagagctatgcccgctacgccgaggtcaaaccggagcaggtgctggtcagccgcggcgccgacgaaggcatcgagctgctgatccgcgccttctgtgagcccggcgaagacgcggtgctctactgcccgccgacctacggcatgtacagcgtcagcgccgagaccatcggcgtcgagtgccgcaccgtgccgacgctggccgactggcagctcgacctgccgggcatcgaagcgcggctggacggcgtgaaggtggtcttcgtctgcagcccgaacaacccaaccgggcagattatcgacccgcagtcgatgcgcgacctgctggagacgacccgcggcaaagccatcgtggtggccgacgaagcctatattgaattctgcccgcaggcgacgctcgccggctggctcagcgactatccgcacctggtggtgctgcgcacgctgtccaaagccttcgccctcgccggcctgcgctgcggtttcaccctcgccaacgccgaggtgatcaacgtgctgctgaaagtgatcgccccgtacccgctctccacgccggtggccgatatcgccgcccaggccctgagcccggaggggatcgccgcgatgcgccagcgcgtggcgcagatccttgacgagcgccgctacctggtggaacagctgcgcggcatcgcctgcgtggagcaggtcttcgattccgagaccaactatgtgctggcgcggataaccgcctccagcgcagtgtttaaatctttgtgggatcagggcattatcttacgtgaccagaataaacaaccttcattaagcggctgtttgcgtatcactatcggtacccgtgccgagagccagcgcgtgattgacgccttgactgcggagaatgtatga

SEQ ID NO: 1041 - DNA, 1971 bp, Klebsiella pneumoniae
tgcaggcaaaacctgagcgcgacgcccaccggcgtggttctcgggtttttttattttttactactcagtcgccggttgtctgcgggcagcggcagtaaggaaaagagcatggaatataaagcactcgcgcaggatattctcaaccgcgtcggcggcaaagagaacattgtgagtctggttcactgtgcgacacgtctgcgttttaaactgaaggataacggcaaagccgatgccgaagggctgaaggccaatccgggcgtgattatggtggtggagagcggcggccagtttcaggtggtgattggcaaccacgttcacgacgtctggctggcggtgcgccaggaggcggggttaagcgatgacagcgaaccggttgccgaggaaaaagcggccaaaggatcggtgttaagccagcttatcgacatcatctccggcatttttacaccgtttatcggcgtgatggcggcaaccggtctgctgaaaggcctgctggcgctggcggtgacctgcggctggcttacgccggagcaggggacttataaaatctggtttgccgccagcgacgcgctgttctttttcttcccgctgtttcttggctataccgccgggaagaagtttggcggcaacccgtttatctcgatggtgattggcggggcgttaacccacccgctgatgattcaagcctttgaggccagccaggcgccgggcgcggcggtggagcactttctcggcattccggtgacctttatcaactacagctcgtcagtgatcccgattattctcgcctcatgggtctcctgctggctggagcgcaagagcaacgcgctgttgccgtcatcgatgaaaaacttcttcagcccggccatctgcctggcggtggtggtcccgctcaccttcctggtgattggcccggtcgccacctggctgagccatctgctggccaacggctaccagttcatttatgcgtttgcgccatggctggcgggcgcggtactgggcgccatgtggcaggtgtgcgttattttcggcctacactgggggctggtgccattgatgatcaataacatgacggtgcttggtcacgactccatgctgcctattatcctcccggcggtgattgcccaagtgggcgccgtgctcggtattttcctcgccacccgcgatgcgcgccagcgggtgctggccggttccgccttctccgccgggctgttcggcatcaccgagccggctatctatggcctgactctgccgctgcgccgtccgtttatcttcggctgtgtcgccggggcgattggcggggcgatcactgcctttagcaacagttatgcctactcgtttggcctgccaaacatctttttcccggcgcaaatgatcccgcccggcgggattgacgccagcgtctggggcgggcttatcggcaccggcgtggctttcgtgctcgcctgcgtgctgaccttcttcgccggcctgccgcgcggtagcgccgcaccaggcgccgtgacggtagccccggcctcggcaaacgatattctggcgccgatgagcggcagcgttatcgccctcgagcaggtgccggatagcaccttcgccagcggcctgctgggtaaaggggtcgccattatcccggcggtgggccaagtgattgccccgttcccgggcgaagtggcctccttgtttcagactaaacacgccatcggcctgcaaagcgacagcggcattgagctgctgatccacgtcggcatcgacacggtcaaactcgacggcgtgccctttaccgcgcatgtgaaagagggcgacagggtacaggccggcgatctgctgattgagtttgatcgccaggcgattctggacgccggctacgacctggtgaccccgatcattatcagcaacagcgacgactaccgggagattgatacggtggcgtccagcgccgtcgaagccggtcagccgctgttgtcagtcagccattaa

SEQ ID NO: 1042 - DNA, 234 bp, Klebsiella pneumoniae
gctattaaaaaacccaaagtccaatatgtagacattaaatatattgggctgattgaaaaagatgaaagaatgtacattgatggtatggaaaaaaggatgaagcttttatttttaatcgagagaaaaaggaagtatagaatcgtaaacacatatattataatgcctaatactcctgaaaatgctaaagttgaatatactcccgactcaacagaaaaaccaccaatccctccatag

SEQ ID NO: 1043 - DNA, 546 bp, Klebsiella pneumoniae
ataatgaaaaaaagcatttttatggcgctggcgggcgtgatgatggtttcttcggcggcccatgcgattagcgttaccggtgaagccggcgagcattacaccaaccttggcgtcggcttcggcaccgagtccaccggcctggccgtttcgggtaactggctgcacagcgataacgacggcgacgccgcgggtttaggcctgggactcaatattccgctggggccgttcctcgcgaccgtgggtggtaaaggtatttacaccaatccgaaacagggcgatgaaggttatgcggccgcggtcggcggcggcctgcagtggaaaatcggcgacagcttccgcctgtacggcgattattactactctccggattcgctctccagcggcattgatagctaccaggaagccaacgtcggcgccagctggaccattatgcgtccgcttagcatccaggccggctaccgttacctgaacctggcgggcaaagatggcaaccgcgataacaccatcgccgacggcccatacatcggcgccagcgccagcttctaa

SEQ ID NO: 1044 - DNA, 333 bp, Klebsiella pneumoniae
tccccccgaaaaactgaggtgctcataagtagaattttctcgtatcttgaacgcaggaggttctacatgaaaacatcacgctttagcgatgcacagatcatcgccatcctcaagcaggccgagtctggttcacccgtccctgagctctgccgtgagcatggcatcagctccgccaccttctacaagtggcgctccaaattcggtggcatggatgcctctctcatggcgcgcctcaaagagctggaagaggaaaatcgtcgccttaagaagatgtatgccgaggagcgcctaaaggctgagatcatctccgaggcgatggcaaaaaagtggtga

SEQ ID NO: 1045 - DNA, 1833 bp, Klebsiella pneumoniae
tttttgcgaaacattcatgcatcaaattgtcatacaaagcgctatgcttatcctcgatatttcgcgcaccaccacaaggagtggaacatgtcatctgcacccactgacacccataaaacgtttctggctgacctggcgcgcctggttggcccttcgcatctgctgaccgacccggcaaaaacccagcgctaccgcaaaggcttccgctccggtcagggcgaggccctggcggttgtctttcccggtaccctgctggagctctggcgcgtgctcaacgcctgcgtagacgccgataaaattattctgatgcaggcggccaacaccggcctgaccgaaggttcgacccccaacggcaatgattacgatcgcgagatcgtgattatcagcaccctgcgcctggacaaactgcatctgctggacaaaggcgagcaggtgctggcctggcccggcaccaccctttattcgctggaaaaagcgctcaaaccgctgggacgcgaaccgcactcggtgatcggttcgtcatgcatcggcgcgtcggtcatcggcgggatctgcaacaactccggcggctcgctggtgcagcgcgggccggcctacactgagatgtcgctgttcgcgcagattgacgccgacggcaagttgaagctggtcaatcatctgggcatcgatctcggcagcacgccggagcagatcctcagccgcctcgatgacgaacggattagcgatagcgatgtgctgcacgacggccgccacgcccacgatcacgactatgtcacccgcgtgcgcgatgtcgatgccgacaccccggcgcgctataacgccgacccggaccgcctgttcgaatcctccggctgcgccggcaagctggcggttttcgccgtgcgtctcgatactttcccggcggaaaagcgccagcaggtgttttacattggcaccaaccagccgcaggtattgaccgagatccgccgtcatatcctcgctgagttccagcatcttccggtggcgggggaatatatgcaccgcgatatttacgatatcgccgagaagtatggcaaagacaccttcctgatgatcgacaagctcggcaccgacaaaatgccgttcttcttcaccatgaaggggcgcaccgacgcgatgctggagaaagtctcgctgtttaagccgcactttaccgaccgctttatgcagaagctcggccacgtctttccggcacatttaccggagcggatgaaaacctggcgtgataaatatgaacatcatctgctgctgaagatggctggcgacggcatcgaagaagcgcagcgttggttgacggagtacttccagcaggccgagggggatttcttcgcctgtacgccggaggaaggcagcaaggcgttcctccatcgctttgccgccgccggcgcggcgatccgctatcaggcggtgcatgccgacgaagtcgaagatattctggcgctggatatcgccctgcgccgtaacgataccgagtggttcgaacatctgccgccggagatcgacagccagctggtgcataagctctactatggccactttatgtgccatgtgttccatcaggattacatcgtcaggaaaggggtcgacgcccacgcgctgaaggaaaaaatgctggagttactgaaagcgcgcggcgcccagtatccggcggagcataacgtgggtcatctgtatgaggccccggagagcctgcagcagttctatcgccagaacgatccgaccaacagcatgaacccggggattggtaaaaccagcaagcagaaatactggggtgaagcggccccgacgccagcctctccggcggatccgcaataa

SEQ ID NO: 1046 - DNA, 1701 bp, Klebsiella pneumoniae
tccgctggaaatatatccacccacggcagggcgatacccgcgtcgttattgcattttagactcatcttatccatgatcgtggtaacacataccgcagtcgtacaggttttaatacatatggaatggattgccgatccgtcaatctgggcaggtctcgtcacgctggtggttatcgaactggtgttgggtatcgataacctggtctttatcgctatcctcgccgagaagctccctcccgcccagcgcgaccgcgcgcggatcactggcctgatgctggcgatggtcatgcgtctcctgcttctggcctctatctcctggctggtcaccctgaccaaaccgctgattgtttttcacgacttcagctttagcgcccgcgatttgattatgctgtttggcggcctgtttctgctgtttaaagcgaccgtcgagcttaatgagcggctggaggggaaagacagcgataaccccacccagcgcaaaggggcgaaattctgggccgtcgtggcgcagatcgtggtgctcgacgccattttctcgctcgactcggtgatcaccgccgtcggcatggttgatcacctggcggtgatgatggccgcggtggttatcgccatcagcctgatgctgatggccagcaaggcgctgacgcgcttcgttaacagccacccgaccatcgtgatcctctgtctgagcttcctgctgatgatcggcttcagcctgattgctgaaggcttcagctttatcattccgaaaggctatctatatgcggctattggcttctcggtcatgattgaagcgcttaaccagctggcgcagtttaaccgccgtcgcttcctctccgccaatatgacgctgcgtcagcgcactaccgaagcggtgatgaatttgctgagcgggcagaaagaaaaagctgaactggatgctgacacggcgtcgctggtcgccgatcaggatcaacatccactgtttaatccgcaggaacgactgatgattgagcgggtgctgaaccttaatcagcgcagcgtcagcagtattatgacgtcgcgccatgatatcgagcgcatcaaccttagcgcgccggaggaagagatccgcagcctggtggagaaaaatcagcatacccggctggtggtgaccggcgggaaggataatgaagatctgctgggcgtggtgcatgttattgacctgctccagcagtccctgcgtcaggagccgctggatctgcaggcgctggtgcgtcaaccgctggtcttcccggagggcctgccgctcctctcggcgctcgagcagttccgccaggcccgcacccattttgcctttgtggtcgatgagtttggctccgtcgaggggattgtgaccctcagcgacgtgatggagaccatcgccggtaatctgcccaatgaggtggaggagatcgatgcccggcacgatattcagcatcatcaggacggttcgtggacggtcaacggtcatatgccgctggaggacctggtgcagtacgttccgctgccgctggatgataaacgggagtaccacaccgtcgccggtctgctgatggagtatctgcagcatgtgccgcaggtgggggaaaccattgagattgacggttatacgctgcgcacgctgcaggtcgacagccatcgggtacagaaggtgcagatcgtcccgccggtaaagcaggatgagctggattatgaggtgtaa

SEQ ID NO: 1047 - DNA, 708 bp, Klebsiella pneumoniae
tcatacaccctgctgaccaaaacgcggcgacgcagaattttctgtgctgtacataaaataatctacagggtgaattatacttggatcagtgcagtacgaagccgtgacaagggggacgctatgaaccatgtctgggggctcttcgctcatcccaaccgggaaatgagcgtgattaagagcgagaatgaaaccatttctcatcactatacgcatcatgtgctgctgatggcggcggttccggtaatctgcgcctttatcggcaccacgcagctgggctggaacttcggcgatggcaccgtgattaaactgtcgatgctgaccggactggcgctggcggtgctgttttacgccgtgatgctcgccggggtggcgatcatggggcgggtcatctggtggatggcgaggcagtatccgcagcagccttccctgaaacgctgcatggtgtttgccggctacgtcgccaccccgctgtttctgagcgggattgtggcgctctatccgctggtctggctgtgcgcgctggtcggtactattgcgctgttctataccgggtatctgctgtatctcggcattccgaccttcctgagcattaatcgggaagaggggttaagctttgccagctcgacgctagctattggggtactggtgctggaagtgctgctggccatcaccgtggtgctctgggggtatggctaccgactcttctga

SEQ ID NO: 1048 - DNA, 2400 bp, Klebsiella pneumoniae
gtcctgttgaactgtattgcccggcaggaatgggttggccgggcctacacaaacgtaggccgggtaagcgtagcgttacccggcaaaaataccttagatcttacaagcgccgctttcgcagccgtcgtcctggatggacggggccaggtcatcctgggcgtcttcagcgccatcacgggtgttgtgatagtacagcgttttgacgccgaatttataggcgttgagcaggtctttgagcaactgctgcatcggcacttttccggacgggaagcgcgtcggatcgtagttagtgttggcagagatcgactggtcgataaacttctgcatgatacccaccagctgcagataaccgtcgttgttcggcatctcccacagcagctcgtaggcgttctgcaggttttcgtaatccggcaccacctggcgcaggataccgtccttggacgctttgatactcacgtggccgcgcggcggctcaatgccgttggtggcgttggagatctgcgacgaggtctcggacggcatcagcgcggagagcgtggagttgcgcaggccgtgagttttaatggactcgcgcaatgcttcccagtcgtagtgcaggggttcgctgacgatgccgtccagatctttcttataggtatcgatcggcaggatgccctgcgcataggtggtttcgttgaaccacgggcaggcgccttgctcgatagccagctcgttagaggccttcagcagatagtactgaatcgcttcgaacgttttgtgcgtcaggttgttggcgctgccgtcggagtagcgtttgccatgcttcgccagatagtaagcgaagttgatcacgccgatacccagcgtacgacgccccatcgcaccgcgtttagccgccgggatggggtaatcctgatagtcgagcagcgcatccagagcacgcaccgccagcaccgccagctcttccagctcgtcgaggctgtcgatagccccgaggttgaaggccgacagggtgcacagtgcgatttcgccgttttcgtcgttgacatcttccagcggtttggtcggcagagcgatctccaggcacaggttagactgacgcaccggggcgactaccggatcgaacgggctgtgggtgttgcagtggtcaacgttctggatatagatgcggccggtagaggcgcgctcctgcatcatcagcgagaacagctcaacggctttaatacgctgcttgcgaatgctgtcgtcctgctcgtactgggtgtacaggcgctcaaactcgtcctgatcggcgaagaaggcgtcatacaggcccgggacgtcggaagggctgaacagggtaatatcgccgcccttcagcagacgggtgtacatcagcttgttgatctgtaccccgtagtccatgtgacgaacgcggttggcgtcggtaccacggttgtttttcagcaccagcaggctttccacttccagatgccacattgggtagaagagggttgccgcgccgccgcgtacgccgccctgcgagcaggatttcaccgcggtctggaaatgcttgtagaacggaatgcagccggtgtggaaggcttcgccgccgcggatcgggctgcccagcgcgcgaatgcgcccggcgttgatgccgatgccggcgcgctgggaaacgtatttcacaatcgcgctggaggtggcgttgatggaatccaggctgtcgccgcactcgatcagcacgcaggagctgaactgacgggttggggtacgcacgccggacatgatcggcgtcggcagcgagattttaaaggtggacaccgcgtcgtagaaacgcttgatatagtccagacgcgtttcgcgcggatagttcgagaacaggcaagcggcgacgagaatatagaggaactgcgcgctctcataaatttcgccggtgacgcggttttgtaccagatacttgccttccagctgcttaacggctgcgtaggagaagttcatgtcgcgccagtggtcgaggaaaccgtccatctgctggaactcttcttccgtgtagtcttccagcagatgatgatcgtatttacctttctcgaccatcttcaccacgtgatcgtagagcgccggcggctcaaactgaccgaaggcttttttacgcaaatggaaaatcgccagacgcgcggcgaggtactggtaatccggcgcgtcgcgggagatcagatccgcagcggctttaataatggtttcgtggatgtccgcggttttgatgccgtcatagaactggatatgggagcgcagctctacctgggaaatcgaaacgttattcagtccttctgccgcccaatccagtacgcgatggattttgtcgagattgatgcgctcggtggtcccgtcgcgctttgtcaccagcagactctgattcatgtggattttacctgtccgtga

SEQ ID NO: 1049 - DNA, 1200 bp, Klebsiella pneumoniae
gcaatgttgaatgtggaaatgctgtccaccggcgatgaagtgttgcatggtcaaatcattgataccaatgcggcatggctggcggatttcttttttaatcagggtttaccgttaacgcgccgcaataccgttggcgacgatctcgatgcgctggtggcgattctgcgcgaacgcagcgaacaggcggatgtgctgatcgtcaacggcggcctcggcccaaccagcgacgacctgagcgcgctggccgctgccactgcgaaaggcgaagggcttattttgcatccggagtggctggaaaccatgacccgcttttttgccgagcgcggcaggccgatggcggaaagcaaccgtaagcaagcggaaatcccggccagcgctgagatgatcaacaacccggtcggtacggcctgtggctttgccatccagctcaaccgctgcctgatgtttttcactcccggggtcccctctgaatttaaggtgatggtcgagcaggaaattttaccgcgcctgcgccagcgctttacgctgccggacccgccggtatgcctgcgtttgaccacctttggccgctcggagagcgagctggcgcaaagtcttaatccgctgacgctgcctccgggcgtggtgatgggttaccgctcgtcgatgccgatcattgaactcaagctaaccggaccggccaaccagcgcgacgccatgctggctctgtggccggaggtgcgtaaggtggctggcgacagcctgattttcgaaggtacggaagggttacccgcgcaaatcgcccgctgtctgcaggagcggcagctgagcctgacgctcagcgagcagtttaccagcggcctgctggcgctccagctgtcccgcgccggcgcgccgctgctggccagcgaagtcgttccggcgcaggaggagacgctggcgcaggcggcccgctgggcggccgagcggcgcataaaccattttgccggcctggctctggcggtgagcggtcaggaaaacgatcatcttaacgtggccctggccaccccggacggcaccttcgcgctgcgggtgaagtttagcgccacccgccacagcctggcggtacgccaggaagtctgcgctatgatggcgttaaacatgctgcgtcgctggctgaatggtcaaccactggccagcgaacatggctggattaacgtggtggattccctctcgctgtaa

SEQ ID NO: 1050 - DNA, 978 bp, Klebsiella pneumoniae
gagacaatgaaattagccggacttcatcccgacgagcagcgtcgcctgcaatcgctacgctcttccgggctgttgaatagcggaaaagaagaacgcttcgatcgcctgaccaggcttgcccgttcgctgtataacctgccggtggcgtccatcagtctggtgggggaagatctcctgcatatcaagtcctgtgccggtctcgatgtggacacggtgccgagagatatttcattttgcgcccataccattctgcaaaccgacccgcttatcgtcaacgacatgcagcaggacgagcgctttcacgataacccgctggtcattgaggcgccgtttatccgcttttacgccgggtatccggtgcaactgccggatggcgcgaccgtcgggtcgttctgtctgatggatcaccagccgcgatcgttttccgcccatgaaatgcagatcttaagcgatctggcggcgatcgtggaggatgagttcaaggtgctggatgcggcaacctcggatgagctgacgggactgtttaatcgccgggggttcctcaccctggcagagtatgccctgctgacggcccagcgccgccatgagccggtgagcctggcgtttgtcgacctcgatcgcttcaagcacatcaatgatacctgggggcatgaagagggcgatcgcgcgctgatcgccatcgccgacttgatgaaagcggccttccgcgagtccgatatcctcgcgaggcaggggggggacgaatttatcattctgttcgccaataccagccgccacgatgccgcggcggcaatggagacgctcagccacaacgtggcgcgtttcaaccagcaggcggctcacccctggcagctggcgttctcctggggctgcgtcgagtacgatcccgcccaccaccccagtctcaacgcgctggtggccaccgctgaccgcctgatgtaccaggcgaagcagaagcagggacgcgagcgccgttaa

SEQ ID NO: 1051 - DNA, 498 bp, Klebsiella pneumoniae
tcaaccgtgaaaaaaatcactacgctagccgtttctctgctgaccgccgcctgcatgtccgctggcgcattggccgcagaccagccgctggaaaaagtcgcgccgttcccgaaagcggaaaaaggcatgaagcgtcaggttattcagctgccgcagcagcaggatgagtcggcgctcaaggttgagctgatgatcggccagacgctggaagtcgactgcaaccatcatcgtctcggcggggaactggaaagtaaaaccctggaaggctggggctatgattactatgtctttgagaagctgagcggcccggtatccaccatgatggcctgcccggacggcaaaaaagagaagaaatttgtcactgccggcctcggggatgacgccatgctgcgctacaacagcaaactgccgatcgtggtatacacgccgagcaatgtcgatgtgaaatatcgcatctggcgcgccgacgagactatcggcaacgccgtcgtccgctaa

SEQ ID NO: 1052 - DNA, 1581 bp, Klebsiella pneumoniae
tacggaaagaatctggctatgcttactcgctacttttcgccccagcgtaaaacctggttaaccagcctgagcgtggggatcatcgtcgcgctgttggccgggagcattcagtttatggtgatctaccataaccgggccgagcgtttcgacgccattatcaacaatgttaatacctatctgaaaagctattttcacgacctgcgccagaccattgacggcctgcagccgctggtggaccagccctgcgagaatattgactccgggcttacctcccacgccgcgttcagccccaacgtccgcgctttcctgctggtcaaaaacggcatcgccttttgctcatcggctacgggagccatgaatacgcccctcagccagctgatcccggccatcgatatcagcaaacccgttgctatggcgattttaccaggcacgccgatgatgccgaagagcgcggcgctggcgctgtgggtaggtaaacccggcgatcaaaacagcggcattttcgtgtcgattaacgctaatctcacaccgtatatcctctattccgcacggcaaaacgatttcagcggcattgcgctggccatcgatcacaccgctatctccaccttcagtaatcggctggtggatccgcaaacgctgcataacgcgccgatccgccaggcacagatcgagggcttaccgctgaaggtctacctgtatgccaacagctggctggcggaaaatacgcagtttgctctgctgctcggggtcgtctgcggcctgctggcggggctgctctgctattacgtgctgacgatcaaatcggatccgcgaaaatctattctgttggggatcaaaaataaccagttctacatcgtttatcagccggtggttaatgcacagactctacgtatcagcggcgtggaggtcctaatgcgctggcgccatccggtggttggtgaaattccgcccgacgtttttattaacctggccgaaacccagcagatgatcgtgccgctaacccatcacctgctcgcgctgatcgccagcgacgctgcggtgttgaagcgtattctgccgcgcggcgtgaagctggggctgaatatttcccctgcccatctgcaggccgacagcttccgcgacgatatgctgcgcttcgccgccgcgctgcccgccgaccactttcacgtggtgctggaggtaaccgagcgggcgatgattgataaagaaaaatcgatggctaacttcgcctggctccaccgccagggattcgaaatcgcgattgatgatttcggcaccgggcatagcgcgctgatctatctcgaacgctataacttcgattatctgaagatcgatcgcggttttgtgcaggcgattggtactgaaacagtaacctcgccggtgctggatgcggtactgaccctcagccgccggctgaaattaatgaccgtcgccgaaggggtggagacccaggaacaggcggagtggcttcgcggccagggcgttcatttcctgcaggggtactggatcagccgaccgctgtcgctggccgggctggtggctgcgcacgatgaacccgcgaactatttcacaacgcgctaa

SEQ ID NO: 1053 - DNA, 1410 bp, Klebsiella pneumoniae
tcacaggagaaaaagatgaaaacattcccgacggattttttatggggcggcgcgaccgcggccaatcaggtggaaggtgcttatctggaagatggcaaaggcttatccacctccgatgtgcagccgcacggcgttttcggcgaagtggtcgagcgcgtacccggcgacagcggcataaaagatgttgcgatcgatttttaccatcgctatccggaagatatcgccctgtttgccgagatgggctttaactgcctgcgagtctctatcgcctggacccgcatctaccccaacggcgacgacgccgagccgaacgaagccggcctcgcgttctacgacaagctgttcgacgagatggcgaagcacaacatcaccccgctggtgacgctgtcgcattatgaaatgccatgggcgctggtaaaaaactatggcggctggggcagccgggaggtgattggcttctttgagcgctacgcccggacggtgttcagccgctataaaaataaggtcaaactgtggctgacctttaacgaaatcaatatgtcgctgcatgccccgatgaccggcgtcggcctgccggccggcagcagcaaaggcgaggtgtatcaggcgattcaccaccagctggtggccagcgcgctggcggtcaaagcctgtcatgagctggtgcctgagggcaaaatcggcaatatgctgctcggcgggctgatgtatcctctgagctgcaaaccggaggatgtgtttgagacgctgcaggagaaccgcagctggcagttcttcggcgacgtacaggcgcgcggcgcgtacccgggctatatgcagcgctatttccgtgacaacggcatcacgctcaccatcaccgacgccgatcgtgaagcgctaaaaaccaccgtcgactttatctccttcagctactacatgaccggctgcgtcaccgccgacgaggcgctgaaccagcaggcgcgcggcaatattctcagcatggtgccgaacccgcacctggcgagctcggagtggggctggcagatagatccgctgggcctgcgcacgctgctgaacgtgctgtgggatcgctaccagaagccgctgtttatcgtggaaaacggtctgggcgccaaagataaggtggaagccgacggcagcattaacgatgactaccgcatcagttacctgaacgaccacctgatgcaggcgcgggaagccattgacgatggcgttgagctgatgggctttaccagctggggaccgattgacctggtgagcgcctcaaaagcggagctatcgaagcgctacggctttatctatgtcgaccgccatgatgacggtaccggcaccctggcgcgcagtaagaagaagagctttggctggtataaagaggtgattgccagccgcggcgccagcctgaaagcctaa

SEQ ID NO: 1054 - DNA, 363 bp, Klebsiella pneumoniae
ggaaaatacctgaccattaactgtcgctttaacccggttcacatagggcatcatctctgcatgcttattgacatagttccacactgtttcattgtcagtatggaaaatatggggtccataaacatgtaccatcacattcgtttcagagtcgcgtgcatcataggaatttcccccaatatgatcacgctgatcgataatgtggacttgatgtcccttctcagcaagttggcgaccgataactgcaccagagaagccagcacctacgatcaatatttttttacttttcatctgttgtctcttttattatccaagaatagcacggcgtactttgtaataatatttagtcatcatgtttcttcttga

SEQ ID NO: 1055 - DNA, 2730 bp, Klebsiella pneumoniae
atgagcgaccttgcgagagaaattacaccggtcaacattgaggaagagcttaagaactcttatctggattatgcgatgtcggtcattgttggccgtgcgctgccggatgtccgagatggcctgaagccggtacaccgtcgcgtactttacgccatgaacgtattgggcaatgactggaacaaagcctataaaaaatcagcccgtgtcgttggtgacgtaatcggtaaataccacccgcacggcgacttcgcggtatacgacaccatcgtgcgtatggcgcagccgttctcgctgcgttacatgctggtggacggccagggtaactttggttccatcgacggcgactccgccgcggcgatgcgttataccgaaattcgtctggcgaaaatcgctcatgagctgatggccgatcttgaaaaagagacggtcgatttcgtcgacaactatgacggtacggagcgtattccggacgtcatgccgaccaaaattcctaacctgctggtgaacggcgcctccgggatcgccgtagggatggccaccaacataccgccgcataacctgacggaagtgattaacggctgtctggcgtatgttgacgatgaagacatcagcattgaagggctgatggcgcatattcctggccctgatttcccgaccgccgccattatcaatggccgtcgcggcatcgaagaggcctaccgcaccggtcgcggtaaagtgtacatccgcgcgcgcgcggaagtggaagtggacgcgaaatccggccgcgaaaccatcatcgtgcacgaaattccgtatcaggtgaacaaagcgcgcctgatcgagaaaatcgccgagctggtgaaagaaaaacgcgtggaaggcatcagcgcgctgcgtgatgagtctgataaagacgggatgcgcatcgtgattgaagtgaagcgcgacgcggtaggggaagtggtgctcaacaacctctattcccagacccagctgcaggtctccttcggtatcaacatggttgcgctgcaccatggccagccgaagatcatgaacctgaaagacatcatcgccgccttcgtgcgccaccgccgcgaagtggtgacccgtcgtacgattttcgaactgcgcaaagcgcgcgaccgggcgcatatcctcgaagcgctggccgtggcgctggccaacatcgacccgattatcgaactgatccgtcgcgcgccgaccccggctgaagcgaaagcggcgctggttgcccaggcgtgggatctcggtaatgtcgcggcgatgctggaacgtgccggtgatgacgccgcgcgtccggaatggctggagccagagttcggcgtgcgcgagggtaaatactacctgaccgagcagcaggctcaggcgattctggatctgcgtctgcagaaactgaccggccttgagcatgaaaaactgctcgacgaatataaagagctgctggaacagatcgcggagctgcttcacatcctcggcagcgccgaccgtctgatggaagtgattcgcgaagagctggagctgatccgcgaccagttcggcgacgaacgtcgtaccgaaatcaccgccaacagcgctgatatcaacatcgaagatctgatcaaccaggaagacgtggtggtcaccctgtcgcatcagggctatgtgaagtatcagccgttgaccgactacgaagcacagcgtcgtggcggtaaaggcaaatcggcagcgcgcattaaagaagaagactttattgaccgcctgctggtggccaacacccatgacaccatcctctgcttctcaagccgcggccgtctgtactggatgaaggtctatcagctgccggaagccagccgcggcgcgcgcggtcggccgatcgtcaacctgctgccgctggaagccgatgagcgcatcaccgccatcctgccggtccgcgagtacgaagagggcgtcaacgtctttatggccaccgctagcggtaccgtgaagaaaaccgcgctgaccgagttcagccgtccgcgttccgccggtatcatcgcggtcaacctgaacgaaggcgatgagctgatcggcgtcgatctgacctctggtcaggatgaagtgatgctgttctccgcggccggtaaggttgtacgcttcaaagaagacgccgttcgcgccatgggccgtaccgccaccggcgtacgcggtattaagcttgcggaaaacgacagcgtcgtctcgctgattattccacgcggcgaaggcgcgatcctgacggtgacgcaaaacggttacggtaaacgtaccgcggcggcggagtatccgaccaagtcgcgtgccacccagggcgttatttcgatcaaagtcaccgagcgtaacggttccgtggtcggcgccgtgcaggtggatgactgcgatcagatcatgatgatcaccgacgccgggacgctggtgcgtacccgcgtttccgaagtgagcatcgtgggccgtaacacccagggcgtgatcctcatccgcaccgcggaagatgaaaacgtggtgggtctgcagcgcgtggctgagccggtggatgatgaagagctggatgccatcgacggtagcgcggcagaaggcgatgacgatatcgccccggaagcggataccgatgatgacatcgccgaagacgaagaaataatcgtccaaggtaaatgttctggaaagggcggggtattttccccggccctttttgcattaacattgcggcaaagccgggtttacccgctaccttaa

SEQ ID NO: 1056 - DNA, 1035 bp, Klebsiella pneumoniae
cagcgacatgattttgtgacgcaagttggaaaaatgaagaagataacgatttacgacctggcggaactttccggcgtttcggcgagcgcggtgagcgctatcctcaacggtaactggaaaaagcgccgcatcagcgccaagcttgcggaaaaggtgacgcggattgccgaggagcagggctatgcgattaaccgtcaggccagcatgctgcgcagtaaaaaatcacacgtcatcggtatgattatccccaaatatgataaccgctacttcggttccatcgccgaacgctttgaggagatggcccgcgagcgcggcctgctgccgattatcacctgtacgcgccggcgtccggaactggagatcgaagcggtaaaggcgatgctctcctggcaggttgactgggtggtcgcgaccggggcgaccaatccggataaaatttccgcgctatgccagcaggcgggcgtgccaacggtcaatctcgacctgccgggctctctctcgccgtcggtgatttcggataactacggcggcgcgaaagcgctgactcataagatcctggctaatagcgcccgccgccgcggagagctggcgccgctgacctttatcggcgggcgcagcagcgaccataacaccagcgagcgtttacgcggcttccacgatgcgcatcgcgagctggggcttagcgtgccgcaggcgaatattctggctcccggctattcgaaaggacacgttgaggactgcctgcaggagcggtttggcagcgcgaagacgttgttgcaggggatatttgttaactcgacgatatccctggaaggggttgtgcgctggctgtcgcaggtgggtctgaccggcagcgagcagccgccgatgggctgcttcgactgggatccttttgtctacctgctggggcacgatatcgacatggtgcagcaggacgtgtcggcgatgctggacgctgttttttcgattattgacgccggcgaagccagccagcagcggattgaaattcccccgcgactgatgagcagcagctga

SEQ ID NO: 1057 - DNA, 1056 bp, Klebsiella pneumoniae
attacaaatgaccagaaaagagcaaaagcttgccagttatgccaaccacggcgagaatgcgggtattcgccgggccaattgcgtgccctggccagcaacttagggcgggaaaccatgagtaaagaagacgatatccggttggatcagaaggtgcgtgccgcatggatgtactacatcgccggccagaatcagagcgagattgccagccagctgggcacctccagaccggtggtgcaacggctgatcgccgccgcgaaagaagaagggattgtgtcaattaatctgcaccatccggtagcgaactgcctcgattatgcgcagttgctgcaggaaaaataccgcttgatcgagtgcaatgtggtccccgcctttagcgaagaaagcaccctcgacagtgtgtcatttggctgctatcagctgatggctcgctatctacaggatgataaagagaaaattatcggtctgggctcgggcctgaccctgaaaaaagcgctgcagcgcatcgattttgacagcctgaatacccgctgcgtggcgctgatcagcgccatgaacgccgacgggcagtgcaattattacgatgacgtgcccctgctgctgacccgcaaaattaaggccaagtactatcagtggccggcgccgcgctacgcccagagcgcggaggagcatgagatgtggtgcaccaatcgcttattccgcagcgtctccggcgtcgcccgcgaggcggacgtgatttttgtcggcattggtccgctgggcacgcaaagtccgatctttaaagacggctttatcaatcaggcgcagatggatgagctgaccgcccgcggcggcatcggggagatcctcgggcggtttattgatgcgcaaggcgacgtggtagacagcgagatcaaccgcatgatcaccagctatgatatccgccagagccactgcccgcggattgccgctgcctgtggagaacataaacgaccggcgatcctggccgcccttaaaggcggctggatcaatggcctggtgaccgatgagcataccgcccgctggctgctgacgcggtaa

SEQ ID NO: 1058 - DNA, 435 bp, Klebsiella pneumoniae
ttgtatgatgaatgcacttcatcaagggttattaccatgagtaaatcgctgactattatctggcagtacctgcgggctttcgtcctgatttacgcctgcctgtacgccggaatttttatcgccgggctgctgcctatcactatccccggcagcatcatcggcatgctgatcctcttcgtgctgctggcgctgcaaattatgccgccgcaatgggtcaaccccggctgcaatatcctgatccgctatatggcgctgctgttcgtgccgatcggcgttggggtgatgcagtactgggatctgctgcgcgcccagctggggcctgtcgttatctcctgcgccatcagtacgctggtggtgtttgtagtggtgagctggagctcccatttggtgcatggcgaacgtaaagtgattggccaaaaaggaaaagaagaatga

SEQ ID NO: 1059 - DNA, 381 bp, Klebsiella pneumoniae
atttattgtgaagccttttgcttccggggaaaccaagtgaatacacaacaactctctatcgtacaccgtctgccgcagagctatcgctggctggccggttttgcgggttccagagttgaaccgattccgcaaaacggcgcgcagaacgagaacagtctcgttgccctgaaattgctgagcccggacggtgagaaagcctggccggtgatgcataagctcagccaggcgttaagcgacatcgaagtcgactgttccgtgctggagtgcgaaggcgaaccctgcctgttcgttaacctgcaggatgagtttgccgccacctgtcgtctgaaaaactttggcgtggccatcgccgagcccttctccggcaataaccctttctga

SEQ ID NO: 1060 - DNA, 708 bp, Klebsiella pneumoniae
ttgccgcgtttggcggtccgccgccaccctccatctctatccaggttaatcaggtcgcaaaaatttatgactgatatgtcccatcagtgcgtcattgtaggcatcgccggcgcatcggcttctggcaaaagtcttatcgccagtactctctatcgcgaattgcgtgaacaagttggcgacgaacatattggcgtcattccggaagacagctattacaaagatcaaagtcatctgtcgatggaagagcgcgtcaaaaccaactatgaccacccgagctcaatggaccacagtctgttgttccagcatttgcagatgctgaaaagcggccagccgattgaactgccggtctatagctacgtcgagcatacccgcacgccgaacaccattcacgtcgagccgaagaaggtgattatccttgaagggatcctgctgctgaccgacgcgcgcctgcgtaacgagctcaacttctctattttcgtcgacaccccgctcgatatttgcctgatgcgccgtattaagcgcgacgttaacgagcgcggccgctccatggactcggtgatggcccagtatcagaaaaccgtgcgtccgatgttcctgcagtttattgaaccgtcgaagcagtatgccgacatcatcgtgccgcgcggcggcaaaaaccgcatcgctattgatattctgaaggccaaaatcagtcagttctttgaataa

SEQ ID NO: 1061 - DNA, 189 bp, Klebsiella pneumoniae
aaaacctcagagttatcgtgtgcttgtactgggcgcgaaatcagctcctctcgcctttggcccattctgattggaaaaatgccttctgtgcttgattattggggggtatttaagcacccttcctttgtcaagctggcttgggaaaataaggccattgcccggggagggggcttgaccgaacgcttttaa

SEQ ID NO: 1062 - DNA, 1644 bp, Klebsiella pneumoniae
acgaaagcagaggagctgaagatgacgggacgtcttgatagcgaggtcattatcatcggcggcggagcaaccggcgccggtatcgcccgcgactgcgcccggcgcggattacgaacgctgctcattgagcgccatgatatcgccaccggggcgaccggccggaatcatggactgctgcacagcggcgcccgctacgcggtgaccgacaacgaatccgcccgcgaatgcatcagtgagaaccgcatcctgcgccgcatcgcccgccactgtattgaaccgaccaacgggctgtttatcaccctgcctgaagatgacctggcatggcagcaaacctttatcgacgcctgtcagcaggctggcatagaggccacgccgctctcgccgcaggaagcgctgcgccgggagcccgccgtcaacccgacgctgctgggcgcggtgcaggtcccggacggtaccatcgacccgtttcgcctcaccgcggccaatatgctcgacgcccgcgaacacggcgcgcagatccttaccggctgcgaagtaacaggcctgctgcgccggggcgatcgcgtctgcggcgtccaggtatacgaccgccaacttcaccaggcccgcactctgtacgccgggatggtggttaacgccgccgggatctgggggcagcgtattgcggaatatgccgacctgcgcatcaccatgttcccggcgaagggatcgctgctgatcctcgatcatcggattaacaacctggtgatcaaccgctgccgtaagccggccgacgccgatattctggtgcccggcgataccatctcgctgatcggcactacctcaatgcatattccttatgacgaaattgacgacaaccgggtaacagcggcggaggtcgacaccctgctgcgcgaaggggaaaagctggcgccggtcatgggccgcacccggatcctccgcgcctactccggcgtccgcccgctggtggccagcgataacgatcccagcgggcgcagcgtcagccgcggcatcgtcctgctcgaccatgcccagcgtgacggtatggaaggcttcattaccatcaccggcggcaagctgatgacctatcgcctgatggccgagtgggccaccgacgccgtctgtcgtaagctgggaaacaccaccccctgtaccacggccgaagccccgctgcccggttcacaggagccaacggaaagtaccctgcaaaagataatctccctccccaccccgctgcgcggctcggccgtctaccgtcacggcgatcgcaccccgtcctggcttggcgacagccgccagcaccgtagcctggtctgcgaatgtgaagccgtcactgccggtgaagtgaaatacgcggtggaaaacctggcggtcaacaccctgctcgacctgcgccgccgcacccggattggcatgggtacctgtcagggggaactctgcgcctgccgcgctgccggcctgctgcagcgctttaacgtcaccacgcccgcgcagtcgttaacccagctctcggaatttctcaatgaacgctggaagggcgtgcagcccatcgcctggggcgatgcgctgcgcgaaagcgaattcacccgctgggtctacctcggcctgtgcggattgccacaggagcaccgggatgaagtttga

SEQ ID NO: 1063 - DNA, 993 bp, Klebsiella pneumoniae
acgcgcagagagcccccggaagattcacttccgggggcttttttttggaccaaattcggacagattcagacaggtattcagaggaaaagaacaatgttagacaacacccgtttacgcatagctattcagaaatcaggccgtttaagcgaagattcacgcgaattactcagccgctgcggcattaaagtcaatttgcacacccagcgtctgattgcgctggcggaaaatatgccaatcgatattctgcgcgtgcgtgatgacgatatcccgggcctggtgatggacggtgttgtcgacctcggtattatcggcgaaaacgtgctggaagaagagctgctcagccgccgcgcccagggcgaagacccgcgctacttcaccctgcgccgtctcgacttcggcggctgccgcctgtcgctggcgactccggtggatgaagcctggaacggcccggcggcgctggacggcaaacgtatcgccacctcttaccctcacctgctgaagcgctacctcgatcaaaaaggtatctcctttaaatcctgtctgctgaacggctccgtggaagtggcgccgcgcgccggcctcgccgacgctatctgcgacctcgtctccaccggcgccaccctggaagctaacggcctgcgcgaagtggaagtgatctaccgctccaaagcctgtctgatccagcgcgacggcgaaatggccgacgccaaacagcagctgattgaccgcctgctgacccgtattcagggcgtgattcaggcccgcgagtcgaaatacatcatgatgcacgccccgaccgaacgcctggaagaagtggttgccctgctgccgggcgccgagcggccgactattctgccgctggcaggcgacaaacagcgcgtggcgatgcacatggtcagcagcgaaaccctgttctgggagaccatggaaaaactgaaggcgctgggcgccagctccattctggtgctgccgattgagaaaatgatggagtaa

SEQ ID NO: 1064 - DNA, 516 bp, Klebsiella pneumoniae
  unsure (402),(403),(404),(406),(407),(408),(409),(410),(413),(414),(415),(416),(417),(418),(419),(420),(421),(423),(424),(425),(427),(428),(429),(430),(431),(432),(433),(434),(435),(436),(437),(438),(439),(441),(442),(443),(444),(445),(446),(447),(448),(451),(452),(453),(454),(455),(457),(459),(460),(461),(462),(463),(464),(465),(466),(467),(468),(469),(470),(471),(472),(473),(474),(475),(476),(477),(478),(479),(480): Identity of nucleotide at the above locations are unknown.
gaggagagagaggagaaggaggagggaggagaggaagaaagaggggaagaggagagggaagaagagggaagaaaggaaggagagagaagaagaaggaggaggggaggagagggagaaagaggaggggaaagaagaagagggggagaagaggggaaggagaagagagagggaggggggggggaaaagaaggggagggaagaaggggagaagggggagggagagggagaggggaagaggggagaggaagggggaggaggggaggaggagagaggaggggaggggaggaaggggggggaaagggagggggaagaggaaaaggaaaaaagagagggagggagggaaggagagaggagaggaggaggaagggggagggggagaggagaggggggggggggagggggnnngnnnnnggnnnnnnnnngnnnannnnnnnnnnnnnannnnnnnnaannnnngnannnnnnnnnnnnnnnnnnnnnncccccacccgacacaacaaaccgcactcaaacgtga

SEQ ID NO: 1065 - DNA, 537 bp, Klebsiella pneumoniae
  unsure (404),(405),(406),(408),(409),(410),(411),(412),(415),(416),(417),(418),(419),(420),(421),(422),(423),(425),(426),(427),(429),(430),(431),(432),(433),(434),(435),(436),(437),(438),(439),(440),(441),(443),(444),(445),(446),(447),(448),(449),(450),(453),(454),(455),(456),(457),(459),(461),(462),(463),(464),(465),(466),(467),(468),(469),(470),(471),(472),(473),(474),(475),(476),(477),(478),(479),(480),(481),(482): Identity of nucleotide at the above locations are unknown.
gagaggagagagaggagaaggaggagggaggagaggaagaaagaggggaagaggagagggaagaagagggaagaaaggaaggagagagaagaagaaggaggaggggaggagagggagaaagaggaggggaaagaagaagagggggagaagaggggaaggagaagagagagggaggggggggggaaaagaaggggagggaagaaggggagaagggggagggagagggagaggggaagaggggagaggaagggggaggaggggaggaggagagaggaggggaggggaggaaggggggggaaagggagggggaagaggaaaaggaaaaaagagagggagggagggaaggagagaggagaggaggaggaagggggagggggagaggagaggggggggggggagggggnnngnnnnnggnnnnnnnnngnnnannnnnnnnnnnnnannnnnnnnaannnnngnannnnnnnnnnnnnnnnnnnnnncccccacccgacacaacaaaccgcactcaaacgtgaatgtagtcgaattcgttga

SEQ ID NO: 1066 - DNA, 1650 bp, Klebsiella pneumoniae
cctgttatggaacttctctctctcgtctggcgccagtaccgctggccgtttctgggcgttattgctctcagcctgctcagcgccgcgctgggtatcggcttaatcgctttcattaacctgcgtctgattaccgctgtcgatacctcactgcgggtcctgccggagtttcttggtctgctggggctgctgatggcggtgaccctgggctcgcagctggcgctaaccaccctcggccaccattttgtctatcgtctgcgcggtgagtttgttaaacgcatcctcgatacccagattgaacaagtagagaagatcggcagcgcgtcgctgcttgccgggctgaccagcgatatccgcaatatcaccatcgcctttgtgcgcctgccggagctggtgcaggggatcattctcaccttcggctccgcggcctacctcgcctggctgtcaggaaaaatgatgctggtgacggcgctgtggatggcgctcaccatctggggcggctttgtgctggtctcgcgggtgtacaaacatatggccagcctgcgcgaaacggaagataaactgtatcacgactatcagacggtgctggaggggcgtaaagagctgaccctcaaccgcgagcgcgcggagtatgtgtttaaccagctctacctcccggacgcccgggagtaccggcaccatatcgttcgcgccgataccttccacctcagcgcggtcaactggtcgaatattatgatgcttggcgccatcgggctggtgttttggatggccaacagcctcggctgggccgataccgccgtggcggcgacctattccctgacgctgctgtttctgcgcacgccgctgctctccgccgtcggcgcgctgcccacgctgctcagcgcccaggtggcgtttaacaagctgcgtcagttctccctcgccccgtaccgggccgactttccccggccgcaggcgcatcctgactggcagacgctggagctgcgcgatgtcaccttccattatccggaccagcgctttgcggtagggccgcttaatctgacgctgaagcgcggtgagctggtgtttttgataggcggcaacggcagcggcaagtcaacgctggcgatgctcctgaccggcctgtaccagccaatatccggtcagatcctcgtcgacggccagccgctggcggcggagaggccagaggagtaccgcaaactgttttccgcagtgtttaccgacgtctggctgtttgaccgcctgctcgggccgcagggcgaggagcccgatccggcgctggtggcgacatggctggagcgtctgcaaatggcccacaagctgcagctggagaacggaaaaatcgccgacctgcggctgtcgaaagggcagaagaagcgcgtggcgctcctgctggcgctggccgagtcccgggacatcattctgctggatgaatgggcggcggatcaggatccgcatttccgccgcgagttctaccaggtcctgctgccgctgatgcagcagatgggcaaaaccgtgttcgccatcagccatgacgatcactacttccagcacgccgatcgtctgctggagatgcgcgccggccagctcgccgaacttaccggcgaagagcgggaacaggcttcccgcgatgcggtggcccgtacggcctga

SEQ ID NO: 1067 - DNA, 1125 bp, Klebsiella pneumoniae
gcaggagcggataacatgagagttaatggacttaccaaaggatttttcatccttatcgtcttcattgtaaccctggccttttttgatgttctctcaccctattattccgccatcctttgggctgcgatcctcgcggtgatttttaatccggtcaaaaacaagatccgtacccgcctcggcgagcgcaatggcctcgcggcgctgatgaccatcgtcattatctgtcttatcgtttttacgccgctggctatcattctctcctcgctggcctacgagctcaatctggtgtacagcaaactgcagcataacgacacccagtttccgacggtggtcgccagcctgttcgcccatctccccggctgggccagaagcttcctcgccgatcataaccttgatagcgcgcagcagatccagcagcagctctctgatgccgctctgaaaggcggtcagtatctggccggcagcgcgtttctgattggcaaagggacttttggcttcaccgtcagcttcggcatcatgctgtatctgctttttttcctgctgaaggatggaccttatctggtgctgttgatcctcgagtctctaccgttatcaagctatgtgaagcagcatttgttcgctaaattcgccgctgtggcccgcgccacggtaaaaggtaccgtcgccgtggcgctggcgcagggtgcgctgggtggctttgccttctggatcgccggtctggacggcagcattctctggggagcgctgatggcgtttctgtcgcttatcccggcggtgggctcggccattatctgggtgccagcggccatctacctcttcgccaccggccagctgtggcagggcgcctttatcgtcggcttctttgtgattgtgattggcctggtggataacattctgcgtccactgctggtgggcaaggataccaggatgccggactatctgatccttatcgccactctgggcggcatggagatctacggtatcaacggcttcgtgatcgggccgctgatcgccgccctgtttatcgcctgctggaatctgctgtcgggacgagaacatgccggcaataccgatgaaatcgatgaagagtttattgaggaagcgaaaaatagccgtaatgaatag

SEQ ID NO: 1068 - DNA, 792 bp, Klebsiella pneumoniae
cggattaaggagcggataatgattgaagttcaacatctcaacctcgcgtttggcgagggggagaagcgtaaccaggtgctgtatgacgtcagtttccacgttaagcccggcgagatctacggtctggtaggagagtccggttccggtaaaacgacggtgctcaagtgcctggcggggctgtttacccactggcagggggaactgaccatcgatgctcagcccttagggcatgaaattagccgcgagcgctgccgtcaggtgcagatggtatttcaggacccctacggatcgctgcatccccgtcacaccattggcgatatcctcgaagagccgctgcagatccatcgtatcaacgaccgcgaccggcggatcaatgtgctgctggataaagttggtctcaaccgcgcctttcgcgagcgctatccgcatcagctctccggcgggcagcggcagcgcgtggcgatagccagagcgctgattcttgagcctcaggtgctgctgctggatgagccgacgtcggcgctggatgtgtcggtgcaggctgagatccttaacctgctggcagaattgcagcgggaggctaagctcacttacctgatggtcacccacgatcttggggttattgcccacttatgccagaaagtggcggtgatgcagtacgggaagatcctcgaaaccctgacggtcgatgcgctggtcagcggccaggcgcagacggcctatacgcagatgctggttaacgccagtcggcaatatacgcgcgaaatggcgcgcgaggtggcggaatactaa

SEQ ID NO: 1069 - DNA, 1584 bp, Klebsiella pneumoniae
gaagcagaggatggtgtcatgggtgttggccaccagcaggcggtcaataaagtcttcttctttaatgcgcgctgccgatttgcctttaccgccacgacgctgtgcttcgtagtcggtcaacggctgatacttcacatagccctgatgcgacagggtgaccaccacgtcttcctggttgatcagatcttcgatgttgatatcagcgctgttggcggtgatttcggtacgacgttcgtcgccgaactggtcgcggatcagctccagctcttcgcgaatcacttccatcagacggtcggcgctgccgaggatgtgaagcagctccgcgatctgttccagcagctctttatattcgtcgagcagtttttcatgctcaaggccggtcagtttctgcagacgcagatccagaatcgcctgagcctgctgctcggtcaggtagtatttaccctcgcgcacgccgaactctggctccagccattccggacgcgcggcgtcatcaccggcacgttccagcatcgccgcgacattaccgagatcccacgcctgggcaaccagcgccgctttcgcttcagccggggtcggcgcgcgacggatcagttcgataatcgggtcgatgttggccagcgccacggccagcgcttcgaggatatgcgcccggtcgcgcgctttgcgcagttcgaaaatcgtacgacgggtcaccacttcgcggcggtggcgcacgaaggcggcgatgatgtctttcaggttcatgatcttcggctggccatggtgcagcgcaaccatgttgataccgaaggagacctgcagctgggtctgggaatagaggttgttgagcaccacttcccctaccgcgtcgcgcttcacttcaatcacgatgcgcatcccgtctttatcagactcatcacgcagcgcgctgatgccttccacgcgtttttctttcaccagctcggcgattttctcgatcaggcgcgctttgttcacctgatacggaatttcgtgcacgatgatggtttcgcggccggatttcgcgtccacttccacttccgcgcgcgcgcggatgtacactttaccgcgaccggtgcggtaggcctcttcgatgccgcgacggccattgataatggcggcggtcgggaaatcagggccaggaatatgcgccatcagcccttcaatgctgatgtcttcatcgtcaacatacgccagacagccgttaatcacttccgtcaggttatgcggcggtatgttggtggccatccctacggcgatcccggaggcgccgttcaccagcaggttaggaattttggtcggcatgacgtccggaatacgctccgtaccgtcatagttgtcgacgaaatcgaccgtctctttttcaagatcggccatcagctcatgagcgattttcgccagacgaatttcggtataacgcatcgccgcggcggagtcgccgtcgatggaaccaaagttaccctggccgtccaccagcatgtaacgcagcgagaacggctgcgccatacgcacgatggtgtcgtataccgcgaagtcgccgtgcgggtggtatttaccgattacgtcaccaacgacacgggctga

SEQ ID NO: 1070 - DNA, 1221 bp, Klebsiella pneumoniae
ggataccgggacggcgacggccgggatcagcgtggcgcgccccgagcgcaggaacaggaacaccacgaggatcaccagcgccaccgaaatcaccagcgtctgctccacctcctccagcgaggcgcggatggtcggcgagcggtcctgggcgatctgcaggtcgatagccgccggaatggtctgctgcagctccggcaggcgggcgcggatgctgtccaccgtctggataatattggcttccggcagtttgcggatcatcagcaggatcgccggtttggcgttggtcatcccggcgttgcgtacgtcctgcaccgaatccgagacggtggcgacatctcccagccgcaccgcggcgccattctggtagtggacgatcagcggctgatagtcggcggcggtcttcagctcatcgttggtctgcacctgccagcggtgcgcgctgtcctccagcgccccctgcggtttgcgcacgttggcgtcgctgatggcggtgcgcaccgcgtccagcgacacgccctggttgaacagcgcctgcgggttgaggtcgacgcgcaccgccggcagggagctgccgccgacgtcgacatcgcccacgccgtcgatctgcgcgatggtctgcgccagctgggtggaggcgaaatcatacagctcaccctgggagtaggtgtccgaggtcagcgtcaggatcatgatcggcgcatccgacggattggctttgcgataggtcggccggttgggcattccgctcggcagcaggctttgcgcggcgttgatcgccgcctgaacgtcgcgcgccgcgccgttgatatcgcggtcgaagttaaactcaagaatgatgcgcgtactgcccagcgagctggaggaggtcatctcattgaccccggctattcgtcccagggagcgctccagcggggtggccaccgacgaggccatggtctccggcgaggctcccggcagcgaggcgctaaccatgatcaccgggaagtccacctgcggcagcggggccaccggcagcagccggaagccgagaatgccgcacagggtgatggccagcgagatgaggatcgtcgccaccgggcggtaaatgaagagggcgaaaaacttcacttacgcctcctcttcctgacgcgggaagcggcgcttcaggtgcagcgacaggcggtcgaacagcagatagatcaccggggtggtgaacagggtcagcacctggctgagcattag

SEQ ID NO: 1071 - DNA, 342 bp, Klebsiella pneumoniae
agtcggcttttaaggagtgcggataatcgccaccctgcacggtggcggagaagttcagcgccaggtcgcgctggtcgcggttcacccggccggagaaatccacggtggcccggtgattctcatcctgctccatctgcagacggatatcgcgcacggtcacctgctcgccgttctcatgctggaagaagagcacgctgtcggccacctgcagctgacggacatcgtaggaccatccgcgatcctccggggccagcggcagggtgttatcatgcggcaccaccggcgctgagctgtcgcgaaccgcctcggttttcggggtcagctggatcaccgcgcccttga

SEQ ID NO: 1072 - DNA, 2151 bp, Klebsiella pneumoniae
tcacagagtttatcacaggtaacgattatccatatatgggcagccatttatggcgcacccacagcccttttggtaatatcgaaagccctttttacaacagaagatgtaatgctcactatgactcaagtcgcgaagaaaattctggtaacgtgcgccctgccgtacgccaacggctccatccacctcggccacatgctggagcacatccaggctgatgtctgggtccgttaccagcgaatgcgcggccacgaggtcaacttcatctgcgccgacgacgcccacggcacgccgatcatgctcaaagcgcagcagctcggtatcacaccggagcagatgattggcgaaatgagtcaggagcatcagaccgatttcgccggcttcgacatcagctatgataactatcactcgacgcacagcgacgagaaccgcgagctgtcggagcttatctacacccgcctgaaagagaacggttttattaaaaaccgcaccatctctcagctctacgatccggaaaaaggcatgttcctgccggaccgttttgtgaaaggcacctgtccgaagtgcaaatctccggaccagtatggcgataactgcgaagtgtgcggcgcgacctacagccccaccgaacttatcgacccgaaatcggtggtctccggcgctacgccggtgatgcgtgactccgagcactttttcttcgacctgccgtcgttcagcgaaatgctgcaggcgtggacccgcagcggcgccctgcaggagcaggtcgcgaacaagatgcaggagtggttcgaatccggcctgcagcagtgggacatctcccgcgatgcgccgtacttcggcttcgaaattcccaacgcgccgggcaaatatttctacgtctggctggacgcgccgatcggctacatgggctccttcaagaacctgtgcgacaagcgcggcgacaccaccagcttcgacgaatactggaagaaagattccacggccgagctgtatcactttatcggcaaggacattgtctacttccacagcctgttctggccggcgatgctggaaggcagcaacttccgtaagccgactaacctgttcgtgcacggctacgtgacggtcaacggcgccaagatgtccaagtcgcgcggcacctttatcaaggccagcacctggttaaatcatttcgatgccgacagcctgcgctactactacaccgccaagctctcttcacgcatcgatgacatcgacctgaacctggaagatttcgtgcagcgcgtgaacgccgacatcgtcaacaaggtggttaacctcgcctcgcgcaacgccggctttatcagcaagcgtttcgacggcgtgctggccgcggagctggccgacccggcgctgtataaaaccttcaccgacgcggcggaaagcatcggcgaagcatgggacagccgcgagttcggtaaggccatccgcgaaatcatggccctcgccgacgtggctaaccgctacgtcgacgagcaggcgccgtgggtggtggcgaaacaggaaggccgcgacgccgacctgcaggccatctgcactatgggcctgaatatgttccgcgtgctgatgacctggctgaagccggtcctgccgcagctggccgcacgtgcggaagcgttcctcaacagcgaactgagctgggacgccattcagcagccgctgctggcgcataaggtcaatccgttcaaggcgctgtacaaccgtatcgagatgaagcaggtggaagccctggtagaagcctctaaagaagaggtgaaagccaccgcggcgccggtcaccggtccgctggcggacgatccgattcaggagaccatcacctttgacgatttcgccaaagtcgatctgcgcgtggcgctgattgaaaacgcggaattcgtcgagggctccgacaagctactgcgcctgacgctggatctcggcggcgaaaaacgtaacgtcttctccggcatccgctccgcctatccggatccgcagccgctgattggtcgcctgacggtgatggtcgccaacctggcgccgcgcaaaatgcgcttcggcatctccgagggcatggtgatggccgccggccctggcgggaaggatatcttcctgttaagccctgacgacggcgccaagccgggtcagcaggtgaaataa

SEQ ID NO: 1073 - DNA, 669 bp, Klebsiella pneumoniae
atgtcatcactgagtaaagaagccgtcctcgttcatgaagcgctggtcgctcgtgggctggagacgccgatgcgtgcgccagtacaagaaattgataacgaaacacgcaagcgtttgattaccggtcatatgaccgagattatgcaactgctgaatctggatctgagtgatgacagtctgatggagaccccgcatcgcatcgccaaaatgtatgtcgatgagatcttctccgggctggattactctcgcttcccgaaaatcaccgtcattgaaaacaaaatgaaggtcgatgaaatggtcaccgtgcgcgatatcaccctgaccagcacctgcgaacaccatttcgttaccatcgatggtaaagcgacggtagcctatatcccgaaagattcggtgatcggcctgtcgaaaatcaaccgcatcgtgcagttcttcgcccaacgtccgcaggtccaggagcgtctgacgcagcagatcctgatcgcgctgcagacgctgctcggcaccaacaacgtggcggtatccattgacgcggtgcattattgcgtgaaggcgcgcggcattcgcgacgcgaccagcgccaccaccactacctctctcggcggcctgtttaaatccagccagaatacccgccaggaattcctgcgcgcagtacgtcaccacgactaa

SEQ ID NO: 1074 - DNA, 1251 bp, Klebsiella pneumoniae
gaccgtaaactaatgaaaggcagtaacatacgtcgttggggcgccgcgctggcggtagtgattatcgccggggccgcctactggttctggcacgatcgcgggacgagcggcagcgggactcccgccgccggacagggcccgcaggggccgggcggcgcacgccatggccgctttggcgccgcgctggcgccggtgcaggcggccaccgccaccgaagaagcggtcccgcgctatctcaccgggctgggtacggtgacggcggccaacaccgtcaccgtccgcagccgggtcgacggccaactgctgagccttcacttccaggagggacagcaggtcaaagccggcgacctgctggcgcagatcgaccccagccagtttaaagtcgccctcgcccaggcgcagggtcagctggcgaaagatcaggccacccttgccaacgcccgccgcgatctcgctcgttaccagcagctggtgaagaccaacctcgtctcccgccaggagctcgacactcagcagtcgctggtggtggaatccgccggcacggtgaaagctgatgaagcggccgtcgccagcgcccaactgcagctcgactggacccgcattaccgcgccaattgacggccgcgtcggcttaaagcaggtcgatatcggcaaccagatctccagcggggataccaccgggatcgtggtccttacccagacgcacccgatcgacgtggtctttaccctgccggaaagcagcatcgccacggtggtgcaggcgcagaaagcgggcaaaacgctcagcgtcgaagcctgggatcgcaccaataagcagaaaatcagcgtcggcgagctgctgagcctcgataaccagatcgatgccaccaccgggaccatcaagctgaaggcgcgctttagcaatctggacgacgcgctgttccccaatcagttcgttaacgcccgcctgctggtggacacccagcagaacgcggtggtgatccctgccgccgcgctgcagatgggcaacgaagggcatttcgtatgggtgctgaacgatgagaataaggtcagcaaacacagcgtgacgcccggcatccaggacagccagaaagtagtcatcagcgccgggctttccgccggagatcgcgtggtcaccgacgggattgaccgcctgaccgagggagcgaaggtggaagttgtcaccgccagcagcggcgagcaggcgcagcccgccccgcgccagagcggtaaacacggagcgcgttcctga

SEQ ID NO: 1075 - DNA, 228 bp, Klebsiella pneumoniae
ttaagccattgcttgcttgtacagttcaatgatttgatcggcagaccccacttctctgagtctatgattttcgatccagatgactctatcgcagattttttcaacgtcactcatattgtggctaacaaacagtatcgtcacgcctcttttcttaaaatctctgatggtctgaatacatttagcctgaaaagcgatatcacctactgccagaacttcatcaataattaa

SEQ ID NO: 1076 - DNA, 1863 bp, Klebsiella pneumoniae
aacattaattgcggtttagcgcgccgcgccgggctttttgccgcgtttgctgcgcaacgcgccgcaaaaaagtgtgatcctggccgtcatttttcatttttatgcagggcttcaaagaaagttttcgccaggcagggtatggtacgcgctttcaggcatgtgtggtttgcgggtatgtacgagtttgatctggtgttgctgctgcttcagcagatgtgcgtatttttggtcatcgcgtggttgatgagcaaaacccgactgtttatccccctgatgcaagtcaccgttcgcctgccgcacaagctgctgtgctacgtcaccttctccattttctgcattatggggacctatttcggtctgcatatcgaagactccatcgccaacacccgcgccatcggcgccgtgatgggcggcctgctcggcgggccggtggtcggcgggctggtagggctcaccggcggcctgcaccgctactcgctggggggaatgaccgccttaagctgcatggtctccaccatcgttgaggggctgctgggcggtctggtgcacagcgtgctggtcaaacgcggccggccggacaaagtctttagcccgctgaccgccggggcgatcaccttcgtggccgagctggtgcagatgatgatcattctgctgattgcccgcccgttccaggacgccctgcatctggtgcagagcattgccgcgccgatgatggtcaccaataccgtcggtgcggcgctgtttatgcgcattctgctggacaagcgggcgatgtttgagaagtacacctccgccttttccgccacggcgctgaaggtggcggcgtccaccgaggggatcctgcgtcagggattcaacgaagagaacagcatgaaggtggcccaggtgctgatccaggagctggatatcggtgcggtggcgatcaccgatcgcgacaagctgctggcgtttaccggcatcggcgacgatcaccatctgccgggcaagcctatctcctcctcgtatacgcaacgggcgattgagaccggggaggtggtctacgccgacggcaacgaggtgccttaccgctgctcgattcatccgcactgtaagctggggtcgacgctggtgatccccctgcgcggcgagaatcaacgggtgataggaaccattaaactgtatgaggcgaaaaatcgcctgttcagttcgatcaaccgcaccctcggggaggggattgcccagctgctgtcggcgcagatcctcgccggacagtacgagcggcagaaggcgctgctgacgcaatccgaaatcaagctcctgcacgcccaggtcaacccgcacttcctgtttaacgcgcttaacacgctgaaggcggtgatccgccgcgacagcgatcaggccggccagctggtgcagtatctatcgaccttctttcgcaagaacctgaaacggccgacggaaattgtcactcttgccgatgagatcgagcatgttaacgcctatctgcagattgagaaggctcgctttcaggctaacctgcagatccagatggcggtgccggaagggctggcgcatcaccagctgccggcctttaccctgcagccgatcgtggagaacgccattaagcatggtacatcgcaacatcttggcgtcggcgaaattaccatccgcgccagccaggacgatcgctggctgcagctggatatcgaagataacgccgggctgtaccgggccaacccccaggccagcgggctggggatgaatctggtggacaggcggctgcgggcgcgttttggcgccgactgcggcatcagcgtcacctgcgagccggagcgctttacccgtgtcaccctacgtctgcccctggaggagaatgcatgctga

SEQ ID NO: 1077 - DNA, 1926 bp, Klebsiella pneumoniae
aataagggttggatcttgaatcgaatactcacggctattattttgtcgttatttgttgtcaccggatatattacttatctggtgcatgagcgacaaagtgagttgcaaaaatttacccgctatacggactcgtggtcaatgtcgcaaatggtgtcggaatatatgcggctggagtctcgtctggcgggaatggctattggggccgaaggggcggaccacgatgaggtgcgcctgcgtcttgagatcatgatgagccagatcgagcttctgcaggagggcgatctgggtaaatttatcaataaaagcgagcagcggaagacggtggttgcgacgctgattcgtaatcttcatctgctcgataaacaagttgataccatgacgccggagcaggtcagacagatcctgccggtgttaagcgagttggatggtccgctgacctcaatggccgccgccaccctgacgcaagatatcaatatcgttaatatcacccatgataaaatccagcatctctattatatctactcggtgatctccattctgctgatcgccatgtgtataactctcggtctgctgatgctccgacagaataataatctgcgtcgcgcccatgttcgtatgaaaacgctggccaacgatctgcaggcctcgaaagagaagctgcaggtgcagaaccgacggctgcagtacgatgcctaccatgattcgctgaccggtatgcccaaccgtctctctttctggcagcggctgcaggagatcgtcaaccaggtgcgtccctataagggatgcgccgtggtgatgcttttcgacctcgacagctttaaggatgtgaacgatacccttggccatgatgctggcgataagctgctgcaggatctggccagtcgcctctcttttttccgcaaaacctccgagacgctgtatcgccttggcggtgatgagtttgcgatgctctcctacgatctcactgaggagatggcccttgagcgggccaatgttatccgggagaagatcagccagccctatcagatctacgatgcgcagattaatatcgacgcctgcattgggatcgtgatctctgacggtgaaagtcgtaccgattatctgtacaagtgcgccgacctcgcgctgtatgaggcgaaaaaagagggtagcggccatgtgcaaatcttccggccggggatgctgcagcgcctgcaggagaacaaatcgtttgaagacgatctgctgcaggccctggcccatgacgaattcaaagtctactatcagccgatcgccgataccgtcacgcgcgaaatctacggctatgaagcgctggttcgctggttccatccggtgcgcggcgccgtgccgccgacggtgtttattccggtggcagagaaaatcggtcttattaatgcccttggcgaatgggtgctgaaaaccgcctgtgccgaagcggccagctgggcgacgccgctgaaggtctcggtcaacgtttcaccaattcagttgatgaatacatcgctgaccgacactattatcgaggtgctgcatcagaccggcctcgatccgcgacgtcttgatctggagatcaccgagtcggacgtattcaatgagaacacccgttcgctggaaattctcagccagctgcgcgagctgggcattcagatctccatcgatgactttggtaccggctattcttccctgtcccgtttaagctacttcccgttcgataaaattaaaatcgaccgctcgtttgtcatcaatattccggaacaaaaagacgatctggatatcgtccgcctgattatcagcatgggaaagagcctgcatatgcgcattgtggcggaaggtgtagagaccgaagagcagttggcttcgctgcaggcgctgggctgtgacctggttcagggatatttaatcggcaaaccgagtccgctgcgctaa

SEQ ID NO: 1078 - DNA, 2748 bp, Klebsiella pneumoniae
cctttatactgccagcagcatctgctttgttgccagttactctggcgctacatcctgtttacaaacaatgatgagtcgttcagccacaagatgaccccgaaaaaattctccctgatccccggcaacatcagccgcttcttcattttgatggttattgtcctgctggcgacaatgggggtgatgatccaaagcgccgtcaatgcctggctgaaggagaaaagctatcaggtggttgatgtctcccacgctctgcaccagcgcattgacgcctggcgctatgccacctggcagatctacgacaatatcgccgccacctcagtcaacaccgcaagcggcggtctgcaggagacgcgtttaaaacaggacgtttactacctggagaaaccccggcgtaaaaccgaagccctgatctttggctcccatgacagctccaccctcgaaatgacgcagaaaatgtccgattatctcgatattttgtggggcgcggagaccattccgtggtcgatgtactatctcaacggcctggacaatagtctgatcctggtctccactctgccgttgaaggacctctcttcgagcttcaaagagtcaacgatcagcagcgtcgtggagtcgcggcgcgcggaaatgctgctgcaggctaatacccttgatgagcgcgagacgttctcgccgctgcgccatctcgcctggcagaacgcgcactattttacgttacgcaccaccttcaaccagcccggacaccttgccacggtggtcgccttcgatctgccgattaacgatctgatcccgcccggcatgaccatcgacagcttccgtatcgagcctgacccgtcgcaaaatctcgccaccacgccggataaagagagcgccgatcatatcgggatcacctttaacggcatgcagattgacatcgccaccgacatcagcaccaccggtatgcagttgctgtggacggtaccaatgagcaccatgctgctggagtccatgcagaacattcttctgccgctgctgctcaacattggtctgctggcgctggcgctgtttggttttaccacctttcgccactataaaggacgcagccattcgtctggcgccgggctcccctccgccgccaacagcgaactgcgtctgctgcgcgccattaacgaagagattgtttctctgctgccgctggggctgctcgttcacgatcaggaagccaaccgaacggttatcagcaatccaattgccgaccatctgcttccgcacctgaatctgcagaacatcactaatatggcggaccagcatcagggggtaattcaggccaccgtcaataatgagcagtatgaaatccgccagtatcgcagccaggtagcgccgcgcacccagatcctgatcatccgtgatcaggaccgcgaagtgctggtcaataaaaagctcaagcaggcccagcgcttgtatgagaaaaaccagcagggacgggccgcctttatgcagcacatcggcagcgccctgaagcagcccgcgctgacgctggcggcagaggcagcggcgctcagtagtacagagaaccggacgctggcccagcatgccgatgagctggtcaaactcatcgatgacattcagctcgccaatctgctggaaagcgatgcctggaaaaccaaccagacgttgttctcggtgcaggagcttattgacgacgtcgtgccgatagtgctgccggtgatgaaacgcaagggtctgcagctgctcatcggcaatgcgctcccggccggcgagcagcgctatggcgaccgtgaagctctgcggcgcacgctggtgctgttaatccagtattcagtgaccaccacgcctatcggcaagatcaccctcgacgtctgtcaggatgagtcggccagcgatcgcctgaccttccgcattctggataccggcaacggcgtctcggcaaacgagatcgacaatatgcacttcccgtatctcaacgagacccagagcgacctgtacggcaaagcaaacgcccttaccttctggctatgcgaccgcatgacgcgcaagctgggcgggcaattgaccattaaagcccgggagtcgctggggacgcgctataccctgcatctgaaaatgccggctagcgaagaggcgccagaggcgggagagcatttgctggatgacgttatcgtcctgctggatgtgacttccagcgaagtgcggcggattgtcactcgccagctggagagctggggagcgtcctgcatcacaccagacgatcgggcgaccagtcaagcctttgatctttatttaacggataatccgtctaatcttactgcttcaggcttgcttttaagcgatgatgaggtcgggatacgcaagatcggcccgggccaactgcgggtcaactttaatattagcacggcgatgcaggaggctatcctgcagcttattgagcagcagctggcggaggaggcggttcagcccgtcacctcaggaaacgagagtaacgccgaactccatgccagcggctattacgcactgtttgccgatacggtaccggatgatgttcagagattgtatactgaaatcgaagcgggcgattttgctgctctggcgcaaaccgcccaccgcctcaaaggggcatttgctatgcttaatctgatacccggcaagcagttatgtgaaacgcttgagcatctgattcgcgaaaaggatgcgcaaggcatagaaaaatatatcagcgacattgacgcttacgtcaagagcttgctgtag

SEQ ID NO: 1079 - DNA, 1089 bp, Klebsiella pneumoniae
cgccttgactgcggagaatgtatgacccagaagtatctctttattgaccgtgacggcaccctgatttccgaaccgccggaggatttccaggtggaccggttcgacaagctggcgtttgagccgcaggtgatcccggggctgctgaagctgcagcaggaaggctataagctggtgatgatcaccaatcaggatggcctgggaaccgacagtctgccgcaggaagcgtttgatggcccgcacaacctgatgatgcagatcttcgcctcgcagggcgttaactttgaagaggtgctgatttgtccgcacttcccgggcgacaactgcgcctgccgcaagccaaaaacgcagctggtgctgccgtggctggaagagggcgtgctggataaagcccacagctatgtgattggcgaccgggccaccgaccttgagctggcggataacatgggaattaccggtctgcgctatgaccgcgagacgctcgactggccgaccatctgcgagcagctgacccgccgcgaccgctatgcccacgtcgagcgcatcaccaaagagacccaggtggatgtgaaagtgtggctggaccgcgaaggcggcagcaagatccataccggcgtcggcttttttgaccatatgctcgaccaaatcgccacccacggcggcttccgcatggaggttaacgtcggcggcgatctgtacatcgacgatcaccacacggtggaggataccggcctggccctcggcgaagccctgaagctggcgcttggcgacaagcgcggcattaaccgcttcggcttcgtgctgccgatggacgagtgtctcgcccgctgcgcgctggatatctccggccggccgcacctggagtataaggcggacttcacctatcagcgcgtcggcgatctgagcaccgagatggtggaacacttcttccgctcgctctcctacaccatggcggtgaccctgcacctgaaaaccaagggtaagaacgatcaccaccgcgtggagagcctgttcaaagcctttggccgtacgctgcgccaggcgatccgcgtccagggcgatgccctgccgtcttccaaaggggtgctgtaa

SEQ ID NO: 1080 - DNA, 294 bp, Klebsiella pneumoniae
gcattctgctgcgggttgcctggctggatatacgtcagcgcaatcctcttctgctgcgcccattgcttgagctcttcgctgatgtattccggaccattatcacagcggattgcggctggtttgccccgccactcgatgacctgctccagcacccgtttgactcgcgaggcaggcaaggaaaaatccacctcgatgcacagtgcttcgcgattgaagtcatcgatcacattaaacaaccgcaccgaacgaccatcgctgagctggtcatgcataaagtccatcgaccaacagtga

SEQ ID NO: 1081 - DNA, 450 bp, Klebsiella pneumoniae
caggtctgctgctggttacgctggcgctgccgtttgtcacttatgcgccgaatcgcttactctccggggaagggcgcgggctgtggcaggtgctgccctggctcgccggcgttcagctggcggcggcccttgccgggatgctgctttgctggctgccgggcaggatcgtgccgtttctccacctgctgctggctgaactgctcttcccgctgcttatctggggcagcggccaggcggcgcttgagctctcccggcacggctcgccgctggcgcgcacctcgcccggcagcggcctgtggttgtcgctggcgctttgtctgctgctggccagcgaggccatccgtcatcttaccgtccggccgctctggcgctggctgctcaatgcgcaagtctggctgttgcccatcatcctgctcgctatcggggcgctcgatcagctctccttgctga

SEQ ID NO: 1082 - DNA, 195 bp, Klebsiella pneumoniae
ccgccgggctggcccgctgggcgcaggtggttttccgctagccctcgcccggcgctgccgcgcagcaggtctgtcctgatcctggcgctgcagattacgctggaatattcctggtctcccacgcaaaatggcctgttcgtccggacaggcctgtccactctcccccgctgcgggggcgtattatccataccgtag

SEQ ID NO: 1083 - DNA, 255 bp, Klebsiella pneumoniae
tccctaaaatgtgctaccgatcacatcatgaattctatgcatagcgctgatagcttacgggaacctagtctcacccgtcagggcccgacaccttgcggctcaggcgggatcgctccccacgctaccttgctggatgaggcgcggcaaataaaggcgaatgggacgccgcagtcccctgtaaagcataaagattatctcgccgctttgccgcatcgagcgtgcggggtacggcgtgcgtctggtccgacgcattga

SEQ ID NO: 1084 - DNA, 1482 bp, Klebsiella pneumoniae
ctaaacgaatggccgcctgcgacaggctgccggtctcagcaatcgtcgcgaaggcttcaatctgtgcgaatgaatactgtagggttttcatcctttttctcccttaagggggaaaatcccccatgtgctgattttagccggcgcgcgccgatttatatactgcgcagcgaatctatggcaaacgaggaaatgacaatgataagaaaaccactggccctggcgttaatattggcggcgctgccggcggcggcaatggcgcaacactgcggcagcctgacgctggatgtctgcccaacgccttacgatcaaacgctacccgcggccaaagacatgctcagctgggatcagacttcacgcgtgattggctttcgcaatgactatcgcaactatgccggcgatgtcttccgccacggcgcctcgacgccgctggagcgcgctgaaaaacaactgactgatgcccggtatacgctcaacggccacacctggaatttgcaggattacctgaagcgcgagaacgtcagcggtatgctggtgctgaaagatggtaaagtcgcctggaaatatctcgccgaaggtaataccgacaccaccctgtggacctcgcgctcggtgggcaaatcggtggtctcgacgctggtcggtatcgccattcaacagggtaaaatccactcccttgatgacctgattaccgtttatgaacccgaactgaaaggcaccgcctgggacggcgtaacgctgaagcagttgattcaacacaccagcggggtggaatggaatgaagactacaccgacccgcagtcgcatttcgcccgcctgacccaatgtgaagcgcagcccggcgcctatgcctgcgtgcgtaagatcgtcaccggcctggcgcgtcaacacccggcgggcgagcagtggtcctactcttccggcggcgcctggctgcttggggatatcctggagcgcgccaccggcatgtcgctggccgcctggcttgaacaggctctatggcagccggccgggatggcccacgacggcgtgtggcatgcttatcagcaagggaagcacgacgtcggcgcccacggctttaacgccacccttgaagactggggccgctttggtgaattcgtcgcccgtgacggtcggttaagcaatggcaaacagctggtgccgactggctggttcgatcaagccgccagctggaccaaggcgctaaactcggtctcggcagcgcatcctgagggtatttacggctatcagtggtggaataacgcgattccggcgaatgcgcaaaacgtacagccgacgccgcaggaagggcttaaagggtcgctgtgggcgctggggatctacggccaggtgatcatggtgaaccgcgcggaacacctggtgatcgtccagtggtcgacctggccgcaggcggaaccttccttcaacgctcagccgttggaagcggcgctgatgtacagcgccattgcccgcgagctgcgttaa

SEQ ID NO: 1085 - DNA, 666 bp, Klebsiella pneumoniae
gcacggcagtggacatcatcgaaggatcacaggtatatgaactggcaactcatctcattttttggcgatagcaccgttttgctgccaagcgcagcggcgctgtttattgtcctgatgctgcgtaaaacgtcgcggttgctggcgtggcagtggagtttgctgttcggcatcaccggcgctatcgtctgcgcctccaaactggcctttatgggctggggtctgggtattcgcgagctggattacaccggcttcagcggccactcagcgctctccgcggcctactggcctatcttcctgtggctgctcagcgcgcgtttttccgcgggtttgcaaaaagcagctgtcgccaccggctatattctggccgccgtggtgggctattcgcggctggtcatccatgcgcattccgtctcggaagtgattgccggcctgctgctgggcgctgctggcagcgctttgttcctgatactgcaaaaaagtacttctgattcggtgtataagactatcccttggggtggggttgcgtgtctgataatggttccgcttgtcctgttacattccggcagtaaagcaccgactcaatccctgttggggcaaatcgccaccgtaattgggccgctggataaaccttttaccagagaagaccttcacaagcaggcatggtaa

SEQ ID NO: 1086 - DNA, 510 bp, Klebsiella pneumoniae
actgtatttcgcttgcagtttaccgaggcggctcgcaaactatttcaccagcataccgccccatccctctgcaggagaaaacccatgcgccacaggacgattgtttgcccgctgatcgagaataaaggccattatctgctttgcaaaatggccgccgaccgcggggtttttcccgggcaatgggccttatccggcggcggcgtggagccaggggaacgtattgaagaggcgctgcggcgggaaatacgcgaagagctcggcgaaaaactcatccttacccatatcgcgccatggtgctttcgcgacgatacccgcgtcaaaacctaccccgacgggcatcaggaaacgatctacatgatctatctcatcttcaactgcgtgagcgccaatcgcgatgtgacgatcaacgaggagtttgacgattacgcctgggtcaaagccgaagatctcaaaaactacgatcttaatgccgccacccgcgttactctcagcctgaaagggctactttag

SEQ ID NO: 1087 - DNA, 1068 bp, Klebsiella pneumoniae
aggaaccttcgattaagggatatgactttctttcgccccgcgctgctgggcgcttgcgttctgttctctggctgggtttcagctaccactcctgcgacccccaccgcgacggccaccgtgctggatggcaaaacgatgggcactttttggcgggtcagcgtcattggcgtggatgaggcaaaggcccagacgttgcgcgccaaggttcaggcccagctggacgccgacgatcgcctgctgtcgacctggaaaaacgactcagcgctgatgcgcttcaatcatgccgccactaccgaaccctggccggtgagcgaagcgatggcggatatcgtcaccctgtcgctgcggattggcgccaaaacgcacggcgcgatggatattaccgtggggccgctggtcaacctgtggggctttggcccggataaacagccggtcaccaccccggatgccgaggcgatagccgcggcgaaggcgcgcaccggcctgcagcatctgcaggttattaatcagagcggcaggcagttcctgcaaaaagatattcccgatctgtttgtcgacctctccactgtgggggaaggctatgccgccgaccaccttgcgcggttgatggagcaggaggggatctcccgctatctggtgtcggtgggcggggcgctggtcagccgcgggatgaacggcgaaggcaagccctggcgggtagcgatccagaaaccgaccgaccgcgaaaacgccgttcaggcgattgtcgacatcaatggtcacggcatcagcacctccggcagctatcgcaactactatgaactcgatggcaaacgcatctcgcacgttatcgatccgcagaccgggcagccgataacccataagctggtctccgtgaccgtcattgcgccaacggcgctggaggcggacggctgggataccggactgatggtgctggggccggaaaaagcgcagcaggtggtgcgcgaggaggggctggcggtctacatgatcgttaaagatggagagggttttaaaacctggatgtcgccgcagttccgcactttccttgtcggcgagaaaaattaa

SEQ ID NO: 1088 - DNA, 1392 bp, Klebsiella pneumoniae
cccagctctcggaatttctcaatgaacgctggaagggcgtgcagcccatcgcctggggcgatgcgctgcgcgaaagcgaattcacccgctgggtctacctcggcctgtgcggattgccacaggagcaccgggatgaagtttgattgcgcgattatcggcggcgggctcgccggcctgctgtgcgggctggccctgaatcagcacggcctgcgcagcgtcatcatcagccgcgggcagagcgcgctgcatttttcctccgcgtcgttagacctgctctcggcgctgcccaacggcgataacgtcactgacgtcgcacaaggtctgcagcagctcgctgaacagcttcctgaacacccttattcccggctcggcgcagaggcggtgctcgaatacgcgacgcagaccgaagccctgctggccgcctgcggcgcggtgatgcagggcgatgcgcgccggccgcaccggcgggtaacgccgctggggacgttgcgcccggcatggctgtcgccccttgaggtgcctgtcgcgcccctgccgtcgcagggcgcctgtctggtggggatcagcggctttgctgattttcagccgcatctcgccgccgccgcgctcggtcaacacggagttaccgccgcggcggtggaaatcgagttaccgctgctggatgtgctgcgtgacaacccgaccgagtttcgcgccgccaatatcgcccgcgtcctggatgatgagaatatgtggccggccctgcatgcagcgctgctaccgctggcgcagcagtatgacctgctgatcatgcccgcctgttttggcctcgccgacgatcgcctgtaccactggctgcaggcgcgtctaccctgcccgctgcgtctgctgccgacgctgccgccttcggttcccgggatgcgtttgcattctcagctgcaacgccagttcattcgcgagggcggcgcctggctcgcaggcgatgaggtggtgaaaatcagccatcgacaggacgccgtcgaggcggtctggacgcgcaatcacggcgatattgcgctgcgtccgcgctttaccgtgctggccagcggcagctttttcagcaacggtcttgtcgccactcgcgatagcgtgcgcgagccgatcctcggcctcgaccttcaccagaccctgccacgggaaagctggtaccagcgcgatttcttcgcctcacaaccgtggcagcgcttcggcgtgaaaaccgatgccctgctgcgccccctgctgggcgggcagccgttccataatctgttcgccatcggctcattgctcggcgggttcgatgccattcagctcggctgtggcggcggcgtctgcgccgttaccgcgctgcacgccgccagacagatccacgcccttgccggaggccggccatga

SEQ ID NO: 1089 - DNA, 1146 bp, Klebsiella pneumoniae
gtcattggtcgccttacgcagccggaacaacggcgcgacgctggcggcgatgctgcaggcaacctcccttgccgcgcaggccgatctgcgcgcgtctctgcaggcacgcgattttccttttcactacctgtgcggcgagcgcgacgcgaagtttcgcgccatcgcgcagacgctcgcggcggatctccatcttattcaccatgccggacacaacgcgcaccgggacaacccggcggcggtgattgcctgtctggcgcagattctggcaagttaactgaaggacattctatgatctctcttgatgaagcaatgctctacgcccccgttgaatggcacgattgctccgaaggctataccgatattcgctatcacaaatcgactgacgggattgccaaaatcaccattaatcgtccgcaggtgcgcaacgccttccgcccgctgaccgtcaaagagatgatccaggcgctggcggatgcccggtatgacgacaatatcggcgtcatcgtgctgaccggtgaaggtgagaaagccttctgcgccggcggcgaccagaaagttcgcggcgactacggcggctatcaggacgactccggcgttcatcatcttaacgtgctcgacttccagcgccagatccgcacctgcccgaaaccggtggtcgcgatggtggccggctactctatcggcggcggtcacgtgctgcatatgatgtgcgatctgactatcgcggcggaaaacgccatcttcggccagaccgggccaaaagtcggctctttcgacggcggctggggcgcctcctatatggcgcggatcgtcgggcagaaaaaagcgcgcgaaatctggttcctgtgccgccagtatgacgctcagcaggcgctggacatggggctggtgaataccgtggtaccgctggcggatctggaaaaagagaccgtgcgctggtgtcgtgaaatgctgcagaacagcccgatggccttgcgctgcctgaaagcggcgctgaacgccgactgcgacggccaggctggtctgcaggagctggcgggcaatgccaccatgctgttctatatgacggaagaggggcaggaaggacgcaacgccttcaaccagaaacgtcagccggacttcagcaaatttaaacggaatccataa

SEQ ID NO: 1090 - DNA, 465 bp, Klebsiella pneumoniae
cccggcggtcggctccagcgtaatgatcaccgccatcaccgacaccggcggcttctttatttttctgggtctggcgacgctgtttctaatgtagcctgcgcttttgcccgcaggcggcgggggatgatcgccatcgcgacaatccccgccagcacaccgatcgccagattgctggttcccaccgtcgcggcgacggtcaccagcatcaccagcgtttccggccacggattacgcgccagctcacccgggcgaatgctgcgccagctaaaggtcttcaccgccacgatcaccatcaccccggcgagaaccgccatcgggatcttcgccatcacctggctgagcgctgtcaccagcaggagcagcaccaggccggcgattaccgttgagaggcggctgcgggcccggcccatttccacgttcacgatagtctggccgatcatcgcgcagccggcgatgccgccatag

SEQ ID NO: 1091 - DNA, 855 bp, Klebsiella pneumoniae
gatcatctccgaggcgatggcaaaaaagtggtgacgccatctgcccgcagggagatggcgaccaaggctgtggctcattacgccatttctatccgtctggcttgccaggtgttcaaggtgagcgagggttgctaccgttatcagcccgtgctggctgatgaaaaccaggagattgccgactggctactgcgcctcaccgccaaccagcgcaactggggtttcggactgtgcttcctgtacctgcgtaacgtcaaaggctttggctggaaccacaagcgggtctaccggatctatcgggcgctagagctcaatctgcggataaaacccaagaagcggctagtacgcgccaagccggagccgttggcagtccctgaccaaccgaatcactgttggtcgatggactttatgcatgaccagctcagcgatggtcgttcggtgcggttgtttaatgtgatcgatgacttcaatcgcgaagcactgtgcatcgaggtggatttttccttgcctgcctcgcgagtcaaacgggtgctggagcaggtcatcgagtggcggggcaaaccagccgcaatccgctgtgataatggtccggaatacatcagcgaagagctcaagcaatgggcgcagcagaagaggattgcgctgacgtatatccagccaggcaacccgcagcagaatgcctacatagagcgatttaaccgcactgtgcgttacgactggttgggccattacctgtttgagtcactgaatgagttacaggaatttgccacgaactggctgtgggtttataaccatgagcggcccaatatggcgctgggcggttacacgccgaaacagcgcttggcacaggccgcatga

SEQ ID NO: 1092 - DNA, 1317 bp, Klebsiella pneumoniae
cgcagtatccgctctggactcaacgttcagacgcaccaccggctcggtattggacgtgcgcaggttaaagcgccactcagggtattcaatactgataccgtccgttgtgtcgatgtgtgcggccgccggctcatactgcgcccggatgcgcgctatcgcctccgccgcatttcccagcttgcggttgatctcccccgacgccgggaacgccgcctggcggtccgccaccagcgatttcagcgaactgttcttcagacacagcagctccgccaccagcagccacgggatcatcccgctgtcgcagtaggcgaagtcgcggaagtaatggtgcgcactcatttccccgccgtagatggcgtcttcctggcgcatccgctccttgatgaacgcatgccccgtcttcgacatcaccggctggccgccgctgcgggtcacgatgtccaccgtgttccacgtcagacgcgggtcgtgaatgattttcgcccccggctgcttctgcaggaacgcctccgccagcaggccgacaatgtagtacccctcgataaacgacgcctcgtcatcgaacaggaagcagcggtcgaagtcgccgtcaaaggcgatccccatgtccgcctgatgcgcacgcaccgcgtcggcggtgtcctggcggcactccggcagcagcgggttcgggataccgttcgggaaatggccgtccggctggtgatgcaccttgataaaggtcaccggcgccccggccgccgcgaagcgtttctccacttcatcaatcacgtgccccgccgccccgttgccggagttcaccaccagcttcagcggacgggtgaagttcgccaggtccacgtagcccatcaggtggtcgacgtactccttcagcaccgatatctggcgcagggtcccgcgacgcgccgggtccaccggcgcgaactggttctcctccgccaggcgctggatatcccgcaggccggtgtcgccgctgatgggcttcgcgttctcgcgcaccagcttcatgccgttgtagttcatcgggttatggctcgccgtcacctcgataccgccgtccaccccgaggtggaaagtggagaagtaaatctcttccgtgccgctcaggccaatatccagcacgtcggtgccggcgtccatcagcccgcgggccagcgccagcttcagcgactcgctggtgaggcgcacatcgccccccaccactatcttcccgggtttcagaaattcgccgtaggcgcggccgatacggtaggcgatgtcctcgttcagctcctcgcccagttcaccacggatgtcataagccttaaagcatgttaa

SEQ ID NO: 1093 - DNA, 915 bp, Klebsiella pneumoniae
ttcgcataccgtaagggggtagcgatgaaaccactgctggatgtcctcgtgatcctggatgctctggaaaaagaggggagctttgccgcggcgtcggcaaagctctttaaaacgccctcggcgctgagctacaccattcaccgcctggaaagcgatctcaatattcagctgctcgaccgcagcggccatcgcgcgcgctttacccccagcggacagatgctgctggagaaagggcgggaggtgctgcatatcgcccgcgaactggagaaccgggcggttaagctgcagcaggggtgggaaaatagccttcgtctggcggtggacagcacctttcccgtggcgctgctctcgccgccaatcgcggcattttatcaacaacagccgctgacccggctgcacttcacgctgaacccctcactactggactggcggccgctgactgacgggcaggccgatctgctgctgggggcgctcggcgagccgccgccgctgagcggttatgactatctccccctcggcgagctggagctgctgctggtcgttgccccacagcatccgctggcgcgacaccgcgcaccgttgagctggcgaaccctgcgccgttaccgggcggtggccaccggcgagggcggggcgctactcagcgatcaggagaccctgacggtgtgtgacgccgcggggcagctggcgctgctgcgcctggggctgggctgggggtgcctgccgcgctatcaggtgcagggtctgctggacagcggcgagctggtctgcatgaccgtgcgcgggctttcgcctcgtcaacgcgcgtggatcgcctggaatgacgccacctgcggtttggctggcaaatggtggcgggaaacgctattagcaaatagtgctatttttacaatttatcatacggaaaccgtatag

SEQ ID NO: 1094 - DNA, 231 bp, Klebsiella pneumoniae
tttattcaccgcataaatctaattaaagcccccgcggatacaactattttttgcttttttaaactaaaagttgatatcaccccggatatcggccgcgggagcgcccggcgtcgcggcggttatccagacatttctcaaccttcttttcataattcctccatttttacggccccttccctcactaaactagtatcattcagcgaaacgcttcaggatgagaccgtaaactaa

SEQ ID NO: 1095 - DNA, 291 bp, Klebsiella pneumoniae
agtcgatgccgacgatctgagcaacttccagctgtaatgaagcggatcttcctgaaaatctctgacactcgccttgagtgtcaggatgaacacccttccctgctggcggcgctggagtcgcataatatcgacgtcgaatatcagtgccgcgaaggctactgcggctcctgccgcacgcgtctggtctccggccaggttgactggctgaccgagccgctggcctttatccagccaggagaaattttgccctgctgctgccgggcgaaaggcgatattgagatcgagatgtag

SEQ ID NO: 1096 - DNA, 1221 bp, Klebsiella pneumoniae
actccgcgccgtctcctgaaactacagaaaaccaaacccatggaaaaccgtagcgccgctctcccccgacgcgggttcgatgtcacctcttccgccttcttaatcgtcgcctttctgacgggcattgccggggcgctgcaaaccccgaccctgagcctgtttctgaccaacgaagtgcacgtccgcccggcgatggtcggtttcttttttaccggcagcgcggttattggcattctggtcagtcagttcctcgccggccgctccgaccgtcagggcgatcgcaagcagctgattgtcgtctgctgtctgctgggggtgctggcctgcgtcctctttgcctggaaccgcaactatttcattttgctgttcatcggcgtttttctcagcagctttggatcgaccgccaacccgcagatgtttgccctcgcgcgggagcatgccgacaggaccggccgcgaagcggtgatgttcagctccattttacgtgcccaggtctccctggcatgggtgattggtcccccgctggcctacgccctggcgatgggatttggttttaccgcgatgtatctcagcgccgcggcggcgtttatcgtctgcgggatcatggtctggctattcttgcccagcatgcgtaaagcaaagccggtagcgaccggccggctggaagctccgcgcacgcatcgccgcgatgcgctgctgctgttcagcatctgcactctgatgtggggtactaacagcctgtacatcattaacatgccgctgtttatcattaacgagctgcatctgccggagaagctggcggggctgatgatgggcaccgccgccggactggaaattccgaccatgctgattgccggttactacgcccggcgtttcggcaaacgctttctgatgcgtctttctgcagtggccggggtgctgttttacgtcggcatgctgacggtgcatacgccagcgctgctgctggcgatgcaggtgctgaacgccatctatatcgggatcctcgccgggatcggcatgctctatttccaggacctgatgccggggcaggcgggcgcggccaccaccctctataccaatactacccgcgtcggctggatcatcgccggttcactggcgggggtagtggcggagatctggagctatcacgcggtgttctggattgcgctggcgatgggcgttgtcactcaggcctgcctgtggcggataagagacgtgtaa

SEQ ID NO: 1097 - DNA, 600 bp, Klebsiella pneumoniae
gtcgcgcgccggccagcagccagcgccagacgatcccctgaccggagacatggaacaacggcagcgacagcagccagtcatctcctgcggcaaacggcatcagcgccagcacgccagccgcgctggccagatgggcgctggcgctatgtaccgccgctttcggcaggccgattgaaccggaggtcaacgtcatcgacaccaaccgatcgccatgccagcaaacagcatgctcgccctcgaccaactgcagggttaacatcggtaaattccccggcaacacatcgccattcagcaccagctgatgctgcatggttaacgcgggtaacaacgcctgcagcaacaccgctggcagctgcggattcagcggcagcacccgcgccccgcactgcagcagcgccagccatgccagcagagtttccggctggttataggcccggagcgccacgccctgcccttccattacgccctgcgcggcaaaaccagacgccagcgcgtcaacccgcgcgcatagctcccgccaggtcagcggctggttattcagacgtaaggcgagggcctctccgcgccgctgacgccaatgccgccagggccagtcgttaa

SEQ ID NO: 1098 - DNA, 1344 bp, Klebsiella pneumoniae
tcggccagccggtcacgggacacacaggggaatacaatcatgagcttcaacacaatcatcgactggaacggctgtagcgcagaccaacaacagcaactcttaacgcgcccggcgatttccgcctccgacagcatcagtaaaacggtgacggagatcctgaataacgtcaaagccaacggcgacgcggcgctgcgcgaatacagcgcgaagtttgataaaaccaccgtcgccgcgctgcaggtgagcgaggcggagatcgccgccgccggcgagcgcctcagcgatgagctgaagcaggcgatggcggtagcggtgaaaaacattgagaccttccacaacgcgcaacagctgcaggcggtggatgtcgaaacgctgccgggggtgcgctgccagcaggtcacccgccctatcgcctccgtcggactgtacattcccggcggctcagcgccgctgttctccacggtgctgatgctggcgacgccggcgcgcatcgccggctgtcagcaggtggtgctctgctcgccgccgccgattgccgatgagatcctctatgccgcgcagctgtgcggcgtaaaaaccatctttaacgtcggcggcgcccaggccatcgccgccctcgccctcggtaccgagtcggtgccgaaggtggataaaatctttggcccgggcaacgcttacgtcacggaagccaaacgccaggtcagccagcgtctggacggcgcagccatcgacatgccggccggcccgtcggaagtgctggtgatcgccgacagtggcgccaacccggactttgtcgcctccgacctgctgtcgcaggcggaacacggcccggactcgcaggtgatcctcctgaccccggacgccgacatgggcagccgcgtcgccgaagccgtggagcgccagctggccgccctgccgcgcgccgaaactgcccgcgtggcgctctccgccagccggatcatcgtggcccgcgatctggcgcagtgcgtggctatctccaaccagtacggcccggagcacttgatcattcagacccgtcaggcccgcgagctggtggacagcatcaccagcgccggttccgttttccttggcgactggtcaccggaatccgcgggcgactacgcctcgggcaccaaccacgtcctgccgacctatggttacaccgccacctgctcaagcctcggtctggccgatttccagaagcggatgacggtgcaggagctgtcgcgcgacggctttgccgccctcgcctcaacgattgagatcctggccgccgccgagcgccttgacgcccacaaaaacgccgtaacgctgcgcgttgccgccctgaaggagcaagcatga

SEQ ID NO: 1099 - DNA, 939 bp, Klebsiella pneumoniae
atgagcagacgtgtagcaacgattacgttaaacccggcatacgacctggtgggattcaccccggagattgaacgcggggaagtgaacctggtgcgcaccaccggcctgcacgccgccgggaaaggcattaatgtggcgaaagtgctgaaagatctcggcattgacgtcaccgtcggcggcttcctgggtaaagacaaccaggacggctttcagcagctgttcagcgagctggggatcgccaaccgtttccaggtggtgcagggccggacccgtatcaacgttaagctgacggaaaaagatggcgaagtgaccgatttcaacttctccggctttgaagtcaccccgggcgactgggaacgctttgtcaacgactccctgagctggctcgggcagttcgatatggtctgcgtcagcggcagcctgccgtccggcgttagcccggaagccttcaccgactggatgacccgtctgcgcagccagtgcccatgcattattttcgacagcagccgcgaagcgctggttgccggactaaaagcggcgccgtggctggtgaaaccgaaccgtcgcgaactggaaatctgggctggccgcaagctgccggagatgaaagatgttatcgacgccgcccatgcgctgcgcgagcagggtatcgcccacgtggtgatctccctgggcgaagagggcgcgctgtgggtcaacgcctctggggagtggattgctaaaccaccttcagtggaagtggtcagcaccgttggcgccggcgattcgatggtcggcggcctgatttacggcctgctgatgcgtgaatccagcgagcataccctgcgcctggcgaccgccgtcgctgccctggccgtcagccagagcaatgtaggaattaccgaccgtacccagttggccgcgatgatggcgcgcgtcgacttacaaccctttaattga

SEQ ID NO: 1100 - DNA, 1098 bp, Klebsiella pneumoniae
caatatttgcgcttatgcggacagaattctcttctgtccgcctcaggacttctcttttcccccttttttcgtcaggataggcgtaactgttacaacattacatttatcctggagaaaagagtgaccagaaccaatttgatcaccggctttctcggcagcggtaagacgacctcgattcttcatctgctggcgcagaagcctgcggatgaaaaatgggccgtactggttaacgagtttggcgaagtcgggatagacggcgcgctgctggccgacagcggcgccctgctcaaagagatccccggcggctgcatgtgctgcgtcaatggcctgccgatgcaggttgggctgaacaccctgctgcgccagggcaaacccgatcgcctgctgatcgaacccaccggtttgggccacccaaagcagatcctcgatatcctcaccgcggcggtgtatgagccctggatcgatctgcgcgccaccctgtgcatcctcgatccccgccagctgctggatgaaagagccgtcagcaacgacaacttccgcgatcagctggccgcggcggacatcattgtggcgaataaaagtgatcgggaaacccccgaaagcgcccgggcgctggccgactggtggcagcgctggggcggcgagcgtcgcaaggtgtcggcaatccagggcaatatcgatctgaccctgctcgatgagccacgacggaacaccgccccgctgccggcgagcgcggagcacgcccaccgccattcccccacttccggcctcgccgcgctcagcctggcggaacaccagcgctggcgccgacatctcaacaatggccagggctatcagggctgcggctggatcttcgacgcggagacggtttttgacaccatcggcctgctcgaatgggccaggctggcgccagtggggcgcgttaaaggcgtgatgcgcattgccgagggggcggtgcgaatcaaccgtcagggggaggatctccatatcgagaccctcagcgtcgctccgcccgatagccggatcgagcttatttccgcgaatgaagccgactggaacgcactccagacctcgttgttgaggcttcgtttaagttaa

SEQ ID NO: 1101 - DNA, 1200 bp, Klebsiella pneumoniae
aacgtgacgctgaagcagaattcttcactggggattgtgtttatccttggcctgctggccatgctgatgccgctgtctattgatatgtatcttccggccctgccggtgattgccgcccagtataacgtcccggacggcagcgcgcagatgacgctcagcacctatatcctcggctttgcgctgggtcagctgctgtacggcccgatggcggacagccttggccgcaagccggtgatcctcggcgggacgctggtcttcgcggcggcggcggtagcctgcgccctgtcgcaaaccgtcgatatgctgattgtcatgcgtttcttccacggtctggcagccgcggcggccagcgtggtgattaacgccctgatgcgcgacatctatccgaaagatgagttttcgcgcatgatgtcgtttgtcatgctggtcacgaccattgcgccgctggtggcgccgatggtcggcggggcggtgttggtctggttcagctggcatgccatcttttggatcctcgccctggtggccctgctggcctcgctgatgatcggcctgtttatccgcgaaacgctgccggctgaaaggcgtcagccgttccatctgcgcaccacgctgggtaactttgccacgctgttccgccacaagcgggtactgagctatatgctggcgagcggctttagcttcgcgggcatgttctctttccttagcgccggtccctttgtctacatcaatataaaccacgtcgcgcctcagcactttggctactattttgcgctgaacatcgtttttctgtttctgatgaccatgttcaacagccggtttgtgcggcgggtaggggcgttgcgtatgttccgcgccgggctgtggatccagtttgccatggcggtgtggatggtggtctgcgcgctgctggatgtcggcttttggtcactggttatcggcgtagcggcctttgtcggctgcgtatccatggtgtcgtctaacgccatggcggtgatcctcgatgagtttccgcatatggcgggcactgcttcgtcgctggcggggactttccgtttcggtatcggggcgattatcggcgcgctgctgtcgatggcgacgtttaccaccgcctggccgatgctggtctctattgccttctgcgcaacctgctctattttcttctcgctttacgcatcccggcggcgaaaaatcgcacgctag

SEQ ID NO: 1102 - DNA, 465 bp, Klebsiella pneumoniae
tttagcctgcgacccgcgacaggtcgctcgcacgctgggcgacctggcgcaggcgcggccggggctgcgcctgccgggggcgctggatgccttcgagcaggcggtgcgcgcggtgctgggccagctggtgagcgtggcgatggccgcccggctcaccgccaaagtggcggctggctggggcgaaccgctggcggaggcgcctggatatgtcttgttcccgacgccagaggcgctgtcccgtgccgatccgcaggcgctgaaggcgctggggatgccgctgcgacgcgcggaggcgctgatccacctcgcccgggcggcgctcagcggcgagctgcccctgacggcgccggcggatatcgacgccgggctgcgtcaactgcaaaccctgcccgggattggccgctggacggcaaactactttgccctgcgcggctggcaggcgaaagatatctttttgccggatga

SEQ ID NO: 1103 - DNA, 951 bp, Klebsiella pneumoniae
gacgcctcgcgtcgcacccgggaacgttgcttagcttttcgcgcggctggcgatgatttcatccgccacattacgcggcgcttccgcgtaatggtggaactccatgctgtaggtagcccgtccctgcgacatcgagcgcagcgtggtggaataaccaaacatctccgccagcggcacgtcggcgcggatgatctggctgccgaagcgctcttccatcccctgcaccatcccgcgacgggaagagagatcgcccataatattcccggcgtactcttccggcgtctccacctcgacgtgcatcaccggctcaaggatcaccgggtccgctttgcgcgcgccctcccggaagccgaagatcgccgccatgcggaacgccatctccgaggagtccacgtcgtggtacgacccgaaggtcagggtcgctttcacgtcaaccaccggataacccgccagcacgccggtgcccatcgcttcgcgcagccctttctccacggaagggatgtactcgcgcggcaccacgccgcctttggtggcgtcctcgaagacgaaaccgctgcccggctccagcggctccagggtcagcacgacgtggccatactgccctttgccgccggactggcgcacaaatttgccttccacgtccgtcactttcttgcgcagggtttcgcggtaggtgacctgcggacggccaatgttggcctcgacgccaaactcgcgcttcatccggtcgacaatgatctccagatgcagctcacccatgccggagataatcgtctggccggactcttcatcggtatgcagacggaacgacggatcttccgccgccagccgctgcagcgcgatgcccattttctcctggtccgctttggtcttcggctcaatcgccagcgaaatcaccggctccggaaactccatccgttcgagggtaatcaccgcatccggatcgcataa

SEQ ID NO: 1104 - DNA, 459 bp, Klebsiella pneumoniae
catcatgcgctatttagcctaccgaggatatacgccatggccgtttatcaccatgcgctggtactgattaacagcagtcaggacggcgtcccgctgctccagcatgccgccagaatggcagaagagaacggcatgcgcatcaccatcgcccacatcagcaccgattaccgggcgctgaactatgtttccgacagcctgcgcgacgatcgggtctcgcaggaggtgatccaggccaaagccctgctcaacgagctggcctgcaccgtctccctgccggtggataccctctcgctggtgaccacccgccggtttgaagacgtggaaacctgcgttcggcagcggcagatcgatttaattattgccgggcaccataaccggctgctgggcgtcctctcctcacactcgctggagtacatcaaccacttaaacctggacgtactgatcaagcacctgccctag

SEQ ID NO: 1105 - DNA, 1029 bp, Klebsiella pneumoniae
taccagacgcggtctggtccaggatcggcgaatcaagcgagacagggtaagttgtcccgcccggcgttaaatatcttctacactgttacaggcatcacattcctgtgcggtcggcactcctgccggccgccgtcggcgttcagcccaggcacgggcctgcaggctggttatcctgaaagaggagtctgtaatatggcatttgtcaccacccaagacggcgtcaacatttactttaaagactggggaccaaaggaagctcagccgattgtctttcatcacggctggccgttaagcgctgacgactgggataaccagatgttatttttccttgccgaagggttccgggtcatcgctatcgatcgtcggggtcatggccgctccgatcaggttagcgaggggcacgatatggaccattacgcggcggacgtctcggcggtggtggagcatctggatctgcacaatgcggtccacgtcgggcactccaccggcggcggccaggtcgcccgctacgtcgcccgctacggtcagccgcaggggcgggtggcgaaggcggtgttaattagcgccgtcccgccgctaatggtgaaaaccgagcagaatccgggcgggacgccgatcgaggtgtttgacggtttccgcaaagcgctggcggcgaaccgcgcccagttctatctcgacgtcgcctctggcccgttctatggcttcaatcgtgatggagcagagatatcccaggggacgatccagaactggtggcgacaggggatgatcggcagcgccaaagcccattatgaaggcattaaggcgttttcagagaccgaccagacggaagaccttaagtcgatcactttgccggtgctggtgatgcagggagatgacgaccaggtggtgccctataaaaatgcggccatcctgcaggacaagctgctgccgaacagccagctgaaaatttatcctggcttcccgcacgggatgcatacctcccacgccgatactatcaacgccgatctgctggcgtttatccgcgcctga

SEQ ID NO: 1106 - DNA, 855 bp, Klebsiella pneumoniae
tcagcacagcgaaagagtcaggagcctgggatgaaaaaggtcgcgatagtcggtttgggatggctggggatgccgctggcgctgtcgttgacggcgcgaggctggcaggttaccggcagtaaaactacgcaggatggcgtggaggcggcgcggatgtgcgggatcgacagctatccgctgcgcctggagccgcagctggtctgtgataccgaggacctcgacgcgctgatgaacgtcgatgcgctggtgatcaccctgccggcccggcgtaccggggcaggggaagggttttatctacaggcggtgcaggagatcgtcgataccgcgctggcttaccatattccgcggatcgtcttcaccagctccacctcggtgtatggcaacgtcaacggtacagtgaaggagaattccccgcgtctgccgcaaaccgcaagcggacaggtgctcaaggagctggaggactggctgcacaacctgccggggacgtcggtggatattctgcgcctggccgggctggtggggccttcccgccatccgggacgttttttcgccggcaagtcggcgccggatggccagcacgtggtcaatctggtgcatttgcaggatgtggtggccgctatcgaactgctgctgcaggccccgaagggcgggcacatctataatctatgtgcgccccgccatccggcgcgcggcctcttttatccgcagatggcccgcgagctcggtctgccgccgccggtgttcagcgacagcccggacggcggccagggtaagattgtagatggcaatcgtatctgcaatgagctggggtttgagtaccagtaccccgatccgctggtgatgccgatggagtga

SEQ ID NO: 1107 - DNA, 1296 bp, Klebsiella pneumoniae
catcgacagcgagtaaacggacgcgaataccagaccaaaggtggagatgacggtgatcgtcggcaccactttatagctgccgaacaggatcataaattcgccgacgaagttaccggtgcccggcatccccagggtggcgacagcgaagaacatcgacatcgccggcagccatttaattttgctccacaagccgcccatctggcgcatatcgcgggtgtgcagacgttcgtacagctggccgcacagaatgaacagacccgccgcggacagaccgtgagcaatcatctggatcaccgctccctgataggccagctggctgccggtgtagatagcaatcagcacgaagcccatgtgggacacggaagtgtaggcgatcaggcgtttaatatcggtctgggcgaaggccatccacgcgccgtagaagataccgatcacgcccagccacatggcgatgggtgcaaactcggcggaggcattcgggaacagcggcagcgcaaagcgcagcagaccgtaggcggcggttttcagcaggatccccgcgaggtcgacagagccggcggtcggcgcctgggagtgagcgtccggcagccagccgtgcagcggcaccaccggcattttcaccgcgaaggcgatgaagaagccgagcatcagcaggtattccacgccgtgagacattggggttttcagcagatcttcatagttgaaggtccacacgccggtggcgttgaagtggacgaaggccagcgccagaatggcaatcagcatcaccagaccgctcgcctgggtatagatgaagaacttggtggccgctgtgatacgcgttttaccgtccgaggctttgtggccccacagcgcgatcaggaagtacatcggcaccaacatcatttcccagaagaagaagaacaggaacatgtcgatggcgaggaacacgccgataacgccgcccaggatccacatcaggttgaggtggaagaagccctggtatttttcgatttcacgccacgaacagagcaccgccagcacgccgaggagaccggtcagcaccaccatcagcagcgacaggccgtcgatcgccagatggatgctaatgccgaagcgtgggatccacggcagcacgaattccgactgccattgcggaatacccgcggattgcgtcagagaatagccgccctgcatccacagctgcaggccaagcaccagcgtcagtcccatggtaatcagcgcgatccagcgcggcactttcacgccaaagcgttcggtctgccagcacaggaagccgccgataaagggaattaa

SEQ ID NO: 1108 - DNA, 408 bp, Klebsiella pneumoniae
gtatcaaagcgtccaaggacggtatcctgcgccaggtggtgccggattacgaaaacctgcagaacgcctacgagctgctgtgggagatgccgaacaacgacggttatctgcagctggtgggtatcatgcagaagtttatcgaccagtcgatctctgccaacactaactacgatccgacgcgcttcccgtccggaaaagtgccgatgcagcagttgctcaaagacctgctcaacgcctataaattcggcgtcaaaacgctgtactatcacaacacccgtgatggcgctgaagacgcccaggatgacctggccccgtccatccaggacgacggctgcgaaagcggcgcttgtaagatctaaggtatttttgccgggtaacgctacgcttacccggcctacgtttgtgtag

SEQ ID NO: 1109 - DNA, 816 bp, Klebsiella pneumoniae
cttctttggcgtgcagttccacccggagcgctccgggagcgccggggcgcagctgctgaaaaacttcctggagatgtgatgattattcctgctttagatttaatcgacggcaccgtcgttcgtctccatcagggcgattacggccagcagcgcgactatggcagcgatccgctgccgcgcctgcaggcctatgccgctcagggagcggaagtcctgcacctggtcgacctgaccggggcgaaggatccggcgaagcgccagatcccgctgctgaaatcgctggtcgccggggttgacgtcccgatgcaggtcggcggcggcgtgcggaccgaagcggatgtcgcggccctgcttgaggccggcgtcgcccgcgtggtggtcggctccaccgcggtgaaatccccggaggaagtgaaaggctggttcaaacgctttggcccagaacggctggtgctcgccctcgacgtgcgtatcgacgccgacggcaataagcaggtggcggtcagcggctggcaggaaaactccggcgtgacgctggaggagctggtggaaagttatctgccggtcggcctgcagcacgtgctgtgcaccgatatctcccgcgacggcacgctggcaggctctaacgtctcgctgtacgaggaagtctgcgcccgctacccgcaggtggcgtttcagtcatccggcggcatcggcgatctcaatgatattgccgccctgcgcggcaccggggtgcgcggcgtgattgtcggccgcgcgctgctggaaggtaaattcaacgtaacggaggccattcaatgctggcaaaacggataa

SEQ ID NO: 1110 - DNA, 999 bp, Klebsiella pneumoniae
cctgtttggcgccatcggtggttttctggcgccgatcgtgcgcgtgcaggccgaaacgttgttcgccagcagcgccgccggactgttaaccctggccggcgtcgccattgtcggggtggtcattatcttttcattgagccttacccgcgcggtaccccagcgcggcagcgtacagcattgaataaaggaatcgctatgaacgcactgttatctaaccccttcaaacgaggattattacgcggtgagacgcaaatcggcctgtggctgagctccacctcatcctacatggcggagatcgctgcgacgtcgggatacgactggctgctgatcgacggcgagcatgccccgaacaccattcaggacctttatcatcagctgcaggcgattgccccctatgccagccagccggtcattcgcccggtcgagggcaaccgcagcctgataaaacaggtgctggatattggcgccagaaccttgctggtgccgatggtcgataccgccgagcaggctcgggaggtggtctcagcgacccgttatccccccatcgggagccgcggcgttggcgccggcgtggcgagagcggcgcgctggggaagggtggagaattatatggcggaggcaaatgacgaactttgtctgctgattcaggtcgagagccgaaccgcgctggagaacctggacgctattctcgaggtggacggcattgacggggtgttcatcggtccggcggatctctccgcctcgctgggctacccggacgatgccggtcaccctgacgtgcagcgggtgatcgagcagagcatccggcgcattcgcgcggcggggaaagcggccggatttctggcggtcgacccggcgatggcggaaaaatgtcttgcctggggggccaactttgtcgccgtcggggtggataccatgctgtatacccaggcgctggaccgccggctggcgatgtttaaatctgccagcgcccagccgcaagagaaaacgagctattga

SEQ ID NO: 1111 - DNA, 420 bp, Klebsiella pneumoniae
tattcccggcgtactcttccggcgtctccacctcgacgtgcatcaccggctcaaggatcaccgggtccgctttgcgcgcgccctcccggaagccgaagatcgccgccatgcggaacgccatctccgaggagtccacgtcgtggtacgacccgaaggtcagggtcgctttcacgtcaaccaccggataacccgccagcacgccggtgcccatcgcttcgcgcagccctttctccacggaagggatgtactcgcgcggcaccacgccgcctttggtggcgtcctcgaagacgaaaccgctgcccggctccagcggctccagggtcagcacgacgtggccatactgccctttgccgccggactggcgcacaaatttgccttccacgtccgtcactttcttgcgcagggtttcgcggtaggtga

SEQ ID NO: 1112 - DNA, 564 bp, Klebsiella pneumoniae
cacccccggcggtatcgaacccagcccggccagcgtcccctgcagcaccggcagtatgccatacaacgcgagggctatcagcgccggcagccagccaaagcccagcaccggcaccgccatcgccagcaccgccaccggcggaaaggtctgcccgatagcggcgatggtctccaccagcggacgaaacgcgccgccggcgggccgggtgaccgccaccccagcccccagcccgattgccgttgccgcgaggctggacgccaccaccagccagccgtgatcgagagtgagcgcccagaagctctcctgctggtagaccggccgcggcagctccgggaacagccgactgaacagcggcgcgctgtagggcagccctgccagcaggccgataaacagcgcgataagccaccacagcggctcacgaagcgccttcatggctcatctcctgacgcagcagatcggcaaaatgcagcgtaccgcagggcctgccttcggcatcgaccaccggcagcgtctcgcagcgccgggcgacaaactgcgacagcgcttcccgcagggtcatggtga

SEQ ID NO: 1113 - DNA, 810 bp, Klebsiella pneumoniae
gaccgacggcgcgcagacccttcagcagctgctggcgcaggtaagtcgcctgtgatcctcagcgctgctgtcgacaacggccagccgggctatccctggctggtgtttctgcacggtttttccggcgaccgcaacgagtggcggaaagtgggcgacgcctttcccgcctggccgcggctgtacctcgatctgccggggcacggcggctccgcggatatcgcggtgcaggactttgccggggtcaatactctgctgcagtctacgcttaatagttacagcatacataagtattggctgatcggctactcgctgggcggccgggtggcaatgaacttcgccagccagccgcgcgcaggcatgcgcgggctgatcgttgaaggcggccatccgggcctgcaggatgtagaggcgcggcaggtgcggcgcagcaatgaccgcgcctgggcggaacgttttcaccgcgagccgcttgagcaggtctttgccgactggtatcagcagccggtcttcgcttcgctgaatgccgtgcagcgtgagtcattggtcgccttacgcagccggaacaacggcgcgacgctggcggcgatgctgcaggcaacctcccttgccgcgcaggccgatctgcgcgcgtctctgcaggcacgcgattttccttttcactacctgtgcggcgagcgcgacgcgaagtttcgcgccatcgcgcagacgctcgcggcggatctccatcttattcaccatgccggacacaacgcgcaccgggacaacccggcggcggtgattgcctgtctggcgcagattctggcaagttaa

SEQ ID NO: 1114 - DNA, 1206 bp, Klebsiella pneumoniae
ttaacgcagctcgttggcgcgacgaaaacgcccctgataatcgaacactttttcccgcacctgccagtactgccccttcatgcgggcgacgacaaagtccggatggcgcagcagcgcctgctgggtcacgatatccgccggcgttatccagcgcagcggcaccccgggggtgcgggtatgcgggcgaataaacagttgttcgaaggcggtgcgctgggcgggggtctgcagacggaagcgctcactgacatccgccccgtcttcatcgtagtaggtgattttcagccacgggcccttctcgtcgccgccgtgctgcagggccatgccgctgcagcgcagcaccagcgcgtccttcagtttcagcgccgccttcagcatatcgtccgggtcaaccagtatagtgtcgcactcccggcagcggcgggcggcgatgtcgttttccgcattacactgcgggcagtttttaaagcgaaagcggaagtcgcactgttcgcggtggccgtcgtcatcttcgaaccacccctggcagcggcggccaaagtgttcaatcaaggtgccgtcggcggtggttttgccccagaaggtattggcgaagccgcaggccgggcagaagacctgcaccggcacgttgtcgcttttgcccttcggcgtccccacttccggggcatacaggtcatgcggattgccggcgtagtcgaggatcagacagtcggttttccccggcgccaggcgcagaccgcggccaacgatctgttggtaaagactcaccgactcggtggggcggaggatggcgatcaggtcgacgtgcggggcgtcgaagccggtggtcagcaccgcgacgttcaccagatagcgatacgcctgcgctttaaaggcctcgatgatgcgatcccgctccggcccaggcgtttcgccggtgatcagcgccgcctggcctaccggcagcaggccggtcacttcccgggcgtgttccacggtggcggcaaagatcatcacccctttgcggttttcggcgaactccacgatctggctgacgatatgcggcgtgatacgctgttgttttttcagctcatggttaagatcggcttcgctgaacaggccgttgctttgcgcctgcaggcgactgaaatcgtactgcaccaccggcatatcgaggcgctccggcggcgtcagatagccgtgtttaatcatatagcgcagcggtag

SEQ ID NO: 1115 - DNA, 585 bp, Klebsiella pneumoniae
ggagaaaagctttttatggatatcaatcacctgatttcccagtatggctacgcggcgctgatcgtcggcagcatggcggaaggtgagaccattaccctgctgggcggcgtcgcggcgcatcaggggctactgaaatttcccctggtggtgatcgccgtcgccctcggcgggatgattggcgatcagctgctctatctggtcggtcgccgcttcgggggacgcatcctgcgccgtttcgccagtcagaaagcgcggatccgtaaagcgcagcgtatgatccagcaccggccgtggctgtttgtcatcggcacccgctttatgtatggcttccgggtaatcggccccctgctgatcggcgccagccgcctgccgccgcgcattttcctgccgctgaatattgtcggagcgctggtgtgggccctgctgtttaccaccattggctatctcggcggcgaggtggttggcccgtggctgcatcatctggacgcccatctgaagcactggatctggctgatcctcgcggtggtggtggtggtggccgcccactggtggctcaggcggcgcgagagtaagaagaaagactaa

SEQ ID NO: 1116 - DNA, 216 bp, Klebsiella pneumoniae
gtgcagaatagggcggatcgcagttcaccgccgcggattcaggctaatatgtcgtcatatccggctgtttatgctgaaatatattgcctggcgaaatttattatctctatctattctttccaggcatacgcgcggcgcggcggggccggcggccaacagaccccgatagacgggcctctcagccacatcgcgcggcgcaaaggaacgagccgctga

SEQ ID NO: 1117 - DNA, 546 bp, Klebsiella pneumoniae
cagcgcatcagcgatagcggcaaattgcgccgcttcgcggggatcgatcaccatcgccggcgaggcgccgacggccagcagaacattggcggtaaaggtctgcaccacgtcattagtcatgcagtgcacaaggggggaatgggcgcgcagcagatggcgcaggtgcgcgacaggcgcgggattcaacagctcaggcatagtttgctcccgccagacgaggtagaagcaatgaccctgcggtctctgacttccctacgctggcattatccagatcaggtggtacgggtatttctcagccttcaacgaagaagggcaccccgagtcaaaatagtgaaattgttaagcgttgtggaatttaccgcaactcaccggttcatacaacaagcctttagccctggatacgacaccttcgcggccatcatgctcttcaggcgaccgggcgggattgcattccgctgctggcgggcggaaaataatgacatcatgcgctatttagcctaccgaggatatacgccatggccgtttatcaccatgcgctggtactga

SEQ ID NO: 1118 - DNA, 357 bp, Klebsiella pneumoniae
ctttccaccagctcctccagcgtcacgccggagttttcctgccagccgctgaccgccacctgcttattgccgtcggcgtcgatacgcacgtcgagggcgagcaccagccgttctgggccaaagcgtttgaaccagcctttcacttcctccggggatttcaccgcggtggagccgaccaccacgcgggcgacgccggcctcaagcagggccgcgacatccgcttcggtccgcacgccgccgccgacctgcatcgggacgtcaaccccggcgaccagcgatttcagcagcgggatctggcgcttcgccggatccttcgccccggtcaggtcgaccaggtgcaggacttccgctccctga

SEQ ID NO: 1119 - DNA, 1545 bp, Klebsiella pneumoniae
ccgagaaccagtccacctttattccgattggcgccgagcacagcctggaaaacccgggccgcattccgctggaagtgctggagatccagtcggggtcgtacctcggcgaggacgacattattcgtattaaagaccagtatggtcgttgctaattttttcgggacaaaacgcagaatgacacagttaacatgctttaaggcttatgacatccgtggtgaactgggcgaggagctgaacgaggacatcgcctaccgtatcggccgcgcctacggcgaatttctgaaacccgggaagatagtggtggggggcgatgtgcgcctcaccagcgagtcgctgaagctggcgctggcccgcgggctgatggacgccggcaccgacgtgctggatattggcctgagcggcacggaagagatttacttctccactttccacctcggggtggacggcggtatcgaggtgacggcgagccataacccgatgaactacaacggcatgaagctggtgcgcgagaacgcgaagcccatcagcggcgacaccggcctgcgggatatccagcgcctggcggaggagaaccagttcgcgccggtggacccggcgcgtcgcgggaccctgcgccagatatcggtgctgaaggagtacgtcgaccacctgatgggctacgtggacctggcgaacttcacccgtccgctgaagctggtggtgaactccggcaacggggcggcggggcacgtgattgatgaagtggagaaacgcttcgcggcggccggggcgccggtgacctttatcaaggtgcatcaccagccggacggccatttcccgaacggtatcccgaacccgctgctgccggagtgccgccaggacaccgccgacgcggtgcgtgcgcatcaggcggacatggggatcgcctttgacggcgacttcgaccgctgcttcctgttcgatgacgaggcgtcgtttatcgaggggtactacattgtcggcctgctggcggaggcgttcctgcagaagcagccgggggcgaaaatcattcacgacccgcgtctgacgtggaacacggtggacatcgtgacccgcagcggcggccagccggtgatgtcgaagacggggcatgcgttcatcaaggagcggatgcgccaggaagacgccatctacggcggggaaatgagtgcgcaccattacttccgcgacttcgcctactgcgacagcgggatgatcccgtggctgctggtggcggagctgctgtgtctgaagaacagttcgctgaaatcgctggtggcggaccgccaggcggcgttcccggcgtcgggggagatcaaccgcaagctgggaaatgcggcggaggcgatagcgcgcatccgggcgcagtatgagccggcggccgcacacatcgacacaacggacggtatcagtattgaataccctgagtggcgctttaacctgcgcacgtccaataccgagccggtggtgcgtctgaacgttgagtccagagcggatactgcgttaatgaatgcaaaaaccgaagagattttagctcttctcaagtaa

SEQ ID NO: 1120 - DNA, 1224 bp, Klebsiella pneumoniae
ggttggcgcagccggtatcaaggatcaccacattcattacagcacccctttggaagacggcagggcatcgccctggacgcggatcgcctggcgcagcgtacggccaaaggctttgaacaggctctccacgcggtggtgatcgttcttacccttggttttcaggtgcagggtcaccgccatggtgtaggagagcgagcggaagaagtgttccaccatctcggtgctcagatcgccgacgcgctgataggtgaagtccgccttatactccaggtgcggccggccggagatatccagcgcgcagcgggcgagacactcgtccatcggcagcacgaagccgaagcggttaatgccgcgcttgtcgccaagcgccagcttcagggcttcgccgagggccaggccggtatcctccaccgtgtggtgatcgtcgatgtacagatcgccgccgacgttaacctccatgcggaagccgccgtgggtggcgatttggtcgagcatatggtcaaaaaagccgacgccggtatggatcttgctgccgccttcgcggtccagccacactttcacatccacctgggtctctttggtgatgcgctcgacgtgggcatagcggtcgcggcgggtcagctgctcgcagatggtcggccagtcgagcgtctcgcggtcatagcgcagaccggtaattcccatgttatccgccagctcaaggtcggtggcccggtcgccaatcacatagctgtgggctttatccagcacgccctcttccagccacggcagcaccagctgcgtttttggcttgcggcaggcgcagttgtcgcccgggaagtgcggacaaatcagcacctcttcaaagttaacgccctgcgaggcgaagatctgcatcatcaggttgtgcgggccatcaaacgcttcctgcggcagactgtcggttcccaggccatcctgattggtgatcatcaccagcttatagccttcctgctgcagcttcagcagccccgggatcacctgcggctcaaacgccagcttgtcgaaccggtccacctggaaatcctccggcggttcggaaatcagggtgccgtcacggtcaataaagagatacttctgggtcatacattctccgcagtcaaggcgtcaatcacgcgctggctctcggcacgggtaccgatagtgatacgcaaacagccgcttaatgaaggttgtttattctggtcacgtaagataatgccctga

SEQ ID NO: 1121 - DNA, 783 bp, Klebsiella pneumoniae
gcgcgcagcagaagttgttacagtgcaggtgttggattgcaactgctgcggcaggcaaaacctgatcacctggcgtttcgtcgggggtcaggtttttttgtttctggggtctatatgcaaatcgccaaagtactcaataacaatgtggtggtggttctcgacgagcaccggcgcgaacaggtggtgatggggcgagggctggcctttcagaaacgcccgggcgacgtgctggacgacagtaaaattgaaaaagttttcgccttacaaagcgatgagctggtcggccgcttaggcgagctgctcagtcaaataccgttagaagtgatgaccacctgcgatcgcattatcgacctggcacgcggacggctgggcaagttacaggaaagtttgtacatcacgttaacggatcactgtcattttgctatcgagcggcagaaaaagggcatcgcactgcgtaacgtgctgctgtgggagattaagcggctgtatccgaaggagttcgcgctgggccaggaggcaagggccatcattgccaaaaggctcggcgtgaagctggcggaggatgaagccggatttatcgccctgcatctggtgacggcgcagctcaacagcgaaatgccggaggtcatgcacgtgacccgggtgatgcaggagatcctgcagctggtgaagtatcagctgcagccttactacgatgaagagtcgctgagctatcagcgtttcgtcacccacctgaagtttttcgcccagccgatgctgacggcgcacggtgatggaagatga

SEQ ID NO: 1122 - DNA, 1374 bp, Klebsiella pneumoniae
aaaacagcaagggccacggaggctgatatgttaagtatttttaaacccgccgcgcataaagcgcgtttgccagcagcggagattgacccgctatatcgccgattacgctggcagatttttattggcatcttttttggttatgccgcctactatttggttcgtaagaactttgccctggcgatgccttatcttatcgagcaggggttctctcgtggcgacctcggcttcgccctttccggtatctccatcgcctatggattttcgaaattcatcatgggatcggtctctgaccgctcgaatccgcgcattttcctgccggctggcttgatcctcgccgcgctggtgatgctggtgatgggcttcgtgccgtgggcgacgtccagcatcatgataatgttcgtgctgctgttcctctgcggctggttccaggggatgggctggccgccgtgcggccggaccatggtgcactggtggtcgcagaaagagcgcggcgggattgtctcggtgtggaactgcgcgcataacgtcggcggcggcattccgccgctgctgttcctgttagggatggcgtggtttaacgactggcacgcggcgctgtatatgccggcattcggcgccattctgctggcgattttcgccttcgcaatgatgcgcgacaccccgcagtcctgcggtctgccgccgattgaagaatataaaaacgactacccggacgattacagcgaaaagcacgaagaagagctgacggcgaagcagatctttatgcagtacattctgccgaacaagctgctgtggtacatcgctatcgctaacgtcttcgtttatctgctgcgctacggcattctcgactggtcgccgacctacctgaaagaagttaaacacttcgcgctggataaatcctcctgggcctatttcctgtacgagtacgcggggatcccgggcacgctgctgtgcggttggatgtcggacaaagtgtttaaaggcaaccgcggcgccaccggcgtgttctttatgaccctggtgaccatcgccactgtcgtttactggctgaacccgccgggtaatccgggcgtcgatatggcctgtatgatcatcattggcttcctgatctacggcccggtgatgctgattggtctgcatgccctcgagctggcgccgaaaaaagccgccgggaccgccgcgggcttcaccggcctgttcggctatcttggcggttccgtggccgcgagcgctatcgtcggctacaccgtcgatttcttcggctgggacggcggctttatggtgatgatcggcggcagcgtgctggcggttatcctgctggttatcgtgatgctcggtgaacgtcgccatcaccaacagctgaaacaagcctaa

SEQ ID NO: 1123 - DNA, 1026 bp, Klebsiella pneumoniae
gatcaggggcttcacatgagtgcgttaaataaaaagagttttctcacttacctgaaagagggtgggatatatgttgtccttctggtcctgctggccattattattttccaggatccgacatttttaagtctgctcaacctgagtaatattctgacccagtcctcggtgcgtattattattgccctcggcgtggccggacttatcgtcacgcaggggaccgacctctccgccggccgtcaggtgggtctggcggcggtgattgccgccaccatgctgcaggcggtggataatgccaataaggtattcccggatatggcgaccatgccgatcccgctggtgatcctgctggtgtgcgccatcggggcggtcatcggccttattaacgggatcgtcattgcctacctgaacgtgacgccgtttattaccactctcggcaccatgatcatcgtctacggcattaactcgctgtactacgacttcgtgggcgcgtcgccgatctccggcttcgacagccacttctcccatttcgcgcaggggtttgtggcgctgggttccttccgcctgtcctacattaccttctacgcgctgattgccgtcttctttgtctggatcctgtggaacaagacgcgctttggcaaaaacattttcgctatcggcggtaacccggaagcggcgaaggtctccggggttaacgtagcgttaaacctgctgatgatctatgccctctccggcgtgttctacgccttcggcggcctgctggaagccggacgtatcggttcggcgaccaataacctcggctttatgtatgaactggacgccatcgccgcctgtgtggtgggcggcgtatcgttcagcggcggggtagggacggtgtttggcgtggtgaccggggtgattatcttcaccgtcatcaactacggcctgacctatatcggcgtcaacccttactggcagtacattattaagggggcgattattatcttcgccgtggcgctggactccctgaaatacgcccgtaagaaataa

SEQ ID NO: 1124 - DNA, 900 bp, Klebsiella pneumoniae
gggagaaaaaggatgaaaaccctacagtattcattcgcacagattgaagccttcgcgacgattgctgagaccggcagcctgtcgcaggcggccattcgtttagctaaagaccggaccacgctgcgcgatctgctggactatctggaagatgctctgggctaccggctgttcagccatgaaggacgtagcctgacgctaactgccgagggtgagcagctgtttcgccaggcgcatctgctgttgcgtcaggcgcaggctttcgagtcttttgcgcaaacgctgccgcaaaccgccgggcaggcgctgcgtctggtgtacgatcccttcgttccgcgtgaatttctctgtgcgctggccgataacctggcccgacggcagatccgcctgagctgctggagcgcctcgcgtcgcgaagccgagcaggcgctgagcgatggcgtggcggagatggcgatttgtcaggctaacaaccgcacgctggggagcgaaatggagtggcgggcgctcggcaccgtggatctgcgtttttacgcggcggacagcctgttccacgacgctccgcggccgctgacgctattgaatctttcgttgacgccgcagttagtgatgcaccggcgcagtgacgatcaaatcgcccgccggctgcagatttccggccatacgctgtatatgaatgaaattaccctgttgcgccatgcgctggagcaggggaggggctgggggtttttaccggaccatttgcggccaggcgagtggcagggagtcagtgaaatcgcgacggaggtcggcagtcaggggctgaacgtcactatggtgatgctctggctgcccggaatgaataagcatcggatgcttaacgacatcgtgcacgaggcgccggagctttggcagcgcagataa

SEQ ID NO: 1125 - DNA, 1059 bp, Klebsiella pneumoniae
agtccgcgaaggagagaaaggatgagtaccgcaatccttgcgcccggctcacgcggccggcgcttatcaaaacggctactgcaggtggtgattacactgttcggcctgctgctgctgacctttaccattggccgcgtcatgcccatcgacccggtgctggcgattgtcggcccggatgctgaccagagtacctatcagcaggtttaccagcagctggggtttgataaatcgctgaccacccagtttggcatctatttcgtcaacctgttgcacggcgatctgggcaacgcgctgctgaccgggaaaccggtggtggacgatattatccgcgtcttcccggccaccatggagctggcaacgatggcgattattgtcggcgcgggtcttggtattccgctgggcgtgttggcggcggcgcggcgcaatagcgtctccgattatgtggtacgcattatcagcctggcgggctactcgacgccgatcttctgggtcgggatgatgggactgctggtgttctatgcctggcttggctgggtaggcggcgccgggagggtagacctcgggctggatggtatggtgccgcgccgcaccgggctgatgaccgttgatgcgctgctggccggcaacggccaggtgttctggaacgccattaatcatctgattcttcccgcctcgctgctgggttttcactcgctggcttatatcagccgtatgacccgcagctttatgttagcccagctgtcgcaggagttcattattaccgcccgggtgaaagggctgaccgagcgccaggttatctggaaccatgcgtttcgtaacatcctcgtgcaactgctgacggtggtggcgctggcctacggcgcgctgctggaaggcgcggtactgattgaaaccgtcttctcatggccggggtttggctcctaccttaccggaagcttgctgctgggcgatatgaatgcggtgatgggctgcgtgctgctggtgggggtgatcttcgtgatgctcaacctgctctccgacatgctgtatcaattctatgacccgaggacaaaatcatga

SEQ ID NO: 1126 - DNA, 222 bp, Klebsiella pneumoniae
tatccaccgagccaagagagctttcactcccttactcaatccagcctctctcaagtactgatgttgcaaatcccatgcataacgaataggagaatgaacataacttatgtgaagttggtcaggtcctgtaagcacgcccttagcgactgcatggctactaagaagtattacatcatgcttagagacatcaagctgttcaattgccagtggcataaatggtaa

SEQ ID NO: 1127 - DNA, 828 bp, Klebsiella pneumoniae
ggaagtcagagaccgcagggtcattgcttctacctcgtctggcgggagcaaactatgcctgagctgttgaatcccgcgcctgtcgcgcacctgcgccatctgctgcgcgcccattccccccttgtgcactgcatgactaatgacgtggtgcagacctttaccgccaatgttctgctggccgtcggcgcctcgccggcgatggtgatcgatccccgcgaagcggcgcaatttgccgctatcgctgatgcgctgttaattaacgtcggtaccctgaccgaagatcgcgccgtggcgatgcgcgccgcggtggagcacgcccgtcaggccggcaagccctggacgctggatccggtggcggtcggcgccctgaccgtgcgcacggccttttgtcacgagctgctggccctccagccggcggccattcgcggcaatgcctctgaaattctggcgctggccgggatgagcgccggcgggcgcggggtggataccaccgatacggccgctgcggcgctgccggcggcccaggcgctggctcgtcggctggctaccgtggtggcggtcactggcgaggtggactacgtcaccgacggcgagcgggtgctcagcgtggcggggggcaatccgctgatgacccgggtggtgggcaccggctgcgcgctgtcggcggtggtggcggcgagcgcggcgctgccgggagaccggctggaaaacgtggccgccgcctgcgggctgatgaagcaggccggggagatcgccgcccgtcagggaggcccaggcagctttattccggcgtttctcgacgcgctgtatcaggaggtgcagggatga

SEQ ID NO: 1128 - DNA, 654 bp, Klebsiella pneumoniae
cgtgcaaagagtagccctgttgccctctccgccgcgaagcgtgcgggaagcagccttataaggagaaagcccatgcgtctgtgtgaccgagatatcgaagcctggttggatgaagggcgactcgccatcaatccgcgtccgcccgttgagcgtattaatggcgcgacggttgatgtacggctgggtaataaattccgcaccttccgtggccacacggcgccgtttatcgatttaagcggcccgaaggccgaggtcagcgccgcgctggaccgcgtgatgagcgaagagatcgtcctgccggaaggggaggcctttttcctgcatccgggcgaactggcgctggcggtgacctacgagtctgtcaccctgcctgccgacctggtaggctggctggacggacgctcctcgctggcgcgcctggggctgatggtgcacgttaccgcgcaccgtatcgatccaggctggtccggctgcatcgtgcttgagttctacaactccggcaagttgccgctggcgctgcgcccggggatgcccatcggcgcgctgagctttgaaccgttatcgggcccggcggcccggccgtataaccgccgtgaagacgccaaatatcgcgaccagcagggcgcggtggcgagccgaatcgacaaggattga

SEQ ID NO: 1129 - DNA, 738 bp, Klebsiella pneumoniae
tttaccgagagacgtatgactgaattgcctgtagatgaaaacaccccacgcatccttatcgtggaagatgaaccgaagctcggccaactgctgattgattatctgcaggccgccggctatgcgcctgcgttgattaaccacggcgacaaggtcctgccctacgtccgccagacgccgccgcacctgatcctgctggatctgatgctgcccggtaccgacggtctgacgctgtgccgggaaattcgccgcttctccgatgttccggtggtgatggtgacggcgaaaatcgaagagatcgaccgtttgctggggctggaaataggcgccgacgactatatctgcaagccctacagcccgcgggaagtggtcgcccgggtaaaaaccatcctccgccgctgcaaaccgcagcgcgatctgcaggcgctggacgcccagagcccgctgattgtcgacgaaggtcgttttcaggcctcctggcgcgacaagctgctggacctcactcccgccgagttccggctgctgaaaaccctctcccaggagccgggcaaagtgttctcccgcgaacagctactcaaccatctgtatgacgattatcgggtagtcaccgatcgcaccatcgacagccacatcaagaacctgcggcgcaagctggaggcgctggacgccgagcagtcgtttatccgcgcggtgtatggcgttggctaccgctgggaagcggacgcctgccggctggcgtag

SEQ ID NO: 1130 - DNA, 549 bp, Klebsiella pneumoniae
  unsure (403),(404),(405),(407),(408),(409),(410),(411),(414),(415),(416),(417),(418),(419),(420),(421),(422),(424),(425),(426),(428),(429),(430),(431),(432),(433),(434),(435),(436),(437),(438),(439),(440),(442),(443),(444),(445),(446),(447),(448),(449),(452),(453),(454),(455),(456),(458),(460),(461),(462),(463),(464),(465),(466),(467),(468),(469),(470),(471),(472),(473),(474),(475),(476),(477),(478),(479),(480),(481): Identity of nucleotide at the above locations are unknown.
agaggagagagaggagaaggaggagggaggagaggaagaaagaggggaagaggagagggaagaagagggaagaaaggaaggagagagaagaagaaggaggaggggaggagagggagaaagaggaggggaaagaagaagagggggagaagaggggaaggagaagagagagggaggggggggggaaaagaaggggagggaagaaggggagaagggggagggagagggagaggggaagaggggagaggaagggggaggaggggaggaggagagaggaggggaggggaggaaggggggggaaagggagggggaagaggaaaaggaaaaaagagagggagggagggaaggagagaggagaggaggaggaagggggagggggagaggagaggggggggggggagggggnnngnnnnnggnnnnnnnnngnnnannnnnnnnnnnnnannnnnnnnaannnnngnannnnnnnnnnnnnnnnnnnnnncccccacccgacacaacaaaccgcactcaaacgtgaatgtagtcgaattcgttgaaaatcggtcctga

SEQ ID NO: 1131 - DNA, 273 bp, Klebsiella pneumoniae
gcgtttgggagtcgggttgtggaatgtcgtactgattgtggcgcatgttgcatcgccccctctatatcatcgccgatccccggcatgccgcagggcaagccagctaacacccgttgtatccagctttccgagcgcaatttatgccttattttcggctcccctctgcgcccgaaggtgtgcgccagcctgcagccctcgccggagatgtgcctcacccaccgcgatgaagcgatcacctggctgctggagcttgagctggccaccgcgccctga

SEQ ID NO: 1132 - DNA, 1362 bp, Klebsiella pneumoniae
  unsure (397),(405): Identity of nucleotide at the above locations are unknown.
tcctcagggagcctgagcatggccgataacacacttcactcttccgcccgcgctaactggctggagcgccgctttgcgctgcgctcgcgcggcggcacgctacgcaccgaatgcctggccgggatcaccggtttcctcgccgccgcctatttactggtggttatcccggggctgctggcgatcggcgggatggataaaggcgccgccaccaccggcaccattctggtcttcgtcgtcggctcgctgctgatggcgttttatgccaacctgccgtttatcgtcggcccgggcattggcggctcggtgctggtgggggtgacgctggccggtagcgaagggattggctggcagactggcctcggaattgcctgctggtcggggatcatttttttcctgntgacccgntttggcctgcgcgaagtggtcacccgttcggtgccgcagtcgatcaagctgggattgacggcctccatcggcctgtttgtcgccgtcctcggttttcgcaatgccgggctggtgctggccaatgcgaaaaccaacgccctgatgctcggcgactttctcgcccccggcgcgctggtggcgctgtgcggcctgttcctggcgatagccctgcaggcgcgtaaggtaccgggcgccattttgtgggccattctgtgcgccaccctggtgggcatccccttcggcgtcacccatctgccgacaagttttatcgacgttccccattcgctgaccccggtgctgggacaggttgacctgctgggggcgttaaacatcgccttcctgccgttcctgttcgtctttttcgcatctgagtttttctccaccatggggacaacgctggcggtgggcggcgaggcgggtctgctggatgaagaaggcaacatgccgcagattaatcgcccgttcatggtcgattcgattgccgccgcgctcggcccgtgggtgggcattccggcggctacggcgctgattgagtcttcggcggcagcggaagcgggcggcaaaacaggcctcaccgccctgtcggcggcggtaatgttcctgctgatgctgctgttcacgccggtggcgttgatgatcccgaaagaagccaccgccccggcgctgatcctgattggcctgaacatgttcagcggcctgcgcaaagtggatcttgccaacttcaccgacgggctgccggtgctgatgatggtgatgatcacccttatcgccaacagctttggcaccgggattgccggcgggctgctgttttacattgtgatcaaggctatcgccggtaagtggcgggagatcccgattggcctgtgggtattggccgtcccgctggtgtattacttcgcgaccttagtcaggcattaa

SEQ ID NO: 1133 - DNA, 408 bp, Klebsiella pneumoniae
catccaattggaacgctagcggagtatataatgccaagttcaggcccattatggcaactaatgaaatatgggttagttgggatagtcaatacactaattacggcagttgtaattttcctgctaatgcatttgggtcttggcatttatctgtccaatgcgatgggttatgttgtaggtattgttttcagcttcatagcaaacacaatatttacatttacgcaaccaattagtatcaatagactaataaaatttttatgtgtttgcttcatttgttatgtggcaaatatcattgtcataaaaatattcttcgtttttatgccagaaaaaatatattcagcacaaatccttgggatgttcacatacactatcacaggttttattttaaacaagttctgggcgatgaaatga

SEQ ID NO: 1134 - DNA, 369 bp, Klebsiella pneumoniae
cgtcaccctggcggtgatggccagcggcatccgccatattgtcaccgacggcatgcgcgccccggcgaaggtttatctcctgccccaggcggtctggcagcaggccctgtaaacccggcgcatcgcccccatcgcgggacgatgcgctttaccatcaggatgacggcgcgctatcgggcaacacaatattgctctgcgccagcgttcccatctggttgtacatcacgctggcggcatccaacaggtgcatcgccagcgcggcgccgctgccctctcccaggcgcatgtccatatcgagatacggccgcagacccagcgcgtcgagggcgatctgcgcccctttctccgccgacaggtgtgaaggaataa

SEQ ID NO: 1135 - DNA, 1038 bp, Klebsiella pneumoniae
ataccgcccggtttaaaaggagagtttaacatgagtctggatatcgaccagattgccctgcatcagttaatcaaacgtgatgaacaaaatctggagctggtgctgcgcgagtcactgctggagccgaacgcgacggtcgtcgagatgatggctgaactgcaccgggtctatagcgccaaaagcaaagcctatggcttgttcaatgaagagagcgaactggcccaggcgctgcgcctgcagcgtcagggggaagaagagtttctggcgtttagccgcgcggcgaccggtcgcctgcgcgatgagctggcgaaatacccgttcgccgaaggaggcattgtcctcttctgccagtatcgttaccttgcggtcgagtatctgctggtggcggtactcaataacctgagcagtatgcgcgtcaacgaagagctggatatccgctcgacccattatctggatattaaccatgccgatatcgtcgcgcgcatcgatctcaccgagtgggaaaccaacccggagtcgacccgctatctgaccttcctgaaagggcgggtagggcgcaaagtggccgatttctttatggatttcctcggcgccagcgaagggcttaacgccaaagcgcagaaccgcggcctgctgcaggcggtggatgacttcgccgccgatgcccagcttgataaatccgagcgacagaacgtgcgccagcaggtctacgcctactgcaacgaacagctgcaggctggggaagagattgagctggagtcgctgtccaaagagctcgccggcgtcagcgaaaagagcttccaggaattcaccgctgagcagggctatgagctggaagagagcttcccggcggatcgcagcaccttacgtcagctgaccaagtttgccggcagcggcggcggattgaccattaacttcgacgccatgctgctgggcgaacgcgtattctgggatcccgccactgataccctgaccattaagggtaccccgccgaacctgcgcgaccagttgcagcgccggacgtcaggcggcaattaa

SEQ ID NO: 1136 - DNA, 1227 bp, Klebsiella pneumoniae
cgtatcgccggtggtcacatccttcagaccgacgcaggccgcgatatccccggcgtgcagttcgtcaacttcgtgacggtcgttggcctgcatcagcacgatacgcccgatgcgctctttcttacccttcaccgggttccacaccgcatcgcctttcttcagcgtcccggagtagacgcggataaaggtcagctggccgacgtaggggtcggtcatcagtttgaacgccagcgccgacagcggctcatcgtcgctcggatggcgttccgccggctggccttgctcatcaacgccctgtatcgccggaatatccagcggcgacggcatcagctccaccaccgcatcgagcatgcgctgcacgcctttgtttttaaaggcgctcccgcagagcaccgcctggatctcccccttcaccgtgcgctggcgcagaccggcgacgatctccgcctcgtccagctcaccggtttccaggtatttatccatcagctcatcgctggcttccgccgccgccgagaccattttctcccgccactgctgcgccgtcgccaacagctcgtcagggactggcccatagctgaaggtcatgccctgggtggcgtcatcccacaggatggcgcgcattttcaccaggtcgacgacgccggtgaaatgctcttcagcgccaatggggatcacaatcggcaccgggttagccttcaggcggtcgatcatcatctgcaccacgcggaagaagtccgcccccgggcggtccatcttgttgacgaaggccagccgcggaacgtggtatttattcgcctggcgccagacggtctccgactggggctgcaccccgccgacggagtcgtacaccatcaccgcgccgtcgagcacgcgcatagaacgttccacctcaatggtgaaatccacgtgccccggggtgtcgatgatattgatccggtgcggctcgaagctgcggtccatccccggccagaagcagcttaccgccgccgaggtaatggtgatcccgcgctcctgctcctgggccatccagtcggtggttgccgcgccatcgtgtacttcacccagcttatggctcatcccggtataaaacaggatgcgctcggtggtggtggttttaccggcatcgatatgcgcggagataccgatgttgcgataacgttcgagagggatgggtcggggcatgatgcgtccttagtcgttttgacggtcagtctgcggtcggaatga

SEQ ID NO: 1137 - DNA, 231 bp, Klebsiella pneumoniae
gattttcacgggacagaaaagcatataacaaaacgtattagccgttcgcggcaaattctgacaccatgcaacacaatcagggtaaaaacgatggccatgcaaacgtggttagttttattgctatgcatttttttcttcagcatctctgtatacagttttatttcctatctgaaagacaggaggcggcagaaatttacttttaacgataagcgttcgatgcgtcgtaaataa

SEQ ID NO: 1138 - DNA, 354 bp, Klebsiella pneumoniae
gtgacctgcggacggccaatgttggcctcgacgccaaactcgcgcttcatccggtcgacaatgatctccagatgcagctcacccatgccggagataatcgtctggccggactcttcatcggtatgcagacggaacgacggatcttccgccgccagccgctgcagcgcgatgcccattttctcctggtccgctttggtcttcggctcaatcgccagcgaaatcaccggctccggaaactccatccgttcgagggtaatcaccgcatccggatcgcataacgtatcgccggtggtcacatccttcagaccgacgcaggccgcgatatccccggcgtgcagttcgtcaacttcgtga

SEQ ID NO: 1139 - DNA, 261 bp, Klebsiella pneumoniae
ccgaagtgcggatccccgccaggatcaccggggccgccagcggtagctccaccttatacagacgctgccagccggtcattcccatcccttcagccacacctgacacccccggcggtatcgaacccagcccggccagcgtcccctgcagcaccggcagtatgccatacaacgcgagggctatcagcgccggcagccagccaaagcccagcaccggcaccgccatcgccagcaccgccaccggcggaaaggtctgcccgatag

SEQ ID NO: 1140 - DNA, 423 bp, Klebsiella pneumoniae
ggatccggcggtggagagtctgacctccttcgtcggcgtcgacggcaccaacccggcgctgaacagcgcccgtctgcagatcaacctcaagccgctggacgaacgcgacgaccgcgtccagacggtgataagccgcctgcagcaggcggtggacggcgtccccggcgtggcgctctacctgcagccgacccaggacctgaccatcgacaccacggtgagccgcacccagtatcagttcaccctgcaggcaaactccctcgaggcgctgagcacctgggtgccgccgctgctcagccgcctgcaggcccagccgcagctggccgacgtcagcagcgactggcaggacaaaggcctggccgcctatatcaaggtggatcgcgacagcgccagccgcctcggcatctcaatggccgatgtcgataa

SEQ ID NO: 1141 - DNA, 213 bp, Klebsiella pneumoniae
tggaaatcaggtagagttaccgaaagtactcctaatgccaagtacaacgaaagcacaaagctaacgaagtccgccaaagccaacgccacgctacaacttacgttttttgaaaaatgcgtcataattccctcatcgacacgggtagataaaaagggcgggaaatattctggagaaaataggtggactctacattgcatagagtccagagtataa

SEQ ID NO: 1142 - DNA, 513 bp, Klebsiella pneumoniae
agccttccaggttggcgcgctgatcttctccaccatcaccgtgctggcttccggtatggcggcgcacgctggcgtggcgcgtctgatgtacgtgatgggccgcgacggcgtgttcccgaaaagcttcttcggctacgtccacccgacctgtcgcactccggcgatgaacatcatcctggtcggcgccgattgcgctgctgggcgattaacttcgacctggtgatggcgacggcgctgattaactttggtgcgctggtggcgtttaccttcgttaacctgtcggtaatttcccagttctggatccgtgagaaacgcaacaagacgctgaaagatcacttccagtatctgttcctgccgatgtgcggcgccctgaccgttggcgcgctgtgggtcaacctggaagagagctcgatgattctgggcctgatctgggccggtatcggtctggtctacctggcctgcgtgaccaaaagcttccgcaacccggtgccgcagtacgaagacgtggcgtaa

SEQ ID NO: 1143 - DNA, 1539 bp, Klebsiella pneumoniae
acgcagccaggtataactatggtcagcaataatagcgaacggtcaggcgaatatttgttggagatgagcaatatcaacaaatcgtttcctggcgtcaaggctcttgataatgtcaacctgaaggttcgtccgcactccattcatgcgttaatgggtgagaacggcgccggtaaatcgacattattaaaatgcctttttgggatctatcaaaaagattccggtagcattctttttcagggaaaagagatcgatttccattcggcgaaagaagccctggaaaacggtatttcgatggtgcatcaggaattaaacctggtattacagcgttcggtcatggataacatgtggctcgggcgctatccaactaaaggcatgtttgtcgatcaggacaaaatgtaccgggataccaaggccatttttgatgagctggatattgatatcgatccgcgcgcccgcgtcggtaccttatcggtatctcagatgcagatgattgagatcgcgaaggcgttttcctatgacgccaaaatcgtcatcatggatgagccgacgtcatcgctgacggaaaaagaggtcaaccatctgtttaagatcatccgtaagctgaaagatcgcggctgcggtatcgtctatatctcgcataaaatggaagaaattttccagttgtgcgatgaaataaccatcctgcgcgacggccagtggatcgccacccagccgctggaagggctggatatggataagatcatcgccatgatggtcgggcgttcgcttaaccagcgttttccggatcgcgaaaacactccgggcgaagtgatcctccaggtgcgcaatctcacctcgctgcgccagccctccattcgcgatgtctcctttgacctgcataagggcgaaattctcggtatcgccggcctggtgggcgctaaacgcaccgacatcgtggagaccctgttcggcatccgtgagaaggccagcggcaccatcacgctgcacggcaagaagatcaacaaccacagcgccaacgaggcgattaaccacggttttgcgctggtgaccgaggagcggcgctctaccgggatttacgcctatctggatatcggatttaactcgctgatctccaatattaagaaatataaaaacagcatcggcttgctggataactcgcgaatgaagagcgatacccaatgggttattgactcgatgcgcgtcaaaacccccggtcagcatacgcagattggctcgctttccggtggtaaccagcaaaaggtcattataggccgctggctgctgacccagccggagatcctgatgctggatgagccaacgcgcggtatcgacgtcggcgccaagtttgaaatctatcagctgattgccgaactggctaaaaaagacaaagggatcattattatttcttccgaaatgccggaactgctggggattaccgaccgcattctggtgatgagcaacggcctggtcgcgggcattgttgagactaaaaccactacgcaaaacgaaatactgcgtcttgcgtcattgcacctttaa

SEQ ID NO: 1144 - DNA, 429 bp, Klebsiella pneumoniae
gcgcgagcagggcatgccgccgcgggaggcgatttaccaggcctgtctgctgcgttttcggccgatcctgatgaccaccctcgccgccctgctcggcgccctgccgctgatgctgagcaccggcgttggcgccgaactgcggcgtccgctggggatcggcatggtcggcggtctaatgctcagccaggtgctgaccctgttcaccaccccggtgatctatctgctgttcgaccgcctgtcgctgcacctgaagcgccgcttcccgcgtcaggaagaggaggcgtaagtgaagtttttcgccctcttcatttaccgcccggtggcgacgatcctcatctcgctggccatcaccctgtgcggcattctcggcttccggctgctgccggtggccccgctgccgcaggtggacttcccggtgatcatggttag

SEQ ID NO: 1145 - DNA, 1173 bp, Klebsiella pneumoniae
aacggagcagggtgcatggagagaaatgtcacgctggactttgtccgcggcgtcgccatcctcggtatcctgcttctcaatatcagcgccttcggcttgccgaaggccgcttatctcaatcccgcctggtcaggaagcgcgtcccttagcgatgcctggacctgggcgctcctcgacctgctggcgcaggtgaagtttctcaccctgttcgcgctgctgtttggcgccggtcttcagctattgcttccgcgagggaagcgctggatccagtcgcggctgacgctgctggcgctgctcggtttcattcacggtctttttttctgggatggcgatattctgctggcctatgccctggtggggctggtgagctggcgcatggtgcgtgaggcgcaccatgtcaaatcgctgttcaacaccggggtggtgctctacctcaccggcattgcagtgctggtcctgttggggctgatctccgggaccgcggcgaatcgctcgtgggcgccggacgcggcgaacctgcagtatgagcagtactggaagctgcacggtggcatggaggcggtcagcaaccgggcggatatgctatctgacaatctgctggcgctgggcgcgcagtatggctggcagctggctgggatgatgctgatgggcgcggcgctgatgcgcagcggctggctgaaggggcagtttagcctgcgtcactaccggcgtaccggcgcgctgctggtggcggccggcatggcggtcaatctgccggcaatattcgcccagtggtatctggcctgggactatcgctggtgcgcgtttttactgcaggcgccgcgcgaacttagcgccccgctgcaggctatcggctatgccgcgctggcctggggctactggccgcagctctgccgtttccgcctggtgggcgctatcgcctgcgtcggacgcatggcgctgaccaactacctgctgcagaccctgatctgcaccaccctgttttatcatcttgggctgtttatgcgcttcgatcgtctgcagctgctggcctttgtcccccccatctgggccgttaacctccttgtctcatcgctctggctgcgccgcttccgccaggggccggtggaatggctgtggcgtcagttaaccctgcgtgcgtcaggcacatcattgaaagacacatccagataa

SEQ ID NO: 1146 - DNA, 594 bp, Klebsiella pneumoniae
ggacaacaagggaaaataaacagcatggtcaaatctcagccgattttgagatatatcttgcgggtagcccccgcgattgcagtagcggttctgctttccgcgtgtagttcaacaagtaccgccaggaatatgcattctgagacgcatgctgtgggtagtggcgatttatcatcactgcaagcctctcaggatgaatttgaaacgatggtccgtaacctggacgtaaagtcccgtttaatggatcagtatgccagctggaaaggcgtgcgttaccgcctcggcggcagcacccgcaagggtatcgactgctcagcgtttgtgcagcgcaccttccgcgaacaatttggtctggaactgccgcgttcaacctctgaacagcaggaaaccggaaaatcgatttcccgtgcccaactgcgtacaggcgatctggttctgtttcgcgccggctctaccggccgccatgtcgggatctacctcggcaacaaccagtttgttcacgcctccaccagcagcggggtgactatctctagcatggatgagccatactggaaaaagcgctacaatgaagcgcgtcgagtcctgagccgctcgtaa

SEQ ID NO: 1147 - DNA, 240 bp, Klebsiella pneumoniae
cccggcctgggatgtgcgcaatatcatccgtttgcgtcgccacttaatgtaggcgctgataagcgcagcgccatcaggcagtgcggcagctacgcctggcccggtctggattatacggtgggcgtcataccccgattagttcgccatcccgtaggcctgataagcgaagcgccatcaggcagtgtggcggctacgcctgacccggcctggattatacggtgggtgtcataccccgattag

SEQ ID NO: 1148 - DNA, 1482 bp, Klebsiella pneumoniae
acaggtgtgggaagaatgacaacaattgcaaccgctacgctaccgaagaacgtgcaataccctcaatacgatcgcagccagctccgctcgcgtattgtccatttcggctttggcgtgtttcaccgcgcgcaccaggcgctgctcaccgatcgcgtgctgaataacgtcggcggcgactgggggatctgtgaaatcagtctgttcagcggcgacacgctgatgagccaacttcgcgaacaggaccatctgtttaccgtgctggaaaaaggcgccgacggcaaccagcccattgtgatcggcgcggtgcacgaatgtctgaacgccaggctcgattcgctggcggcgattatcgaaaaattttgcgagccgcaggtagcgattgtctcgctgaccattacggaaaaaggctactgcatcgatccggcgaccgggaaactggatccgacgcatccgcgcattattcacgatctggagaatccgacgctgccgcagtcagctcccggtattttagttgaagcgctggcccgccgccgggaacgaggccttccgccctttaccgtgctctcctgcgataatatccccgacaacggtcacgtggtaaaaaatgccgtcctcggcatggcggaaaaacgcagcccggcgctggcggactggatcgccgacaacgtcagcttcccgggcaccatggtggatcgcattgttcccgcggccacaccggagtcgctggcggaaatcgccgccgtgctgggggtcgacgatccctgcgccatcagttgcgaacccttcattcagtgggtggtcgaagatcactttgtcgccgggcgacccgcctgggagacggcgggcgtgcagatgaccgacgacgtgttgccctgggagcaaatgaagctgcggatgctcaacggcagccactctttcctcgcctggcttggctatctggcagggcatgcgcacattagcgactgcatgcgggatgaggtcttccgccgcgccgcccgccagctgatgcttgacgaacaggctccgacgctgaccattaccggcgttgatctgctggcctatgccgacagtctcatcgcccgcttcagcaatccggcgctcaaacaccgcacctggcaaatcgccatggacggtagccagaagctgccccagcgcatgctcgatggcatccgcgtacatctggcgcgcgacagccgttggccgctgctggctctcggcgtggccggctggatgcgctacgtcagcggcacggacgacgccggtcagacgatcgacgtgcgcgatccgctggtcgacaagatccggcagcgggtggcccagagcgatgagcagcagcgcgtcgacgccctgctggggctggaggaaatatttggccgcgacctgccgcacaacgcccagtttgtcgccgggatccgcgccgcctggcaacagctggcgacgcacggcgcccgcgaggccgtcgcccgcgcgctgaattcttaa

SEQ ID NO: 1149 - DNA, 912 bp, Klebsiella pneumoniae
tgcaaaaagggccggggaaaataccccgccctttccagaacatttaccttggacgattatttcttcgtcttcggcgatgtcatcatcggtatccgcttccggggcgatatcgtcatcgccttctgccgcgctaccgtcgatggcatccagctcttcatcatccaccggctcagccacgcgctgcagacccaccacgttttcatcttccgcggtgcggatgaggatcacgccctgggtgttacggcccacgatgctcacttcggaaacgcgggtacgcaccagcgtcccggcgtcggtgatcatcatgatctgatcgcagtcatccacctgcacggcgccgaccacggaaccgttacgctcggtgactttgatcgaaataacgccctgggtggcacgcgacttggtcggatactccgccgccgcggtacgtttaccgtaaccgttttgcgtcaccgtcaggatcgcgccttcgccgcgtggaataatcagcgagacgacgctgtcgttttccgcaagcttaataccgcgtacgccggtggcggtacggcccatggcgcgaacggcgtcttctttgaagcgtacaaccttaccggccgcggagaacagcatcacttcatcctgaccagaggtcagatcgacgccgatcagctcatcgccttcgttcaggttgaccgcgatgataccggcggaacgcggacggctgaactcggtcagcgcggttttcttcacggtaccgctagcggtggccataaagacgttgacgccctcttcgtactcgcggaccggcaggatggcggtgatgcgctcatcggcttccagcggcagcaggttgacgatcggccgaccgcgcgcgccgcggctggcttccggcagctgatagaccttcatccagtacagacggccgcggcttga

SEQ ID NO: 1150 - DNA, 1875 bp, Klebsiella pneumoniae
cgtcaacggggtgttgctgagggtgccatgagacgaatactgacaacgctgatgatcctgctggcggtcattgtcgccgggcttacctcgttggtattgctggtcaatcccaacgattttcgcgcctatatggtgcatgaggtggcagagcgcagcggttatcagcttgaccttgatggcccgctgcgctggcacgtctggccgcagctcagcattctcagcggacggatgacgctgaccgccagaggcgccgaagagccggtgatccgcgccgacaatatgcgcctcgacgtggcgctgctgccgctgctctcgcatcagctgcaggtgaagcaggtgatgctcaagggcgcggtgatccagctgaccccgaaaaccgaggcggttcgcgacagctcagcgccggtggtgccgcatgataacaccctgccgctggccccggaggatcgcggatggtcctacgatgtccgtcagctgcaggtggccgacagcgtgctcttcttccagcatgagaacggcgagcaggtgaccgtgcgcgatatccgtctgcagatggagcaggatgagaatcaccgggccaccgtggatttctccggccgggtgaaccgcgaccagcgcgacctggcgctgaacttctccgccaccgtgcagggtggcgattatccgcactccttaaaagccgactttacccagcttagctggcagctgcgcggcgccgagctcccaccggacggcattaatggtcaggggagtctgcaggccagctggcaggaagatgacaagaccctgcgttttgacaacctgaatctgatggctaaccgcagcaccgttaccggcagcggcagcgtggtgctgggggatcgcccggactggtcattggatctgcacgccaccactctcgatctcgatagtctgctggcgcaaaggtcgccggcgacggacagtagcgccagtcagcagggccagagtcagacgcgaccgctgcgcccggtgatcgccgacagcgatgagcgcgaagattaccagagcctgcgcggcttcaacggccgaatggtcctgagcgccgaccagctgcagtggcgcggtctgaacttcacccaggtgcagagcgaaatcagcaaccagcaggggctgctgactgtcagcaaaatgcagggcaatcttgacggcgggcagctctctctccctggcaccctggatgcccgcggcgacacgccgctggcgacgttccagccggcgctgcagaatgtggagatcggttcgctgatcaaagcctttaactattccttaaacctgaccggcaagctgtcgctgagcggcgaattttccggaacgcgcattgacgccgatgatttccgtcgccactggcagggacaggctcagctccagatggccgatacccgcaccgaggggctgaacttccagcagctggtgcagcaggccgtggaacgcagcaccaacgtgcgggcgcaggaaaattacgacaatgccacccgcctggattccgtgagcagccggctgacgctggataacgggctggtgacgctgaaccgcctgcagggacagtccgacgtgatggcgatgaccggcgaaggacagctcgatctgcagaaagagaactgcgatatgcgcttcaacgtgcgcgtgctcggcggctggaaaggggagggcaagcttatcgaccgcctgaaacagaccgctatcccgctgcgcatctacggcgagtggcagtcgctgagctacagtctgcaggtcgaccagatcctgcgcaaacagctgcaggatgaagcgaagcagcgcctcaacgactgggttgagcgtaataaaggcagcaaagacggcaacgatgccaaaaagctgctcgataagctgtaa

SEQ ID NO: 1151 - DNA, 471 bp, Klebsiella pneumoniae
atttcaaggggtcagcaaagtgtttgccggccacccggcggtgaaggacctgaccctggagctgcgcgaaggcgctttctcggtgctggtggggacttccggctcgggcaagtcgacgacgctgaagatgatcaaccgtctgctggagccggaccggggcactattcgctttgccggcgaggacattcgccagcagccggtcctgaccctgcggcggcggatgggctatgccatccagtccatcggcctgtttccccactggacggtggcgcagaatatcgccaccgtgccgcagctgcaaagatggccgcaggcaaggatcgccgaccggatcgacgagctgatggcgctgctggggctggaggcgacgctgcgcgaccgttacccgcatcagctctccggcggccagcagcagcgggtgggggtggcgcgggcgctggcggcagatccggaggtgctgttgatggatga

SEQ ID NO: 1152 - DNA, 1149 bp, Klebsiella pneumoniae
tgtgacattatgaagaaaaaacttgttagattttcggcattagcattggcaattgggtttttatcgggttgtacgattattcctgggcagggattaaatagcctgcgtaagaatgttgtagaacttccggacagcgactacgatctggataaactggtcaatgtgtacccaatgacacctggcttgatcgataaactgcgcccggaaagcgtaatggcacgttctaaccctcagttagatagtttgctccgaagttatgaatatcgcataggagtgggcgatgtgttgatggttacggtatgggatcacccggaactaaccacgcctgcaggccagtaccgtagcgccagcgacaccggtaactgggtaaatgcagacggtaccattttctatccttatatcggtaaagttcaggtggctggtaaaacgctgagccaggtgcgccaggaaattactagccgacttaccacctatattgaaagcccgcaggtagatgtgagtattgctgcatttcggtcgcaaaaagtatatgtcactggggaagtaactacatcgggtaaacaagcgataactaatatcccactaacagtaatggatgcgattaatgccgcgggcggattggctgccgatgctgactggcgcaatgtagtgctgacgcatgacggcaaagatactaaaatttccttgtatgccttaatgcaaaaaggggatttaacacagaatcatctactatatcctggcgatattctgtttgtaccccgtaatgacgacttgaaagtcttcgtgatgggggaagtaggtaaacagagcaccatgaaaatggatcgcagtggtatgacgctggctgaagcattgggtaatgctgaaggcatctctcagtcgatgagcgatgcaacggggatttttgtagttcgtcaactgaaaggcgataaacaaggtaagatcgcaaatatctatcaattaaatgcgcaggatgcttcggcaatggttctgggaacggagttccagttagaaccgtatgatatcgtatacgtgactacagctcctttggttcgctggaaccgtgtcatttctcagcttgtcccaacaatcaccggtgttcatgatatgacagaaacagttcgttatattaagagatggcccaactaa

SEQ ID NO: 1153 - DNA, 1161 bp, Klebsiella pneumoniae
atgataattatggacttaatggcgactcagtcatcgcctgaagctgcatttcatggtggtggtgaatatgctaaatgtgttttctatgctgcaattaagaatgggtataaagatttcacaggaatatataataatactttaaatcttgatcccgacattacttttttatgcaatcagaataatataacattaatacccgtctcttcatcggcagagttggttaaaatcgttaactctcatccaggttctatattttactctgcattgccgtatgctttaaatggtattgatacttcaatcattaactttataattacaatccatggtttaagagagcttgagtgtccatatgatgaagttgtatgggattatactcatggtcttaaaaacaaattaaaagtatttctgaaaaactatgtattcaagtcatacttcttagataaagttaaaagtaactttgagaaaatagctgtaaagaaaaatgtaaaaatatttacagtatctaatcattcaaaatattcaatattaagtttttttccgactatcgataaagatgatattttggtttttagagctccatgtccatttggaccgcatgagccagagtgtaaaaaccataatcttttgtctttaggtggacgaaaattttttttaatggtaagtggcaatcggtggcagaagaacatagttagagctctacgtgcattagataactattttgataaaatagctgattgtgatttaaaagtaatcattacaggtagtaaatcaccattaataaaattacgtaatgataaacgctttatattcatcgattatgtcgaaggaagtacattagattggctttataagaatgcattttgttttatttatccctctttaaatgaaggatatggttatccgccgttacaggccatgaggtacggtacacccgtaattgcatcttgcacatcaagtattccagaagtatgtgcagataatgtactatattttgatccaaggaatataagcgaaatcgaaaatcgaattctgcaattatctacagatggtgaactttataataaactagctttgaaggggagcgagcattataaaaagatattacaatcacaggacaaagatctatctaaattactaaggggtatttttgaggcacgttaa

SEQ ID NO: 1154 - DNA, 1473 bp, Klebsiella pneumoniae
gaggtgactatgtatctgggtatcgatctcggcacatcggaagtcaaagcgctggtcattgatgagaaccatgaggttatcgccagccatagcgcgccgctgagtattcagcggcctcatccgcactggtcagaacaagcgccggagctatggtgggaggcgacggagtacctgatggccacgctacgggaaaaatgcgcccagcattggccggccattaaggcgattggcctctccgggcagatgcacggcgcggtgttgctggatgcagagggggaggcgatccgtccggccattctgtggaacgacacccgctgcgccgcagagtgcgccgagctggaggcgatggcgccggagctgcatcaggtggcgggcaacctggcgatgccgggctttaccgcgccgaagctgttgtgggtgcgccgtcacgagccggaacactttcagcgcaccgccacggtgctgttgccgaaggattatctgcgctaccggatgaccgggaagaaagtctccgatatgtcggacgccgccgggacgctgtggctggacgtggcgaagcgcgactggtccgacgctctgctggacaagtgcggcctgtcgcgtagccaaatgccgacgctggtcgaaggctgcgaggtttccgccacccttgacccgcaggtggctgcgcgctgggggctgaacgcctcggtgatggtggccgggggcgggggggataacgcggtcagcgccattggcgtcggcgcggtctcgccgggagatgcgtttatttcgctcggcacctccggggtgctgtttgtggtgaccgatgcctatcgtccggcgccgcagtcggcggtacatgcgttttgtcacgtgctgccgaacctgtggcaccagatgagcgtcatgctgagcgccgccagctgtttgcagtggttctgccgcctgaccggcaccacggaggtggcgctgctggcggagattgccgagctaagcgaggatgataaagccaacgcgccgttcttcctgccctatctctccggggaacgaaccccgcataacgatcctgacgcccgcggcatcttctggggcatgacccatgccagcctgcgcgcgcagctcggctacgcggtgctggagggggtgagctttgggatcaacgacggcctgcaggcattgaaagagagcgggacgccgatcgcgcagtgctcgctggtgggcgggggcgcccgcagtccgttctgggcccagctgctggccgatattctcgctatgccggtggtgacccacaaaggcggagagaccggcggcgcgctgggcgcggcgcggctggcctgcctggctgcgggcaaaccggttgccgcggtgtgtgaaaaaccggaagtctggcagacctggcgtgcggatcccattcgccaccacatcctgatgcaacgctacgcgcagtttaacgccctgtatttaaacgatctgcactatcgacagcactga

SEQ ID NO: 1155 - DNA, 894 bp, Klebsiella pneumoniae
ggcaacgctatgcactcacgttttcaagctgctttgacgactctggcagcagatctgcaggcggccatcgccccgatgctcgccgacccgcatttcccggcgctgctcgaagccgatcaggtggcgacgctgcagcatgcgacaggtctggacgaagacgcgctggcttttgcgctactgccgcttgccgctgcctgcgcgcgccccgacctttctcattttaacgtcggggctatcgcccgcggcgtcagcggccgctggtactttggcggcaacatggagtttctcggcgctaccatgcagcagaccgttcacgcggaacagagcgccatcagccacgcctggctgcgcggcgagacctccctgcgcgctatcacggtgaactacacgccgtgcggtcattgccgtcagtttatgaacgaactgaacagcgggctggcgctgcgcattcatctgccgggtcgcgaagcgcatgccctggagcactatctgccggacgcctttggcccgaaagacctcgagatcaaaaccctgctgatggatgaacaggaccatggcttcccggtcagcggcgatgccctaacccaggcagctattcaggccgccaaccgctgccatgcgccctacagccactcgccttccggcgtggcgctggagctgaaagacggtaccattttcagcggtagctatgcggaaaacgcagcgttcaacccgacgctgccgccgctgcagggggcgctgaatctcctgagcctcaacggctatgattatcccgctatccagcgggcaatcctggcggagaaagccgacgcggcgctgatccagtgggatgccaccgtcgccaccctgaaggcgctgggctgccacaatattgagcgcgtcctgttaggttga

SEQ ID NO: 1156 - DNA, 885 bp, Klebsiella pneumoniae
aatatctgtattatgaacgtttacgcgcacatcccttccgaggagccttgcatggaactgcttgaagagcatcgctgttttgacggccagcaacaacgctggcgtcatcactcccctgtcctgaactgcgccatgacgttcagcatttttttaccgcctgagcgcgaaacgccgccgccggtgctgtactggctgtcggggctgacctgtaacgatgagaactttaccaccaaggcgggcgcccagcgcattgccgccgagctgggcatcgcgctggtgatgccggataccagcccgcgcggtgacgaggcggccaacgacgacggttacgatctcggacaaggcgccggcttctacctgaacgccaccgaggcgccctgggcggcgcactaccgaatgtacgattacctgcgtgacgaactgcccgcgcttattcgtagcgagtttagcgtcggcgaacgctgcgccgtcagcggccactcgatgggcggccacggcgcgctcattatggcgctcaaaaatcccggccgctacgccagcgtctccgccttcgcgccgatcgtcaatccctcccaggtcccgtggggcaagaaagcgtttaccgcctatctcggcgcggatgaatcggcatggcactcctgggacagctgcgcgctgatgcaggccagccggccggaggacgccgtgccgacgcttatcgatcagggcgacaacgatcctttccttgccggacagctgcagccggcggtactggcggaggtcgcgcggcagaaggcctggccgttaacgctgcgcatccagcccggttacgaccacagctattacttcattgcctcgtttattgaagaccatctgcgcttccatgcgcagcatctctttggctaa

SEQ ID NO: 1157 - DNA, 519 bp, Klebsiella pneumoniae
attaactgtatatttatacagcaatttatctccaaaggaggcaaaatgaactacagcatcaccaccctcggcaagaaaaccatcgccggtttccatctggtcgggccctgggatcacacggtcaagcaggggtttgagcaactgatgatgtgggttgagaaccaccaggtgcccgcccgcgaatgggtggccgtctactacgataacccggaggaagtgccggcggaaaaactgcgctgcgcgacagcggtcgccgtggatgaggattatgtcattcccgccaacagcgaaggggtgatcctggcggcgattgccggcggggattacgcctgcgcccgcgcgcgggtggtggagtacgacttcgccactccgtggatgcagtttttcgacagcctgcagcagagcacggcgtatcgcatcgccccccagccctgctttgaggtctatcttaacgacggcaaccacgacggctactgggatatcgacatgtatgttcccgttgagcgcgtcgcgtcgtag

SEQ ID NO: 1158 - DNA, 783 bp, Klebsiella pneumoniae
tttatgagtataaagatgaagtacaatttagggtatttatttgatttacttgttgtgataacaaataaagatctaaaagtgcgctataagagcagcatgctaggttatttatggtcagtagcaaatccattgctttttgccatgatttattattttatatttaagctggtaatgagagtacaaattccaaattatacagttttcctcattaccggcttgtttccgtggcaatggtttgccagttcggccactaactcattattttcattcatcgctaacgctcaaattatcaagaagacagtttttccccggtccgtgattccgctaagtaatgtgatgatggaaggcttgcattttctttgcaccatcccggttattgttgtctttctttttgtttatggcatgacgccgtccttgtcctgggtttggggtatacctctcattgctattggccaggtgattttcacctttggtgtttcaatcatcttttcaacgctgaacctgtttttccgtgacctggagcgctttgtcagtctggggattatgctgatgttttattgtacgccgattttatatgcgtctgatatgattccggaaaaatttagctggataattacctacaatccgctagcgagtatgattcttagttggcgtgatttattcatgaatgggactcttaattatgagtatatttctatactctattttacgggaatcattttgacggttgtcggtttgtctattttcaataaattaaaatatcgatttgcagagatcttgtaa

SEQ ID NO: 1159 - DNA, 726 bp, Klebsiella pneumoniae
gccaagttcatgttaaagcgtgcgttctacagcctgttagtcctgctcggcctgctgctgttgaccgtgctgggccttgaccgctggatgagctggaaaaccgcgccctatatctatgatgaactgcaggacctgccctaccgtcaggtcggtgtggtgctgggcaccgccaaatattaccgcaccggcgtcatcaatcagtattaccgttaccgcatccagggtgcgctgaacgcctacaacagcggcaaggtcaactatctcctgctgagcggcgataatgctctgcaaagctacaatgaaccgatgaccatgcgtcgggacctgattaaaggcggcgtcgatcccgcggatatcgtactggactatgccggcttccgtaccctcgactcgatcgtccgtacccggaaagtgttcgacaccaacgacttcattatcatcacccagcgcttccactgcgaacgggcgctgtttatcgccctgcatatggggatccaggcccagtgctacgcggtgccgtcgccgaaggatatgtggagcgtgcggctgcgcgagttcggcgcccgctttggcgcgctggcggacctctatatcttcaaacgggaaccgcgctttctcggccctctcatcccgattccggcgcagcagcatgacgtgccggatgacgcccagtcctacccggccgtcaccccggagcagctgctggagctgcagaaagaaaagtag

SEQ ID NO: 1160 - DNA, 729 bp, Klebsiella pneumoniae
aaaaatctcatgcgacttgataagtttatcgctcagcagctgggcgtcagccgggctattgccgggcgtgaaattcgcggcagccgcgttaccgtggacggcgacattgtgaaagatgcctcttttaagctccagccggagcacgaggtggagtatgacggaaatacgctgacccagcagaatggcccgcgttactttatgctcaacaagccgcaagggtacgtctgttctaccgacgatcccgatcatccgactatcctttatttcctcgacgagccggtggcgcataagctgcacgccgccggacggctggatatcgacaccaccgggctggtgctgatgaccgatgacggccagtggtcgcatcgcattacctcgccgcgccaccactgtgaaaaaacctatctggtggcgctggaaagcccgctggcggaagggaccgcggagctgttcgtcaaaggcgtccagctgcataacgaaaaagatctcaccaaaccggcgttgctggaagttatcactccgaccgaagtgcgcctcaccatcagcgaaggccgctaccatcaggtgaaacgcatgttcgccgccgtgggcaaccacgtggttggcctgcatcgggaacgcatcggcgacatcctgctggatgaatcgctggcgccgggtgaatatcgtccgctgacggaagcggaaatcgccagcgtgggcgccccgcagccacggagtaaaacgtga

SEQ ID NO: 1161 - DNA, 1371 bp, Klebsiella pneumoniae
aagcgtctcattccaataacgacaaattacgtgactgacaggacagggtatggattcaacaataagcgtgcagcccaccgagccggtgaatgcactgcatcgtgcccggcggggcggccatggggcagttttgccggcgccgtggtcgactggtacgattttcttctctatggcattaccgccgcgctggtgttcaaccgcgagtttttcccgcagatcgggccggcgatggggacgctagcggcgtttgcgaccttcggcgtcgggttcctctttcgcccgctcggcggcatcgtcttcggccatttcggcgaccgtctcggacggaaacggatgctgatgatgacggtctggatgatgggtatcgccaccgcctgtattggcctgcttccctcgttcaaccagattggctggtgggcgccggtgctgctggtgttcctgcgagcggtgcagggattcgccgtcggcggcgaatggggcggcgcggcgctgctctcggtggagaatgccccacaggggaaaaaagccttttacagcagcggggtgcaggtgggctacggcgtcggcctcctgctctctaccgggctggtatcgctgattagcagcctgaccagcgaccagcagttcctcagctggggctggcgcgtaccgttcctgttcagcgtggtgctggtccttattgcgctgtggatccgtaacggcatggcggaatcgcaggagtttgaagcgcagcagagccaggacaacgcgccgcagatgaaaaagcggctaccggtagtggaagcgctgcttcgccatccgggagcgtttttactgattatcgccctgcgcctgtgtgaactgctgacgatgtatatcgtcaccgccttcgccctcaactactccacgcaaaacctcggcctgccgcgcgagctgtttctcaacattggcctgctggtgggcggtcttagctgcctgactatcccctgtttcgcctggctggcagaccgctttggccgtcggcggatctatatcaccggggcgctgatcggcactttgagcggtttcccgttctttatggcgctggagagtcagtccgttttctggatcctgttcttcgccctgatgctggccaatatcgcccatgatatggtggtctgcgtccagcagccgatgtttaccgagctgttcggcgccagctatcgctatagcggcgccggcgtcggctaccaggtggcgagcgtggtcggcggcggctttaccccgtttattgccgcggcgctggtcaccttctccggcggatcgtggcacagcgtggccctctatctgaccgcaggatgcctgctgtcagcgctcaccgcgctgctgatgaaaaagcaccccgtcgactga

SEQ ID NO: 1162 - DNA, 480 bp, Klebsiella pneumoniae
aaggccctcatgctcagtaatgatattcttcgtagcatgcggtacaccctgaaagtcaataataacgatatgatgcgcattctcgcgatctccgctatggaatccaccgccgccagcttggacacctggacgacgaaagaggatgaagagggctttgttcgctgcccggacattatcctgtcgggtttcctcaacggccttatctatgacaagcgcggcaaagatgattcggccccggagctggcgctggagcgtcgggtgaataacaacacggtgctgaaaaagctgcggatcgccttctcgctgaaaacggacgatatccaggcgattataagcgagcagaaataccgggtgtcggtgccggagatcaccgccatgatgcgctcgcctgaccacaaaaactaccgcgagtgcggcgaccagtttctgcgcaatttcctgcgcggactgacccagcgggtgcataacccgaaggcttga

SEQ ID NO: 1163 - DNA, 903 bp, Klebsiella pneumoniae
gccgctatcattacccaccccccagcggctttaactggagttttttttatgaaatacgtaggagcgcacgtgagcgcctcaggtggactggccaatgccgccattcgcgccgccgaaatcgaagcaaccgccttcgccctcttcaccaagaaccagcgccagtggcgcgccgcgccgctcagcgacgagaccatcgccgaattcaaagccgcctgtgaaaagtatcactttggcccggggcagatcctgccgcacgacagctacctgattaaccttggccacccggtggaagaagcgctggaaaaatcccgtgatgccttcattgatgaaatgacccgctgccagcagctgggactgacgctgctcaacttccaccccggcagccatctgcagcagatcccggaggaggagtgcctggcgcgcatcgccgaatcgatcaatatcgcgctggcgaagaccgaaggcgttactgcggtgatcgaaaacaccgctggccagggcagcaacctcggctttaaattcgagcacctcgcggccatcatcgacggtgtggaagataaatcccgcgtcggcgtctgcatcgatacctgccatgctttcgccgccggatacgacctgcgcagcgccgaagcctgcgaaaaaaccttcgccgccttcgaacgcatcgtcggttttcagtatctgcgcggcatgcatctcaacgatgccaagagcgccttcggcagccgggtcgaccgtcaccacagcctgggggaaggcaacatcggccacgattgcttcagctggatcatgcaggacagccgcttcgacggtattccgctgattctggaaaccatcaacccggatatctgggcggaagagattgcctggctgcgggcgcagcagattgccgaagtggcgtaa

SEQ ID NO: 1164 - DNA, 2112 bp, Klebsiella pneumoniae
ggacgcatcatgccccgacccatccctctcgaacgttatcgcaacatcggtatctccgcgcatatcgatgccggtaaaaccaccaccaccgagcgcatcctgttttataccgggatgagccataagctgggtgaagtacacgatggcgcggcaaccaccgactggatggcccaggagcaggagcgcgggatcaccattacctcggcggcggtaagctgcttctggccggggatggaccgcagcttcgagccgcaccggatcaatatcatcgacaccccggggcacgtggatttcaccattgaggtggaacgttctatgcgcgtgctcgacggcgcggtgatggtgtacgactccgtcggcggggtgcagccccagtcggagaccgtctggcgccaggcgaataaataccacgttccgcggctggccttcgtcaacaagatggaccgcccgggggcggacttcttccgcgtggtgcagatgatgatcgaccgcctgaaggctaacccggtgccgattgtgatccccattggcgctgaagagcatttcaccggcgtcgtcgacctggtgaaaatgcgcgccatcctgtgggatgacgccacccagggcatgaccttcagctatgggccagtccctgacgagctgttggcgacggcgcagcagtggcgggagaaaatggtctcggcggcggcggaagccagcgatgagctgatggataaatacctggaaaccggtgagctggacgaggcggagatcgtcgccggtctgcgccagcgcacggtgaagggggagatccaggcggtgctctgcgggagcgcctttaaaaacaaaggcgtgcagcgcatgctcgatgcggtggtggagctgatgccgtcgccgctggatattccggcgatacagggcgttgatgagcaaggccagccggcggaacgccatccgagcgacgatgagccgctgtcggcgctggcgttcaaactgatgaccgacccctacgtcggccagctgacctttatccgcgtctactccgggacgctgaagaaaggcgatgcggtgtggaacccggtgaagggtaagaaagagcgcatcgggcgtatcgtgctgatgcaggccaacgaccgtcacgaagttgacgaactgcacgccggggatatcgcggcctgcgtcggtctgaaggatgtgaccaccggcgatacgttatgcgatccggatgcggtgattaccctcgaacggatggagtttccggagccggtgatttcgctggcgattgagccgaagaccaaagcggaccaggagaaaatgggcatcgcgctgcagcggctggcggcggaagatccgtcgttccgtctgcataccgatgaagagtccggccagacgattatctccggcatgggtgagctgcatctggagatcattgtcgaccggatgaagcgcgagtttggcgtcgaggccaacattggccgtccgcaggtcacctaccgcgaaaccctgcgcaagaaagtgacggacgtggaaggcaaatttgtgcgccagtccggcggcaaagggcagtatggccacgtcgtgctgaccctggagccgctggagccgggcagcggtttcgtcttcgaggacgccaccaaaggcggcgtggtgccgcgcgagtacatcccttccgtggagaaagggctgcgcgaagcgatgggcaccggcgtgctggcgggttatccggtggttgacgtgaaagcgaccctgaccttcgggtcgtaccacgacgtggactcctcggagatggcgttccgcatggcggcgatcttcggcttccgggagggcgcgcgcaaagcggacccggtgatccttgagccggtgatgcacgtcgaggtggagacgccggaagagtacgccgggaatattatgggcgatctctcttcccgtcgcgggatggtgcaggggatggaagagcgcttcggcagccagatcatccgcgccgacgtgccgctggcggagatgtttggttattccaccacgctgcgctcgatgtcgcagggacgggctacctacagcatggagttccaccattacgcggaagcgccgcgtaatgtggcggatgaaatcatcgccagccgcgcgaaaagctaa

SEQ ID NO: 1165 - DNA, 342 bp, Klebsiella pneumoniae
ggcacaatcatgcagcgaatcattattcccacccattacgttcacacccgtagcacgccgctgtggaccaaagagaccgccccggcctctatctggcgccgccatctggatgccggcacccggcagggcgtctaccctcgtctctcggtgatgcagggggcgatccgctatctcggctatgccgatgaaaccagccccgagcccgttgaaaccctgactattgaagccggccagtttggcgtctttccgccggagaagtggcactgtattgaggccctctcagaggacacggtttttaatgtcgacttttatgttgatccaaaaattctcatcgagggataa

SEQ ID NO: 1166 - DNA, 210 bp, Klebsiella pneumoniae
gcagctgtcatagccgttacttccctgccggcttgtggaaagataaaagctgactgcgtcctgcagcgctaccaccctctctcccctgttttcagcattcagccttataaactaaatggtatctctatccctgcactggccccaacgtcatcgctgtcgctattgttcgcgtttgtgtaccacaaagaggtattcagacgaaccgactga

SEQ ID NO: 1167 - DNA, 1290 bp, Klebsiella pneumoniae
tcaggggtcattgctgtggcaaacgcaaacaaactcacgctcttcatcgtcatttttatgctgatggggatcctctccggcgcggctatccatgcctacgcgacgccaaccaccgtctccgcctgggcggacaatattacgctgctcaccgatctgtttctgcggttgatcaaaatggtcatcgcgccgttggtgttcagcaccctgacggtcggcattatgcgcctcggcgagacggcgaccatcggccgggtaggcggcaaggcgatggtctggttcatcacctcctcggtattatccattctcgtcgggctggtgatcgtcaccttccagcacccgggcgccgggttaaacctggcggtgccgaaagaggcggtggataccggcctggcggtcagcggcatgagcctgaaagggttcctgtcgcacactatccccaccagcatcaccgaggcgatggccaacaacgagatcctgcagatcgtggtgttctcgatgttcttcggcatcgccggcgcgtcgctgggggagaagtttaatgctccgctggtggcggcccttaacgtggtgtcgcacattatgctgaaggtgacgggctatgtgatgtacgttgcgccgctggccatcttcgccgccatctcgtcggtgattgcctcccaggggctggggatcctgctcaactatgcttcgttcatcggcggctactacctggcggtgctgttgaccagcgcggtgctgattgccgtcggctatatggtgctgaaaaaagaggttttccgtctgctgaacatgctgaaagatccggtgctggtggcctttaccaccagcagctcggaagcggcctatccgaagaccctcgagcgactggtgaagtttggctgctcgcgcaatatcgtctcgttcgtcctgccgattggctactcgttcaacctcgttggctcgatggtctactgctccttcgccgcgatgtttatcgcccaggcctataacgtgccgctgagctttagcgagattacggtcatgatgctgaccctgatgctggcctcgaaaggtatcgccggggtgccgcgttcggcgctggtggtgctggcggcgacgatccccagcttcaatataccggtcgccgggatcctgctgctgatgggtatcgaccatttcctcgacatggggcgctccgccatcaacgtgctgggtaatggcatcgccaccgcgatgctgtcgaaaaatgaagggttgctgaccgacgaggaagcgcagccggactgggaagtggagaaagcggaagcctga

SEQ ID NO: 1168 - DNA, 978 bp, Klebsiella pneumoniae
acggaatccataatgcgcgtttcgcaggtttaccgctggcagataccgatggacgcgggcgtggtgctgcgcgagcggcggttaaaaacccgcgacgggctgttcatccgcctgcaggagggggaacgcgaaggctggggcgaaatttctcccctgccgggattcagtgtcgagacgctggaagaggcgaaaatggcgctgttagcgtgggcacaggcctggcgcgacggcgccgagccgccgcttcccatgcagccctccgtcgcgtttggcatcagctgcgcgcaggcggagctgagcggcggactaccgcaggccgcggattatcgcgcggcgccgctctgctccggcgatccggatgagctattcgccagactggcggcgatgcccggcgagaaggtcgctaaggtcaaagttggcctctgggaggcggtccgcgacggtatggtggtcaatctgctgctggaggcgatccccgacctgcagctgcggctcgatgccaaccgcgcctggacgccgctcaaagcgcaacagttcgccaaatacgttaatccggcgtaccgccagcgcattgcttttcttgaagaaccttgcaaaacgcgggaggattctcgggcctttagccgcgagacagggatcgctatcgcctgggatgaaagcttgcgcgaggcggatttccgctttgtcgccgagccgggcgtacgtgcggtggtgatcaaaccgacgctaaccggcagtttgcagaaggtgcagcaacaggtcgccgcggcgcatgcgctggggttgagcgtagtgatcagctcgtcgatcgagtccagccttgggttaacccagctggcgcgggttgccgcctggctgacgccgcagaccatccccggactcgatacgctggcgctgatgggcgcccagctggtacggccgtggcccgaaagtgcgctgccggtgctcaacattgatgcgctggagccgctgctgtga

SEQ ID NO: 1169 - DNA, 1104 bp, Klebsiella pneumoniae
ggacatcccatgggcagctacctgatccgccgtttgctgttagtcatccccaccctgtgggccatcatcaccattaacttttttattgtccagatcgcgcctggcggcccggtcgatcaggccatcgccgccatcgagtttaatcagcgcggcgggatgccgggggctggcgacggcgggatgggcgccagccatgcccgcaccggcgcaggcaatatcagcgagggtcactatcgcggcgggcgcggcctcgacccggaagtcatcgccgagataacccaccgctacggcttcgataaacctctccacgaacgctatctgaagatgctgggcgattatctgcgctttgatttcggcgacagcctgtttcgcagcgcctccgtgctgcagctgattaaagacagcctgccggtctcggtgagcctcgggctgtggagcacgctgattatctatctggtctccattccgctgggcatccgcaaagcggtcagcaacggcagccgctttgatatctggagcagtacgctgattatcattggctatgcgatccctgcctttctgttcgccatcctgctgatcgtgatttttgccggcggcagctatttcgacctcttcccgctgcgcggtctggtctcgccaaatttcgacaccctcccctggtatcagaagatcctcgactacctgtggcacatcaccctgccggtgctggcgacggtaattggcggctttgctgcgctgactatgctgaccaaaaacagcttcctcgacgagatccgcaaacagtatgtggtcaccgcccgcgccaaaggcgttggtgagaaacagatcctctggggacacgtgttccgtaacgccatgctgctggtgatcgccggcttcccggccacctttatcagtatgttctttaccggctcgttgctgatcgaagtgatgttctcgctaaacggcctgggtctgctgggctatgaagcgacggtctcccgcgactatccggtgatgttcggcacgctctatattttcactctgattggcctgctgctgaatatcgtcagcgatatcagctatacgctggtcgacccgcgcattgattttgagggccgctaa

SEQ ID NO: 1170 - DNA, 219 bp, Klebsiella pneumoniae
gccaggcccatcattacaaccggaactaacgtaagcgttttacgtaattccacgcgagaggtatttggagtagcgttatgcgacatagttatccccttttacggtgaacgccagcgcgtaagcaaaaaattgccccatttctttctattcctcagcgacaacgactgtcggtttttagtaaatatctatccggtacgaagcccggcctcttggtattga

SEQ ID NO: 1171 - DNA, 945 bp, Klebsiella pneumoniae
ttttcagccatagatgagaaaaactcagccatgagaccaccccgtctgccgccgctgggggcgctacgcgcttttcatgccgtcgcccgccaccgcagttttaaacaggccgccgaggcgctcggcgtcagcgcgacggcggtcagccatcagattaaactgctggagtcggtgctggagtgccgggtctgcgaacgcagcgcgcagggcgtcagtctgaacgctgatggcgagatcctttacgcggccacccaacgcgcctttagcgccctggaacaggccgtcgtccagatcgctcatgcccgtcagccgccatccttaaccgtcaccaccacctccaattttctcacccactggctggtgccgcggctggcggatttcaccgcccgctttccggctatcgacctgcggctacacaccagcgtcgaacgagtggatctgcatctgggcacggtagacgccgcgattcgctatcgtgaaacgccggagccggacctgtactgcacgctgctgtatgaggatcgctttatcgtggtcgccagcccgactctgggcctcagccggcctgaagatctgcagcgggtgacgctgtttcacgttgccaaccggtgcgtgccagctgattcgccgagctgggagaactggcgtcggcgctatggaccgccgacgctgaatattgatgcggggttaacctttagcgatgagacccatgccctgcaggcggcggtggccggtcagggagtggtgatcgccagcgaactgctggcgcgggatctgctgcagcgcggcgtattgtccgcgccgttcagcaacgcattgcctggcgcccgctactacctggtcactaccgaagcggtagcgcagcgggcggatattatcgctctgcgggagtggctgctcagtcagatggtgtcgggcgacggcggccatccgactgcgggatag

SEQ ID NO: 1172 - DNA, 1479 bp, Klebsiella pneumoniae
cattatcacatggtttcggaaactaaaaccacagaagcgcccacgctacgtcgtgaactgaaggcgcgccacttgaccatgatcgccatcggcggttccatcggtacgggtctttttgttgcctctggcgcaaccatttcgcaagcaggtcccggcggggcgctgctgtcttatattctgatcggtttgatggtctatttcctgatgaccagcctcggcgagctggcggcgtttatgccggtatccggttccttcgccacctacgggcagaattatgttgaagaaggcttcggcttcgcgctgggctggaactactggtacaactgggcggtgacgatcgccgttgacctcgtggcctcacagctggtgatgagctactggttccctgacactccgggctggatctggagcgccttgttcctcggcatcatgttcctgctgaactggatctcggtgcgcggctttggcgaggcggaatactggttctcgctgataaaggtagccaccgtcattatctttatcatcgtcggcgtgatgatgattgtcggcatcttcaaaggggcgcagccagccggctggagcaactgggggatcgcggatgcgccgttcgccggcggtttctcggcgatgattggcgtggcgatgattgtcggcttctcgttccagggcaccgagcttatcggcatcgctgccggtgaatctgaaaatccggagaagaacattccgcgcgcggtgcgccaggtcttctggcgtatcctgctgttctacgttttcgccattctgattatcagcctgatcattccgtacaccgacccgagcctgctgcgcaacgatgtgaaggatatctccgtcagcccgttcaccctggtgttccagcatgctggtttgctgtcggcggcggcaatcatgaacgccgttatcctgactgccgtgctgtcggcgggtaactccgggatgtacgcctccacgcgtatgctgtacaccctggcctgcgacggtaaagcgccgcgcattttctcgaagctgtcgcgtggcggcgtgccgcgtaacgcgctgtacgcgaccaccgtgatcgcggcgctgtgcttcctgacttccatgtttggcaaccagacggtgtacctgtggctgctgaacacctccgggatgacgggctttatcgcctggctgggtattgcgatcagccactatcgtttccgtcgcggctacgtcctgcagggtaacgatattaataatctgccgtatcgttccgggttcttcccgctggggccgatcttcgccttcgtgctgtgcctgatcatcaccctcggacagaactacgaagcgttcctcaaggacactattgactggggcggcgtggcggcgacctacattggtattccgctgttcctcgtcatctggtttggttacaagctggcgaaaggcacccgctttgttcgctacagcgaaatgaccttcccggaccgctttaagcgttaa

SEQ ID NO: 1173 - DNA, 1425 bp, Klebsiella pneumoniae
gcgaataacatgacagacctcccggccagcgtgcgctggcagctatggatagtggcgttcggcttctttatgcagtcgctggacaccaccatcgttaacaccgccctcccctcgatggccaaaagcctcggggagagtccgctgcatatgcatatgattatcgtctcctatgtgttaacggtggcggtgatgctgccggccagcggctggctggccgaccgggtcggggtgcgcaatatcttcttcaccgccatcgtgctgtttaccgccggatcgctgttttgcgcccaggccagcaccctcgaccagctggtgatggcgcgggtgctgcagggagtcggcggcgcgatgatggtgccggtcggccgcctgacggtgatgaagatcgtcccgcgcgatcagtatatggcggcgatgaccttcgtcaccctgccgggccaggtcggcccgctgctcggcccggcgctgggcggggtgctggtggagtacgcctcctggcactggatcttcctcatcaacatcccggtggggatcgttggcgcgatcgccaccctctgtctgatgcccaactacaccatgcagacccggcgcttcgatctctccggctttctgctgctggccgccgggatggcgaccctgaccctggcgctcgacggccagaaagggctcggcatttcccctgcctggctggcggggctggtggccgtcggcctctgcgccctgctgctctacctgtggcacgcccgcggtaacgcccgggcgttgtttagccttaacctgtttcgaaaccgcaccttctccctcggcctcggcggcagcttcgcgggacgcatcggcagcggcatgctgccgtttatgaccccggtgtttctgcagatcggcctcagcttctccccctttcacgccgggctgatgatgatcccgatggtgctcggcagcatgggcatgaagcggatcgtggtccaggtggtcaaccgctttggctaccgtcgggtgctggtcgccagcaccctgggcctggcggcggtcagcctgctgtttatgtttagcgccctggccgggtggtattacgtgctgccgctggtcctgtttctgcaggggatgatcaacgccagccgcttctcctcgatgaataccctgacgctgaaagatctcccggacgatctggccagcagcggcaacagcctgctgtcgatggtgatgcagctgtcgatgagtatcggcgtgaccatcgccgggctgctgctggggctgtatggccagcagcatatgagcctcgacgccgccagcacccatcaggtctttctctacacctatctgagcatggcggcgatcatcgccctgccggcgctcatcttttcccgggtaccggatgacgtcggcagcaataccgtcctccgtcgacgcaacaggagtggatcgtga

SEQ ID NO: 1174 - DNA, 750 bp, Klebsiella pneumoniae
ggagaatgcatgtctcagttaaccctggccgactgctggcctcgccgtttttccccctcctcgctggcgctgcagttttgcgaggatccatcccaggccgagcagccgctgtttgccaaagccagcgccggcgaggccgtcgcccagctctggcaggcgccgcagggattggtggtgccggggagctatcgtcagtttacggatctgccggcggtcagcgcgcattttgccgcgcgcggctggccggtatggcttcgccgctccggcggcggtctggtgccccaggggccgggcattatcaaccttagcctcgcctggccggtgcagcagccgctcggcgaagccgccgaaccgatctatcattcgctgtgcgttgtgctgcagcgtaccctcgcgcgcttcggcgttgccagccacccccgggcggtgagcggttccttttgcgatggacggtataatcttgcctgcggagaaggcgcggaggcgcgcaagattgtcggtaccgcccagtactggcggccactgacggcaggccgcggccacgtggtgctggcccatgcggtgatccttattgacgccgatctgagcgcggcgcatcaggcggcgaacgccttcgaagcgcagctcggcagcgagcgggtctattgcgctgacaagaccgttactctcgcgcagctgcttcccggcgagcgccatctgctgccccgctttagcgagacgctggcgcaggagctggacgcggctcgctga

SEQ ID NO: 1175 - DNA, 1164 bp, Klebsiella pneumoniae
ggaccgagcatgaaaattgaatctgtgaatgtcaccgttttccaatatcccactcgtcgggtttccgacagcgccgggcactcccatccgggggttgaaagcatggccaaaatggcgatgctgaccatcaccgctgatgatggagcgcagggcttttcgtttgcgcctccggaagtcgtgcgcccgttcgtggtgaatactttttttcgcaaagtgctggtgggacaggacccgtttaaccgtgagcgtatctggcaggatcttaaccactggcagcgcggcagcgcacatcagctaacggagcgcgcgctgtcgtttgttgaacaggcgctgtgggacctgatcggccgcagccttaagatgccggtttataagctgctcggcggctatcgcgacactgtcccggcttacggtagcaccatgtgcggcgacgatctgccgggcggcctgtcgaccccggaagagtatgccgcttttgctgagaagctggtcgcccgcggctacaaggccatcaaactgcacacctggatgccgccaatctcttttgcgcccaatcccaaaatggacattaaagcctgcgcggcggtgcgcgaagccgtagggccggatattgacctgatgattgatggctatcactggtacagccgcgccgaggcgctgtggatcggcaaagagctggaaaaactcaatttcgcctggtttgaagagccgatggaggaggattcgatgtcttcctatgcgtggctggcggaaaacctgtcgattcccatcgtcgggccggagagcttcggcggcaagcaccacatgcgcgccgaatgggtgaaagccggggcctgcgacattctgcgtgccggcgctaacggcgtgggggggattacaccgaccatgaaggtggcggcgctggcggaatctttcggcatggattgcgaagtccacggcaacggagcggcaagcctggcggtggtgggcgcgatccgcaactgccgctggtacgagcgcggcctgctgcatccgttcctcgactacgatgaaccggcggcctatctcaacagcattgtcgacccgatggatgacaagggatttgtgcatttgtcacaacgtccgggtctcggtgaagacattaattttgcgtatatcgaagccaataccgttagccacgactga

SEQ ID NO: 1176 - DNA, 690 bp, Klebsiella pneumoniae
ctggcgagcatcggttatccttcatcgaatgatcttgtttgtgcacgattatgcatgttatggtgcctgctgtcacctcaaaggggaaataacatgcaaacacatgcaccgcacgtccgccacgttcgcgagacgctgctctcggataactggtacacgttgaaaaaatataccttcgaactgctgcgtcgggacggtcgctggcaggagcagagccgcgaggcttatgaccggggcaacggcgcagtcattttactctacaaccgggaaaagcggacggtggtcctgacccgtcagttccgttttccggtatttactcatggccacgacggatatctcattgaggctgccgccgggctgttggataacgcctcgccggaggcgcggatcgttgccgaagcggaagaggagaccggctttcgcgtgacccgtgtcgaacccatcttcactgtctttatgagccccggctccgtcaccgaaaaactctacttttttatcgccgaatatcaggccgatgaccgtcggggcgacggcggcggactggcggcggaaggtgaggatattgaagtactggagtggccgctgacgcgggcgctgcaggctattcgcgatggcgagatcatggatgctaaaaccattatcctgctgcaacacctggcgctgaatgccgacacgctcctcgccggctga

SEQ ID NO: 1177 - DNA, 609 bp, Klebsiella pneumoniae
  unsure (130),(131),(132),(133),(134),(135),(136),(137),(138),(139),(140),(141),(142),(143),(144),(145),(146),(147),(148),(149),(150),(151),(153),(155),(156),(157),(158),(159),(162),(163),(164),(165),(166),(167),(168),(169),(171),(172),(173),(174),(175),(176),(177),(178),(179),(180),(181),(182),(183),(185),(186),(187),(189),(190),(191),(192),(193),(194),(195),(196),(197),(200),(201),(202),(203),(204),(206),(207),(208): Identity of nucleotide at the above locations are unknown.
agggaattaatattagccagggtagtaacatggcgatttttattccttgttaaagtcccgttcaggaccgattttcaacgaattcgactacattcacgtttgagtgcggtttgttgtgtcgggtgggggnnnnnnnnnnnnnnnnnnnnnntncnnnnnttnnnnnnnntnnnnnnnnnnnnntnnncnnnnnnnnnccnnnnncnnnccccctcccccccccccctctcctctccccctcccccttcctcctcctctcctctctccttccctccctccctctcttttttccttttcctcttccccctccctttccccccccttcctcccctcccctcctctctcctcctcccctcctcccccttcctctcccctcttcccctctccctctccctcccccttctccccttcttccctccccttcttttcccccccccctccctctctcttctccttcccctcttctccccctcttcttctttcccctcctctttctccctctcctcccctcctccttcttcttctctctccttcctttcttccctcttcttccctctcctcttcccctctttcttcctctcctccctcctccttctcctctctctcctc

SEQ ID NO: 1178 - DNA, 1035 bp, Klebsiella pneumoniae
gggccgctaatgtctttcttcagtcccgttaatcaggcccgctgggcgcgctttcgccacaaccgtcgcggctactggtcgctgtggctgtttttaattctcttcctatgcagcctgggcgccgagctgctggccaacgaccgcccgctgctggtgcagtaccggggccagctgtacgtcccggtgttaaaaaactacactgagcaaaccttcggcggcgcgttcgccaccgccgccgactatcaggatccctggctgcagcagcagctggcgactcacggctgggcgctatggccgccagtgcgcttcggcgcgacgacaattaattttgccagcacggttccctttccatcgccgccctcggccagcaactggctcggcaccgacgccaacggcggcgatgtgctggcgcggatcctctatgggacacgcatctcggtgctcttcggtctgctgctgacgctgttctccagcgtgctgggggtgctggccggggcgatacagggttactacggcggtaaaatcgacctgtggggacagcgttttatcgaagtctggtccggcatgccaacgctgttcctgattatcctgctctccagcgtcgtgcagccgggcttctggtggctgctggcaatcaccgttctctttggctggatgacgctggtgggcgtggtgcgcgcggaatttctccgtacccgcaactacgactatgttcgggcggcgcaggcgttaggggttagcgaccggcagatcatcctgcggcatatgttgcccaacgcgatggtggcgactctcaccttcctgccctttatcctgtgcagctccattaccaccctgacgtcgctggattttctcggcttcggcctgccgctcggctcgccctccctcggcgagctgctgctgcagggcaaaaacaacctgcaggcgccctggctgggcattgccgcatttctctccgtcgccgtgctgctgacgctactgatttttattggtgaagcggttcgcgacgcctttgacccgagtaaggcggtgtaa

SEQ ID NO: 1179 - DNA, 1473 bp, Klebsiella pneumoniae
gctaacataatgatcacatttaaactgcgaacgtttcgcagtgaccacaccagacaggagtatgtaatgtccaagcaacagatcggggttgtcggtatggctgtgatggggcgtaaccttgcgctaaacatcgaaagccgtggttataccgtctccgttttcaaccgctcccgtgaaaagaccgaggaagtgattgcagaaaacccaggcaagaaactggttccttattacacagtacaagaattcgttaaatcccttgaaacaccacgtcgtatcctgttgatggtgaaggccggggctggcaccgacagcgccatcgactccctgaagccttaccttgataaaggcgacatcatcattgatggcggcaacaccttcttccaggacactatccgtcgaaaccgtgagctgtctgccgaaggttttaactttatcggtaccggtgtttccggtggtgaagagggggctctgaaagggccttccatcatgcctggtgggcagaaagaagcctatgagttagttgctccgattctgaagcagattgctgcggttgctgaagacggtgagccatgtgtgacctatatcggtgctgacggtgctggccattatgtgaagatggttcataacggcattgagtatggtgacatgcagctgattgctgaagcttatgcgctgttgaaaggcggtctggcactttccaacgaagagctggcgcaaaccttcaccgaatggaacgaaggcgagctgagcagctacctgatcgacattaccaaagatatcttcaccaagaaggatgaagacgttaaatacctcgtcgatgtcattcttgatgaagcagcaaacaaaggtactggtaagtggaccagtcagagctcactggatcttggggaacctctgtctctaatcaccgagtccgtatttgctcgctatatttcttctcttaaagaccagcgtgtagccgcttcgaaagtactgagcggtccgcaggctcagccggccggtgataaagctgaatttatcgaaaaagtgcgtcgcgcgttgtacctcggtaaaatcgtttcctatgctcagggcttctcccagctgcgagctgcttctgatgaatacaactgggatctgaactacggcgagatcgctaagattttccgcgctggctgcataattcgtgcgcagttcttgcagaagatcaccgatgcttatgcgcaaaacgcaggcattgctaacctgttgctggcaccatacttcaagcagattgctgatgactatcagcaggcgctgcgtgatgtggtggcctatgccgtgcaaaatggtattccggtaccgacgttctctgccgcaattgcctattacgatagctaccgttccgctgttctgcccgctaatctgattcaggctcagcgggattactttggcgcgcatacctataagcgtaccgataaggaaggtgtattccataccgagtggctggaataa

SEQ ID NO: 1180 - DNA, 1365 bp, Klebsiella pneumoniae
catacctccttattttataacaataatgctccgctgctgtgcagcggagacactcatctgcactctgaaatcgaggtcaacatgtccgttaataacaaacagtggtacggtctaccgctcaacctcatctggggatatgtcgccatcgccgtgtttatgaccggcgacggctttgagctggcttttctgtcgcactacatcaaagcactcggattcaccccggcgcaggcttcctttgcctttactctctacggtctggctgccgccctgtcggcgtgggtctccggcgtggtggcggaaatcattaccccacgtaaagccatgctgattggcttcgtgctgtggtgtgtgttccacgtactgttcctcgtcttcggcctcggtcgcgccaactatgcgctgatcctgctgttttatggcatccgcggcctggcctacccgctgttcctctactcctttatcgtcgccattatccacaacgtccgcagcgacagttccagctccgcgctgggctggttctgggcggtctactcggtgggtatcggcgtgttcggcagctatattccgagctttaccattccccacattggcgaaatgggcaccctgtggctggcgctgctcttttgcgccaccggcggcattattgcgctggtgtcgatgcgtcataccgaaacgccgcgccatatgcagaacctgaccactcgtgaaaaattcgccgaactggggcgcgcggcgacgctgctctataccaaccgcagcattctgttctcgagcattgtgcgcattatcaacaccctgtcgctgtttggttttgcggtgatcatgccgatgatgtttgttgatgagctgggatttaccacctcggaatggctgcaggtatgggcggcattcttcttcaccacgatcttttcgaacgttttctgggggattgtggcggagaaaatgggctggatgaaggttatccgctggttcggctgcatcgggatggcgctttccagcctggcgttctattacctaccccagcacttcggccataattttgccatggcgctggtaccggctattgccctggggatttttgtcgccgcgtttgtgccgatggcggcggtgttcccggcgctggagccgaaccataaaggcgcggcgatttcggtctataacctgtcagccgggctgtcgaactttctggcgccggcgattgccgtggtactgctgccctatttcagcactatcggcgtggtaatagcctataccgccttatatattctggccttcttcctgtgcccgttaatccgcgttgaacagcctggctttaccagcgttcagcatgcgaaaccgtttaccgccaacgcggcagagtcttaa

SEQ ID NO: 1181 - DNA, 1053 bp, Klebsiella pneumoniae
cgtgctgtaattctcttaaggttgctgagtatgatcaccattcgtgatgtcgcccgccaggcgggcgtttccgtggccaccgtgtcgcgggtgctgaataacagcgcgctggtgagtccggatacgcgcgacgtggtgatgaaagcggtgacccaactgggctaccggcccaacgccaacgcccaggcgctggccacccaggtcagcgataccatcggcgtggtggtgatggacgtctccgacgccttcttcggcgcgctggtgaaagcagtggataccgttgctcagcagcatcagaaatatgtgctgatcggcaacagctatcacgaggcggaaaaagaacgtcacgccatcgaggtgctgatccgtcagcgctgctcggcgctgatcgtccactcgaaagcgctgagcgatgatgaactgagcgactttatgcaacatatcccggggatggtgctgatcaaccgcatcgtgccggggtatgcccatcgctgcgtagggctcgacaacgtcagcggcgcgctgatggccacccgtatgctgctcaatcatggtcaccagcgcatcggctatctctcctcaaaccacggtattgaagatgacgatatgcgccgggaagggtggagcaaagcgctgcaggagcaaggcatcatcgccccggacagctggatcggttccggctccccggatatgcagggcggtgaagcggcgatggtcgaactgctggggcgcaatctcggcctcaccgcggtgtttgcctataacgacagcatggcggccggcgcgctgacgacgctgaaggacaacggcattgtcgtgccgcagcatctgtcgctgattggctttgatgatattcctatttcccgttacaccgatcctcagctcaccaccgtgcgctatccggtaatgtcgatggcaaagctggccaccgagctggcgctgctgggggcggccggcaagctggatcgcgaggcgacgcactgctttatgccgacgctggtgcgccgtcattccgttgcccagcggcaaactgtggggccgatcactaactga

SEQ ID NO: 1182 - DNA, 663 bp, Klebsiella pneumoniae
ggaggagtaatgctcgatctgtttagcgatatcccaccgtggcaggagccgctggcccccggcgcggtggtgctgcggcgatttgcccgcgaacgcgccccggcgctgctgcaggcgatagccgacgtcgccagtcagtcgccgtttcgccagatggtcacgccgggcgggtacaccatgtcggtcgccatgaccaactgcggcgcgctgggctggactaccgatcgccacggctatttgtacgccccggtcgacccggtaaccgatcaaacctggccgccgatgcctgccgtctttcatgaactggcgctggcggccgccgccgccggcggctatccggagttttcccccgacgcctgtttgattaaccgctattgtcctggcgcaaaactgtcgttgcatcaggataaagatgaacaggatctgcgggcgccgattgtctcggtctcgctgggcttgccggccatctttcagtttggcggcttgcaacgcagcgacccgctgcagcggctgctgctggagcatggcgatgtggtggtctggggcggcgagtcgcgcctgttttatcatggcattcagccgctgaaagcggggcatcatccggaaacgggcgactgtcgttacaatctcaccttccgacaggcgggcggtcgccagtattaa

SEQ ID NO: 1183 - DNA, 1161 bp, Klebsiella pneumoniae
aacgattcaattcagcaggagaggagaaccatgttccagttatctgtgcaggatattcatcccggccagcaggccggtaataaagaagaggccatccggcaggtcgccgccgcgctggtcagcgccggcaacgtggccgatggctacgtgaacggcatgctggcgcgcgagcagcagacctcgaccttcctcggcaacgggattgcgatcccgcacggcacgacggatacgcgtgaccaggtgctgaagaccggcgttcaggtgtttcagttcccgcagggcgtcacctggggcgaagggcagaccgcctatgtggcgatcgggattgccgccagctcagatgaacacctcggcctgctgcgtcagctgacccatgtgctgagcgatgacgcggtcgccgcgcagctgcagtccgccactaccgcggaagagctgcgcgcgctgctgatgggagagaagcagagcgaagcgctgaagctggataacgagaccctcagtctcgacgtcgcggccagcgatctgctgaccctgcaggcgctgaacgcggcgcgtctgaaagaagttggcgctgtcgatgccgccttcgttagccacgtcattaacgatacgccgctgaacctcggtcagggcgtctggctgaacgacagtgcggaaggcaatttgcgcagcgccgtggcggtcagccgcgcggctaacgcctttacccgcgacgagcagccggtttccctgctggtcacggtggcgatggccgacgagcagccgaccgcagtgctgaaccgtctgagcaagctgctgctggacaagaaagctgaacatttgctgaaagccgacgccgccaccgtgctggcgctgctgaccagcgacgacgccattgccgaagatgtgctgagcgccgaattcgtggtgcgcaatgaacacggcctgcatgcccgtccgggcaccatgctggtcaacaccattaaacaattttccagcgacatcaccgttaccaatctcgacggttccggcaagccggctaacggtcgcagcctgatgaaggttgtggcgctgggtgtgaaaaaaggtcaccgtctgcgttttaccgcgcagggtgaggatgcgcaacaagcgctggatgcgattggcgaagcgatcgccgcaggccttggggagggcgcataa

SEQ ID NO: 1184 - DNA, 1146 bp, Klebsiella pneumoniae
actaataaaatttttatgtgtttgcttcatttgttatgtggcaaatatcattgtcataaaaatattcttcgtttttatgccagaaaaaatatattcagcacaaatccttgggatgttcacatacactatcacaggttttattttaaacaagttctgggcgatgaaatgacaacctcaactgatataaaaagcactccttctttagctattgtggtaccttgctataatgaacaagaggcttttcctttctgtctcgaaaagctttcgaatgtactaaattcattgatagccagaaataaaattaacaacaatagttatcttttgtttgtcgatgatggtagtcgtgacaatacttgggcacaaattaaagatgcctcgaccgcttatcactatgtgcgaggaataaaattatcaagaaataaaggacatcaaattgccttaatggcagggttacgctcggtcgatacagacgtaaccattagcatcgatgcggatctacaagatgatgtaaattgcatcgaaaaaatgattgacgcttacagccagggatatgacatagtatacggcgtaagatgtaatcgagacagtgacactttttttaaacgtacaacagctaatgcattttacgcaataatgtcccacatgggtgtaaatcaaactccaaatcatgcagattatcgattattaagtaatcgtgcgttggaggctcttaaacaatataaagagcaaaatatatatttacgtggattagtgcctcttgtgggatatccctcgatcgaggtgcaatatagccgtgaagaaagaattgcaggtgaatcaaaatatccaattaaaaaaatgcttgcgctggctctcgagggaattacctcattatcagttacaccgttacgaattatagctatgacaggttttataacttgcatcatatctaccatcgctgcgatttatgctttaattcaaaaaataacaggtactacagttgagggatggacatcagtcatgatcgctatattctttcttggcggtgtgcaaatgctttctttaggtattataggagaatatgtcgggaaaatttatatagagacgaaaaatagacctaaatatttcattgatgaaagcgtaggtaatgatagcaatggaaaataa

SEQ ID NO: 1185 - DNA, 978 bp, Klebsiella pneumoniae
cgtgcaaaaatacttttcagaatgcccatgatgccgaaatttcgagtctctttgctcagcctgaccttgctgctggctgtgccttttgcgccccaggcgttagcaaaaaacccgacggcggtgaccgcctcgcagccggaaattgcctccggcagcgccatgatcgtcgatctggccacgaaaaaaatcatttatgccagccagcctgatctggtgcgcccgatggcgtcgatcaccaaagtgatgaccgccatggtggtgctcgatgcccatctgccgctggatgagatgctgacggtggatatcagccatacgccggaaatgaaggggatctactcccgcgtgcgcctcaacagccagattagtcgccgcgatatgctgctgctggcgctgatgtcttccgagaaccgcgcggccgccagcctggcgcatcactatccgggcggctacgacgcttttattcgcgcgatgaacgccaaagcccaggcgctgggcatgacccatacccgctacgtggagcccaccggcctgtcggtgcataacgtctccaccgcccgcgatctgaccaaactgctgatcgccagcgagcagtatccgctgatcggccagctgagcaccaccaaagaagagaccgccaccttcgcccatccggcctacagcctgccgttccgcaacaccaaccatctggtgtatcgcgataactggaacattcagctgaccaaaaccggcttcaccaacgctgccggccactgcctgattatgcgcacggtgattaaccaacgtccggtggcgctggtggtgatggatgccttcggcaaatatacccacttcgctgacgccagccgcttgcggacctggattgaaaccgggaaggtgatgccggtacccgcctcggcgctgagctataaaaagcagcgcgaagcgcagatggcggaggcgatgctgaaaggcggcgcacagaccgcgcagaacgattaa

SEQ ID NO: 1186 - DNA, 1017 bp, Klebsiella pneumoniae
atgaaaaaaatgttgataatactcatagccgtttttaatccgtgctactccttcgaattaggtattggaacacatttttcctcttatccggggcaaccggataaatatcttcggctcatcaaatcttatggttttacatcaattagagatgactatacgtggaataaaattgaagacgtcaaggatgattttaattcacgtggtaaaattgctaaagttgataaggctataaatcaagctgcatctttcaatataaatactttagtcgtattggattatggtaataaacattataactctaattattatccaaatacagaagagtctttaaacgcttataataggtatgttgaatggacagtcagacatctaaaggggaaagtaaaatattatgagatttggaatgaatggacaataggtacagggattaaaaaagatgggaaaatcccaccatcggttgatgattattataatttagtaaaactaaccagtgccacgatcaggaaagaagatcctaatgctattattctggcggggtcaattaatccattatccgataaacctagatttatcggcgtaagtgatgagcaatggataacggctttaataaaaaaagggatgctggagtatatagatgggatttcattacatccatattcatatgctaatagttcggaaagtctacgaactgttaaaggaaatatagatgctattgattcttttcatgataggattaaactgatttcggggaaagaaattcctttttatattactgaaatgggagtgcctacccattatggccatggaggagtttcacttgatgaacagagtgattttataaacgagtattcgcgtgaagtaatgaatagaaaatatatcaaagggctttggtggtacgacttaataaacgatggtggtaacattttaaataaagaagataattttggtttcttctatgaaaatttatctccgaaaccagttatgcaggattttaaaaaaaacctcatatctaagtga

SEQ ID NO: 1187 - DNA, 1431 bp, Klebsiella pneumoniae
ttaaaggaaattaatatgttacttcctgtgataatggctggcggtaccggcagtcgtctctggccgatgtctcgcgagctttacccgaaacagttcctccggctgtacgggcagaactccatgctgcaggaaaccatctcccgcctctcgggccttgaaatgcatgaaccgatggtcatctgtaacgaagagcaccgtttcctggtggctgaacagctgcgccagctcaacaagctgtccaacaacattattctagagccggtcgggcgcaacaccgccccggccatcgccctggcggctcttgaggccacccgtcacggtgaggacccgctgatgctggtcctcgccgccgaccatatcatcaataaccagccggtcttccacaacgccatccgtgtcgccgagcagtatgccgatggaggccatctggtcaccttcggtatcgtgccgaatgccccggaaaccggctacggctatatccagcgcggagtggccctcaccgacagcgcccacaccccgtaccaggtggcccgtttcgtggagaagccggaccgcgcccgcgccgaggcctacctcgcctccggagagtactactggaacagcggcatgtttatgttccgcgccaaaaaatacctttccgagctggccaaattccgcccggatatcctcgaagcctgccaggccgcggtcaatgccgccgacaacggcagcgacttcatcagcattccgcatgacattttctgcgagtgcccggacgagtccgtggactacgcggtgatggagaaaaccgccgacgcggtggtggtcggtctcgatgccgactggagcgacgtcggctcctggtccgccctgtgggaggtcagcccgaaagacgggcagggtaacgtcctcagcggcgacgcgtgggtgcacaacagcgaaaactgctacatcaacagcgacgagaagctggtggcggccatcggcgtggagaacctggtgattgtcagcaccaaggacgccgtgctggtgatgaaccgtgagcgttcccaggacgtgaagaaggcggtcgagttcctcaagcagaaccagcgcagcgagtacaagcgccaccgcgagatttaccgtccctggggccgctgcgacgtggtggtccagaccccgcgcttcaacgtcaaccgcattacggtgaaaccgggcggcgccttctcgatgcagatgcatcaccaccgcgccgagcactgggtcattctcgccggcaccggccaggtgaccgtcaacggcaagcagttcctgctgaccgagaaccagtccacctttattccgattggcgccgagcacagcctggaaaacccgggccgcattccgctggaagtgctggagatccagtcggggtcgtacctcggcgaggacgacattattcgtattaaagaccagtatggtcgttgctaa

SEQ ID NO: 1188 - DNA, 672 bp, Klebsiella pneumoniae
ggtgaacgaatgagtaagcaggcggttatttttgacatggatggcgtgattattgattccgaggcgctgtggcgtcaggcgcagattgacgccctcgcgcagtggggggcaacggcgagcgttgctgaatgtgaaaccctgaccaagggcaagcgcctcgacgacattgccggcacctggtgccgctattttcagcttgatctcgctccgcagcggcttgaagacgccatcctgcagcgcatcacccgcctgattgccgcgaaaggcgaaccgatgcgcggggtgcaggaggcgttacgctattttcgcgaagcgggttataagattgcgctcgccacgtcatcatctcgtcaggttattgccgctgtgctgaacaagctttcgctctggcacttttttgacgcgatctccagcgcggatgatgaaccacgcggcaaaccgcacccggcggtgtacctcacgacgctgcggaagctcaatctcaacgccagccagtgtctggtgattgaggatagctttaccggcttttgcgcggcccagtcggcggggattgccacgatagtgattgcagaagatagccagcacgcgcgttttcaggccgccgctggccgctatcaaaccttacctgaactgctggaagcgcttagcgcggagccagcggcggcggtttaa

SEQ ID NO: 1189 - DNA, 252 bp, Klebsiella pneumoniae
tgggtgggaataatgattcgctgcatgattgtgcctcactttaccgtctcaaacgcgacgttcagaaatagcctatatgatgcatatcatataccccttttaaacgttaaggatattattttgttgtggaattttacgcctactcctttttatacctcgcagggattagcgctaagagaaaataaaaaaggcgatttcaggatcctgaaatcgcccgggagaataaaaataaacgcgttaaaaatttgttag

SEQ ID NO: 1190 - DNA, 1239 bp, Klebsiella pneumoniae
cgagagacctttatgtccatcgattattttgcggatcactatagaaatatagcatttaaatataagcatatattatgctttttatctttactttgtgttgcgttcgcagtttttgatggttttcgcgggacgcaatataagccttacttcccatttgcgtttttaagagacttgtctgtttttgtggggggagggctaggtttttttataatcgcaaaaattaaaatacaaaaaagctttgccttattggtttttttgcagatttttatttgcgcttattcatttttcactagttttttggtttcagataaagccgtattcgttaggcaattgactttaggtgggggcattggattttggtccaaaatgttaagcatgatttgtatttgtttccttacatatgcttatatttacgtgtccgggaaaaaagctgttgaaaaaatatttaagtgttttatttattgttcatttctctattcgttgctcaccattatattgtatttgtttttaccgtctctttatgcatccttaccaaggcaatggtacggtcgaatatctattggttatccgactcaagatgtttatgttttagctatttcgctagtgttacttctggagaatatattaaacaaaactctttcaatattaatttctgcggtaaatgtaagctgtattatcatgcagaacacatttacaggctatattcttattgtgttcgtgttttttatttattttatccgatttggtttttttagcaaggcattaatattatctttaggtttctttttgctcatgtttgttttttatatctataaaaactatgaggtctttggcaattttggtgttttgattaaggtgaaggctgattcacttattctaggcggcacggatgacccatctttttatttaagattgcagcaaatagcaatgatgatgaagtcgttattttcagactggatatttgtattatttggctatggagggattggtggtttttctgttgagtcgggagtatattcaactttagcattttcaggagtattaggcattataatatatgtgtttacgattctatacttcctttttctctcgattaaaaataaaagcttcatccttttttccataccatcaatgtacattctttcatctttttcaatcagcccaatatatttaatgtctacatattggactttgggttttttaatagcctatcaatcttttgttgatgaggttaaataa

SEQ ID NO: 1191 - DNA, 759 bp, Klebsiella pneumoniae
gcgaaaatgattgtatggagcaccgccatggaaagggcgacgaattccccccacgatgctgtatttaaacacctgctgtcgcatcgggcgacggccagggattttctggacattcaccttcccgcaccgctgcgcgcgttatgtaatctgaacacgctgcggctggagtccgggagctttatcgacgacgaactgcgggcgagtcattccgatatcctttactcgctgcaaacgcaggcgggggagggctatatctatctgttgatagagcaccaaagctcggcggaccgccatatggcatttcgcctgatgcgctatgcgatagccgcgatgcagcgtcatctggataaagggcatacgcagctgccgctggtgatcccgctgctgttttatcatggtcgcgtttctccctggccttacccgatgtgctggctggcaggctttgccgatccggacatcgcgcggcggatctatggtgaagattttcccttaattgatatcactagcaccccggacgatgaaatcatgcgccaccggcgcgtggcgatgctggagctgctgcagaagcatattcgccagcgggatttgatggacctgcatgagcagctggtcaggctcctggcgctgggatacactagccgcaggcagcttaagacgctgttgcactatttattacaggcaggaaacgccgccgatccggttgcttttttgcgccatcttgcgcaaaacgttcccggcggccgcataaggagacgctaa

SEQ ID NO: 1192 - DNA, 1617 bp, Klebsiella pneumoniae
gaggatgtgatgcaaaacgatacgcaaaacattattggcgtggatgtcggttcgggcagcgtgcgcgccggggtattcaatctgcggggcgagctcctcgcccacgcgacccgggaaataaccctgtttcgcagcgccggaaacaaggtcgagcagtcgagccgtgagatctggcaggcggtgtgctactgcattaaaacggcggtggccagcgccggcgtttcgccgtcgtcgatagccgggatcggcttcgatgccacctgctcgctggtggtgattggcgataacgatgcgccgctggcggtcgggccttcggacgatgcggaccgcaacattattgtctggatggatcatcgcgccaccgggcaggcggaaaagatcaatgccacgggccacccggtactgcggtacgttggcggcaaaatctcgccggagatgcaaacgccgaaaattttgtggctgaaggagaatcgcccgcacatctatcagcaggcgcgccacttcttcgacctcgccgattacctcacctggcgctcaaccggcgatgaagcccgctcggtctgcacggtgacctgtaaatggacctacctggcgcatgaacaacgctgggatgccggttacttccgccagattggcctcgcagagctggcggatgaagattttgtccgcatcggccagcggattgtcgatccaggcaccccctgcggcgagggcctttgcgccacggcggcagaggagatgggcctgccgatcggcacgccggtggcggtggggatgattgacgcccacgcgggcggcatcggtaccgtcggcgtgcttaacggcgcggtcaacaatatggcctatgtcttcggtacttcttcctgcaccatgaccaccactcaggaagcggtattcgtcccgggcgtctggggcccttactattcggcgatggtgccgggctactggctaagtgaaggcgggcaaagcgccgccggcgcggctatcgaccagctgctgagcttccatccggcggcggcagaagcgcgcgagcaagcgaaagccgcaggcgtccctctaccagtctggctggcggatcgcgttctgacgcaagttgcttcgccttctgaagcggtaacgctggccgccggtctgcacgtcgttccggagtttctcggtaatcgcgcgccgcttgccgatccccacgcgaaagcgctgattgccgggctggggatggagcgggacctggataacctgaccgcgctgtacgttgccggcttatgcgggattggctatggtctgcgacagatcattgacgcccagcgcgcctgcggaattgagagtgaaaatatcgtcatcagcggcggagccgggcagcatccgctggtgcgtcagctgttggccgacgcctgcggcgttagcatcgtgagcaccgccagccgcgagccggtgctgttaggttccgccatcctcggcgcggtggcgggcagagtcgcggcttcgctgccggaggccatgaagcagtttactcaggtggacgccacctatcacagcgagacggcgtttagcccgcttcatcagcgcaggtatgcggcctataaggcgctacaacaggccggcaggctgattcgcgaataa

SEQ ID NO: 1193 - DNA, 384 bp, Klebsiella pneumoniae
aaaaacgtgattaagatcgcgactatcagaaggtcacgacggttttccactccactacccacgcgtcctgggtctgcgcgacgccgcccggacggtgccagtactgcaggcccggctgcagctccagccaggagaccgggcggaagcgataatagagctcaccgttcagcgaatgaccggccaccggctggtaagccggatcgttatagtcggtggcgccgcttatctgattcatatagcgctgattacgtgcgtagtggctgctcatgtcgatccacgtcaggccgaagccaatccagtcctccgggcgggcgtcaaacagaccgcggtagcgcatggaggcggcgacggcggagtggatatagttgctgcgctggtcgctga

SEQ ID NO: 1194 - DNA, 1080 bp, Klebsiella pneumoniae
ggagcggcgatgaaaatgaaacttaccgcgctgatgagcggaatgattctgtccagttcggcgctgtgcttcagcgcgacagcggctgataaaatggtcatcgcccaccgcggcgccagcgggtatctgccggaacataccctgccggcgaaagcgatggcttacgctcagggggcggattaccttgagcaagacctggtgatgaccaaagacgaccggctggtggtgttacacgaccactatctcgatcgggtgactgacgttgcgcagcgtttcccgcagcgggcgcgtaaagatggccgtttctacgccatcgactttaccctggacgagattaagtcgctgaagttcaccgaaggttttgagccgaaaaatggtaagaacgtgcaaacctatcccgggcgattcccgatgggcaaatccgatttccgtattcatacctttgaagaggagattgagtttgtccaggggctgaaccattcaaccggcaaaaacatcggtatctacccggaaatcaaagcaccgtggttccaccaccaggaaggcaaagatattgccgccagcacattgaaggtgctgaaggaatatggctataccagcaagcaggataaggtttatctgcagtgctttgacgccaacgagctcaaacgcattaaaaatgagctggagccgaagatggggatggatctcaatctggtgcagctcatcgcctataccgactggaatgaaacccagcagaaacaggccgatggtaagtgggtgaactacagctatgactggatgttcaagccaggggcgatggcgcagattgcgcagtacgcggacggcatcggcccggattaccatatgctggtagcggaaggctcgaagccgggggcggtgaagctgacggcgatggtgaaagaggcgcatgccagccatctgcaggtgcatccgtacaccgtgcgcgcggatcagttgccggagtacgcgactaacgttaatcagctctatgacgtgctgtataaccaggcgggcgtcgacggcttatttaccgatttcccggataaagcggtgcagttcctggacgcgaaacgctaa

SEQ ID NO: 1195 - DNA, 666 bp, Klebsiella pneumoniae
aaggtagccttatacatgaacactatgaacgtaattattgccgatgaccatccgatcgtactgttcggtattcgtaagtcacttgagcaaattgagtgggtgaacgtcgttggcgagtttgaagactccacggcccttatcaacaatcttccgaagctggacgcccatgtgctgatcaccgatctgtccatgcccggtgacaaatacggcgacgggatcacgctgattaaatacatcaagcgccacttcccggatctgtcgatcattgttctgaccatgaacaacaatccggcgatcctcagcgcggtgctggatctggatatcgaagggatcgtcctcaagcagggggcgccgaccgacctgccaaaagcgctggccgcgctgcagaaagggaagaaattcaccccggaaagcgtctctcgcctgctggaaaaaatcagcgccagcggctatggcgataaacgcctgtcgccgaaagagagcgaagtactgcgcctgttcgccgaaggtttcctggtaaccgagatcgccaaaaagcttaatcgcagcattaaaaccatcagcagccagaagaaatcggcgatgatgaagctgggcgtcgaaaacgacatcgccttgctgaactacctctcttccgtctcgctgagcgcgacggacaaagagtaa

SEQ ID NO: 1196 - DNA, 1068 bp, Klebsiella pneumoniae
agcataaagattatctcgccgctttgccgcatcgagcgtgcggggtacggcgtgcgtctggtccgacgcattgagcgctttcaaccagcgcccggaggcgctaccatagcgcctctttttttttcgggtaacgatatgcgtgttctactggcgccgatggaaggcgtgctcgattcgctggtgcgcgagctgctgaccgaggttaacgattacgatctctgcatcaccgaatttctgcgcgtggtggatcaactgctgccggtaaaatcattctacaggctatgcccggaactgcatcaccagagccgcacgccgtccggcacccgcgtacgcgtccagctgctgggacaatatcccgagtggctggcggaaaatgccgcccgcgcggtggcgctgggttcatggggggtggatttaaactgcggctgtccgtcgaagctggtaaacggcagcggcggcggggcaacgctgctgaaagatccggagttgatctatcgcggcgcgaaagccatgcgagaggcggttcccgagcatctgccggtgacggtgaaagttcgtcttggctgggacagcggtgaacggcgctttgaaatcgccgacgcggtgcagcaagcgggggccagcgaactggtggttcacggccgtaccaaagaagatggctacaaagccgaacgcatcaactggcaggcgatcggcgagatccgccagcgcctgactatcccggtggtcgccaacggtgaaatctgggactggcaaagcgcccaggattgtatggctgtcaccggctgcgattcggtgatgattggccgcggggcgctcaatgtgccgaacctcagccgggtgatcaaatacaatgaaccgcgcatgccgtggccgcaggtggtccagctgttgcaaaaatatacccgcctggaaaagcagggtgataccggtctgtatcatgtggcgagaattaagcagtggttaggctatttacgcaaggaatataccgaggcgctgaccctgtttaatgaaattcgcgccctgcaaacgtctgctgaaatagcggcggcgatcggccgctattaa

SEQ ID NO: 1197 - DNA, 192 bp, Klebsiella pneumoniae
gcgggggagatggcgcaaaaaagaatcgatgggaaagacggtcgaaatcacaccctggacttaacattctggcaatttgccatccagcttatacttttaattaaatcaacggataacaaagatggacaccttttaagaatcgacgtaaatggtttacacttaacgtgtctccctctctggaatggtgagtaa

SEQ ID NO: 1198 - DNA, 957 bp, Klebsiella pneumoniae
tataagcggattttccttccgtcagccgcctcgatttgtgtcaccatagtaaggaaggttattcaggttggattactaaacgggtgggttatgcatattacgctgcggcagctggaagtgttcgccgaagtccacaagagtgggtcgaccactcaggcgtcacagatgctggcgctttcgcaatccgcggtcagcgccgcgctgaccgatctggaagggcagctcggcgtgcagctgtttgaccgcgtcggtaaacgactggtggtgaatgagcatggacggctgctgtacccgcgtgcgctggcgctgctggagcgggccctggagatcgagcagctgtttcgcggcgataacggggcgatccgagtctacgccagcagcaccatcggcaactatattatgccggagattattgcccgctatcgtcatgacttcccggatctgccggtcgagctgagcgtcggcaacagcctggacgtcatcaacgccgtcgccgacctgcgggtggatttcggcctgattgaggggccgtgccatgccgccgatattattgccgagccgtggctggaggatgagctggtggtgtttgccgcgcccaactcaccgctgctggcgggggaggtgaccctgcagcaactggctgaggcgccgtggatcctgcgcgagcatggctccggcacccgggagattgtcgattacgttctgctgtcgcatctgccggcgtttcatctgggcatggagctgggtaattcagaggcgatcaagcacgcggtcaggcatggcctgggcatcagctgtctatcgcggcgggtgattgccgaacagcttgcctcgggcacgctggcggagctgaaagtgccattgccccggctgacgcgcacgctgtggcggatccatcaccggcagaagcatatttctaaagcattacaacgttttctgcactattgccaggtgtag

SEQ ID NO: 1199 - DNA, 792 bp, Klebsiella pneumoniae
ccaggcgggattgagataagcggccttcggcaagccgaaggcgctgatattgagaagcaggataccgaggatggcgacgccgcggacaaagtccagcgtgacatttctctccatgcaccctgctccgttttagtcgtggtgacgtactgcgcgcaggaattcctggcgggtattctggctggatttaaacaggccgccgagagaggtagtggtggtggcgctggtcgcgtcgcgaatgccgcgcgccttcacgcaataatgcaccgcgtcaatggataccgccacgttgttggtgccgagcagcgtctgcagcgcgatcaggatctgctgcgtcagacgctcctggacctgcggacgttgggcgaagaactgcacgatgcggttgattttcgacaggccgatcaccgaatctttcgggatataggctaccgtcgctttaccatcgatggtaacgaaatggtgttcgcaggtgctggtcagggtgatatcgcgcacggtgaccatttcatcgaccttcattttgttttcaatgacggtgattttcgggaagcgagagtaatccagcccggagaagatctcatcgacatacattttggcgatgcgatgcggggtctccatcagactgtcatcactcagatccagattcagcagttgcataatctcggtcatatgaccggtaatcaaacgcttgcgtgtttcgttatcaatttcttgtactggcgcacgcatcggcgtctccagcccacgagcgaccagcgcttcatgaacgaggacggcttctttactcagtga

SEQ ID NO: 1200 - DNA, 507 bp, Klebsiella pneumoniae
  unsure (27),(28),(29),(30),(31),(32),(33),(34),(35),(36),(37),(38),(39),(40),(41),(42),(43),(44),(45),(46),(47),(48),(50),(52),(53),(54),(55),(56),(59),(60),(61),(62),(63),(64),(65),(66),(68),(69),(70),(71),(72),(73),(74),(75),(76),(77),(78),(79),(80),(82),(83),(84),(86),(87),(88),(89),(90),(91),(92),(93),(94),(97),(98),(99),(100),(101),(103),(104),(105): Identity of nucleotide at the above locations are unknown.
gtgcggtttgttgtgtcgggtgggggnnnnnnnnnnnnnnnnnnnnnntncnnnnnttnnnnnnnntnnnnnnnnnnnnntnnncnnnnnnnnnccnnnnncnnnccccctcccccccccccctctcctctccccctcccccttcctcctcctctcctctctccttccctccctccctctcttttttccttttcctcttccccctccctttccccccccttcctcccctcccctcctctctcctcctcccctcctcccccttcctctcccctcttcccctctccctctccctcccccttctccccttcttccctccccttcttttcccccccccctccctctctcttctccttcccctcttctccccctcttcttctttcccctcctctttctccctctcctcccctcctccttcttcttctctctccttcctttcttccctcttcttccctctcctcttcccctctttcttcctctcctccctcctccttctcctctctctcctct

SEQ ID NO: 1201 - DNA, 258 bp, Klebsiella pneumoniae
gcgcgtcctgttaggttgatcagcctgagcagattgccggacggcatcttcggcttatccggccgactttttataccgttaggtgtcgggtggcgctacgcttacccgacctacggttcgcgccatggcgacctgaagatccctatgccgggtgtcggctcacgccttacccggcctgcattcggcgatctgtctatattgctgaaaatccccgcaatcaaacgcgggtttcttgcgcttacccggcgggtaaagtag

SEQ ID NO: 1202 - DNA, 1284 bp, Klebsiella pneumoniae
gccagcactgtttgcagccaggtgagaaacatgtatggtagtcgtcatgagtgtcgccattattggtataacaacttttgtgaggacatagcgatggagcaaacctggcggtggtatgggccgaacgatccggtatcgcttgatgatgtacggcaggcgggggcgaccggcgtcgtcactgcgctgcaccatattgcaaacggtcaggtatggccggtcgacgagattaaagcgcgtcaggcgctgttagcggcaaaagggttgacctggtcggtcgtcgaaagcattcccgtccacgaggatattaaaacccacagcgggcagtatgcgacctggattgccaactatcagcagagcatccgcaacctcgcggcctgcggcatcgataccgtgtgctacaactttatgccgatcctcgactggacgcgcaccgatctggaatatgagctgccggacggctcccgggcgctgcgtttcgatcagatcgctttcgccgcctttgagctgcatatccttaaacgcccgggagcggaagcggattacagtgaagaagagcagcgtcaggctgaggtctatttcaaggcgatgagcgaagcagatatcgataaactgactcgcaatatcatcgccggcctgccgggagcggaagagggctacacccttgaccagttccgcgcgcgtctggcggagtacgaccacattgataaagcgcagctgcgtgaaaatatggcctatttcctgcgcgccatcgtgccggtatgcgaagaggtagggatccgcctggctgtgcatccggacgatccgccgcggccgatccttggcctgccgcgtatcgtgtcgaccatcgaagatatgcagtggctgaaggagacggtggacagcattaataatggcttcaccatgtgtaccggatcgtatggcgttcgcgccgataacgatctggtgaagatggtggagacctttggcgatcgcatccattttacccatctgcgctctacctgccgtgaagcaaacccaaaaaccttccacgaggcggcgcaccttagcggcgacgtcaatatggtggcggtggtggatgctatcctgcgtgaagagcagcggcgtaaacaggccggcgatctgcgcccgatcccatttcgtccggatcatggtcatcagatgctcgacgatctgcgcaagaaaaccaacccaggctattcggcgattggccgtctcaaggggatggcggaagtgcgcggcgtcgagctggcgctgaaaatgaccaaataccctgaactgctgtaa

SEQ ID NO: 1203 - DNA, 789 bp, Klebsiella pneumoniae
tggcaaactgtggctggccgagcatggcccggacggctgcacctttattctcaccctccccacggttgcttaagaggagaacgacgtatggctttacggctggcgataattgaagataacgccgatctgctggatgaactgctggcctggctgggctatcgcggcttcgaggtgtgggggacgcgcagcgccgaagccttctggcggcaactgcacagccatccggtggatatcgtgctggttgatatcggcctgcccggcgaggatggcttcagcgtactgaactatctgcatgagctggggcactacggtctggtggtggtcagcgcccgcggccagcagcaggataaactgcaggcgctgagccttggagccgatgcctatctgatcaaaccggtaaacttcgcccatcttgccgagaccctcaccgccctcggcgcgcgcctgcgccaggaccgtccggcggctccgcctgcggaggcgatcggcacgccgccggccgtctcccccggcagctggcgtctgcaagaggataaactgatttcacccgacgcccggacgctggagttaacccagcaggaatatcgcctggtggagctcctgatgcgcaatcgcaacgaagtgtgcagcaaactggatctccatgcctgcctgttttcccatgaaagcgagcctgacctgcaccggatcgacgtggtggttagccgcctgcgtcacaaggcacgccagcaggggatccacctgcccgttcgcgcaatctttggtaagggactggcctttatttcctga

SEQ ID NO: 1204 - DNA, 711 bp, Klebsiella pneumoniae
cgccgggctgtaccgggccaacccccaggccagcgggctggggatgaatctggtggacaggcggctgcgggcgcgttttggcgccgactgcggcatcagcgtcacctgcgagccggagcgctttacccgtgtcaccctacgtctgcccctggaggagaatgcatgctgagagtattgatcatcgatgatgagccgctggcgcgggaaaacctgcgcattttgctggagacacagcgcgatatcgagatcgtcggcgagtgcggcaacgcggtggaggccattggcgcggtgcataagctgcgtcccgacgtgctgtttctcgacatccagatgccgcgcatcagcggtctggagatggtcgggatgctcgacccggagcaccgcccctatatcgtgtttctcaccgcctttgatgaatacgcggtgaaagcctttgaggagcatgcctttgactatctgctgaagccgattgaagctgcccggctggagaaaaccctcgcccgcctgcgccaggagcgtaatctgcaggatgtgtcgctgctggatgatgctcagcagacgctgaaatacattccctgtaccggccacagtcgtatctggctgctgccagatggaggatgtggccttcgtcagcagccggatgagcggcatctacgtgaccgaccgcgagggaaaagagggctttaccgaactgaccctgcgcacccttga

SEQ ID NO: 1205 - DNA, 324 bp, Klebsiella pneumoniae
aatatctatgttttttgttgctttattttttatctttctcatttcgggtccgtcaccgacaacaacaagttttcttcctggcatacaactaaatgcctcaacaatcaaatcaatacgtttatacggaaccaaacgagatgccgtaaaataatattcttccttctcttcttgaaatgtgaagttgtcgacatcaacaggaggatatataacatccgcattcctgccatagactttttttatacgacgcgcaataaaattagaattagcaatgaaatggtctacaccatttgcagtccgggaatcccacatccttattttatgtaa

SEQ ID NO: 1206 - DNA, 1173 bp, Klebsiella pneumoniae
gcgcgtcgcgtcgtagcggtttacccctgttccggacaaggttttttacattcccggcatgctccgggcgaaaaagcagttacaattggccttttcgttttgccggagagggttgtgcgcgctgataaatcactcaagccatttgagatccgcttgtatcgccattatcgggtggtgcatggtgtgcggattgcgctggcctttgtgctcacctttttgctggtgcggctgctgaacgtgcctgagggaacctggcctctcatcactctggtggtggtgatggggccgatctccttctggggtaacgtcgtgccgcgggcgtttcagcgtatcggcggcacgatcctcggttcggcgctggggctggtggcgctgaagcttgagctcatctctctgccgctgatggtcctctggtgcgcggcggcgatgttcctctgcggctggctggcgctgggcaagaaaccctatcaggcgctgctgatcggcattactctgtcggtggtggtcggggcgccgcccggcgatatgcataccgcgctgtggcgaagcggcgatgtgatcttcggctcgctgctggcgatgctgtttaccggcatctggccgcagcgggcgttcatccactggcgcatccagatggccagctatgtcaccaactttaaccgcctctaccaggccggcttctcgccaaatctggtggatcgaccgcggctggaaaagcatctccagcaggcgctgaacgacgtggttaaaatgcgcgggctgatcacccccgccagcaaagagacgcacatccagaaggcgatcttcgaggctatccagaccgtcagccgcaacctcgtctgcatgctggagctgcagatcaacgcctggtgggcaacgcgtccgggtcacttcgtgatgctcaatgcgcacaccctgcgggagacgcagcagatgacccagcagacgctgttgtccatcgcccacgcgctgtacgaagggaaccctcagcctgtgcgcgccaacaatgaaaagctgactgagatcatcctcgaactgcgccagctgctgaaagagcagggtgatgacggcctggcggaaaccccggtccatggctatgtttggctctcaatcgaactggcgcgccagctggagctgctctcgcatctgatctgccgcgcgttgcgcaaataa

SEQ ID NO: 1207 - DNA, 186 bp, Klebsiella pneumoniae
ggatttggcgttgcgcctgaggcatggcttcgctccctaataaaaggcagcgccaatttcaataattatcgttacggctactggattctgtgcgccacctcacgcacaatgaatacaaactttgcccccagaaaaagcaaagagcgccacacctgcaggagaaacataaatgtcatcactgagtaa

SEQ ID NO: 1208 - DNA, 873 bp, Klebsiella pneumoniae
cgcagcggcgtcagggcgatatctcaacacctctcacctctccgacgatcgattcgccagaagacaaactcaggtgctgaccgggcgcgacagaactcttccgctgctttcgccgacaggagtcaacctcacgtgattaagtcattctttgctgcactctcgtttatcagccgcctgccggtcccggcgcggttatctcagggcctggagatcgaacagtaccagcgcagtatcgtcacctttccgctggtcggtttactgcttggcgccatcgccggcgcggtggcgctcctcctgcagccgtggtgcggcgtcccgctggcggcgctgttcggcgtgctggcgctggcgctgctcaccggcggattccatcttgacgggctggctgatacctgcgacggcattttctccgcccgcacccgcgatcggatgctggagatcatgcgcgacagccggctgggcacccacggcgggctggcgctgatcttcgtgctggtggcgaaagtgctggtggttggcgagctgctgctgcgtgatatccaccccatcgcagccctggcggcggcctgcgccgtcggtcgcgggatggcggtgctgctgatgtatcgtcatcgctatgcgcgggaaaaggggctaggcaatctgtttatcggcaaaattagcctgcagcagacgctggtgacgatggcgatggcgatcgcgctggccaccgccctgctggggctgcaggggctgcgcgccgcgctgatcaccctggtgctgatctggggtctgggatgggcgctgaagcgaaccctcggcgggcagaccggagataccctcggggcggcgattgagctgggcgaattactctttttactggcgctgctgtaa

SEQ ID NO: 1209 - DNA, 1407 bp, Klebsiella pneumoniae
tcaattacagtggcgccatcaactcaaggagagcagaacatgaacaatcaattcacatggcttcatatcggtctgggttcttttcatcgcgcgcatcaggcgtggtatctgcatcgtctgattgcttccggggataatcgctggcgcatcgcggcggggaatattcgcaacgacgccgagcaggtggtccaggcgctggcggcgcagggaggacgttacgtcctcgagaccgtcagcccggaaggggagcgcgaatatgaagagatcacctcaatccagaaactgctgccgtggcaggccgggctacagccgctgattaacgaaggggcaaacccgcagaccaaagttatcgcctttaccgtgacggaaggggggtactacctgaatactcgccatcggctggaaaccagcaaccccgatctgcaggccgacctgcaaggcgagtgcaaaaccatttacggcaccctcgcgcggatcctggaaaagcgcatggccgacaacgccgggccgctgaccctgctcaactgcgataacgtgcgtcataacggcgagcgtttccacgacggtatggtcgagttcctgcagctcaccggcaaacaggcggtgattgactggatggcggccaataccacctgtccgaacaccatggtggaccgcatcaccccgcgtccggcggccgatctgccggcccgcatcaaagcgcaaaccggaattgatgacaaagcgccggtgatgggggagacctttatccagtgggtagtggagaacaacttccgcgatgcccgcccgaatctggaggcggtcggcgtggagatggtggagtcggtcatcccgtatgaagaggcgaaaatccgtattttgaactcgtcgcacagctgcattgcctgggcgggaaccttaatcggccagcagtatattcatgaaagcacgctgaccgatgttatctacgccattgccgaccgctacgtcacggaggacgttattccgtgtctcggcgataacggtattgatctgccgacctaccgggatgtggtgcttaagcgctttaccaacccctatatccaggacaccaaccagcgcgtcgccgccgacggtttctcgaaaattccggcgatgatcgcgccaaccttgcaggagtgctaccagcgcggcgtccgcccggaagcgaccgccatgctgccggcgctgttcttcgtctttatggagcagtggcacaagggaactctgccatatcagtaccaggacggcatcctggatgcgcaggcggtgcatgagatgttcgaggctcaggatccggtggctgtctacgcgcgcgataaagccctgtttggtgatctcgccaacaacgcggatttcctggcgctgatgcgcgagaaagtcgccgccgtttacacgctgattaactaa

SEQ ID NO: 1210 - DNA, 1644 bp, Klebsiella pneumoniae
tttttattggtgaagcggttcgcgacgcctttgacccgagtaaggcggtgtaatatgacccacccgctattagctatcgacaatctctctattgcctttcgccagcagggtgagacgcagaccgtggtgcacaatctgtcgctcgaggtggcggtcggcgaaacgctggccctggtgggcgaatccggctccggtaagagcatctccgccctgtcggtgctacggttgctccctaccccgccggccagctaccccagcggtgacatccgttttcatggccagtcgctgctgcatgcggatgaggcgaccctgcgcggcgtgcgcggcaaccggatcgcgatgatctttcaggagccgatggtatcgctcaatcccctgcacaccctggaaaaacagctctacgaggtgctgtcgttacaccggggaatgcgcaaacaggcggcgcgcggggagatcctcgactgcctggagcgcgtcgggatccgtcaggcgccgcggcggctggcggactatccgcatcagctctccggcggtgagcgccagcgggtgatgatcgccatggcgctgctaactcgcccggagctgctgatcgccgacgagccgactaccgccctggacgtatcggtgcaggcgcaaattctgcaactgctgcgcgagctgaagcaggagctgaacatggggctgctgtttatcactcataacctgagcatcgtccgccagctggctgaccgggtggcggtaatgcaggacggccgctgcgtggaacacaatgactgtcgggcgctgttcagcgcgccagcgcatccctacacccaacgcctgctggatagcgagccggacggggagcctgtgccgctggccgccgatgccccggtgctgctgcaggcggacgatttaaaggtggcgtttcccgttcgcaaagggatcctgcgtcgggtggtcgatcatcatcgggtggtcaacagccttagctttcagctgcgcgccggcgagacgctgggcctggtgggggaatcgggttccggtaaaagcaccaccggcctggccctgctgcgcctgatcccgtccgggggcaagataaccttcgccggccagccgattcagggccgtaaccgccgacagctgctaccgctgcgccgacagatgcaggtggtttttcaggatccgaactcgtcgctcaatccgcgcctcacggcgcagcagatcattgaggaaggcttgcgcgtccaccagccgacgctgacggcggccgaacgcgaacaggcggtgatccttgccatgcaggaggtcggcctcgacccggccagccgccagcgctatccggcggcgttctccggtggccagcgacagcgtatcgccatcgccagagcgttgatcgtcaaaccgcagctgatcgttctcgatgaaccgacctcatcgctggacaaaaccgttcaggcgcagatcctgaagctgctgaaagccttacagcgaaagcatcagctggcctatatttttatcagccatgatttaggcgtggtgcgggcgctgtgtcaccaggtgatggtgctgcgtcagggagaggtggtcgaacagggcgagtgcaagtccgtcttcagcgcaccccggcatgagtatacccgccagctgctggcgctaagctga

SEQ ID NO: 1211 - DNA, 429 bp, Klebsiella pneumoniae
gccgctgtggtggcttatcgcgctgtttatcggcctgctggcagggctgccctacagcgcgccgctgttcagtcggctgttcccggagctgccgcggccggtctaccagcaggagagcttctgggcgctcactctcgatcacggctggctggtggtggcgtccagcctcgcggcaacggcaatcgggctgggggctggggtggcggtcacccggcccgccggcggcgcgtttcgtccgctggtggagaccatcgccgctatcgggcagacctttccgccggtggcggtgctggcgatggcggtgccggtgctgggctttggctggctgccggcgctgatagccctcgcgttgtatggcatactgccggtgctgcaggggacgctggccgggctgggttcgataccgccgggggtgtcaggtgtggctga

SEQ ID NO: 1212 - DNA, 1140 bp, Klebsiella pneumoniae
gctaagtcggtaccaggcttaacctgcccaaaaaaattgggttgggataatgcatgccggcttcggccggccttacgggagattgctatgactgatattacgcagttgctgggcaaagatgccgagagcctgttgcagcaccgttgtataaccattccgtccgaccagctgtatctgcctggcgcagattatgttgatcgggtgatggtggataacaaccgaccaccggcggtgctacgcaatatgcagaccctgtacaataccggacgcctggggggaaccggctacctttccattctgccggttgaccagggcgtggagcactcggcgggcgcctcctttgccgccaacccgctgtactttgatccgaaaaatatcgtcgagctggcgatcgaagccggctgtaactgcgtggcgtcgacctacggcgtgctggcctcggtgtcgcgccgctacgcgcatcgcatccctttcctggtgaagctcaaccataacgaaacgctgagctaccccaccgaatacgaccagaccctctacgccagcgttgagcaggcgtttaatatgggggcggtggccgtgggagcgacgatctatttcggctcagaacaatcgcgtcgtcagatagaagagatttccgccgcctttgagcgggcccatgagctgggcctggtcaccgtgctgtgggcctatctgcgcaattcggcgttcaagaaagacggcgtcgactatcatgtttccgctgacctgaccggtcaggccaaccacctggcggccaccatcggcgccgatatcgttaagcaaaagatggcggagaataacggcggctacaaagcggttaacttcggctataccgacgatcgggtatacagcaaactgaccagcgataaccccatcgatctggtgcgctaccagctggccaactgctatatgggccgcgccgggctgatcaactccggcggcgcggcgggcggggagaccgaccttgccgacgcggtgcgcacggcggtgatcaataaacgcgccggcggcatggggctgatcctgggccgcaaagcgtttaagaaatcgatggccgacggcgtgaagctgatcaatgccgtgcaggatgtttatctggatggcaaagtgactatcgcataa

SEQ ID NO: 1213 - DNA, 801 bp, Klebsiella pneumoniae
agcaatacggtttattcatggcgcgctgctgatatactcgcaggtctgaacagaaaaggagtaaaagcgcccatgaatgccgaaaaaacgtcggtagcccctaacgtcgatcatgctgaaatcgccaaattcgaagccgtcgcctcgcgctggtgggatctggagggcgagttcaaaccgctccaccgcatcaacccgctgcggctgggctatattgccgaacgctccggcggcctgttcggtaaaaaagtcctcgatgtcggctgcggcggcggcatcctcgccgagagcatggcgcgcgaaggcgcgacggtcaccgggctggacatgggggccgaaccgctgcaggtcgccaggctgcacgccctggagagcggtattcaggtagactatgttcaggaaacagttgaggaacatgccgcgaagcacccgcagcagtatgacgtcgtgacctgcatggagatgctggagcacgtccccgacccgcagtcggtggtgcacgcctgcgcgcggttagtgaagcccggcggccaggtcttcttctccaccatcaaccgcaacggcaaggcctggctgatggcggtagtcggggcggaatatgtcatgaagatggtgcccaaaggcactcatgatgtgaagaagtttatcaagccagccgagctgctgggctgggtagatcagactactctgaaagagcagcatatcatcggtctgcattacaatccgctgaccaataccttcaagttagcgccgggggttgatgttaactatatgttgcataccaccgccaaacaggactga

SEQ ID NO: 1214 - DNA, 189 bp, Klebsiella pneumoniae
cggcgcacggtgatggaagatgacgacgtctcgctgcacagcgcggtgaaagataactacgccaaagcgtggaagtgtgcggaaacggtggcgacgcatctgcaaaagcagtatcagcggtcgctgaccaccgaagaaattatgtttcttgccattcatatcgaacgggtaagaaaagaggggcgttaa

SEQ ID NO: 1215 - DNA, 1278 bp, Klebsiella pneumoniae
  unsure (1245),(1252): Identity of nucleotide at the above locations are unknown.
gttggcgcggtcgaagccatcgccgcgggagaccggcggctggtaaacctggctgaagagctccgggggcagttcgtttttcatcggcgtcagcagggccagctcggctgcgtcaggcaggctgcgggcggcatattcggtgttctggaaatagctgttggcgcgctgataggcgctgtaaaacagcgccttgttcatccattcgaaatcgaacgccagggtaatggcctgccgcacccggcgatcggcaaaaatcgggcgctgaatattgaacgccagccactgggtatcctgcgccgaggtattggtatgctcatctttaatgatgtagccgcggctgaagttgcgaccgacgtagcgggtagcccagtttttggcgacggtctcttcccggcgatcgacggctcccgctttaaaggcttcgaaagcgacattgtcgtcgagataatagtcatagcgcagcgtatcgaaattccagcgaccgcggttgaccggcaggtcggccgcccagtagtctgcgacccgggaataggtaatatattgccccattcgccaggcgctgatgcggtatggcccgctggccagcggcggcttcgacagcgggtcgctgagtttgtgctggcgccagaacgcctcgggcatcaccggcaggctcagcagactcagcatgttctctttgccgggctggccgaggtcaatacgcacggtcaacggcgcgatggccttcacggtggtgcctttataaaacaggcgaaactgcggcaccccttcggtcataaacttgttgaaggtaaacgccacatcgcgggcggtgatcggcgtgccgtcatggaagcgggcgcgcgggttgagcgcgatctccatccaggaatagtcctcggcatagcgcgcccgctcggcaatcagcgggtagtagctgccgggctcatcatccgaggtggtgaacaggggatcgtagagcgcctccgtgcgtaccgcggggttgccgcgcagcgcataacggttgaagttatcaaaggtgccgatcgccgccagggtgagggtgccgcctttcggcgccctgggattgacgtaatcaaaatgactgaaaccggcggcgtatttcggttcgccgataatcgcgaaggctacgctttcttgaatggttgccgccttagcgtcctggctaaacagagccagcagattcagaaggaggcgcgcatacataggcggcagaataccgtgtcatggccggcccccatggcngacatcngttcccgcatcataagtgagacttag

SEQ ID NO: 1216 - DNA, 978 bp, Klebsiella pneumoniae
gcaataaaggttcccttgatgatgtctacgtttcctgccagcttactgatccttaacggcaaaggtgccaatgaaccgcagctacgcgaagcggttaacctgttacgcgatgaagggattgatattcacgtccgcgtgacctgggaaaagggcgatgccgctcggtttatcgatgaagccctgcagctgaacgttgaaacggtgatcgccggcggtggcgatggcaccattaatgaagtggcgaccgcgctggtggagcgcggcggcaagatggcgctagggattttaccgctgggcacggctaacgacttcgccaccagcgtcggtatcccgcaggatctggccagcgccctcaagctggcgatcgtcggccgcgatgtgccgatagatatcgcccgggtgaatgataaaaccggctttattaatatggcgaccggcgggttcggcacccggatcaccaccgaaacgccggaaaaactcaaggccgcgctcggcggtgtctcttatttaatccacggtctgatgcgcatggataccctgaagccggaccgctgcgagatccgcggggagaactttcactggcagggcgatgcgctggtcatcggcatcggcaacggccgccaggccggcggcggccagcagctgtgcccggaggcgttgattaacgatggtctgctgcatctgcgcattttcaccggcgaagagctgatccctgccctgttcagcaccctggcgaatccggaaaactcgccgaatattgttgacggtgtctcctcgtggtttgaaataaccgcgccccatgagatgacctttaacctcgacggcgagccgctcagcggcaaaaccttccgtatggagctgttaccggcggccctgcgctgccggcttgccgcccgactgcccgctgctacgctgatcaggcttcgcaaagcaaagacggcgcccggctggtatacagcagccgggttcgttgattga

SEQ ID NO: 1217 - DNA, 1944 bp, Klebsiella pneumoniae
ttgaaaagggtgtctgcgatcttcgcggcggtccggcgttgccggccgcggctcctggcaggctggctgctcagctgtggattactcttgctgctggtcgccccgcaggcgcaggcggcgacgcgccaggtggggattgatattccggtccagtggtacgccgacgacagcggccagatgaccctcgatcgctttgccgccctgcccacagaccagctcgccaccacccggcagatcccctcctttggttattcgcgaaaaacctggtggctgcgcagcgagctgccgggcacgtggtttgccggggagccgcgttggctgcagctgggccccactttcgtcgaccatctgaccatttactaccggccactgggcagcgatggcccgtggacgcagcgcatatttggcgatcgcgacggcgcccgcggaagcgatctgcattatcgggaaagggtgctgatactgcccccgccgccaaccgccgccggctatgagctggtctttcgcctgcagagcaccagcaccctgatcctgctggcctcgctctcctctgcgcaggcgtttgtgcagcgggccaccgctgacaccgctttctggagcttctacttcggcctggccgctgtcgccagcggtgtggcgctttggctggcgctggccctgcgccggcgtctgctatggggcatctgtcttttctcgctcaattatccgctggtggccgccctgcacggcttcccggagtggttcttcggccacgccgcgctgcccttccaggattttatgatcagtagcctctcgctgttcagctatgccaccgccctctggctgcacagcgagatttttgatctgaagaagaatatgccgcgacttcatcagctgctgatcgccgccgtgatactcaacctggcgctgcaggtcagtattccgctcgggttttacggcttcgcgatgcagattgaaggggtagtattcatcattatcaccccggtactgctgttcacctcctggtggctgtggcgcaaaaaagctatcgaccgtaccaccctgctgctgggtctgctgccgccgttctatgtcgtcgccgcggtgctggtgcagttgtcgatccatgggattatcccgttccatatggcgatctattccctctggcagtacgcgctgatcgtccacatcattacggtgctgatcattgccatcctgcgggtgcgtgctgaaaaccgccagctggagcagaagcagcgcctggcgcgcgaactgcagattgagcgtgaagccagcttccaccagcggcagtttatgggcatggtggcgcacgaattccgcaccccgctggcggtgatccaggcggcgctggagaatcttcgcctctcggcgccctcgaccagccaggaggcgcgcttcgatcgcatcggccgcgccgccacccgcctggtgcagctcaccgataactgccttgccgacgcccggctcgcctcccacgatctgcacgtcgagcgccagcagaccgccctgctgacggtgatcaacatggccgcctcggtggtggccatctcccatgatcactacctgaacatccgccagcacggcgcggtggaaagcccgcagctgcaggccgatgccggcctgctgtgcatcgccatcgctaatctgctggataacgccgtcaagtattcgccccccggtgaaatcgccatcgatattcattccgatgccgggcaaacggagctacgcattcgcgaccacggcacgggactccccgccggacaggcggaactgatctttgagcgctaccgccgcggcgagcacacatcgccggtgccaggcggcaccggtctcggactgtatgttgcgcgtcagatagtgcaggctcatgatggcaaactgtggctggccgagcatggcccggacggctgcacctttattctcaccctccccacggttgcttaa

SEQ ID NO: 1218 - DNA, 1122 bp, Klebsiella pneumoniae
actaaatctttttggattcatatgaaaaaactaatcatagttaatgaagtttgttccgataatattggtgatcatgctataaatttaggggtgttgaagatattagatgaatataattttaagggcataagttatggattcgatgctgagaaaaaaaatgtagggcctacaataaaaaaatcaaagaaagaatctagtttcattcgatttttaaagtttataaaaaataaaacattgaaaaataatagattttataaatattccctgtggattttaaggaattattctagggtatccagtataactaaacaaaataaagggcaagcgataataatagggggaggccagttgatccagtctggaggaacttttgctattgccatgtacacatggacacttttttctaagctacgtaatgtagatatatatatcattggtgttgggtgcgctgagcattttgatagaatagatcggttcttgttcaagcgctcgttatcaagagcgaaggatatattagtccgtgaaaagagttctataagtaaaataaaagatttctttgattgtgatgtaagatatattcctgatcttgcatatgcattatttaaacaagatgattataaccacaaaaaagacaatttagctattataggttgcactgcttattatgtttatatgaaaaacataaacgaattgggtctgaaagatattatgacctttgagcaatatataaatgcttggatttcaattattttagacgaatgtaatgagcacagagtattacttctatctactaccgttgaagacgctgagtttagtcgtatcgtgtataaccaaataagtaagaactatattcatttattggatcgtataataattaaagatgaagtgttgcctgtccgtgaatatattgaattactgaaaactgcaaaaatagtacgttctgggcgcatgcattcactaattcttggtcatattagtggatgcaaatgtattccatataatataaataaaaaaatagaacatttttcgcatgagtatttggaccatgatgcatcaaatataagcaagagtgtttacaactcatttggtaatgcattttccggtgataaagggagtaagtaa

SEQ ID NO: 1219 - DNA, 990 bp, Klebsiella pneumoniae
ttgaatacattgtttttactggtgaacaatcacatgagcgagagtcgtccggagagttactggctccatctgtactggctgacggtgctggaagaacaaaaaagctatacccgggccgcggaaaaactggggatcagcaagtcggctatcagccagaaaatcagcgagctggagcgggtgaccggtaaaaccctcgtccatcgcaccacccgcagcgtgagcctcagcgacgacggactgcggctggtggcggagctcaacgagccgtttggtcagctgcgggatattttcaccggcgcttgcgatgagggcgggccgctgcggggaacgctgcgcctgaccgcgccggtggccttttcccgccagcagctggtcccggcaatcgcgccgtttttgcatcagcatcccctgctgcatctgcagcttgaggtcaccgaccggctggtctctctggccagcgaagggttcgatctcgccatccgccactgtcgacgcgaggcgctcccggatacccacgtcgcctggccgctgtgtcacaccgcgacgcttaccgtcgcgtccgccgactatattcgccgccatggccgcccggagacccccgaagatctgcgccaccaccaatgcctgacctatccccgtgggccacagcgcccgcagtggacgttcgcctcccgtcagtcgcccgatgctcgggtgaccatcaacgtgcaggggccattcgccaccaataacagcgagtcgctacgtgatgcggtgctggcggggcttggggtggcgctgttgccggatttcagcgcccgggaggccattggccgcgggctggtgcaggagctgctgccggcgtggcagccggtggaggtgtttgccgaccggctgtacgtcattcggccctatactccgcgcgtgtcgcgcgcggtggaaaccttcagccgctacctgaaagcgaccttcagcgagccgcgtccagctcctgcgccagcgtctcgctaa

SEQ ID NO: 1220 - DNA, 204 bp, Klebsiella pneumoniae
atttgggcattggcacaacaagacgtgactgttttcacaaaagatgagcgaaatgtgaggcagatcgaccaggagaaaaaagggcgtgagcgcagagaagagattaaccgaccagctacatcccgggaatgtctgcgcccacaaatggctgacttaaaccgccgccgctggctccgcgctaagcgcttccagcagttcaggtaa

SEQ ID NO: 1221 - DNA, 945 bp, Klebsiella pneumoniae
catgtacaattttgcaaaaccgcgtgttttgcaaccaaacaggtgaagatgaatatggcgaatttgaaagcggttattccggtcgcaggactaggcatgcatatgctgccggccacaaaggcaattccaaaggagatgctgccgatcgttgataagccaatgattcagtacatcgttgacgaaatcgtcgccgccgggatcaaagagattgttctggtgacgcactcctcgaagaacgcggtggaaaaccacttcgacacctcctacgagctggaagccctgctggaacagcgcgtgaagcgccagctgctggcggaagtgcaggccatttgcccgccgggcgtgaccatcatgaacgtgcgtcaggcgcagccgctgggcctgggccactccatcctctgcgcccgcccggtagtcggcgacaacccgtttgtggtggtcctgccggatatcatacttgacggcggcaccgctgacccgctgcgctataacctcgccgctatgatcgcccgctttaacgagaccggccgcagccaggtgctggcgaaacgtatgccgggcgatctctccgaatactccgtcatccagaccaaagagccgatggtggctgaaggccaggtggcgcgtatcgtcgagtttattgaaaaaccggacgaaccgcagaccctggactccgatctgatggcggtggggcgctacgtgctgtcggcggatatctgggccgaactggaacgtaccgagccgggcgcatggggccgtatccaactgaccgacgccattgccgaactggcgaagaagcagtccgtcgacgcgatgctgatgaccggcgaaagctacgactgcgggaagaaaatgggctacatgcaggccttcgtcacctacgggatgcgtaacctgaaagaaggcgccaaattccgcgaaagtattaaaaaactgctggcctga

SEQ ID NO: 1222 - DNA, 1164 bp, Klebsiella pneumoniae
aatcccttttcggtcagggggataccccttttgcgaattgaaggtcataacccagtgaataataaaatctctttagcgaaagaagtggcatgggccagccagaatatgccgcgtaccctgcgtcaggtcgccgcgctgcccgacctcagcggcgtgcgtctggcctgctgtatgcacctcgacatgaaaatgatcccgctggtgcaggggatcctcgacaagggcgctcaggtctttttaaccacctgtaaccccaccaccgtgcaggacgacgtggtggcctggctggtggagcgcggcgccgaggcctgcgcgtggcgcaatatgagcgatgccgactggcaacagtcatgggaaaaagcgattgcctggcagcccactcacctgtgcgagatgggcgccgatatcaccaccctgctccaccagcgcggcgagtttgggaacatcgtggcgggtctggaagccaccggctcgggcgtcaatcggctgggggatattcagccaggctatccgatctttaactgggacgatctgccggtcaaagaggggctgcacaaccgccatatggtcggtctcaccgcctggcacaccttcttccagaccactcacctcaccctgcatgagaaaaaagtgctggtgatcggctacggcctggtcggccagggcgtcgcggcggcggcaaaagcttttggcggtcaggtgatggtggcggagatcgatcctgcccgccgtctgcaggcggcctacgacggctggcacgtggtggacctccaggaggctatcgcctcggcggacgtggtggccacggcgacaggcggtaaaaacgtagttaatcgccaggcgctggaccgcgcgaaagcgggagtatttatccttaacgtcggccacgtggcggaagagatcgacggcgattacctgcgccagtacccccaggaagaggtgatgccgtatatcaatgcctaccgcatggccgacaaaaccgtctatctgctggccaatggttcaatgctcaatctgaccgctggcttcggcgacagcctgaacgcctttgacgtcaccctggcggtgatggccagcggcatccgccatattgtcaccgacggcatgcgcgccccggcgaaggtttatctcctgccccaggcggtctggcagcaggccctgtaa

SEQ ID NO: 1223 - DNA, 270 bp, Klebsiella pneumoniae
ttattgaaattggcgctgccttttattagggagcgaagccatgcctcaggcgcaacgccaaatccttatcgccgtatccggaatgttccaaccgctgtacgcattcataagcgccgtcgctacaccggcatgttggctataagttgcattaatgatgcagtaagttctcaaaaggagaaagtgaaagttgctcaccggctaatgaaatatctgtattatgaacgtttacgcgcacatcccttccgaggagccttgcatggaactgcttga

SEQ ID NO: 1224 - DNA, 1770 bp, Klebsiella pneumoniae
ccccgtgaattcatgacttttacattacgtccttaccaacaagaagccgtcgatgccaccctcgcctggttccgtcgccataccgagccggcggcgattgtcctgcccaccggcgcgggcaaaagtctggtgatcgccgagcttgccaggctggcgcgcggccgcgtgctggtgctggcccatgtcaaagagctggtggcgcagaaccatgccaaatactgcgcccttggcctcgaggcggatatcttcgccgccggtctgcagcgaaaagagagccacggcaaagtggtgttcggcagcgtgcagtcggtggcgcgcaatctcgaccagtttcgcagcgaattttcgctactcatcgtcgatgaatgccaccgcatcagcgatgatgacgacagccagtatcagcagatcatcggtcacctgcggcaggtcaatccgcagatccggctgctcggcctgacggccacgccgttccgccttggcaagggctggatctatcagttccattatcatgggatggtgcgcggcgatgaaaaggccctgttccgcgactgcatctatgagctaccgctgcgctatatgattaaacacggctatctgacgccgccggagcgcctcgatatgccggtggtgcagtacgatttcagtcgcctgcaggcgcaaagcaacggcctgttcagcgaagccgatcttaaccatgagctgaaaaaacaacagcgtatcacgccgcatatcgtcagccagatcgtggagttcgccgaaaaccgcaaaggggtgatgatctttgccgccaccgtggaacacgcccgggaagtgaccggcctgctgccggtaggccaggcggcgctgatcaccggcgaaacgcctgggccggagcgggatcgcatcatcgaggcctttaaagcgcaggcgtatcgctatctggtgaacgtcgcggtgctgaccaccggcttcgacgccccgcacgtcgacctgatcgccatcctccgccccaccgagtcggtgagtctttaccaacagatcgttggccgcggtctgcgcctggcgccggggaaaaccgactgtctgatcctcgactacgccggcaatccgcatgacctgtatgccccggaagtggggacgccgaagggcaaaagcgacaacgtgccggtgcaggtcttctgcccggcctgcggcttcgccaataccttctggggcaaaaccaccgccgacggcaccttgattgaacactttggccgccgctgccaggggtggttcgaagatgacgacggccaccgcgaacagtgcgacttccgctttcgctttaaaaactgcccgcagtgtaatgcggaaaacgacatcgccgcccgccgctgccgggagtgcgacactatactggttgacccggacgatatgctgaaggcggcgctgaaactgaaggacgcgctggtgctgcgctgcagcggcatggccctgcagcacggcggcgacgagaagggcccgtggctgaaaatcacctactacgatgaagacggggcggatgtcagtgagcgcttccgtctgcagacccccgcccagcgcaccgccttcgaacaactgtttattcgcccgcatacccgcacccccggggtgccgctgcgctggataacgccggcggatatcgtgacccagcaggcgctgctgcgccatccggactttgtcgtcgcccgcatgaaggggcagtactggcaggtgcgggaaaaagtgttcgattatcaggggcgttttcgtcgcgccaacgagctgcgttaa

SEQ ID NO: 1225 - DNA, 813 bp, Klebsiella pneumoniae
ttccagtattcaggattggagtccagtatgttggaatcaacgaaagtcccggcgctgacccgcgcgattgagatcctcaatttaattggccgcatcggcccctgcagcgcggcgacgataatagcggagctggggatcccgaaaagcacggtgtatctgctgctgggcgagctgaaaaagcagcgcttcatcagtatggataatcaggataactactgcctgtggaccaagctggtggagctggccgggcaggcgctgagcaaaatggacctgcgcgagctggcgcggccgcgcctcacccggctgatggatgagtgcggcctgctttgtcatctgggcattatcgatcagggtaacgcctactacattctgaaaattgagtctcccgccaccatcagcgtgcgctcgcatgagggtaagagcctgtctctttaccgctccgggatcggcaaatgtttgctggcctggcagcccgccagcgttcaggcgtcgattatcgaagacctacagtgggagcgggccacgccaacgaccatcaccgatgctcaacagctgcgggaggagctggggcggatccgcgcccggggctggagctttgataatggcgaggactatccggatgtgcgctgcgtggctgccccggtatttaacgccaataacgacctgaccgccgccatctcggtggtgggtacccgtctgcaaatcaatgaagacaatcgcgattacctggctggtaaggcgattgcctgcgcgaaagatatttcacgtctgctggggtggaaaagccccttcgaacaactcgcctcatcataa

SEQ ID NO: 1226 - DNA, 726 bp, Klebsiella pneumoniae
caaggtctatcgttacgaagtaggcaggttaaaaaaatgagcgatgccgtgctgagtatcctgtgcctggtggcgacgctggtcctctattacgccaacaaaaaactgtatcgccgttttcataaactccctctgatgccgctggtgttcacgccgatcctgctggtgctgattctggtggtaggccacatctcttatcagagctatatgggagagacccactggctgctgtggctgctgggcccggcgaccatcgcctttgccgttccggtgtatgaaaatgtcgcggtgattaaacgccactggatgtcgctcagcgccggggtggtgacggcggtagtggtggctgtcaccagttccgtatggctggcgcgcgggtttatgttgtctgatgaaattcagcgtagcctggcggtgcgctcggtgaccacgccctttgcgctggcggcggcgaaaccgctcggcggtcaacccgatctggtggcgctgtttgtggtgatcaccggcgtgtttggcatggcggtgggagatatgctgtttttacgtcttgctatccgggaggggatggcgaaaggagccgggttcggcgcggcttcccatggtgcgggaacggcgcgctcgtatgagctgggccagcaggagggcgtggtggccagcctggtgatgatgctgtcaggcgtagtggtggtgctggctgcgccggtcgtgcgctggctgctgttttaa

SEQ ID NO: 1227 - DNA, 1131 bp, Klebsiella pneumoniae
ctatattcatctaaaatagcgtgtatcatagaggttttgccccatcagggcgaccaggagccagatcgattgagtaaaaataaactctccaaaggccagcagcgccgcgtcaaagccaaccaccagcgccgtctgaaaaccactgcggagaaggccgactacgatgacaacctgtttggcgaaacgtcggaaggcattgtcatcagtcgctttggtatgcatgccgacgtcgaatccgctgacggcagcgtgcatcgctgcaatatccgccggacgatccgctcgctggtcaccggcgaccgcgtggtctggcggccgggtaaagacgccgccgacggcgtaagcgtcaaagggatcgtcgaggcggtgcacgatcgcgcctccgtcctgacgcgtccggatttttacgacggcgtgaagcctatcgccgccaatatcgaccaaatcgtggtggtttccgcgatcctgcctgagctgtcgctgaatattatcgatcgctatctggtggcctgcgaagcgcaggatatcgagccgctcattgtgctgaataaaatcgatctgctggatgatgatggtcttcgcttcgtcaatgagcaaatggatatctaccgcaacatcggttaccgcgtgctgctggtttccagtcggactcaggacggccttaagccgctggaagcggccctgaccgaccgcatcagtatcttcgccgggcagtccggggtcggtaaatctagcctgctgaacgccctgctcgggttgaacgaggatcagatcctcaccaatgatgtctcggacgtttccggcttaggtcaacacaccaccaccgcggcacgcctctaccacttcccgcacggcggcgatgtgattgattcaccgggggtacgtgagttcggcctgtggcatctggaagcggaacaaatcaccaacggctttgtcgaattccatgattatttaggccgttgcaaatatcgcgactgtaaacacgataccgatcctggctgtgcgcttcgcgaagcggtagagaacggcaagatcgccgaaagccgttttgagaactaccaccgcatcctggaaagcatggcgcaggtacaggtaaaaacgcgtaaaaacttttcctcgtccgatgactga

SEQ ID NO: 1228 - DNA, 1905 bp, Klebsiella pneumoniae
ccttgcccatcagcaggcgctgctggactgcctgaagtcacaccacccgtatcaaaccccagaactgctggttctacccgtcacgcatggagacaacgattacctctcatggcttaccgcatcattacgctgatcctgctgctgtgcagcacatcagccaccgccgggttattcgacgcgccggggcgctcgaacttcgtgcctgctgatcaagctttcgcctttgactttcagcagcaacagcatgacgtcaacctgagctggcaaatcaaggatggttattatctttatcgtcaacagtttaccttcagcgccgccggggcgacgatcgacgaaccggcgctgccggcgggagagtggcatgaagatgagttttacggcaaaagcgagatctttcgccaacgcctgaccgtgccggtgacggtgaaggaggcggacaaagaggctactctcaccgtcacctggcagggctgcgccgatgccggattctgttatccgccggagactaaagtgatcccgctgagcgccgtgcgggcggcctcaaacgacgctcagccaaccgccgccgcgcccgtgtcgtcgctgaaccatcgcccggccttcaatccgccgctgccggttgaaccgcgcccgatggaggagaacgccgtgccgcaggcgcctgccatggcgccgccagcaggcgtccccgctcgtctgcccttcaccgccctgtgggcgctgctgattggcattggtatcgccttcaccccctgcgtgctgccgatgtacccgctgatttcgggcatcgtgctgggcggaaaacagcggctttccaccccgcgcgccctgctgctggcctttatttacgtccaggggatggccctgacctataccgcgctggggctggtggtagccgccgccgggctgcagttccaggcggccctgcagcacccgtatgtcctggtcggcctgtcggcggtgtttatactgctggcgctctccatgttcggcctgttcacgctgcagctgccgtcgtcgctgcagacccggctgacgctgctcagcaataagcgccaaggcggctcgcccggcggggtctttgcgatgggcgctattgccgggctgatctgctccccctgcactaccgcgccgctaagcgccattctgttgtatatcgcccagagcggtaatctgtggctgggcggcggcacgctgtacctttacgcgctgggcatgggtctgccgttgatccttgtgaccgtgtttggcaatcgcctgctgccgaaaagcggcccgtggatgagccatgtgaaaaccgccttcgggtttgtgatccttgccctgcccgtcttcctgctggaacgcatattcggcgaccagtgggggttacggctgtggtcaatgctcggtgtcgccttcttcagctgggcgtttatcacctcgctgggcgctacccggccgtggatgcggctggtacagatcattctgcttgccgccgcgctggtcagcgcgcggcctctgcaggactgggcgtttggcgccccggcggtcgagcagcaggcgcacctggctttcacccgcgtcagctcggtggccgagcttgaccaggcgctggcgcaggcgaaaggtcaaccggtgatgctcgatctttacgccgactggtgcgtggcctgcaaagattttgaaaaatacacctttagttcacctgacgtgcagcaggcgctgaaaggcaccgtgttattacaggtcgatgtgacgaagaacagcccgcaagacgtcgcgctgctgaaacacctgcaggtgctgggtctgccgacgatcctgttcttcaacgctgagggtcaggaacagcctgagcggcgagtcaccggctttatggatgccgcggcattcagcgcccatttgcgcgattggcaagcgtga

SEQ ID NO: 1229 - DNA, 2136 bp, Klebsiella pneumoniae
gtgggccgatccatgactaatgaaatatttaccaccattatatccagactaaatttttcattacgccataaaacgccagttatattacagtcggaggcaacagagtgtgggatcgcttgcctggcgatggtttgcggtcactatggtctggatattgatctgtttaatttccgccagcgctttggcagcgcttcgcagggagtaacgatgatgtcattaagcaaaacggcagatcatgccggcttgaaaagccgtgctctgtcgttagacctgaatgagattcgtcagcttaaactgccctgtatcctgcattggggaatgaatcactatgtggttctcaccaaagtacgtaaatcaagtttcattgtacacgatccggcattgggtaaacgagtcattggcaatcaggagatgtccaattattttaccggtatcgccctggaactctggccggatcaaaactttcaacaggaaaaagccaaatctcgcctgcgtctgttggatctgatgcgtaatattatcggattgaagtcaacgctactgaaaattttcgccttctcggtcgtggttgaagcgattggcttattgctgccgataggcactcaactggtgactgaccacgtgatcatggcccatgatcagagcctgctatccgtaatctgtatcggtctggtcttcttcaccctgttccgcacctttatcagtatgctccgggcctggacatcgttaacattaaatacgttaactaatattcaatggaaaaccacgcttttcgatcatctggccagtctgccactatccttttttgaaaagcgtcatttaggagatatccagtcgcgtttttcctctctggacaccatacgctcgacgtttacgaatagtattgtcagcggcattattgactcgatcatgactattggtctgctgatcatgctgacactgtatgggggctggctgacctgggtggtcgttggttttaccctatgctatgcgattatgcgctttgctacctaccgcttttatcgtcgcgtagcggaagaacaagtgattaaaggcgcacgctccagctcgcattttatggagtctctgtatggaatctcgaccatcaaggccttaaacctgaaagagcgtcgctcccagcattggctcaatattaatattgaagcctgcaatgccggaatcaaacaaacgcgcttcgacatgatgtttggtggaatcaatacttttataactactatcgatcaggtcgcggttctttggctgggtgccattatggttattgataataatatgactctcggtatgtttatggccttcaacgcctaccgtggccagttttcacagcgagcttctagtctgattgatctctgtatgcaactccgtatgctttctttacataatgaacgtttgtcagagatcgtcttcagcgaaccggagcaggagcttcctgcaagagaagttttctctgctgactcgggtgcaaaactagaagtaaaaaatctctgttatcaatacgatcccttttctcagcctatattttctaatttaaatattacggtagaacctggggaatctgttgcgttaatcggaccttccggtgttggtaaaaccacgctgttaaaagtgatgtgcggtttgctttcacctactagcggagatgtattagccgataacctcgatatcactaaaattggtttgaataactatcgtcacggtaccgcctgcgtactgcaagaggaccgccttttctccgggtcgcttatcgataatatcagcggcttcgaagataatgccgatattgattttgtgatggaatgcgccaggcgctgtaacattcatgacgaaattatgaagatgccaatgggctatgaaaccattgttggtgaactggggttaggtatatccggcgggcaaaagcagcgtattctgatcgctcgagctttgtatcgtaaaccaagcattctgtttatggatgaggccaccagccatctcgacttaaagaatgaatcagttatcaatcagtcaatctcggcgttaagcattacccggattatcgttgcccatcggccatccactattgcctctgcagatcgcgttatcgatctgtcgcagacaaagactctcgcgccagcataa

SEQ ID NO: 1230 - DNA, 396 bp, Klebsiella pneumoniae
tcctgtttgtcgccctgttctggtaaggaggctgagatgattaatcccaatccgaaacgttccgatgaacccgtattctgggggctgtttggctcaggcggcatgtggggcgcgattgtcgcgccggtgatggtgctgctggtcggcatcctgctgccgctagggctagctccggccgacgccttcagctatgagcgtgtgctggcctttgcccaaagctttatcggccgcgcgttcatctttctgatgattgtcctgccgctgtggtgtgggttgcatcgtattcaccacgccatgcacgatctgaaaatccatgtgccaaacggtaagtgggtcttctatggcctggcggcaatcctcagcgtcatcaccctcgttggcgtactgtttatctga

SEQ ID NO: 1231 - DNA, 1548 bp, Klebsiella pneumoniae
ggccaggcgtcgctcgtcgggcgatgcccacgtttggatagatttatgcatcaacaactcaagaagatgagcctgatcgggctgattctgatgatcttcacctcggtgtttggctttgccaacagcccatcggcgttttatctgatgggctatagcgcgatgccgttttaccttttttccgccctctttttctttatcccgttcgcgctgatgatggcggagatgggctcagcttatcgtcgcgaagagggcgggatttattcctggatgaaccacagcgtcgggccgcgctttgccttcattggtacctttatgtggtttgcctcgtacgtagtgtggatggtgagtaccgccgctaagatctgggtcccgctctctacttttttgtttggcgcggacaaaacccagacctgggcgctgggtagcctgacgccgacgcagacggtcggtattctggcggcctgctggatggtcgtggtgacctttattgccgtcaaagggatcaataaaatcgctaaaattaccgccgtcggtggtatcgcggtgatggggcttaacctggtgctgctgctggtgagcggggcgatccttctgcttaacggcggtcatttcgcccagccgttaaacttcaccctttcgcctaatcccgggtatcagtcgggcatggcgatgctgtcgtttgtggtatttgccatctttgcctatggcggaattgaggcggttggcggcttagtggataagaccgataagccggaaaagaactttgccaaaggtattatcatcgcggcgatcgttatctcgatcggttactcgctggcgattgtgctgtggggcgtgagcgccaactggcagcaggtgcttggcgcgcgttcgaccaacctcggcaacatcacctatgtgctgatgaccagcctcggggcgacgctgggccaggccctgcacctgacccctgcggcgtcagccctgaccggggtctggttcgcccgtattaccggcctgtcgatgtttctcgcctacaccggcgcgttcttcaccctcagctattctcccctgaaagcgattatccagggcacgccaaaagcgctctggccgtcggtgatgacccgtctcaacgtcaacggaatgcccgccgcggcgatgtggctgcagtgtctgctggtcggggtgtttatcgtactggtatcgttcggtggggatagcgcttccgcgttttataacaagctgacgctgatggccaatgtctctatgaccttgccttatctgttcctgaccatcgccttcccgttcttcaaggcgaaaacccatcttgaccggccgttcgtgatcttcaaaaaccgtccgtcgacgctgctggcgaccggcgtggtgctgctggtggtgaccttcgccaatatcttcaccattatccaacccgtcatcgacagcggggactggaacagcaccctgtggatggtcggtgggccgatcttcttctcactgctggcgctggggatctacgaaagctaccgtcggcgcatggcgtccggcgcgctggtgatggagagttaa

SEQ ID NO: 1232 - DNA, 567 bp, Klebsiella pneumoniae
tcgtcaattccgaatactgatgaccgcctgaacgcgataaacggcagcgacggcgctgccgtttttttatgcaaaatcaggggtggaaggttttaccttttcacgtattgctgcacacttagaaggattcattcgcaaaaggagtcaatgatgtggtatcagcaaaccctgacgcttgggccaaagtcccgcggttttcatctggtcaccgacgaaatccttggccagatccgcgggctgtccggggtgaaggttggcctgctgcacctcctgctccagcatacttccgcttccctgacgctcaacgaaaactgcgatcccaccgtccgctatgacatggagcagtattttctcaacgccgtaccggacaatgcgccgtatgaacatgactatgaaggccctgacgatatgccgtcgcacatcaaatcatcgatgcttggcgtgtcgctaatgctgccggtcgaggacggacgcgtcaggctgggaacctggcagggcatctggctgggggagcatcggatacacggcggttcgcggcgcatcgttgcgacgctcatgggggaataa

SEQ ID NO: 1233 - DNA, 714 bp, Klebsiella pneumoniae
gcgcctgttcctatagttaatttgaacaaactacgggagaggctcatgctgacggttcatcatcttaatcaatcacgatcgcaacgcgtactgtgggcactggaagagctgcagctgccttatcagatagtccgctatcagcgggagaaaacgatgctggcgccggcggcgctgaaaaaaatccatccgttgggcaaatcaccggtactggaagacaacggctatgtgctggcggagtccggggcgatcctcgagtatttgcaggaaacctgggacagcggcgggttgttgaagccgcagggaattgacgacaaactgcagtaccgcttctggctgcactatgccgaaggctcgctgatgccgctgctgttaatgaagctggtgttcgccagccttggcaaaccccctgtgccctttggcgttcgctcgctgggttcgctgctgggcaaggggatacagaaaacgtggctcgatccgcagctggccacccatgcgcggttcattgacgaccatcttgccgcacggccatggttcgctggcgagcggctgagcatggctgatatccagatgagcttcccggtgatggcattgttggcgcgcggcggcatgcatgaccttgtccatatcgaggcctggcgtcagcgagtggaacagcgaccggcctggcaacgcgccatcgagcgcggcggccccttcaccttacccggcgcctga

SEQ ID NO: 1234 - DNA, 645 bp, Klebsiella pneumoniae
gtgcatcctccgggatgcacctttttttgcacgcgcggcagcctgttgcatggctgttgcgtgaatgatcgtatattgacgtttgcccgccaccaaccgcctattctgcgatacaatgctttcacgttatgtaccggagaatcaggcatgtcccatcctgcgcttacgcgactgcgtgcgctgcgctattttgccgttatgccatccctgccgccgccgctaagtgactggctgctgctggaggactcaatgacccagcgctttgaacaacaaggaaagcaggtcaccgtgaccctggttaacgaagggtatatcggccgtgacgcgctgactgacgaagcggcgctgctgcccgacgagccgcgctactggctgcgggagattatactcaatgccgatggcgagccctggctggccgggcgcacggtggcgccggagtcgacgctgtgtggtccggagctggcgctacagcagctcgggcaaactccgctgggccgatacctgtttacgtcgtcgacattaacccgcgattttattgaaattggtcgcgatgcagcgctgtgggggcgtcgttcccgcctgcggctgagcggcaaacccctgctgctgaccgagctttttttgcctgcgtcgccgttgtactaa

SEQ ID NO: 1235 - DNA, 306 bp, Klebsiella pneumoniae
gcaggtaatccactttgctgcccggggcaacctgctgcagcgcgtcgaccagcgcctggcgcatggtcaggatgtgcgcgcgcatggcgtccacttccgcctgccacgtggctttcagcccggcatcgttcagcaccgtcgccaccacctgcgcgccaaagctcggcgggctggagtagttacggcgcacggtggccttcagctgccccagcacgcggcccgcggtttcgctgtcttcacagaccacggacagaccgccgacgcgctccccgtacagcgagaaaattttggagaacgagttgctga

SEQ ID NO: 1236 - DNA, 1557 bp, Klebsiella pneumoniae
aggatgatccccatggatgccgttaaaaagagacactggtggcaaagcccgcaactcacatggtctgtgattggcttactgtgcctgctggtgggttaccttgttgttttgatgtacgcccagggggagtacctgttcgccatcatgacgctgattttaagctcagttggcctgtatattttcgctaatcgcaaggcttatgcctggcgctatgtttatcccggcctcgccggcatgggcctgtttgtcctgtttccgctgatctgcactatcgctatcgcgtttaccaactacagcagcaccaaccagctgacctttgagcgtgcgcagcaggtgctgatggatcgttccttccaggccggcaaagcctataatttcacgctgatccctgcgggtgacgagtggaagctggcgctgaccgacggcgaaagcggtaaaaactacctttctgacgcctttaaatttggcggcgagcagaagctggcgttaaaagaaaccgacgccctgccggaaggcgagcgcgccaacctgcgcgtgattacccagaatcgcaccgcgctgaaccagctgaccgctgtgctgccggatgacagcaaagtcatcatgagctccctgcgccagttctccggtacccagcctctgtataccctcggcgaagacggggtactgaccaacaatcagacccacgttaaataccgcccgaacaacgacgtcggcttctaccagtcaattaacgccgacggcagctggggcaatgagaagctgagcccgggctacactgtgactatcggctgggacaactttacccgcgtcttccacgatgaaggcattcagaaaccgttcttcgcgatcttcgtctggacggtggtgttctcggtgctgaccgtggtgctgaccgtcgcggtggggatgatcctcgcctgcctggtgcagtgggaagcgctgaaaggcaaagcgatttatcgcgtcctgctgattctgccgtacgccgtaccgtcgtttatttcgattctgattttcaaagggctgttcaaccagagctttggtgaaatcaacatgatgctcagcacgctgttcggcattaagccggcctggtttagcgacccgaccaccgcgcgcaccatgatcatcatcgtcaacacctggctgggctacccgtacatgatgatcctgtgcatggggctgctgaaggcgattccggacgatctgtacgaagcgtcggcaatggatggcgccggcccgttccagaacttctttaaaattaccttcccgctgctgattaagccgctaacgccgctgatgatcgccagcttcgcctttaactttaacaacttcgtcctgattcaattgttgaccaacggcggtccggaccgtctcggcaccaccaccccggccggttataccgacctgctggtgagctacacctatcgcatcgcctttgaaggcggcggcggtcaggacttcggcctggcggcggctatcgcaacgcttatcttcctgctggttggcgcgttagcgattgtgaatctgaaagccacgcgcatgaagtttgattaa

SEQ ID NO: 1237 - DNA, 396 bp, Klebsiella pneumoniae
gggcgtcacccgcagcccctgcaggttaaacatcacaaacggcgtgacggtatggctaaagtcaagcagaccggggtgtttgagcagatcgtcgcagccggcgtcatccggcgggccatagaccggaatcgacgcgccgactccccagcgcagcggaaacagcccctgcacatgatccagatggtagtgggtcagcagcacctgttgaaagctgccggcgggatgatgttccatcagatccggtcgtccggcatcgagcagcgtcacggcgctgttgaacgtgaccactccgctacaggggcggcggcggtgattttcctcgcggcgagcgcggcggcaggccgcgcagtcgcagccgaagaccggcaccagctgagcgccgccggtgccggttaa

SEQ ID NO: 1238 - DNA, 765 bp, Klebsiella pneumoniae
cgaggccaccccgacgccaaacagggaattagcatgagaaaagtcctcaccgtcctgctgctgagcacgctggccatcggaaccgcgtcagccgagacgctccattttggcaccaccacggccaatccaccgtttgtcaccgccaacggcaaaaatcagcccgttggcttcgatatcgatctcgcgcacgccctgtgccagcagatgcaggcgcagtgccagttcacggcgcagcgtttcgataccctgatcccggctttacgctttaagaaatttgacgcggtgattgccggcatggaagtgatcccgatgcgtgagaagcaggtcgccttcagccgcccctatcgccaggcgctctccggggtagtgatcgtcaacaaagatgtcgcccatacctttgccgatctgaaggctaaaaaagtcggcgtggtgaaaggcacgctgcatcagcgctacctgcgtgataaacagaaagccgtacaggctgtcccttacgacgatgtcgccagcgccctggccgcgctgaaagccgggcaaataaccggcgtcatgggcgacttcgccaccctcgacgcctggcagcaggagaaccctgactacgccatcatggatgaacgggctaccgacccggcttattacggtaagcagtatgcgattgcggtgcgcaaagacgatccggagctgctgaacgccatcaacgatgccctggccgcggtcatggcgacacctgacttccagcagatgcagcagaagtggtttaaataa

SEQ ID NO: 1239 - DNA, 507 bp, Klebsiella pneumoniae
acgcagcgcccgttgatgaaggagacgccggtgcgttggattccgtttattgccttttttctttacgtttacattgagatatcgatctttatccaggttgcgcacgtgctgggcgtctttatgaccctgatcctggtgatctttagctcggtggtaggaatgtcgctggtgcgtaaccagggcttcaaaaacttcctgctgatgcagcagaagatggccgcgggcgagagcccggcggcggagatgatcaagagcgtatcgctgattatcgctggtctgctgctgttgctcccggggttctttaccgacttcctcggcctgctgctattgctgccgccggtgcaaaagcatttgacgatgaagctgatgccgcacctgcgcttcagccggatgccgggcggcggctttagcgccggaactggcggcggagagaccttcgaaggggaattccagcgcaaagatgagcagcgtgaccgtctggaccataaggacgatcgccgcgattaa

SEQ ID NO: 1240 - DNA, 1029 bp, Klebsiella pneumoniae
cgagacgtacctcctatgaacccacgcaaacccagcgtcaccgcccaggatgttgcccggcgagcgggcgtctcccgggcagtggtgtcccgggcgttgagcaacaacggcagcatctctcccgacgcccgggcgcgggtactgcgcgccgccgaagagctggggtatcaggttaacttcctcgcccaggggctgaaccgtcagcgcagccacttaatcggcgtgatcgtctcgcgcatcagcgatccttttcgcagtaccctgcttgatgcgctgcttaacgagatccagcgccagggctttcaggcgctggtgagcgagatccacagcgagcaggatctggcgcagaccttgcgccgtttcgctcagtttcgcgtctccggcgttatcgtcacctccggccagccaccggaggcgctggtgaacgagtgcgtccagcagcatattccggtcgtgggcattaatcgtcagccgacgatccccggtgtggattacgtttgttctgacaacgccgccggcgccgaactggccgccgaccagctgctgcgcagcggctgtcagcgctttggctggctcaaccaccatccttccacctgggccggccgcatgcgcggggaagcgttcggccgggcgctgcaaacgcgcggagtggacgtcgaacgccacctggcgatcctcgcctgtcagcaagaaggttacgcgggcgggttacaggctgcggcgctcgccgacgaggcgctggaggggatcttctgcgccaacgcccagcttgcctgtggctttctcgatggaatgcgccagcgcggcagagaggctccggcggattttcagctgattggttttgataacacgccgacgaccgcgcaatatagctatcagctcaccacgctacatcaggatgtggcggcgatcgcccgccaggcgctcgcccggcttctggagcgcgccgccgacccttcgcaaccttcacgcaccacctgggtggaggtaaccttaattcaccggcgcacgtcgccctttgttatctga

SEQ ID NO: 1241 - DNA, 798 bp, Klebsiella pneumoniae
aaccttccacccctgattttgcataaaaaaacggcagcgccgtcgctgccgtttatcgcgttcaggcggtcatcagtattcggaattgacgattacttcctcgcccagcgcgccagccatcggcaacggcttataggaggagttggcggcccgcagcacgcggatgccacgggcgcccgcttcgcgggcggcggtgatatcgttatccgaatcgccgtagaaaacctttatctgcttcgcctgcagccactgggtcttggtgttctggccaggcttatcgccagcgaaaatcaccggattcatattggcggccgggatgagaaaatcatcctgcagggttttagaaacggtttcggttttggtctggctgcggccggtgacgaaccagatgctgtccccgcgcttcacatgcatcgcaatcagctggcgcgccacctctttcggcatgctgaattcatcccagccattgttcattttttcccagaactgcgggtttttcaggtaatcctcgctgccgggagagaaggttttttgcccgcgccagaaacccggactggagaagaggacggtgtcatcgatatcaaagcggacggccatcggcggccgccccagcaggctgttctcaatttgcgccaccgaaacccagtggattggcgcctgctcggccagctgggccacgttggtgccgacccacagcggctgcggcgtggaggcgcgtgccacaacggcgctgttcagcgtgaacaggagagaagccgccgcaagggcgagagtaagtttgcgcatatttatccctaa

SEQ ID NO: 1242 - DNA, 207 bp, Klebsiella pneumoniae
tattggccacccgcgcctgctcctgctgcgccagcggggccgccgccagctgggccagcgagtgcttcagcgcctgctgcgtcgccagcagccgttccgcttcgcttttgtactccagcgcccccaccacctgcgacaggcgcaccgccgccgtggcgacattcgccgtgtcccgcgccagatccatactgccgcgcatgtcgttga

SEQ ID NO: 1243 - DNA, 1698 bp, Klebsiella pneumoniae
attcgaccgtttgaccaaaagcgttctcaacgaggtaaaagcatgatcaagagagtcctgacggcgctcgccgccacgctgctgcccctcggcgctcacgccgcagacgctattaccggctcggtacagcgccagccgaccaactggcaggcgattgtcatgttcctgattttcgtcgccctgacgctgtacatcacctactgggcctcaaaacgggtgcgttcgcgcagcgattactacaccgccggcggcaatattaccggcttccagaacgggctggcgattgccggcgactttatgtcagcggcgtcgttcctcggtatctccgcgctggtgtatacctccggctacgatgggctgatctactcgctgggctttctcgtcggctggccgattatcctgtttctaattgctgaacgtctgcgcaatcttggccgctacacttttgccgacgtcgcctcttaccgcctgaagcaggggccgatccgcaccctctccgcctgcggttcgctggtggtggtggccctgtatctgattgcccagatggtgggcgccggcaagctgatccagctgctgttcggccttaattaccatgtcgccgtagtgctggttggcgtgctgatggtgctctatgtcctgttcggcggcatgctggcgactacctgggtgcagattattaaagcggttctgctgctgtgcggcgccagttttatggcctttatggtcatgaagcacgtcggcttcagcttcaataacctgtttaccgaggcgatggcggtccacccgaaaggggcggcgattatgagtcccggcggactggtgaaagatccgatatccgcgctctctctgggtctgggtctgatgttcggtaccgctggcctgccgcatattctgatgcgcttctttaccgtgagcgacgccaaagaagcgcgtaaaagcgtcttctacgccaccggttttatgggctatttctatatcctgacctttatcatcggcttcggcgccatcatgctggtcggcgcgaacccggcgtttaaagacgcggccggacagcttatcggcggcaataacatggcggcggtgcacctggcggatgcggttggcggcaacctgttcctcgggtttatctctgcggtagccttcgccactatcctggcggtggtggcgggcctgaccctcgccggcgcgtcagcggtgtcgcacgacctgtacgccaacgtcttccgcaagggcgcgaccgagcgtcaggagctgaaggtctccaagatcaccgtgctgatccttggggtggtggccattctgctgggtattctgtttgaaaatcagaacattgctttcatggtcggcctggccttctccatcgccgccagctgtaacttcccgattattctgctgtcgatgtactggtcgaagctgaccacccgcggcgcgatggtcggcggctggctgggcctgctgactgcggtcattctgatgatcctcggccccaccatttgggtgcagatcctcggccatgagaaagcgctgttcccgtatgaatatccggcgctgttctccattgccatcgcgttcattggcatctgggtcttctccgccaccgataactcaccggaagggatgcgcgagcgcgagcagttccgcgcccagtttatccgttcacaaaccgggatcggtatcgaacgcggccaggcgcattaa

SEQ ID NO: 1244 - DNA, 1446 bp, Klebsiella pneumoniae
aaatgccgaccaaagggtcggcattccgtcttagctgcgcaagcgttatgcgcgccaggctttataacggttaatcaggccgttagtagagctgtcgtggctgctaacttcgctgccgtctttcagctccggcaggatgcggttagccagctgtttgcccagctcaacgccccactggtcaaaggtgaagatgttgaggatcgcgccctgggtgaagattttgtgctcgtacagggcaatcagcgccccgaggctgaacggggtgatctcacgcagcaggatggagttagtcgggcggttaccttcgaacactttgaacggcaccacgtgctccagggtcgccgggtctttaccctgatcgcgatattcctgctcaaccacttcgcgggatttaccaaaggccagggcctcggtctgggcgaagaagttagacagcagtttctgatggtggtcagacagcgggttgtgggtgatagccggagcgatgaaatcgcacggtaccattttggtgccctggtggatcagctggtagaacgcgtgctgaccgttggtgcccggctcaccccagatgattgggccagtctggtagtctaccgcgtggccgttacggtcaacatacttaccgttggactccatgttgccctgctggaagtaagcggcaaagcggtgcatgtactggtcgtacggcagaatcgcttcggtttccgcaccgaagaagttgttgtaccagatgccgatcagcgccagcagcaccggcaggtttttctccgccggagtggtggagaagtgcttatccattgcatgcgcgccggacagcagctcaacgaagttgtcgaagcccacggagagaatgatggacagaccaatcgccgaccacagggagtaacggccgccaacccagtcccagaattcgaacatgttggcggtgtcgataccgaactcgccaaccgctttcgcgttggtggaaagcgcggcgaagtgtttcgccacgtgcttgtcgtcgcccgcggttgccaggaaccagtcgcgcgcgctgtgggcgttggtcatggtttcctgggtagtgaaagtcttggacgccaccaggaacagagtcgtttccggattcacgttcttcagcacttcggcgatatgggtgccatcgacgttagagacaaagtgcatgttgaggtggtttttatacggacgcagcgcctcggtcaccatgaaaggaccgaggtcggagccgccgatgccgatgttaaccacgtcggtgatcggtttgccggtgtagcctttccagctaccggagataatcgcttcggagaaggttttcatcttctccagcacagcgttcacttccggcatcacatctttgccatcaaccacaatcggcgtattgctgcggttacgcagcgcgacgtgcagtaccgcgcggtcttcggtgcggttgatcttctcacctga

SEQ ID NO: 1245 - DNA, 285 bp, Klebsiella pneumoniae
tggcgcttgcctcccggtatgtcagcctcctccacgcatactccttttctcttaaaaatcgcaaagatcccttcatctttggacggtttgtctatgcttatagggcatgaaaacaaaactgacactaaggatgacattatggtgaaaaaaacgattgcagcgttctttacggttttggtcctctcttcagcactgaccgcttgtaacaccacgcgcggtgtcggtgaggatatttcagacggcggcaacgcaatctctggcgcggcaaccaaagctcagcaataa

SEQ ID NO: 1246 - DNA, 1212 bp, Klebsiella pneumoniae
aaaacagtgccaatactcaagccaacattgtcagtgatgaagggatggtttatctctctggcttgcaagatagtggtgagttacttgttttatggggccaacggcaggatcaacgttgcaatgcaacgtatcaattacttcccacgcaaggaagtctcacaacatccaaagctatttgccgctagtgataaaaggatatcacatatgaaaaaaatatttttattctcggctttattgattatcgcttgtggtcaagcagaagcaacttgtaatatcaaagatatcgccaaaagggttaattttaacatgccaagcaatgttaaaatatctactgatccaactataccggtaggaagcatactctatacaaaattgatgggtatcggcggttctgcacccgcatttacttgcgacaactcatctaagaatagatacactaccgtgatcactgccagcgaagttccaggagtgactggcattatgggtaaacctgtttatgaaacgggaattccaggcattggttatcagattagtgatttacttactggctcggtctatggaatgatacccgcggttgcaggaagcataccggttccaggaacaactgaaaatacactttatcgctattggttaatcaaaactggaactattgacttaagtcagtccccaaccaatagcagcgtatcattttatgttgctgatagcgattataaagccacaatgccatctagcttactattatcaataaatatgaaatttgtaagccctgtacctcgcgaaaactcatgtgaaataacatcaactaaaaccgtaaacctctcaagaattgataaagtgacacttttgtctacttcaccgggaagtaaaacctcaaaagaaaaatcctttaccttgaatattaactgcgaacaaaagtcaactggaaatacgatttactattggtttaaccctcgttcgagtactgatggcactcccggcgttctccttaacagcgattcaacaagtagcggaggtgcacaaaacgtcaacactataataaaagaaaatggtatccctgttaatttttatgattatgaagctaagtcatttatagtagatgccaacaagctcaataaagagattaatcttaccgcagattactatcgtactaccgatgacattactattggcaccgtcagagggttgttagaggtcgtcattcaagaggaataa

SEQ ID NO: 1247 - DNA, 1419 bp, Klebsiella pneumoniae
tattgcgcgttaaataaccccacaaagcaacgcaacacaattcataccccctgcagtgggtaccatgacgaaaaggaatggtgcctttcattgaggaagtcagtagtgaagaaaacaaaaaaagtcagtctggcctggcaaattttgctagccctggtgctgggtatccttctgggcagttatctgcattaccacgctgaaagtcgcgattggttaattagcaatttgctgacgccggcgggcgatatctttatccatctgattaaaatgatcgtggtcccgattgtcatttcgaccctggtggtcgggattgccggcgtgggtgacgccaaacagttagggcggatcggtgccaaaaccattatctatttcgaagtgatcaccacggtggcgattgtgctgggtatcaccctggccaacgtcttccagccggggacgggcattgatatgtcgcagctggcggcagttgatatttcgaaatatcagaacaccaccgccgaagtgcagagccatgcgcacggcctgatgggcaccatcctgtcgctggtgccgaccaatatcgtggcatcgatggcgaaaggcgatatgctgccgattatcttcttctcggtgctgtttggcctggggctctcctcgctgccggcgacccaccgtgagccgctggtgacggtcttccgctctatctccgagaccatgtttaaagtcacccatatggtgatgcgctatgcgccggtcggggtattcgccctgatttcggtaaccgtcgccaccttcggtttcgcctcgctgtggccgctggccaagctagtgttgctggtttactttgcgatcctgttcttcgcgctggtggtgctggggattgtcgcgcgcctgtgtggtctgagcatctggatcctgatccgcatcctgaaagatgagctgattctggcttattctaccgccagttcggagagcgtactgccgcgcattattgagaagatggaagcctacggcgcgccggcgtcgatcaccagctttgtggtgccgaccggttactccttcaaccttgatggttcaacgctgtatcagagcatcgcggcgatctttatcgcccagctgtacggtattgacctctctatctggcaggagattaccctggtgctgaccctgatggtgacctcgaaagggatcgccggcgtgccgggcgtctccttcgtggtgctgctggccaccctgggtagcgtcgggatcccgctggaagggcttgcctttattgccggcgtcgaccgtatcctcgacatggcgcgtaccgcgctgaacgtggtgggtaatgcgctggcggtgctggttatcgccaagtgggagcataagttcgaccgcaaaaaagcgctggcctatgaacgcgaagtgctgggcaagtttgataaaaccgcccaataa

SEQ ID NO: 1248 - DNA, 1371 bp, Klebsiella pneumoniae
ccggtcaggccagcgagtttcgccgcaacgcgaaccagcgctacgccgccgccagccaccacgccttcttcaaccgcagcacgggttgcgtgcagggcgtcgtcgacgcgtgcttttttctctttcatttcaacttcggtagccgcaccgactttgattactgctacgccgccagccagtttagcgacacgttcctgcagttttttcacgatcgtagtcggaggtcgtttcttggatctgcttacggatctgagctacgcggccctggattgcggattcttcgccaacgccatcgatgatggtggtggtgtctttgttgataaccacgcgtttcgcctggcccaggtcttccagagtcgctttttccagctccataccgatctcttcagagataacggtaccgccagtcagagtagcgatgtcctgcagcatagctttacgacggtcgccgaagcccggtgctttcaccgcagccactttaacgatgccgcgcatggtgttaaccaccagggtcgccagcgcttcgccttcaacgtcttcagcgatgatgaccagcggtttgccagctttcgctacggcttccagaaccggcagcatttcgcggatgttggagatttttttgtcagccagcaggatgaacgggctttccagctcaacggcaccggtgtccggcttgttgatgaagtacggagacaggtagccgcggtcgaactgcataccttcaactacgtccagttcgtcttccagaccggtaccgtcttcaacggtgatcacgccttctttaccaactttatccatcgcttccgcgatcagtttaccgacggtttcgtcggagttagcggagatggtacctacctgagcgatagctttggagtcagagcacggaacggacagcgctttcagctcttctacggcagccagtaccgctttgtcgataccgcgtttcagatccatcgggttcatgcctgcagcaacagctttcagaccttcgttcacgatagcctgagccagtacggttgcggtggtggtaccgtcgcctgctgcgtcgttcgctttagaggcaacttctttcaccatctgcgcgcccatgttttcgaacttgtcttccagttcgatttcacgtgcaacggaaacaccatctttggtgatggtcggcgcgccgaaggatttgtccagaaccacgttacggcctttcgggcccagggtcactttaactgcatctgccagtacgtttacgccgcgcagcatttttacacgagcgtcgttaccgaattttacgtcttttgctgccatttcttttattcctcaaattcgttcagggtcgtgcgaattaagcttcaacaattgccaggatgtcgctttcggacatga

SEQ ID NO: 1249 - DNA, 894 bp, Klebsiella pneumoniae
aaaataaagttacgaatcaaggcgccgttgggcaaggcttcggcgaaaaagggtgatattttgtcacccagactcacgtgccgttcacttatcgcaaggatccccactatgtctggccacaagaaatacctctctgtcgccatgctgagcgctgtcttactgccggcgatggcctctgccgctgacgcgccggcgactttcaccccggaacaggaggcgaaaatcggcaaaatcgccgccgactatctggtcgcccacccggaagtcctgctgcaggcgagccagaaactgcagcaaattcaggctgagcagcaggccagcgcggccactcaggcggtgctgaagaacgccgccgtgctgacccaggataaaaataccccgacttacggcccggccaacggcaaagtcacggtgatcgaattcttcgactaccagtgcgtctactgcagccgtctggcgccggtgatggagcaggtgattaaagcgcacccgcagacccgcttcgccttcaaagagtggccgattttcggcggccgctgggaaagctcgctggaggcggcaaaaaccggcctgcagatctatcagcagaaaggggcggatgcctatctggcctaccataacgggatttacgctaccggccataacgaaggcaagctgacgacggcggatatccagcagcaggcgaagaaagccggcttcgatgcgaagaaggccgccgacgtcgaaccggtgctgcaaagcattaacgatctggcgcaggagattggtctgagcggcacgccgggcgtgatcgtgatgccgaccaccggcgccacggaagccagcatcaccgtcttcccggggctggcagacaaagcctcgctggaagccgccatcaaaaaagccggcggctaa

SEQ ID NO: 1250 - DNA, 369 bp, Klebsiella pneumoniae
attaacactaccatggtattccgactcacgcgtcggaataccatgagatatcgtgaaagcatcagaggagcgaggtggatgagaataagggacagtattgctgagcggttagaggcatgcgggctctaccgtcgggcggcatccagatggattgaggtgatgcagcgttgcctggacgatgaggaccgagagtggatccgtcaccatcgcaatcagtgtctgaaaaaggcgcaacgtccgccggcgccgaaagaggagtttgccgacctccaccaggcggcgaaagagactcaatatcgtatgggcattgcgaagccctatggcgaagcattcaggctgcccggcaaagggaaaacggccgccgagtaa

SEQ ID NO: 1251 - DNA, 2043 bp, Klebsiella pneumoniae
tgcaaatatacggttttaaggatgaccatgctgaacacgaccctgcgcaacggcctgatgcttctcatctggctgtgccttatcttcagcgtgcgtgctgaggaagtccccttcctcgtcccgcagcagcgcccccaactggaggccaatcaaccctggccggcggatcgctttctggtgctggcctaccatgacgtcgaagacgatgccgccgaccagcgttatctttcggtgcgcaccagcgcactcaatgagcagatcgcctggctgctgcataacggctaccatgcgattagcgttcaggacattctcgatgcacattatggcttaaagtcgctgccgcccaaggcttttctcctcagttttgacgatggttacagcagcttttacacccgcgtatggccgctgcttaaagcctggaacgtcccggcgctgtgggcgccggtgggcagctgggtggacactcccgctggtcagcccgttaattttggcggcctgatgacgccgcgcgagcgcttcgctacctgggagatggtgcgcgagctcagccgctcgccgctggtggagatcggcgctcacacctgggcctcgcactacggtctgccggccaatccgcagggcagccgcgagcctgccgccgccaaccgcggctgggataaaaccaccggccgctatgaaagcgacgcgcagtttacccggcgaatgaccgatgacgtgcagaaagtgacggcgaaaatccatgaggttgccgggaaaacgccgcgcgcctgggtgtggccctacggcgccgccagcggcagcaccctggccatcgccaaacagcaagggtatcagctggcgtttacgctgaacgacggcctgggcaacgtgaaggatctggacaatattccacgcctgctgatcgccggtaacccgtcgctcaaggcctttgccagcgccgtgacccaaattcaggaagccgatcctgttcgggtgatgcatgtggatctggactatgtctatgaccccaatcccgtccagcaggcgaagaatatcgataagctggtgcagcgcgtctatgacatgaaaatcagccatgtctttctgcaggccttttccgacccgcagggcgacggcacggtcaagtcgctctatttccccaaccgctggctgccgatgcgcgccgacctgtttaacttcgtctcctggcagttgcagacccgcggcaatgtgaaggtttatgcctggatgccggtgctggccttcgatcttgcctcagatctgccgcgcgttcagcgctgggatccgcaaaccgggaaggcgttacttgcccgccagccgtacgtccgtctgtcgccctgggatccccgggttcgccagcagatcaccgacatctacgaagatctggcccgacacgccagcttcagcgggattctgtttcacgacgacgccgtgctgaccgattttgaagacgtgagcccggaggcggtcgccgcctggcggcagacgggtatggcgcacgatgccgccccggtgccccaacgtccgcaagagcgccaggcatggatgcgtttcaaaagccaaaccctgacccgcttcactctggatctacgccaggcagtgcaggccatccgcggcccgcaggtgaaaacggcgcgtaatctcttcgccctgccgatcctggagccgcaaagcgaagcttggtttgcgcagaatctggatgacttccttgccgcgtatgactggacggtccccatggcgatgccgatgatggagtccgtgccgatcgacgccagccaggcctggctgacgcggctggtgcaggccgtcgcccgccacccgggcgcgctgaagaaaaccatctttgaactgcaggccagagactggaatcgacgccagcaaaacgccattcccgaccagcagctggcggactggatgcgtttgctgcggctgaacggcgtcaaaaactacggctactaccctgacgattttattaacaaccagcctgatatctctcgtatcaggccgcaattttcttcctggtggtaccctgaccatgactga

SEQ ID NO: 1252 - DNA, 1191 bp, Klebsiella pneumoniae
cgaaggggtacgccgtcaggtcgccgaccgactgcactctatgggaatgacagcatgattatcaataacgtaaaactggttctcgacgacgaggtggtccacggttcgctggaagtccatgacggtcgcatcctcgccttcgccgaaagccagagccggctgccgcaggcgctggatggggaaggcggctggctgctgccgggccttatcgagctgcataccgataacctcgacaagttctttaccccgcggccgaaggtagactggccggcccactcggcgatgagcagccatgacgccatgatggtcgccagcggcatcaccaccgtgctggacgccgtggcgattggcgacgtgcgcgatggcggcgatcgtcttgagaatctggagaagatggtcaatgccgtggaggagacgcaaaagcgcggtctcaaccgcgccgaacaccgcctgcacctgcgctgcgagctgccgcatcacaccacgctgccgctgtttgaaaagctgatcgatcgcgagtcggtgagcatggtctctctgatggaccactcgccgggccagcgtcagtacgccgatcgcagcaagtaccgcgattattatcagggcaaatatcatctgacgcatgacgaaatggaccgttttgaagccgagcagatggctctggccgccacctggtcgcagcccaatcgccagaccatcgccgccatgtgccgcgcccgccgtatcgccctcgccagccacgacgacgccaccgaagcgcatgtggccgaatcccaccagctagggagcgtgatcgccgagtttcccaccacgctggccgcggcgcaggcttcacgtcagcacgggatgcacgtcctgatgggggcgccgaatatcgtgcgcggcggttcccactccggcaacgtcgccgcccaccagctggcgagccatggtttgctggatatcctctcatctgactattaccccgccagcctgctggatgccgctttccgtatcgccgacgccgaggacaatgccttcaccctgccacaggcgatccgtctggtcagtcagcatccggcgcaggcgctgggccttgacgatcgcggcgtcatcgccgagggaaaacgcgccgacctggtgctggcgcaccgtcgcggcgaacatatccagatcgaccatgtctggcgccagggaaagagggtcttttaa

SEQ ID NO: 1253 - DNA, 207 bp, Klebsiella pneumoniae
cacacctccacgtgggtggtgcgcgggatcgccagcaggcgctcgccgcaggtgaggatcaggtcgatgcccagcgggaacgggtgcgggcgttcggttaattcgtcgatgatgcagtccggcagctgcggcgcgatcattcgctcttcggcaatgcctgccccggtcaggcgcagcatgcgtccgccgctgaggctggcaagctga

SEQ ID NO: 1254 - DNA, 225 bp, Klebsiella pneumoniae
aaactggccacggtaggcgttgaaggccataaacataccgagagtcatattattatcaataaccataatggcacccagccaaagaaccgcgacctgatcgatagtagttataaaagtattgattccaccaaacatcatgtcgaagcgcgtttgtttgattccggcattgcaggcttcaatattaatattgagccaatgctgggagcgacgctctttcaggtttaa

SEQ ID NO: 1255 - DNA, 234 bp, Klebsiella pneumoniae
cccttttcaaccgatgtttatcgtatttcgctaaatttcgcttatgacgaacagaaaatgaccagccgatgcgcaaacgttatcgtccatgcgcaatccgctaacaattttttagtgagttgctttcatttatcgacgtcatcggatccgctgatatctcaggcgccgggtaaggtgaaggggccgccgcgctcgatggcgcgttgccaggccggtcgctgttccactcgctga

SEQ ID NO: 1256 - DNA, 306 bp, Klebsiella pneumoniae
tcgtttgggttcaggtactggtattcgcctttctggtggcccatcagctcaaggccaatgttcgccaggacttcgttggtgttcatgtttacggaggtaccggccccgccctggaagacatcgaccgggaactggtccatgcatttgccgttattcaggacttcgtcacaggcggcgataatcgcatttgccgcgcttttgggaatggtctgcagctccttgttcgccagcgcggcggctttcttaaccatgaccatgccgcgcacgaattctggtatgtcgctgattttgctgttgctaatgtag

SEQ ID NO: 1257 - DNA, 645 bp, Klebsiella pneumoniae
  unsure (616),(620): Identity of nucleotide at the above locations are unknown.
ggcggtgggttcatcaaggagcaggatcggatagtcgaccgcaaaaccgcgggcgatgttgacccgctgctgctcgccgccggaaaaggtggacggcgcaaggtgccacaggcgttccggaacgttgaggcgggtcaggagctgggcggctttcgcggcgctcgcttcgcgcggcgtcccaagatcgagcagcggctgcatcaccacctccagcgccgaaatgcgcgggatcacccgcagaaactggctgacccagccgatggtggttttgcgcacttccagcaccttgcgtggggtggcggtgaccaggtccacccattcgtcgccgtggcggatatggatatggccgctgtccggcagataattggcgtacagcgaacgcagcagggtcgatttgccgctgccggagtgaccgtggagcaccacgcactccccggcgttaacggtcagcgaggcgtcggccagcaccggcagacgcacgccgtgctgctggtgcagaacaaaggttttatggacgttttcaacgcggatcatgttagctctcacggggttgagttgccgggtggcgcttcgcttacccggcctacgaataacgcacctgtggcccgggtaaggngcanccgccacccggcaaaacagcattaa

SEQ ID NO: 1258 - DNA, 762 bp, Klebsiella pneumoniae
tctatggcaacaaaattaaactggctgctgcaaaacagcgctcccggagatgtgatccttcagtcctggttaagccagcatgccatctctccctctctggcctttaaatacgcgcaaagtggctggttaaaaaaaagaggcaacggcgtatatgcgcgtgcgggacgtgagccggagtggaacgatgcatttgcatgtttgcaaaatcagcttgccgctccggtgtatgttgcggggctcagtagcttagtctggcagggccgttcacactatctacagctaaaacaaaaccagtgctggcttagtgtggaaaataaagcgctgctgccgaaatggttcagggaattcccgggtgtggagtggatagtcatatcggggaaaaaactgccggtgctggatgatagataccgtgtaacgcttgatataaaagggaaaaaactcatcggcagtgcgccagaactggctgcttacgagttgctgagcgcggtgccggggaccctctcatttaaccacggtgcagagcttttccaggggctggttaatcttaatcctcgtaaagtagagtatcttctttccgtcagccagtccgtgcaggccaagcgtttgtatctcttcttcgccagtttttacgagcatggctggctcaaacgaatcgatagccaaaaaatcgatctgggagcgggcaagcggcaaatcgtggaaaatggaaagttcaatgctcaataccaaatcacagtgcctgaacgctttcaaaaggaataa

SEQ ID NO: 1259 - DNA, 1011 bp, Klebsiella pneumoniae
ggcagggcaactatgagcataccgaaagagaactccgcgccggtcgcgaaatccgcttcggcgaaaaaaatgttgatgggcgacctgatgcagaccgtcggcattctgccgatcctcatcctgatcgtcgccgttttcggctttatcgcccccaactttttcacggaaagcaatctgctgaatatcacccgccaggcctcgatcaacattgtactggcggcgggaatgaccttcatcatcctcaccggcggcattgacctttccgtcggctccatccttggcaccaccgcagtggccgcgatggtggtgtcgctgatcccggcgtttgcgttgctgtcgattccggcggcgctgatgctcggcctgctgctcggcctgttcaacggcgcgctggtcgccttcgccgggctgccgccgtttatcgtcaccctcggcacctacacggcgctgcgcggcgccgcctatctgctggccgacggcaccacggtgatcaactccgatatcagcttcgagtggatcggcaatgactacctcggcccggtgccctggctggtagtcatcgccctggcggtgatcgcggtgtgctggtttatcctgcgccgcaccacccttggggtgcatatctacgcggtgggcggcaacatgcaggcggcgcggctgaccggcatcaaagtctggctggtgctgctgtttgtctatggcatgagcggcctgctctccggccttggcggggtgatgagcgcttcgcggctgtacagcgccaacggcaacctcggcgtcggctacgagctggacgccatcgccgcggtcattctcggcggcaccagcttcgtcggcggtatcggcaccatcaccggtacgctggtgggggcgctaattatcgccaccctcaataacggcatgaccctgatgggggtctcctacttctggcaactggtgatcaaaggggcggtgatcatcattgcggtgctgatcgacaaataccgtacccgacatcatcaaagtgcataa

SEQ ID NO: 1260 - DNA, 615 bp, Klebsiella pneumoniae
tggggcaaaacctctatgatacacgctattttagatgaatatagtcacgcgagaagggtggaaaatagcatgagtgcaaatgaaaacaacctcatttggatcgatcttgagatgacagggctggatccggagcgcgatcgcattatcgaaatcgccaccctggtgaccgatgccaacctgaacattctggctgagggcccgaccatcgcggtgcatcagtcggacgctcagctggcattaatggacgagtggaatgtgcggacgcataccggcagcggtctggtggatcgcgtaaaggccagcaccgtcagcgagcacgatgccgaactggcgaccattgagtttcttaagcagtgggtgccggcgggcaagtcgccgatctgcggcaacagtatcggccaggatcgtcgcttcctgtttaagtacatgccgcaactggaagcctatttccactatcgctacctggacgttagcacgctgaaagagctggcgcgccgctggaagccggaaattctcgacggttttaaaaagcagggcactcatcaggcgatggacgatatccgcgagtcggtcgccgagctggcttactaccgcgaacacttcattaagctgtaa

SEQ ID NO: 1261 - DNA, 738 bp, Klebsiella pneumoniae
ggcttgatgaccatgcacctgtccagacatccgaccagttaccccacgcgctatcaggaaatcgccgcccgacttgagcaggagctgcgccaccactatcgctgcggcgactatctgcccgccgagcagcagctggcgacgcgcttcgacgttaaccgccacaccctgcgccgggctatcgaccagctggttgagcgcggctgggttcagcgccgtcagggcgtgggtgtgctggtgctgatgcgccccatcgactacccgcttaacgcccaggcgcgcttcagccaaaacctgctggaacaaggcagcgatcccaccagcgaaaagctgctgtcggtgctgcgccccgccagcgcccatgtcgccgaggcctttggcatcaatgagggcgagaacgtgatccacctgcgtaccctgcgccgggtcaatggcgtcgccctgtgcctgattgaccactacttcgctgacctgcgcttctggccggtgctacagaccttcagccacggctcgctgcacgatctgctacgcgatcggctcgacgtcgaactgacccgcgtacgcaccaaaattagcgcccgccgcgcgcaggcaaaagagagcaagctgctggaaatccccaatatggcgccgctgctctgcgtccgcacgctcaatagccgcgagggcgagtcgctcacggcggagtactccgtcagcctgacccgcgccgacatgattgaatttaccatggagcactga

SEQ ID NO: 1262 - DNA, 288 bp, Klebsiella pneumoniae
tcgtgggtgacaattaatgacgtgaaccccagtctcttttgcagagatttaatttcatggcgcacattcaggcgcactttggcatccagattagataacggctcatccaacaccagcacctggggctctatggccagggctctcgccagcgccacccgctgccgctggccgcccgacagttcggtcactttcacttcgccaagcccttcgagattgactattcgcagcagctccgccacccgccgcgcgatatccgccccccgccatttgcgcagcttcaggccatag

SEQ ID NO: 1263 - DNA, 564 bp, Klebsiella pneumoniae
atgaaaaagacaatcgtagctgtaatggtcgctgcatctgcagtgctgagtgctcaggcaatggcaaccaacaccgctcaggtaactgtactgggtgaagtctctgatgcatctaactcttgcgtcgtgactccgacgggtaccctgaacaacggtatcgttcagctgatcactgtaaccaccactgaagcaaatgctgaagccgctggtaaactgttcaaaacccaggactttggttttgaggtgaaagactgcgcacagggcagcactaacccggttactggcgtgaccgtaaatgtaagtggcacctccagcagcgatgcaaccattctggacaacaccgccgctaacggtgcagctggtatcggtattggtatccagcgcgtcagcgatgcgcatcgcgtagccttcgacggttccgacactatgtccgaaagctactctgcaaccaacggtactcagctgaagtacaccactggttatgtaagaactaacgccgcgactccggttaccgaaggtccggttaaaggtgttgcgacctttactatcgattacaccaattaa

SEQ ID NO: 1264 - DNA, 600 bp, Klebsiella pneumoniae
aaaaatcttgccgccttttccctgctggactctacacttagcttaaaagccagcaaggagcatgccatgcgtatcctgccgataatcaccgcgattgccgtctcgttcctgtctgtcgcctgcagcacgcccgccccgccgccgggcgtcaccgtggtcagccccttcgacgttcagcgctatctgggtacctggtatgaaatcgcccgctttgaccacccttttgaaagcggtctggaaaaggtcacgatcgcctggcacccacgtgatgacagcggtctggatgtggtgaataaaggttataaccccgaccgcggcatgtggcagaaaacggacggggtagcgtactttaccggggagcccagccgcgccgcgctgaagatttccttcttcggccctttctacggcagctataacgtcattgctctggataaggagtatcgttacgcgctggtctgcggccccgatcgcgactatctctggctgctggcccgggcgccgaccatcgccccggaggtcaggcagcagatgctggacattgccacccgacagggctttgatgtcggcaaactggtctgggtcaatcagcgctatgattag

SEQ ID NO: 1265 - DNA, 396 bp, Klebsiella pneumoniae
cggcgcattgcgccttatccgggctgcctcaatggaacgtccaaacgcaaaaccccggttagcacagcgccgccggggaatggctcagtagtcatcccgttcgtcgtcttcatccggctgctccatcacgctgtaagccaccgagcagaacaggctgttcagacgcttcatatcccccagcagcgccaggtgcaacgtactggtttcgatgctctgcacgttctgctgatgcagacggtcaacgtgcgcatgcgagtagcggcggttaagaatgcggaaccggtgtttgctgcgccgcaggcggcgggcgctgggcacatcgctggagaagaagaccgacatcgccagctgcaggttgctgagcagcagatcgtacagggcgtccagctcctttaa

SEQ ID NO: 1266 - DNA, 1065 bp, Klebsiella pneumoniae
atgtacgttgccgtcaagggcggcgagaaggcgatccgcgccgctcacgccttacaggaacagaaacgacggggcgatggacggcttcccgaactgagcgtcgaacagataggcgaccagctcagcctggcggtggaccgggtgatgaccgagggcggcatcgccgaccgcgaactggcggcgctggcgctgaagcaggccagcggcgataacgtcgaagcaatatttctgctgcgcgcctaccgcaccaccctgccgcggctggcggtcagcgaaccgattaataccgcggagatgcgcctcgaacgccgcatctccgcagtgtataaagatatccccggcggccagctgctgggccccacttacgactacacccaccgcctgctcgattttaccctgctggccaatggcgaagcgccgtctgtgcagcaagccgatggcgaagcagagccgacgccgcacgtctttagcctgctcacgcagcaggggctggcgaagaccgaggaagatcgcggcacgccgcccgacgatatcacccgcaccccgccggtctacccctgctcgcgttcctcgcgcctgcagcagctgatgcgcggcgatgaaggctacctgctggcgctggcctattcgacccagcgcggctatggccgcaaccatccgtttgccggcgagatccgcagcggctacgtgcaggtggaaatcgtcccggaagagctgggctttagcgtcaatattggcgagctgctgctgaccgagtgcgagatggttaatggcttcgtcgccccgcaggaggagccgccgcacttcacccgcggctacggcctgaccttcggcatgagcgagcgcaaagcgatggccatggcgctggtcgaccgtgcgctgcaggcgccggactatgacgaagagattgccggcccggcgcaggatgaagagtttgtgctggctcacgccgataacgtcgaagcggccggcttcgtctcgcatctgaagctaccgcactatgtcgatttccaggccgaactggcgctgctgaaacgcctgcaacgggagaacgaacgtggctaa

SEQ ID NO: 1267 - DNA, 279 bp, Klebsiella pneumoniae
gctttggttgccgcgccagagattgcgttgccgccgtctgaaatatcctcaccgacaccgcgcgtggtgttacaagcggtcagtgctgaagagaggaccaaaaccgtaaagaacgctgcaatcgtttttttcaccataatgtcatccttagtgtcagttttgttttcatgccctataagcatagacaaaccgtccaaagatgaagggatctttgcgatttttaagagaaaaggagtatgcgtggaggaggctgacataccgggaggcaagcgccattaa

SEQ ID NO: 1268 - DNA, 1278 bp, Klebsiella pneumoniae
ccgcctgctgctggcggatgccgcgcagtgctggccgacaaaaagccgcgttcggctccatgtgccaacgccggccctgcatatttttcctttaccactatcacagtgatatcagcgtgttcattctggggacaatccatgttgactaagacgaaagcagcgatcgtaacgaccctcttcctgagccttggcgcacaggccgacactattcttaacgtcgccaccgcgggcgatcagaatatggtggattatgtaaaaacctggctggggccaaaatttgaagccgctcatcccggcgtcaaggtgcgggtgatcggtaccggccccggcgacgccgggtcgaataaaattagcgagaagctaacggcccagcaggagagcggcgcgcagcagtgggatatcgacgtcgcggtagtgcaccagaaggcgggcggtgagcaggtgacaaagggattgctgcaaaaataccgtcaggatattcagaccggcggcatggtgagttcgccgagcgccacccaggcgctgggcgttaacgttgacggatacgtgatgccgatgttcttaagccagaccgctatcgcctggaacagcgatctggtcactaccccgccggcgtcgtatgacgagctggtggcctggacgcagaaacacccgcaggcttttggctataacggcatcaagaacggcatgtccggcgtcagctttgtggtgggctggatctacgcctacgggaccgacgcccagcgtctctccgccgggccctatgataaaagcgtcgaaaaaggctggcagcaggcctatgagaagctaaaggcgttcaataaaaacgtaactttcaccccgggcaacgccgggacgctcgatatgctgagccggggggaaatcgccatgggcccggtgtgggtcgatatgttctatagctggaaagatcagggcaagctgccgccgtcgatcaagcttgctttactggcgccgggcatgccgggccagccgatgtattacgtcatcccgacgaaggcggcgaatccgcagctggcgcgcgactttatcgcgctggccaccagcccggaagtgcaggcgcaggggatcgtcaagcagttcaactggtatccgggcatcgacgccgggcaggtgaagccgaagctggatgcggcgacctggcaaaagctgtttgccgaaatctcgccggaagcgctggcgaagtatggcaaaagcttcccgatcgccccctactttgacgatatcaaagagggttacgaaagccaggtggctaattaa

SEQ ID NO: 1269 - DNA, 1509 bp, Klebsiella pneumoniae
tcctcttatgccgccgggggcaacgaacccggcggtgcctgtcacgctctatcaaacgctgaaggaggcgctggcgacagcgacctggaccctatgagtatttcaatgacaacaaagctcagctacggatttggtgcctttggtaaagatttcgctatcggtatcgtctacatgtacctgatgtattactacaccgatattgttggcttatcggtcggggtggttggcaccttgttcctggtggcaaggatcctcgatgcgatagccgatccgattatgggatggatcgttaactgtacgcggtcgcgatggggaaagttcaaaccgtggatcctgatcggcacgataaccaactcggtggtgctgtatatgctgttcagcgcccaccatttcagcggcggggcgctgctggcgtgggtgtggctaacctacctgctgtggggcttcacttacaccatcatggatgtgccgttctggtcgttggtgccgaccattaccctcgataaacgcgaacgcgagcagctggtgccttacccgcgctttttcgccagtctggcgggatttgtcacggccggcgtcacgctgccgttcgtcaacgccgtcggcggcgccgatcgcggtttcggttttcagatgttcactctggtgctgatcgcctttttcgtcgtttccaccctcgtcaccctgcgcaacgtgcatgaggtttactcctccgacagtggtgtgagcgaagactccagccacctctcactgcgccagatggtggcgctgatctataaaaacgatcagctggcctgcctgttaggcatggcgctggcctataacacggcggcgaacattatcgctggctttgcgatttactactttacctacgtgattggcagcgcggagatgttcccgtattacatgtcctacgccggggcggcgaatttgctgacgctgatcctgttcccacgactggtgaaagggctgtcgcggcgcattctgtgggcgggtgcttcgatcatgcccgtgttgggctgcggcgtgctgttgctgatggcgctgggcggcgtttacaacatcgcgctgatttcgctggccgggatgctgttgaatatcggcaccgcgctgttctgggtgctgcaggttattatggtggccgataccgtcgactatggcgaatatacgatgaatatccgctgcgaaagcatcgcctactcggtgcagacgctggtggtaaaagccggttcggcgtttgcggcctggtttatcgctatcgtgctcggtatcatcggttacgtgccgaatgttgtgcagtcgtcccacacgctgctggggatgcaggtgattatgattgcgctgccgacgctcttttttgctctgacgctgtttctctatttccgttattacaaactgaatggcgatatgctgcgacggattcagattcacctgctggataaatatcgccgggtaccggaaaatgacgtcgagccggaacggccgattgtggtacccaatcaggtgtaa

SEQ ID NO: 1270 - DNA, 189 bp, Klebsiella pneumoniae
agcccgcatgcctctaaccgctcagcaatactgtcccttattctcatccacctcgctcctctgatgctttcacgatatctcatggtattccgacgcgtgagtcggaataccatggtagtgttaatttatgacaaaactattcctgtgcggcgcaaggaatatattcattataataatcgctgtgcatag

SEQ ID NO: 1271 - DNA, 969 bp, Klebsiella pneumoniae
tggagcaatgcaatgcgcatttttatcgatgatggttcaaccaatatcaaaatgctgtgggagcaagatggcgaaactttcacccatatcagccccaacagttttaaacgcggctggtctgccaccttcggttcgggaaagccttttaactacacggtggatgatgaaaagtactcattcgacctgatcacccccgatgcgctcccaaccaataacattgactggcaatacagcccgttgaactccatcgctgtccatcatgcgctgctgaccagcggtcttgagccgcaggatgttgaaattgtggtcaccctgccgctgaccgaattttatgatgaagatgcgcaatatcgcctcgacaatattgagcgcaagaaaaagagcctgctgcgcgacgttaaactgaataaaggcgtggtgttcaatatcactaaagttaccgtgcgcccggaatcgattccggcgggcattagcctgtgtgatgagctgaaaccgtcgcattcggtgctgattatcgaccttggcggcaccacgctggatatttcaatggtcgccgggcagatgacctcggtttcgcgcatttacggcgacccgaagctgggcgtatcgctggtgaccgacgccgttaagctggcgctggcccgggcgaataccgacacctccagctataacgtcgaccagataatcatcaaccgccacgacgaagaatacctgaccgacaacatcaacgatccggatgcggtttctgaggtgaagaaggtgatcaataacagtatcgaacgtctgaccacgcgtgtcctgacggccatcgatagctttaaatgctattcgcacgcgatcgtcattggcggcggcgcgccgctggttgccgacgccattcgtgaacggatgggtctgcgcgaggatcgtttcgtggtggctgaagagccgcagtttgccctggtgcgtggtctgaaaattattggttaa

SEQ ID NO: 1272 - DNA, 207 bp, Klebsiella pneumoniae
cccctgggtgcgacgagctaccgatttagcgcgaccaacacaataatattaattacaatcatcactacaattagcgcgattaaccatatgggtattttaaaagtaacatgcaaccgctcagatgctttttcaccttcttccggtttatttgccatcaaatcactgccatgctttgatgagttttctattagtggaagatttaaatga

SEQ ID NO: 1273 - DNA, 258 bp, Klebsiella pneumoniae
ccacctaccgcagccgctacaacccccgctatcagtcgcttattcaccccgcctcccgctgatttccacggtcgcattcatctcggtgatgaacggcctgtagccgtatttcacatagcgctgcagcacaaaccagatccggaaaattcggccctgatgaaaaacagggttcaggatatccgcgtcatcaagcccgaagtggtcctgtacccggtagtgtactttcgcccggtagctgtcgcccgtcacctccagtga

SEQ ID NO: 1274 - DNA, 1185 bp, Klebsiella pneumoniae
ccccgccacgcacatgcgtccgctggcaatcaggtagacgccaaactcatcgcgcagacgatccacctgcgccgcgctaaatccggtatagctgaacatcccgcgctgcttgagcaggtaatccactttgctgcccggggcaacctgctgcagcgcgtcgaccagcgcctggcgcatggtcaggatgtgcgcgcgcatggcgtccacttccgcctgccacgtggctttcagcccggcatcgttcagcaccgtcgccaccacctgcgcgccaaagctcggcgggctggagtagttacggcgcacggtggccttcagctgccccagcacgcggcccgcggtttcgctgtcttcacagaccacggacagaccgccgacgcgctccccgtacagcgagaaaattttggagaacgagttgctgaccagcatcggcatcccggcgctggcgatggcgcgaatagcgtaggcatccttttccagccccccgccaaagccctggtaggcgatgtcgaggaaggggatcagctgacgcgctttcaatacctcaaccacgcggtcccactgggctggcgtcaggtcggcgccggtcgggttgtggcagcaagggtgcagcagcacaatatcgcgggccggcagcgtttgcagcgtcgccagcaggtcctcaaagcgcacgccgttggtggctttatcaaaccaggggtaagtacttacttcgaagccagccccttcaaaaatggcgatgtggttttcccaggtcggatcgctgacccagacatgagactcaggaaagtaacgtttgaggaagtcggccccgaccttcagcgcgcccgaaccgccgaccgtctgaatagaggcaatgcgattttgcttaagcgcggtatgctctgcgccaaacagcagtggcgcaatcgcctgacggtagccgctcaacccttccattggcagatacagcgaggcgccatgcggctcggcgttcaggcgtgcttccgcttccgccaccgcctgcagctgcgggataatgccgtcatcgttgtagtacagcccgatactcaggttgactttgtcgcttcgcgggtcttctttgaagcgttccatcagagaaagaatagggtcgccggcgtaggcgtcaactttttgaaacacgcgatgtatctccaggtttacatggggcaggttcttacacaataa

SEQ ID NO: 1275 - DNA, 225 bp, Klebsiella pneumoniae
aggcttaacgccagctatgtcaacgctgcggttatgcggatttttcatgcctctgcggctaacagaaaaaagccttatgatagctatactaatggggctttttactccgttttgacccgattcctgaccggcgtcagggtcaagtcacaaaaatcatcacaattttccgtcaccggcgctacaatcgaccgaagtcacaatctcaaatcagaagagtattgctaa

SEQ ID NO: 1276 - DNA, 591 bp, Klebsiella pneumoniae
aaagttaacgcatcccgattgatcgaacagatgcgaaacactgatcgaacttcaattctaatccatgatcgctcagagcggaatgagcaaccagatacactaaaaggatttaccatgtcacagcaatacaccaatgaactgaccactgatgtactggaacggctgcgtcagccgccatttaccgatgagtttctgtcagaacttgagccacagtcgcgtcagtcactcgtcgcagaaatggaatcaatgttacagcgccctgttctccatattttccggggtgcaacgattggtagcctgacccgtcatggtggcgtgatccgtgagacatccggcaaaagtacccttgacgggcattattctgcgcgggtcggagataaagttgtgtatccggatggacgtgaggcgaccattatttgcggagccggtaaaggtcgggtgatgcagggggaatcgatggcgctcgtgggcagcatgctggataacggtgatgaaatcatttcgacacctcaggggtgtcagatgtttgtattccgtgagggcgatgcactgccggatggctttttaactgtgccgggagataagcactga

SEQ ID NO: 1277 - DNA, 354 bp, Klebsiella pneumoniae
gaccagagcgctatgccatcgtcagtcgcgccaggtcgtccatggctcccgactttctttgaggataggttaatggcttccattactaccagtgtcgtattattgcgctggcccctggtgagcgcggtactgatgtttctcgccagctcactgaatattcagcttcgcaaaagcgattacgccggtctggcggtgatctgcagctgcctcggcctggccgccgcctgctggttcgccaccggtttgctcggtatcaccctgcttgatatagccaaaatctggggcaatatcaaagatgtgatgattgaagtcatgagtcagacgccgccagagtggccaatgatgatgacctga

SEQ ID NO: 1278 - DNA, 804 bp, Klebsiella pneumoniae
ttcaccggcgcacgtcgccctttgttatctgagagcaggactatgacggaagcacaacgagagtcattatgcgccttgattcgccaggcaggcgcccacgcccaggcgctgcgcgatgcgggattacaggtcgataaaaaagcgcgccaggactttgtgtcgcaggcggatctcgcggtagaacaagagattaaaggctggctgcaggcccactttcccgaggagggtttcctcggcgaggagagcggttttgaaggcgacgaccataccgtctgggtgctggatcctgtcgatgggaccaccaactttatcctcggcatggattactggtgcatctcactggcgcgagtgtgccagggcgagctgtcgctcggcatcatttacgcccccgatcgcgatgaatttttcttcgccgcccgcggcgaaggcgcgtatctcaacggtcggcgcctgacgctacgcgagccggagcccgatgcggtggtgatcggcatggggcgctccagccgggccccggccagcgactacgcccgggccatcgacacgctgctcgacgccggtctggagtatcgccgttttggcgcgggcgccctgatgctggcgcatgtcgccgccggtcagctccacgcctattatgaagcgcatatgaacagctgggatgcgctggcaggcatgctattgattgaggaggcgggcggaacgtgcaatgcgtttctcgccaatgcgggcctgcggcgaggcaacctcgtgctggccggctgcgcaagcgtccagcctcgactggccgccctgctggcgaaatga

SEQ ID NO: 1279 - DNA, 375 bp, Klebsiella pneumoniae
cccggctcagcgtggcgcaagccgggaacatcctcttcgcgttatcccgcggtgcgatggttaaaaattccgaataacgaatcgacgccagcattctcatctatagttaataccatgtccggcacaaaacgggctgtaaacccaccgaatgatgaggacgttattatgaataaagacgaaatcggcggtaactggaaacagtttaaaggtaaagccaaggaacagtggggcaaacttaccgatgatgatatgaccgtaatcgaagggaagcgcgaccagctggtcggcaaaattcaggagcgttacggctatgagaaagatcaggctgagaaagaagtctcagactgggagcataagaacgactatcgctggtag

SEQ ID NO: 1280 - DNA, 510 bp, Klebsiella pneumoniae
agatgtccagctggcgttcggtggcgccgcaggtcggctcatcggcgcgcgcgaagtggctcaccacgttcaccggctggcggacgtttttacactggctcagacgctgataaaacgcctcggcttcctccgggcgcactcctaagcgatgcatgccggtatccagcttcatccacacggtcaccggctcggggagatcggcttgctccagcgccgccagctgttcggggctatgcaccgccgtatgcaggcgctgggcggcgatcaccgccaggtcttccgcagcaaaaaagccttccagcaggaggatcggctgggcgatgccccccgctcgcaggcgcagcgcctcttccaggcgggcgacgccaaaggcgtcggcgtcggtcagcgttcgcgcggtctcgagaagaccgtgtccgtaggcgttcgctttcactaccgcaaccagtttgctggcgggcgccagttcacgcagacgttgcaggttgtgtcgcagagcgcggcggttga

SEQ ID NO: 1281 - DNA, 828 bp, Klebsiella pneumoniae
cagcggccagcggatgtttgtctgctccgataccgactattgccgccagcagagcgaggggcagaaaaaatgaaccagccattacttgctgtgaataacctgacccatctctacgccccggataaaggttttcgcaatgtctccttcgagctgtggccgggagaagtgctcggcatcgtcggcgagtccggctccggtaaaaccaccctgctgaaggcaatctccgcccgcctgacgccgcagcagggcgaggtgctgtaccagcagcgctcgctgtacgccatgagcgaagccgaacgccgccgcctgttgcgcaccgaatggggcgtagtgcatcagcacccgatggacggtctgcgtcgccaggtctccgccgggggcaacatcggcgaacggctaatggccaccggcgcccgccactacggcaacattcgcgccaccgccgaaaagtggctgcaggaggtggagatcccgccctcgcgcatcgacgacctgcccaccaccttctccggcggcatgcagcagcgtctgcagatcgcccgtaatctggtcacccagccgaagctggtgtttatggatgaacccaccggcgggctggatgtgtccgtgcaggcgcggctgctagacctgctgcgcggcctggcggtggagctgaatctggcggtggtgattgttacccacgatctcggcgtcgctcgcctgctggcgaaccgtctgctggtgatgaagcagggccaggtggtggagagtggcttaaccgaccgggtgctcgacgatccgcaccatccttacacccagctgctggtgtcgtcggtgttgcagaattaa

SEQ ID NO: 1282 - DNA, 861 bp, Klebsiella pneumoniae
atcatgaaagcgctggccctcgtatcaaccccggcatggtgggtgaaagggcgccgtaaagtgcgcgccagtccggtgctgcagaccctgctgctgttgtttatgctgctggcgatgtttggtccgctgctgaacctgttgatctggaccgtagcggaaagctggtattttccccattcgctgcccagccggtgggggctgaagtactggtatcaggttttcaatccatacagcgatgtctccagctcgctgttaaccagcgtgctgatcgctctgttatcggtgggggtctgtttgctgatttccgtacccgccggctatgcgctttcccggcggaaaatgccattacggatgctgttcatgctgctatttcttatcccgcaggcctttcctaacctgacggtatacatgaatgttgccagattgttttatcagtggggattgaacggcagtatcgcaggggtggtgctggtgcatagcgtccacggtctgatgtactcggtgtggatctgtgtggccgcgttttcagccatcgacccgctgctggcgcgggcatcgcgtaacctgggcgccgggccggtgtataccttctggcacattgtgctgccgcaggcggcgccggggatcgttgccgccagcatctttgtttttctggagtcgctggatgagtttaccggcactttcttcgtcggggcgccggatatcaccacgctgccgctgctgctctataacgccagcatgtcgggtaactatcaggtctcgtcgattaccgcgctgattttgctggtcccatcgctgctctttatggtggtgatccataaatttatgcgtccggagatgatggcgaaattagggaaataa

SEQ ID NO: 1283 - DNA, 438 bp, Klebsiella pneumoniae
ataactggagcaagaccgatgaaaaaagtcgtcacggtttgcccgtattgcgcatcaggttgcaaaatcaacctggtggtcgataacggcaaaatcgttcgggctgaagcggcgcaggggaaaaccaaccagggaaccctgtgcctgaagggctattatggctgggacttcattaacgatacccagatcctaacgccgcgcctgaaaacccccatgatccgccgtcaacgcggcggcaagctggaagccgtctcctgggacgaggcgctggattacgtcgccacccgcctcagcgccattaaagccaaatatggcccggatgcgatccaaaccaccggctcctcccgcggcaccggtaatgaaaccaactatgtgatgcaaaaattcgcgcgcgccgttattggtaccaataacgtcgactgctgcgctcgcgtctga

SEQ ID NO: 1284 - DNA, 2337 bp, Klebsiella pneumoniae
ggcaagtattttatcccattgttttttcaattggggaaggcgttatgcccgacagcaacagaaaacagggcatattctatgaaatacacgtctcacttcccgctggggatcgtcattcctctgctcgcctgtagcgtgccgctgcaggcggcagagaacatgaccgaacaatcgacgcctgacgagagcgccgccactgccgaaaatcacgaggagacgatggtcataaccgccgccaggcagaacctgcaggcgccgggcgtgtcgaccatcaccgcagaagagatccgcaaacatccccccgcccgcgatgtgtcggagttaattcgtacgcagcccggggtaaacctgaccggcaactctaccagcgggcagcgcggcaacaaccggcaaattgatatccgtggcatggggcccgagaatacgctggtgctggtcgatggtaaaccggtgaccagccgtaactcggtgcggtatggctggcgcggcgatcgtgactcccgcggcgataccagttgggtgccagcggagatgatcgatcatatcgatgtgatccgcggcccggcggcggcgcgctatggtaatggcgcgatgggtggggtcgtcaacatcgtgaccaaaccgaccacaccagaatggcacgggtcgtggaatacctatatgaacgctccgcagcaccgtaaagaaggggcgacgaaacgtactaactttagcctcaatggtccgctgtcggacagtgtcagcttcaatctctggggtaatctgagtaaaacccaggccgatgcgcaggatattaacgccgggcatgaagcggaacgtaccggttcctacgccggttcttatcccgccggacgtgaaggggtggtgaacaaagatattcacagtaagctgcgctgggagtttgccccgatgcaggccctggagtttgaggccggttacagccgccagggtaatctctatgccggcgacacacaaaacaccaataccagtacgctggtgaagagtatgtacgggaaagagaccaaccgtctctaccggcaaacttacggcgtaacatggaccggcggctgggataatggcgtgaccagcaatagctatgcccagtacgaacacacccgtaactcgcgaatggatgaagggctggcgggcggtacggaagggatcttctccagtagcgagttttcagatatcgatctggccgatgtcctgctacatagtgaagtgaatattccgtttacgctgggggtcgatcagaatctgacgctggggacagaatggaatcagcagcggatgaaagatggcgtatcgacaacccaggcgctctcttacggcactatcgatggcgtatcggctaccggtcgtagcccgtactccagcgccgagatcttctcgctgtttaccgaagataatatggcgctaacggacagcaccatgctgacacccgctctgcgcttcgatcaccacagcatcgtcggcaataactggagcccctcactgaacctgtcccaagagctgacggacgactggacgctgaagctgggcattgcccgcgcttacaaggcgcctaacctctaccagttgaacccgaactatattctctacagcaacggtcaaggctgttacgccagtagttccgcctgctatctgatggggaatagcgatctgaaagcggagaccagcgttaataaagagattggtcttgagtacaagcatgatggctatcaggcggggatcacctggttccgtaacgactatcacaataagattgagtcagggtatgcggcggtgggtactgccagcaacggcaccaccaatatctatcagtgggaaaacgtaccaaaggcgttagtggaaggcctggaaggaacgctgaatctgccggtgggggaggcggttaactggagcaataacctgacctggatgctgcagagcaagaataagacgaccggcgaccggctgtcagtgatcccgcagtttaccctgaactcgactttgagctggcaggttcgtgaagatctctccctgcagagcacctttacctggtatggccgacagaaaccaaaacgcttcaattataagggcgaggcggtcagcggcagcgaactaaacgaagtcagcccatacagcattgtcggcctcagtgcgacctgggatgtgaacaaaaatctgagcttcaccagcgggatagataacctgtttgatatccgccactaccgggcagggaatgcgcaaacgaccggcaacgcgacgacgggagcttatctgtatggcgcgggtgccgagacctataacgaatcggggcggaccttctttatgagcgttaatactcatttctga

SEQ ID NO: 1285 - DNA, 1305 bp, Klebsiella pneumoniae
gcgccgctggccagctggaacgccgcctcgcccgcgcgctgcatgagttcgaacagcgtcagccccaggctgtccgccgcctctcgttcggccaggcgcagcgcctccgcaggccaaatgttgtatggtatactgtcagggtttttcgtcattgtatggtccatcatgtcacagcccctcgatctcgttcagttagcgcaacaaatcaaacaatggggcacagagcttgggttccagcaggtggggatcgccgataccgacctcagcgccagtgaacccaaactgcaggcatggctggataaacaataccacggcgaaatggaatggatggcccgtcacggtatgatgcgcgcccgtccccacgaactgctacccggtacgttacgcgtcatcagcgtgcggatgaactatctgcccgctaacgccgcctttgcccgcaccctgaaagatcccacgctgggttacgtcagccgttatgccctcgggcgtgattatcataaggtgctacgtaatcgcctgaaaaagctgggggagaagattcaggaacagtgtgcttcgctcaattttagaccttttgtcgattccgcgcctatcctggaacggccaatcgcagaaaaagcgggcctaggctggacaggtaagcactcacttatcttaagccgcgacgccggatcgttctttttcctcggcgaactgctgattgatctgcccctgccggtcgacagcccgatcgcggaggagtgtgggcgctgcgtcgcctgcatgaccatctgtcccaccggggccatcgttgagccctataccgtcgacgcccggcgctgcatctcctatctcaccattgaactggaaggtgcaatccccgaggagttccgtccactaatcggcaaccgtatttacggttgtgatgattgtcagcttatctgcccgtggaaccgtttctcacagctcaccgatgaagaggatttcagcccacgcaaagcgctgcatgccccgccgctggtggagctgttcgcctggagcgaagcgtggtttctgaaggtgaccgaagggtcggcgattcgtcgcattggccacctgcgctggctgcgcaatatcgccgtcgcgttgggcaatgcgccctgggatgaagcccatcttcgcgccctggagagccgccggggcgagcacccgcttctcgacgaacacattgagtgggcgattgcccagcaactgaaaaagcggaacgccgacgccgttgaagtacagctgccgaaaaaattacgtctggtcagagtggtagagaaaggcttgccgcgcgacgcctga

SEQ ID NO: 1286 - DNA, 1242 bp, Klebsiella pneumoniae
gcactgatggcgctggaaggctattttcttttccagggagatcgtaccgtctgtggcggtaaaattatcaccggtgctgaagacaccgaatttttcgggcgatcacaggcgcgggaaagcgataaagtgacctgcggaaaacatccggggatctaccgtatttgtggtggcatgggcgacatgtacgaagtaggcggtgtaaaccgccagctagcaggctccatcgaaagttacagctcctgcccgtgtcgggcgaaattcattccgcaagatttggataacacctacgaatataactgcaatgccgggctggctgccgaacgggagagggaagccagcaggaaaaaactgaatgaggcgaaggctaaagggcctgagccaatgccccttccggcgctgatttatgccacgcacagggcaatggatgactacggcgcaaaggacatgcaccacggtgatctgagcgaggaagcactgaaagagcgctttggtctgacggacgtctcggcgaaagtgaacccgtatacgctgacccttgtcccaccagcgcccgccagttcgtatggtgtattttatccgggcagcctgacgggaagtacgccggtcgtggtcagccgggaggaaagtgtccggctgatgtttgatgagttccggggacttgccaaggtattctccttccatggcccatataaaaacatcatcaccgacatgattaatcatatgcaggggaacagcggcacaccgtacagcagcccattactggacagggcgctgaaagagcagatcctgaatgaccattcgagtgatagctcgttgttggggattaaaacggccttggatgatgctgttagctacgaatatggatttcttcctctcggtaaaaaggacgatttattcgacggaaagggcaactttaaggaagttaataaagctgttctacctaaatttgatcgtcagatcgataagactaatgggctggtgattaccgtccatgatacgtggtcgacgcatatcacgctcgagtcactggaggtgacgggcgacagctaccgggcgaaagtacactaccgggtacaggaccacttcgggcttgatgacgcggatatcctgaaccctgtttttcatcagggccgaattttccggatctggtttgtgctgcagcgctatgtgaaatacggctacaggccgttcatcaccgagatgaatgcgaccgtggaaatcagcgggaggcggggtgaataa

SEQ ID NO: 1287 - DNA, 213 bp, Klebsiella pneumoniae
  unsure (122),(154),(168): Identity of nucleotide at the above locations are unknown.
acccgcccggcgtggtgggtctgttcccgggccaaccgcgtgggcgacgatattgaaatctatcgcgatgaaacccgcacccacgtgctgacggtgagccatcatctggcgccagcagacgnagaggttgggcttcgccaactactgcctcgcngattttgtcgcgcngaagctgagcggccaaggcggactacatcggcgcgttcgccgtga

SEQ ID NO: 1288 - DNA, 1356 bp, Klebsiella pneumoniae
tccttcacctatgagcctggggagccaggaaattatatggagcatctgcacatgaaaacccgtacccaacaaatcgaagaattaaacaaagaatggacgaacccgcgctgggaaggcattacccgtccctacagcgcggaagaggtggtgaagttacgcggctcggtgaatccggaatgcacgctggcgcagcttggcgcggcgaaactgtggcgtctgctgcacggggaggcgaaaaaagggtacgtcaacagtctcggcgcgctgaccggcggccaggccttgcagcaggcgaaggcgggtatcgaagccatttatctctccggctggcaggtggcggcggatgctaacctggcgtccagcatgtatccggatcaatcgctgtatccggccaactcggtaccggcggtggtggatcggatcaacaacaccttccgccgcgccgatcagatccagtggtcagcgggaattgaaccgaacgatccgcgctttatcgactacttcctgccgatcgtggcggatgcggaggccggttttggcggcgtcctgaacgcctttgagctgatgaaatcgatgattgaagccggtgcagcggctgttcacttcgaagatcagctggcatcggtgaagaagtgcggccatatgggcggtaaagtgctggttccgactcaggaggcgattcagaagctggtggcggcgcgtctggcggccgacgtgatgggggtcccgacgctggtcatcgcccgtaccgatgccgacgccgcggatttaattacctcagactgcgatccgtacgatcgtgagtttattaccggggatcgcaccagcgaagggttcttccgcacccacgccgggatcgagcaggcgatcagccgcgggctggcctacgcgccgtatgcggatctggtgtggtgtgaaacgtcgaaaccggatctcgagcaggcgcgccgctttgccgaggctatccatgcgcgtttcccgggcaaactgctggcctataactgctcgccgtcgtttaactggaagaaaaatcttgatgataaaaccatcgccagcttccagcagcagctgtcggacatgggatacaaataccagtttattactctcgcggggatccacagcatgtggttcaacatgttcgacctcgcccatgcctacgctcagggtgaggggatgcgccactatgttgagaaagtgcagcagccggaattcgccgccgggccggaaggctacaccttcgtctcgcatcagcaggaggtgggcaccggctacttcgacaaggtcaccaccattatccagggcggtacctcgtcggtaacggcgctgaccggctcgaccgaagaagagcagttttaa

SEQ ID NO: 1289 - DNA, 1386 bp, Klebsiella pneumoniae
cgcctgcctctgcgcagcgtcatctgttgcgtgacgctgcgacgtttttcctcaatcaggtcctcaaacatgctgctcaacgctgccgataaagcgctgtggcgtcttgccctccctatgattttctccaacatcaccgtcccgctgctggggctggtggatacggcggtgatcggccacctggacagcccggtatacctcggcggcgtagcggtcggggcgacggccaccagtttcctcttcatgctgctgctgttcctgcgcatgagcaccaccgggctcaccgctcaggcctggggcgccaaagatccgcagcgcctggcgcgggcgctggtgcagccgctggccctggcgctgggcgccggggtgctgattatcctgcttcgcctgccgctaattgacctcgctctgcatattgtcggcggcagcgaggcggtgcttgagcaggcgagacggtttctcgaaattcgctggctcagcgcccccgcctcgctggccaacctggtgctgctcggctggctgctgggcgtccagtacgcccgggcgccggttattctgctggtggtgggtaatctgttgaatattgtgctcgatctgtggctggtgatgggcctgcggatgaacgtccagggagcggcgctggccacggtcaccgcggagtacgccaccctcattattggcctgctgatggcgaagcgggtgctgacgctgcgcggcgtgtcgctggcgatgctgaaaaacgcctggcgcggggatctgcgccgtttattggcgttgaatcgggacatcatgctgcgctcgctgctgctgcagctgtgctttggcgcgctgaccgtattcggcgcccgtctgggcagcgacatcgtggcggttaacgccgtactgatgaccatgctgacctttaccgcctacgcgctggatggctttgcctatgccgtggaggctcactccggccaggcttacggcgcgcgcgacggtagccagttgctggaggtgtggcgggcggcctgccggcagtccggcatggtggcgctggcgtttgccctgatttacagcctggcggggcagtacattatcgcgttgttaacctcactgccttccctgcagcagctggccgatcgctatctgatctggcagacgatcctgccggtggtcggcgtctggtgctatctgctggacggcatgtttatcggcgcgacgcgcggcgctgagatgaggaacagtatggcggtcgccgcggcggggtttgccgtgacgctgcttacgctaccggtgcttggcaaccatggtctgtggctggcgctggcggtgttcctcgccctgcgcggcctgtcgctggcgctgatctggcgtcgtcactggcgacgcggcacatggtttagttag

SEQ ID NO: 1290 - DNA, 735 bp, Klebsiella pneumoniae
ttgatagatttagggataaatatgcgcaaacttactctcgcccttgcggcggcttctctcctgttcacgctgaacagcgccgttgtggcacgcgcctccacgccgcagccgctgtgggtcggcaccaacgtggcccagctggccgagcaggcgccaatccactgggtttcggtggcgcaaattgagaacagcctgctggggcggccgccgatggccgtccgctttgatatcgatgacaccgtcctcttctccagtccgggtttctggcgcgggcaaaaaaccttctctcccggcagcgaggattacctgaaaaacccgcagttctgggaaaaaatgaacaatggctgggatgaattcagcatgccgaaagaggtggcgcgccagctgattgcgatgcatgtgaagcgcggggacagcatctggttcgtcaccggccgcagccagaccaaaaccgaaaccgtttctaaaaccctgcaggatgattttctcatcccggccgccaatatgaatccggtgattttcgctggcgataagcctggccagaacaccaagacccagtggctgcaggcgaagcagataaaggttttctacggcgattcggataacgatatcaccgccgcccgcgaagcgggcgcccgtggcatccgcgtgctgcgggccgccaactcctcctataagccgttgccgatggctggcgcgctgggcgaggaagtaatcgtcaattccgaatactga

SEQ ID NO: 1291 - DNA, 972 bp, Klebsiella pneumoniae
caacaacatcttacctgcgaggaaaagcgaatgcgtttaaaaccgatagtcaccgcgctgtgtgctggcgcgctgctggccgcctccccttttgcgtcggccaaagagctgaaagcgattggcgtgacggtgggcgaccttgccaacccgttctttgtacagatcaccaaaggggcggagctggaggcccgcaaactggcgggggataacgtcaaagtgacgctggtctccagcggctacgatttgggccagcaggtggcgcagatcgataactttatcgccgccaaagtcgatatgatcatcctcaacgccgccgattcgaaaggcattggcccggcggtgaagcgggccaaagaggccgggatcgtggtggtggccgttgacgtcgccgccgaaggggccgacgccaccatcacctccgataacacccaggcgggcgagctggcctgtaaatacattagcgaccgcctgaacaacaaaggcaacgtggtgatcatcaacgggccgccggtctccgccgtacaaaaccgcgtcgaaggctgcgaaacggagttcaaaaaacacccggacattaaaatcctctccgccaaccagaacgccaaaggcagccgggaaggcggcctggaggtgatgacctccctgctggcggccaatccgaagattgacggcgtgttcgcgatcaacgatccgacggcgattggtgccgatctggcagcgaaacaggcgcagcgcagcgagttcttcatcgtcggcgtcgacggcagcccggacggcgaagaggcgctgaagcgtaagaactcgctgttcgtcgccaccccagcgcaggacccacaggtgatggcagcgaaggcagtggagattggctacgacatcctgcagggcaaacctgcgccgaccgcgccggtactgatcccggtgacgatgatcgacaaaaataacgtcagctcttacaaaggctggaccgtgaaataa

SEQ ID NO: 1292 - DNA, 270 bp, Klebsiella pneumoniae
gtaaatcctcaaagcgcagacgctgcacgcgcagctgcgccatttccgtatccagctgttgcgggcgagggcgctccggcagccgcgccacctgggcgcgcagggcttcgcccagcagattggaggagcccagccactgcgactgctcgcgcagggtgtttaacgcctggcgcacctgcagcgtttgattcgtcgcctgccgctgctgggacgccaccagatccatgcgctgcgcctgctggttcagcgcctgggagagttcacggttga

SEQ ID NO: 1293 - DNA, 1317 bp, Klebsiella pneumoniae
cagcgcgatcagcatcagcagggagcgcacaagccgcagcgactgggtactgatggcatcgaggtcgacctcgctgacctccgtctccaccgacccttccgggctgctgacgtgaacgggctcatcttcgccgcgggcgcgctgagcgagaatttccgcgcgacgatggcgggcccggtcgaaggccagccggcggcgctggatcagcatccagcggcggatgatgtgatagaccaccagcagcaggaaccagatggcgaccgaggtttccagacgcgcaagcagcgcctgggcggtggcgaggtagccgacggcggccgccagcatggccaccagcggggcgccaagcatcaggttccacagcaggcggttcaccatattgtcgccattcccctctttatccagatagagcggaataccggcgtgcttaaggctcagggtgaccaccgccagcgcgccgcagatcagcaggaagcacaggcggcccagcgaagcggagaattcgcggtcgttaagattatcgaacatgatcagcgccataatcagcggcacaatcagcccgatgctcatcaggtagtagcgcatcgccttcgccacgcggctacgcggccagccgaagtgggcgataaacagcccgtttggccgggcgaaggtggcgcagatcatcaccacccacagcaaaggcaccgtcgcggtgactccatcgccaatcgccaccgccagcgggaacggccaggcggactgcagaccatagccgagcgtcatccacagcaccggcagcggcgaggccaccagtatcgaccagaagaccgtgcgcagcgtcagccagaagtgatcctgggtgactttccccacccgggcgctggagcgctcgagaaagcgggtgaaatggcgccgcgagctgatgctaaagccaaccagcagcagggcggcaaacagcggcagcagggtctctttgctggtaagcatcatcgcgctggctttgcccagttcgctgatggtatccagggagatcaggcgccgcagatcctggacgatctccagcggccaggagaagccgatggggctgacgtccgaagtccagaacagatagcggtgggtggcttcgttgatctctttcagcgcgtcttccagctggccgttggcgaccttcagcttggtgagctccagcatcagggtgtcgccgccgcgcagcagcgagttcagcagctcgttctgcgtgcgcagctgcgcctgcaggatcttgttctgctcgctggtcagcggttcgccgtcggcctggcggatctgccgcagctgcggctgcttactgagtaa

SEQ ID NO: 1294 - DNA, 678 bp, Klebsiella pneumoniae
gcggcgagtcaccggctttatggatgccgcggcattcagcgcccatttgcgcgattggcaagcgtgagcgacactttaggaggaaagatggaggagaacaccgtgctacgtgaagacgtcctggcagaagccattaagattcttgaaattgaaggtatcgccaacacgtcgctggagatggtcgctgagcgcgtgtcctgcccgacgagcgacctgaaacgcttctggcctgaccgcgaagcgctgctgtacgacgcacttcgctatctgagccagcaggtggatgcctggcgtcgtcagctcctgctggacgagaccttaagcgcagagcaaaagctgctggcacgctatgccgcactcaccacctgcgtaagcaaccagcggtacccgggctgcctgtttatcgccgcctgcaccttctacccggatcctcagcaccccattcaccagctggcggaacagcagaagcaggcttcgctggcctacactcacgagctgctgactcagctggaggtggatgacccggaaatggtcgccaagcagatggagctgattgtcgagggctgtctgagccgtctgctggtcaaacgtagccagacggatgtggataccgcccggcggctggctgaagatattctacgcttcgcccagtgccgtatgggtggcgccttgacctga

SEQ ID NO: 1295 - DNA, 894 bp, Klebsiella pneumoniae
acctttttccagcccgggccgccgtcccgggcgcttgcttgtgctgacgccaggtttattatgtccagttcaataaaatatctgctgctggttgccccagcggcgctgatgatcgcgatcctgtttttgtatccgctggggttttcgctggtctcggcgtttaccgcgccgggacagccgttcaccctcgatcacttccgcaaggtctatgcgctctacgccagcgatgtgctcttttcgctgcttattgtgctgatctcggtggcgctgttagcgctgctcgccattaccctgtcggcagtgattgcgctgtcaccctgccgacccgttgtgcgtctgctgggttttttgtatcgcctgccgctgtttattccttttatcgttgttgcccagatgatgcgcacttttctcgccaaaaatggcctgatgaacaatgcgctggtggcggccgacctggtcacgccgctggagacgctctcctggctgggatggaaagggatagtgatcacctttgtctggaagcaactggcctttgccacgctgctgatctgcggggcgatggcggcgctggagtcgtcgcagatccttgctgcacgtaatcttggcgcctcccggccgcggatcctgttcgatatcatgctgccgcaggtcctgccgactatcggcgtggcgctggtgctgtcgacggtgaccatgatgtcggtgctgtcggtaccgttgatgatcggcgtggggaccccgacgatgctaaccgtggatatggcgtttcgcgtcaattcctatggtgattacgcggtggcgaatgcgcttggcgtggtgtcgctggcgatctgcggcgcgctgtcgtggttttacctgcgccacagcctgcagcaaaaaggcggtgaatcatga

SEQ ID NO: 1296 - DNA, 204 bp, Klebsiella pneumoniae
cgccttccccaattgaaaaaacaatgggataaaatacttgcctcagcgcgtcgccagattttggcgcaggtcagcgccttcccggcattaatgggaataaaaaaaagcgtgaggcataataaaattaagtgccctgtttcatcattagagaaaaagcgctgcgcgctattctttgatagcgtaatccagacagcgtgtcattag

SEQ ID NO: 1297 - DNA, 732 bp, Klebsiella pneumoniae
ggccatccccatcccgtcaccggtgacgatgccgccgttggtgttgtagcggtagacgcgcccggcgccgccggtagccagcaccacggcgttagcgcggatctgcaccagggtgccttccatcatattcatcgccaccaggccgcgggcctgcccgtcatcgaccagcaggtcaaggacgaaatgttcgtcaaagcgctgaatttggggaaactgaagggaggtctggaagagggtatgcagcatgtggaagccggttttgtcggcggcaaaccaggtgcgttcgattttcatgccaccgaagcgccggacgttgacgctgccgtcggggcggcggctccatgggcatccccactgctccagctgggtcatttccgtcgggcagtgatgaacaaaatagtcgacgacatcctgctcgcacagccagtcgcctcccgcgacggtgtcgtgaaaatggtactcaaagctatcgtgatcctgggcaacggctgcggatcccccttctgcagcgaccgtatggctgcgcatcggatagactttagaaatcagggcgattttagcgttggggttggcctgagcggcggcgatagcggcacgaaggcctgccccgccggcgccaattacggcgagatcggcttgaaaagtttgcacgacattcctccagttttagtgtatttcgccgccgggctggcgaaaaagtatcactgctcctttataggtacaggagtatag

SEQ ID NO: 1298 - DNA, 2478 bp, Klebsiella pneumoniae
gctcaacgccagcagaacactgctattgctcattatctcgtagacgacacattcatgttaaaaaagactcatatcatcagcggattattgatcgcccctttaacgttatatgccgcaacatcatatcaagttgatgatatccgttttgaagggctacagcgcgtgaccatcggggcggcgctattaagtatgccattgcacgcgggagatgcggtgacgccagaagatgtcagcgaggcagtgcgcgcgctgtatgcgagcggcaatttcgaaaatgtgcagatcctgcgcgatgggaaaacgctggtggtgcaggttaaggaacggcccactattgccagcgtcagtttttccgggaataaggcagtgaaggatgatgcgctaaaggaaaatctcaccgcgtccggtatttctgcaggtagcgcactggacagaaattcgcttagcgaaatagaaaaggggttgcaggatttctattacagcgcggggaaatacagtgcgcaggttcacgcggtggtgaccccgttaccacgtaatcgcgttgacttaacgttcgtctttcaggaaggcatctcggcgaaaatcgcacaaataaacattatcggtaatcaggcgtttcgggaagagacgctcctggaccagcttcagctacgtgataatgtgccgtggtggaacgtggtagccgataaaaaataccagaagcagaagctggaagccgatctggaaacgctgcgcagtttttatctcgatcgcggctatgcgcgctttgctatcgagtccacgcaggtcagtatgacgccagataaaaaatccctgtatatcactatcgccctcaatgaaggcgaacgttatcgggtcgaccgaactcaggtgacaggcgatctggctcagcatgggccggagatcgaggcgcttgcccagccgctggcgggggcatggtatagcggggcgcaagtcaccacggttgaaaatgagatcaaaaagcactttggtaagtatggttatgcctggccgcaggtgacgtccacgccggaaatcgatgatgcgcatcaccgcgtggtgctgcatattcaggtcaacgcgggccgccgctactcggtacgccagatccgcttttccggtaacgacacctcccgggacgcggtgctgcgtcgtgaaatgcgccaaatggaaggggcgtggctcaacaacgaaaaagtcgatcaagggaaagtacgtcttgaccgaacgggtttttttgagaacgttgaacagcagatcgttccggtcagtgggacggcagatcaggtcgatgtggtctacaaggtgaaggagcgcaacaccggctcattcaacgtgggcctgggatttggtacggacagcggcgtgagctatcagcttggcgtgacgcaggataactggctgggtacgggtaatagcgtgagcttcaacgggacgcgcaacagctaccagtcttatcttgaactgggggcgacgaacccgtggtttaccgtagatggcatcagcctgggcggaaagattttttataacagctatgatgcttctgatgcggatgccgggagctacaaccagcagagctatggtttaggtagtacgctagggtttcccattagcgaaaataactccctgaacctgggactggattatgtccataatcgcctgaccaatatggatccggagctgacgacctggcgctacctcagctctcggggaatcgagcccagcgtggtgacgaaagatggcgacagcggcgcaaaatatagcgccaacgattattttgcgagtcttggatggggctacaacgatctcgatcgcggcttcttcccgcgtgcgggaaacaagagcagcctgagcggtaaagtgacgctccccggttcggataatagctactacaaactctcttttgacactgcccagtatctgccgctgagcgagaacaagcgctgggtctggatggaacgcctgcgcgcaggctatgccggcgggttagacggcaaaagtgtgccgttctacgataacttttacgctggcggttcgtcgtcagtgcgcggattttcttctaacaccattgggcctaaagcggcctattaccgctgtaacggtagcgaaagcagctatagcgcctgcccgctggacgcctcgtctgatgcggtcggcgggaatgccatggcggtgctgaacagcgaatttatcattccaaccccctttgtgaatgacaaatacgccgatagtctgcgaacctcgctgtttgttgacgcggggacggtctggagtacatcctggcacaacaccgcgcagacgctggcggcagggatccctgactacggcgatccgagtcatattcgtctctccgcggggattgccgtgcagtggatgtctcccctcggtccactggtcttctcctgggcagagccgtttaaaaagtacgatggtgataaagcagaacagtttcagtttaatatcggcaaaacctggtag

SEQ ID NO: 1299 - DNA, 1686 bp, Klebsiella pneumoniae
ttgagtagtcttaattgtgctgagcgaaaactgcacaacgatctttcgctcgcttccagcggatcaaccaagaggagcagcacaatgacgcagcaggcgacaatcaccgatgaactggcctttagtcagccctatggcgagcaggagaagcagatcttaacgcctgaggcggtagaatttctgacggaactggtgagccgctttacgccggcgcgcaataagctgctggccgctcgtttgcagcaacagcaggctattgacgacgggcagcttccggattttatttcggaaactgcttccattagaaatggcgactggactattcgcggtatcccggctgatttgcaggatcgccgcgtggaaatcaccggccccgtcgagcgcaagatggtcattaacgcgctgaatgccaacgtcaaagtctttatggcggactttgaggattcgctggcgcctgactggcgcaaagtcattgatggtcaaatcaacctgcgcgatgccgtgaacgggaccatcagctacaccaacgaggccggcaaaatctatcagttgcagcccaatcccgctgtgctggtatgccgtgtgcgcggcctgcacctgccggaaaagcatgtggcctggcgtaatgaggccatccccggcagcctgttcgattttgcgctctatttctttcataactaccaggcgctgctggcgaaaggaagtggtccctacttctatctgccaaaaacacaggcctggcaggaggcggcatggtggaacgatgtcttcagttttacggaagatcgctttgacctgccgcggggcaccatcaaggccacgctgctgattgagacgttgccagcggtgttccagatggatgagatcctgcatgcgctgcgcgaccatattgttggcctgaactgcggccgctgggattacatcttcagctatatcaaaacgctgaaaaaccatccggaccgcgtgttgcctgaccgtcaggtggtgacgatggataaaccgttcctcagcgcctactcacgcttgttgattaagacctgccacaaacgcggcgcgtttgcgatgggcggtatggcggcgtttatcccgagcaaagataccgaacgtaaccgccaggtgctgagtaaagtcaccgccgataaagagctggaggccaacaacggtcacgatgggacctggatcgcccacccgggcctggcggataccgccatggcggtgtttgaccgcgtgctgggcgataagccgaatcagctctcggtcacccggagcgaggatgcgccaattactgctgaacaactgctggctccctgcgagggcgaacgcacggaagccggaatgcgcgccaacattcgcgtggcggtgcagtacatcgaagcgtggatctccggcaacggctgcgtcccgatttatggcctgatggaagacgccgcaacggccgagatctcgcgcacctctatctggcagtggatccatcatcagaaaaccctgaacgacggtaccccagtcactaaggcgctgttccgccagtggctggcggaagagctgatggtgattcaggaggagctgggagagcaccgcttcagccacggccgctttgacgatgcggcgcgactgatggagcagatcaccacctccgacgagctaattgattttctgacattgccgggctaccgcctgctggcctaa

SEQ ID NO: 1300 - DNA, 633 bp, Klebsiella pneumoniae
ctgtatatacacccagggggcggaatgaaagcgttaacgaccaggcagcaagaggtgtttgatctcattagggatcatatcagccagacgggcatgccgccgacgcgtgcggaaattgctcagcgcttggggttccgttccccaaacgcggcggaagaacacctgaaagcgctggcgcgtaaaggcgcgatcgagatcgtctccggcgcttctcgcggtattcgcctgctgacggaagaagagcaaggcctgccgctgatcggccgcgtcgccgccggtgagccgctgctggcgcagcagcatattgaaggccactatcaggtcgacccgtcgatgtttaagcccaacgccgatttcctgctgcgcgtcagtgggatgtcgatgaaagacatcggtattctggatggcgatttgctggcggtccacaaaacccaggatgtgcgtaacggccaggtggttgtcgcgcgtatcgatgaagaagtgacggtgaagcgcctgaaaaagcagggcaatgtcgttgaactgttgccggaaaacagcgagttttccccgatcgtcgtcgatctgcgccagcagagttttaccattgagggtctggccgttggcgtgatccgtaatggagaatggctgtag

SEQ ID NO: 1301 - DNA, 1338 bp, Klebsiella pneumoniae
tccggtacgcaccaggcctgcggcgctcaaaaaagcggtttataccgctgcgcgctcactttcccctcaacatcctctcgacctgccgtcatatccggtttattgtgtaagaacctgccccatgtaaacctggagatacatcgcgtgtttcaaaaagttgacgcctacgccggcgaccctattctttctctgatggaacgcttcaaagaagacccgcgaagcgacaaagtcaacctgagtatcgggctgtactacaacgatgacggcattatcccgcagctgcaggcggtggcggaagcggaagcacgcctgaacgccgagccgcatggcgcctcgctgtatctgccaatggaagggttgagcggctaccgtcaggcgattgcgccactgctgtttggcgcagagcataccgcgcttaagcaaaatcgcattgcctctattcagacggtcggcggttcgggcgcgctgaaggtcggggccgacttcctcaaacgttactttcctgagtctcatgtctgggtcagcgatccgacctgggaaaaccacatcgccatttttgaaggggctggcttcgaagtaagtacttacccctggtttgataaagccaccaacggcgtgcgctttgaggacctgctggcgacgctgcaaacgctgccggcccgcgatattgtgctgctgcacccttgctgccacaacccgaccggcgccgacctgacgccagcccagtgggaccgcgtggttgaggtattgaaagcgcgtcagctgatccccttcctcgacatcgcctaccagggctttggcggggggctggaaaaggatgcctacgctattcgcgccatcgccagcgccgggatgccgatgctggtcagcaactcgttctccaaaattttctcgctgtacggggagcgcgtcggcggtctgtccgtggtctgtgaagacagcgaaaccgcgggccgcgtgctggggcagctgaaggccaccgtgcgccgtaactactccagcccgccgagctttggcgcgcaggtggtggcgacggtgctgaacgatgccgggctgaaagccacgtggcaggcggaagtggacgccatgcgcgcgcacatcctgaccatgcgccaggcgctggtcgacgcgctgcagcaggttgccccgggcagcaaagtggattacctgctcaagcagcgcgggatgttcagctataccggatttagcgcggcgcaggtggatcgtctgcgcgatgagtttggcgtctacctgattgccagcggacgcatgtgcgtggcggggttaaactcacgtaatgttcagcaggtagcgaaagcttttgccgcggtaatgtaa

SEQ ID NO: 1302 - DNA, 645 bp, Klebsiella pneumoniae
cttctccagcatggcccttggcgacgatattctgttctatcaggccgaatgtcggtaatggatgcaggttttcaacatggaagaggggctgatatgaatatgcgagacggcagcacaaggggcctcctggtggccagccttttgctgctctcccttccggcgctggcttatgagggcagcagcacggtcaattttaacgtcacgggcaccatcgaagcgccttcctgtgaggtggccgtggagccgtcgaacagtatcgatttaggcaccgtctcctcgcagacgttctccggacatgccggggcgagcggcgccagcgtgccggttaagctggtcttttccagctgttccgccgatgcgtcggcggtgaccatcgcgtttagcggcaccagcttcgatagcacccacgcttcaatctataaaaacttccagactggcagcagcggtgccagcggcgtcggtttgcagctgcagagcatgaccgaccagcagccccttggccccggcgaccagtatctctatacctttggggacgatgcggatatccatacctttaatatggtggcacgtatgtattcgccctatggccaggcgaaccccggcatcgtcgggtttaccgccacgtttgatgtggtctacaaataa

SEQ ID NO: 1303 - DNA, 1467 bp, Klebsiella pneumoniae
attcattggcagcttgaaaagaaggttcacatgttaaacaacattcgtatcgaagaagatctgttgggcaccagggaagttcccgcggacgcttactacggcgttcatactctgcgagcgattgaaaacttctacattagcaacagcaaaatcagcgacataccagaattcgtgcgcggcatggtcatggttaagaaagccgccgcgctggcgaacaaggagctgcagaccattcccaaaagcgcggcaaatgcgattatcgccgcctgtgacgaagtcctgaataacggcaaatgcatggaccagttcccggtcgatgtcttccagggcggggccggtacctccgtaaacatgaacaccaacgaagtcctggcgaacattggccttgagctgatgggccaccagaaaggcgaataccagtacctgaacccaaacgatcacgtcaacaaatgccagtccaccaacgatgcttaccccaccgggttccgcattgcggtgtatgcttccatccttaagttaatcgatgcgattaaacagctgggcgaaggcttccaggcgaaagccgaggagttccaggacatcctcaaaatgggccgcacccagctgcaggacgcggtgccgatgaccctcggccaggagttccatgccttcaatgtgctgcttaatgaagagaccaaaagcattttgcgcactgcggagctgctgctggaggtgaacctcggcgccaccgccattggtactcgcctcaacaccccggacggctatcaacagctggcggtgcagaagctggctgaagtaagcaacttaccggtcgtcccggcggaagatctgattgaagccacctcggactgcggggcgtacgttatggttcacagctcgctgaaacgcctggcggtgaaactgtccaagatctgtaacgacctgcgcctgctctcttccggtccgcgcgcgggcctcaacgaaatcaacctgcctgagctgcaggctggctcttcaatcatgccggcgaaggttaacccggtggtgccggaggtggtcaaccaggtctgcttcaaagttatcggcaacgataccactgtgaccatggcctccgaagccggtcagctgcagctgaacgtgatggagccggtgatcggccaggcgatgttcgagtcgattcatatcctgaccaacgcctgctacaacctgctggagaaatgcgttaacggcatcaccgccaataaagcggtatgtgaaggctacgtctacaactccatcggcatcgtcacctacctcaacccgtttattggccaccacaatggcgatatcgtcggcaagatctgtgccgaaaccggcaagagcgtacgggaagtggtgctggagcgcggactgctgacggcggcggagttggatgatattttctctgcgcaaaacctgatgcatcccgcttataaagcaaagcgttataccgatgaaagcgaacagtaa

SEQ ID NO: 1304 - DNA, 348 bp, Klebsiella pneumoniae
tcagcagggcaatatccggcgaggcctccagcagctgcagcgcctcttcaccgctggcggtttccagcgtcagccagcccagctgatgcagctgttcacatagcgtctggcggacatcctcttcatcttccagcaccagcgccagccgctcgcccgccggggacggctcgtccaccgctggcgccacctccttctcaacctcggtcaacgctcgcggcagctgcagccgcaccgtcgtcccctgccccggcgcgctctccagcgccacccggccgcccgactggcgcacaaagccatacaccatcgacagccccaggccgctgccgctgccggtggctttggtggtga

SEQ ID NO: 1305 - DNA, 465 bp, Klebsiella pneumoniae
accatgattaaccgagtgattcctttacccgatgagcaggccacgctggcccttggtgaccgcatcgcgcaggcctgtaccggcgccaccgtgatttatctgtatggtgatttaggcgcggggaaaacgaccttcagccgcggctttttgcaggcgctcggtcaccgcggcaatgtcaaaagcccaacttataccctggtggagccctataccctcgagaacctgatggtgtatcacttcgatctctaccgtctggcggatcctgaggaactcgaatttatggggatccgtgattattttgccgacgatgccatctgcctggtggaatggccgcagcaaggcgctggtgtcctgcctgacccggatgttgaaattcaccttgattaccaggcacaagggcgtgaggcgcgtattaccgcgatctcctcacggggtgaatctttactggcgcgtttagccttttag

SEQ ID NO: 1306 - DNA, 417 bp, Klebsiella pneumoniae
aaccacgctaaggagtgcattatgacgacgaaacgcaaaccctacgtgcgaccaatgacctccacctggtggaaaaagctgccgttttatcgcttctacatggtacgggaaggcacggcggtaccgacggtatggtttagcattgtgctgatttatgggctgtttgccctcaagcacggcgccgagagctgggcgggatatatcggattcctgcaaaacccggtggtggtaatcctcaacctgattactctggcggcggcgctgctgcacaccaaaacctggtttgagctggcgccgaaagccgccaacgtcatcatcaaaggcgaaaaaatggggccagagccggtcattaaagggctctgggtggtgacggcggtggtcaccgtggtgatcctgtttgtcgccctgttctggtaa

SEQ ID NO: 1307 - DNA, 744 bp, Klebsiella pneumoniae
cagatgaataaaaaagtcatcttccgcggcgccagcgctattatgcccctatgcatcggcgactttccattttcatttattgtcggcgcattaagcgttagcgcgggcatgagcgtctggcagagtacggcgtggtcggcgatcgtcattgccggctcggcgcaaatgctggcactgaatatgttaaaaaccggcgccacgctcggcgtgattattttcaccacattaattatcaatcttcgccacgtgctgtatagcgcctctatttccggcaccgtgcgcgaagcttcattctttaaaaaatgctttatgtcctatgcgctcaccgacgaggtgtatgccaccaccgtcaaagagatggaaggaaataaaaaggaaaaatatctgttttatggttcggcgatgattaccttctgggcgatttgggtgctggctgattttcttggcgcgctggtcggcgcctcgtttccccacattgagaaatacggtctcgatttcgccatggtcgccgcctttatcgccatcgtggtgccgcaaattaaaagccaggcctgcaccgtcgccgcggttgtagccgccgtttccggcgtgctgttagtggtcctaccctattcgctgggtatcgtcgtcgcctcagtgcttggcgtcctcgccggcctgtgcgtcgacctggcggaagagcgcaagcagatggcaaaaaccgaatccgatatgccgttagtggaggcgatggaaaatgagtaa

SEQ ID NO: 1308 - DNA, 273 bp, Klebsiella pneumoniae
atatatgtcaaacaaacgttaagagtaggggttttgacagctttgtttgttaattggggggcagatcacgcaatgattaaactgggtgaaatttcatcaaatgaaactttgaagcgaaataattacgcaaatgaatttatagaaacggaagctgtgaaaatttttttattacaaatacttatgcaatataactgggggaaattcgctgctttatgcataaaagcagaggaaagccctgttcttaaaggcttgcgcagcatgccgtgcaaatga

SEQ ID NO: 1309 - DNA, 1041 bp, Klebsiella pneumoniae
ctaagccacaaaatggcgcatattgtaaccctaaataccccatccagagaagattggataacgcaacttgccaatgttgtgaccagtcctgatgaactgctgcgtcttttaaatgtagacgctgatgaaaaactgctggccggacgcgaggccagacgcctgttcccgctgcgcgtcccgcgcgcgtttatcgcccgcatggagaaaggcaaccctaacgatccactgcttcgtcaggtacttaccgccgaggaagagtttatcgtcgcccccggctactccaccgatccactggaagaacagcacagcgtggtgcccggtctgttgcacaagtatcgcaaccgggccctgctgctggtgaaaggcggttgtgcggtaaattgtcgttactgcttccgccgccacttcccttatgccgaaaatcagggcaccaggcgcaactggcagacagcgatggactacatcgcggcgcatccgcagcttgatgaaatcatcttctccggcggcgacccgctgatggcaaaggaccatgagcttgactggctaatgacccagctggaagctattccacacgttaagcgcctgcgtattcacagccgcctgccgattgtgatcccggtgcgcatcaccgagacgctggccagccgcttccagcgttcgtcgctgcagataatcctggttaaccacgtcaaccacgccaatgaaattgacggtgagtttcgcgcggcgatggccatgctgcgtcaggcgggcgtcacgttgctcaatcagagcgtgctgctgcgcggggtgaacgacaacgcgcaaaccctggccgacctcagtaatgcgctgttcgacgccggggtaatgccctactacctgcacgtgctggaccgggtgcagggagcggcgcacttcatggtcagcgatgatgaagcccgtgaaatcatgcgcgaactattgaccctcatctccggctatatggtgccgaagctggcgcgcgagattggcggggaacccagcaagacgccgctggatttagggctgaagcagcgttaa

SEQ ID NO: 1310 - DNA, 1008 bp, Klebsiella pneumoniae
tctcggaacaacacaggagcgaacatggcaacacgcatcgaattttcgaaacacgggggaccggaggtgcttcaggcggttgagttcacgccacgcgatcccgcagaacatgagattcaggtcgaaaacaaagccatcggcatcaactatatcgacacctatgttcgcagcggcctctatccgccgccgtcgctgccgagcggcctgggcaccgaggcggccggcatcgtcagtaaagttggccatggggtcacgcatattaaggtaggcgatcgggtggtgtacgcccagtcggcgctcggcgcctacagcacggtacacaatgtgctggccgacaaagcggcggtcctgccggacgctatctctttcgaacaggccgccgcgtcgttcctcaaaggattaacggtctggtatctgctgcgcaaaacctatgaaattaagcctgatgagatgttcctgtttcacgcggccgctggcggcgtggggctgatagcctgtcagtgggcgaaagcgctgggggcgaaacttatcggtaccgtcggcagcgcgcagaaagcgcagcgcgccaaagaggcgggcgcctggcaggtgattaactatcgcgaggagtctatcgtggagcggctcaaggcgctcaccgacggtaagaaagtggccgtcgtctacgactcggtggggaaagatacctgggaggcctctctggactgcctgcagcgccgcggcctgatggtcagctttggtaactcctccggtccggtgaccggcgttaatctggggatcctgaatcaaaaaggctccctgtacgtcactcgcccatcgctgcagggctatatcaccaaccgggaagaactggaggaagcctgcagtgaattgttttcgctgatcgccagcggggtgattaaagtggacgtggctgaaagtcagatctatccgctgagcgaagcgcggcgggcgcatgaagttctggagagccgggtgacgcagggttcgagtttgctgctgccataa

SEQ ID NO: 1311 - DNA, 873 bp, Klebsiella pneumoniae
aacgcctgcaacgggagaacgaacgtggctaacccactgactggctataactttgcttacctcgacgagcaaaccaagcgcatgatccgccgggctattctcaaagcggtagcgattcccggctaccaggtgccgttcggcgggcgcgaaatgccaatgccctacggctggggcaccggcggcatccagctgaccgccagcgtcatcggtgagaatgacgtgctgaaggtgattgaccagggcgcggatgacaccaccaacgcggtgtcgattcgtcagttctttaagcgcgtcaccggcgtcgccaccaccgagcgtaccgaagacgccaccctgatccagacccgccaccggatcccggagacgccgctggtggaagatcagatcctgatctaccaggtgccgatcccggagccactgcgctttatcgagccgcgtgaaaccgaaacccgcaccatgcacgccctggaagagtacggcgtcatgcaggtgaaactgtatgaagatatcgcccgcttcggccatatcgccaccacctacgcctatccggtgaaggtcaatggccgctacgtgatggacccttcgccgatcccgaaattcgataacccgaaaatgcacatgatgccggcgctgcagctgttcggcgccgggcgcgaaaagcggatctacgccgtgccgccctataccccggtggagagtctcgatttcgacgaccatccctttaccgtgcaggagtgggatgagccctgcgccatctgcggctcgcgccacagctacctcgacgaagtggtactggatgacagcggccagcggatgtttgtctgctccgataccgactattgccgccagcagagcgaggggcagaaaaaatga

SEQ ID NO: 1312 - DNA, 183 bp, Klebsiella pneumoniae
agacaatgtttcttgcttgttttgagaaagcttgtttattatttcttcagcattggctatcttttctttattaacttctatctgtacagaactaacatttccagtagtcgtgtcacgagagatatctatttcatagagaggttgtccttttttaaccagatcaccaactttcacatattgtga

SEQ ID NO: 1313 - DNA, 1161 bp, Klebsiella pneumoniae
attgtcataaatacccgacaaagtaggctcacatcatgtcgagtcaacgttgcattttttttacagccaaatgaacacgtgttcaccttgctaaaaaaaatgccgcagcagcgctttcaggtagcgaatatgagttatttacagatctccggccttaaaattagttatggcgataaggtggttttacataatatcgatctggcggtagagcagggagagatgattgctctactgggcccgtcgggatgcggaaaaaccacgctgctgaacgccctctgcggctttattccggtgcaaagcggcgaggtggctattgccagccgaacgatcactcatcttgcgccggagcagcgcaatatcaccatggtatttcaaagctacgccctgtggccgcacctgacggtagcgcgcaatatcggctatggcctgaagctgcgcaaatggcggggggcggatatcgcgcggcgggtggcggagctgctgcgaatagtcaatctcgaagggcttggcgaagtgaaagtgaccgaactgtcgggcggccagcggcagcgggtggcgctggcgagagccctggccatagagccccaggtgctggtgttggatgagccgttatctaatctggatgccaaagtgcgcctgaatgtgcgccatgaaattaaatctctgcaaaagagactggggttcacgtcattaattgtcacccacgatcagcaggaagccttagtgatggcggaccgcattgcggtattaaatcaggggcgtattgaacaaaccggcacgccggaagaaatatatcaacgccccgcgacgcccttcgtcgctgattttatgggggccgataataaaataatttccggtgaattatccgctgccgcaatatccggtttatctgccgctcagcagggtgacaacgttatttattttcgcagcgccgatgccgcgctcgctgaattaacgcagcctgcgccgcaggaggggctggctctggaaggcgtggtggagcaaagcgcgtttctgggcaatctgtatcgtcacagcgtgcgctgccatgaccgcctgctgctggcggatgccgcgcagtgctggccgacaaaaagccgcgttcggctccatgtgccaacgccggccctgcatatttttcctttaccactatcacagtga

SEQ ID NO: 1314 - DNA, 477 bp, Klebsiella pneumoniae
cttgaggtaaagcgctttatggaaaagaaatcaccccgcatcaaaatgctgttgacgcctggagaagtggcaaaacgaaccggcgtggcggtctcggccctccatttttatgagagtaaaggattgatccacagtcagcggaatgccggcaatcagcggcgctaccggcgtgacgttctgcgcgcggtggcgattatcaaaattgcgcaacgtattggcatcccgctggccactatcggcgacgcgtttggcgtgctgccggaagggcacaatctcagcgcaaaagagtggaagatgctgtcatcgcagtggcgtgaggagctggatcggcgcattcataccctgacggcgctacgcgaccagctcgacggctgtatcggctgcggctgtttatcgcgacgcgactgcccgctgcgcaacccgggcgataaactgggggaagagggaaccggcgcccggctgctggaagacgagtga

SEQ ID NO: 1315 - DNA, 942 bp, Klebsiella pneumoniae
acgctttcaaaaggaataaaaaatatggatatacaggcgccttattatcggcaggttgctctgctaatgcaggttttaccctatgttgctgtcgaacgggaatttgcgctgagaggtggcactgccatcaatctctttatccgcgatttccctcgattatcggtggatatcgacctcgcctgggtgcccctggaaagcagagccatcgctttacctcatatacgggatgcgcttgcacgtattgtcgccaatctgcaacaacaggcaggtatgagcgctgtattacaagctaatcgttcagatgagatgcgtgtcattgttactaccgatagcgcgcaaataaagatagaggtttcaccggtcgcccggggaacattatatccaccacaggagcgagaagtggtgggggcggtagaggacgtttttggctatgccagccttccagtggtttcgttgcctgacctctacggtggaaaattatgcgcggcgctggatcgccagcatcccagagatttttatgacgtgaaattacttcttgatgcgcaggagcttgaccgtcccattttcaatgggtttatcgtgtatttactgagccataatcggcctctggctgaagtgctgaatcctcgctggaaagatattgctgaacctttttaccgtgaattcagcgggatgacatttgagacgatagccctggaggaactgacagcagtccccaacaggatgattgctgcgttaaaatcctgtttcacacaacaggatgtcgattttttactgtcatttaaacgaggcgaaccagactggcgtttagcgccggaaatgcgtattcaggatttgcctgccgtgcagtggaaattgcgcaatattcatcagatgccagcgataaaacgcgctgagtcattagataaactggaaaaggtgctggccgagtggcgcagttag

SEQ ID NO: 1316 - DNA, 1431 bp, Klebsiella pneumoniae
acggcgtcaaaaactacggctactaccctgacgattttattaacaaccagcctgatatctctcgtatcaggccgcaattttcttcctggtggtaccctgaccatgactgatcgcattatcgcattgtgcattttatgcctcgtattcgggctgccgttaggtgtcgcagcggtatttaccggcgagcttatcctcgactttgtctttttctggccgctgtttatgtcagtgttgtggatcaccgggggtctctacttctggtttcagctggaacgtcactggccgtggggggaggataccccgccgccgacgctgccgggcaatccactgatctcgatcctgatcccctgctttaacgaggagaaaaacgcccgggaaaccatcagcgcagcgctggcccagcgttacgccaatcttgaagtgatcgcgattaacgacggctcttcggacaacaccgcccaggtgctccagcagctggcgcaggaggagccgaggctgcgggtgatccatctggccgccaatcagggaaaagcggtggcgctcaaagcgggcgccgccgccgcccgcggcgatctgctggtctgcatcgatggcgacgccctgctggaccgggataccgcggcctggctggtcgcgccgttgatccattatccgcacgtcggggcggtcaccggcaatccgcggatccgcacccgatccacgctgatcggccgcattcaggttggggagttctcgtcgatcattgggcttatcaaacggacgcagcggatctatggccgggtctttaccgtctccggcgtaatcgccgccttccggcgccaggcgctggcggacgtcggctactggagcccggatatgatcactgaagatattgatatcagctggaagcttcagctccgccactgggacatctttttcgagccgcgagcgctgtgctggatcctgatgccggagaccctcaaagggttatggaagcagcgtctgcgctgggcccagggcggcgccgaagtctttctggtcaatctgcgccgcctgtttcactggcagcatcaccggatgtggccgctgtttctggagtatgcctgctccacgctgtgggcctttgcctacgcgatcaccattctgctgtttatcctcagccgcctgatgccgctgcctgacaatctggcggtgtatagcctgtttccaccggaattcaccggcatgctgctcggcctgatgtgcctgctgcagttcgtcgccagcctgtatatcgagcggcgctatgagaaaaaggtcgccaaatcgctgttctgggtgatctggttcccgatggtctactggatgatcggcctgctgaccacgctggtcgcttttccgaaagtgatggtgaaacgtcaacgttcccgcgcgcgctgggtgagcccggaccggggaaaaggaagcctgtga

SEQ ID NO: 1317 - DNA, 1035 bp, Klebsiella pneumoniae
aatcgtccccttttttcaggtccccgcccgcaggcggggtcaggaacgacatatcatggcctggaggctactttgttaaacgatcttaaactttcactgcaatacattctgcctaaactgtggctcacccgcctcgcaggctggggtgcgagcaaacgcgcaggttggctgacgaagctggtcatcgatctgttcgtgaaatactacaaggtcgatatgaaagaggcgcagaagccggataccgcggcttatcgcaccttcaacgatttcttcgtgcgcccgctgcgcgacgacgttcgcccgctgaataccgatccaaacgtgctggtgatgccggccgatggcgtgatcagccagcttggcgccattgagaacgataaaatcctgcaggctaagggtcatgactacagtctggaagccctgctggccggcaactatcagatggccgacctgttccgtaacggcagcttcgccaccacctacctgtcgccgcgcgactatcaccgcgtacacatgccgtgcaacggcatcctgcgcgaaatgatctacgttcctggcgacctgttctctgttaaccacttgacggcgcagaacgtgccgaacctgttcgcccgtaacgagcgcgtcatctgcctgtttgatactgagtttggcccgatggcgcaaattctggtgggcgcaactatcgtcggcagcatcgagaccgtgtggtccggcaccgtgaccccgccgcgcgaaggcattattaaacgctggacctggcccgctggcgacaacgaaggctccatcgccttgctgaaaggccaggagatgggccgcttcaaactgggttccaccgtgatcaacctgtttgccccgggccaggtgaagctggtcgacacgctgcaaagcctgtccgtgaccaagatcggccaaccgctggcgacagcagtggaagcgaccgccgccgctgaacccgcgccgttaccggaagaagagatccgcgccgaacaccgcgccagcccgctggttgacgataaacaagaccaaggttaa

SEQ ID NO: 1318 - DNA, 1515 bp, Klebsiella pneumoniae
cagaggaaaaatatgcttaaaaggaaaaaaataaagcccatcacccttaaggatgtgaccatcatcgatgatggtaaactgaaaaaggcgatcaccgcggcctccctgggcaacgcgatggagtggttcgatttcggcgtctatggctttgtggcctacgccttaggtaaagtcttctttcccgatgccaacccaagcgtgcagatgattgccgcgctgggtaccttctccgtaccatttttaattcgtccgttaggcggcctgttcttcgggatgctgggcgataaatatggtcggcaaaaaattctcgcgataactatcgtgatcatgtcgataagtactttctgtatcggccttattccgtcgtatgccacgataggtatctgggcaccgatcctgctgctgctgtgtaaaatggcgcaaggcttctcggttggcggtgaatataccggggcgtcgatcttcgtcgcggaatactctcctgaccgcaagcgcggctttatgggcagctggctggactttggctccatcgccgggtttgtgatgggggccggcgtggtggttctcatctccagcgtggtgggtgaacagaactttctcgactggggttggcgtatcccgttcttcctggcgctaccgttaggtatcattggtctttacctgcgccatgcgctggaagagacgccggcgttccagcagcatgttgacaccatggagcagggcgaccgtgaaggactgcaggacgggccgaaggtctcttttaaagagattgccaccaagcactggcgtagcctgctgacctgtatcggtctggtgatttccaccaacgtgacttactacatgctgctgacctacatgccgagctatctgtcgcataacctgcactactcggaagatcatggggtgctgatcatcatcgctatcatggtcgggatgctgtttgtacagccggttatcggtatgctcagcgaccgtttcggccgtcgcccgtttatcctgattggtagcgtggcgctgtttgccctgtcgatcccggccttcattatgatcaacagcaacgtgactagcctgatcttcgccggcctgctgctgctggcggtggtgctgaactgctttatcggggtgatggcctcctcgctgccggcgatgttcccgacgcacatccgcttcagcgccctggccagcgcctttaacatctcggtgctgattgccggtctgacgccaaccctggcggcgtggctggtggagaccacccaaaacctgatgatgccggcgtactacctgatggttatcgcggtggtgggtatggcgacgggcctgtcgatgaaagagacggctaaccgtccgctgaaaggggcgaccccggcggcgtcggatattcaggaagcgaaagaaatccttggcgagcactacgataacatcgagcaaaaaatcgaagatatcgatcaggagatcgccgatctgcaggcaaaacggtcgcgtctggtgcagcagcatccgcgtatcaacgactaa

SEQ ID NO: 1319 - DNA, 879 bp, Klebsiella pneumoniae
gaggaagaaaaaatggagtggagtctgtcgcagaataagctgttggcgtttcatcgcctgatgcgcactgacaaaccgatcggcgctttgctgctgctgtggccgacgctgtgggcgctatgggtggcctcgccgggcgtcccgccgttgtggatcctggcggtattcgtcgccggcgtctggctgatgcgcgccgccggctgcgtggtgaatgactatgccgaccgaaaatttgatggtcacgtaaagcgtaccgcccgccgtccgctgccgagcggcgatgtcaccgagaaagaggcgcgaacgctgtttatcgtgctggtgctgctctctttcctgttggtgctcaccctcaacaccatgaccattctgctgtcggtggcggcgctggcgctggcgtgggtctatccgtttatgaagcgctacactcatctgccgcaggtggtgctgggcgcggcctttggctggtcgatcccgatggccttctcggccgtcagcgaatcgctaccgctgagctgctggctgatgttcctcgccaatattctgtgggcggtggcctacgatacccagtatgcgatggtggatcgcgatgacgacctcaagatcggcatcaagtcgacggcgatcctgtttggcgaaaacgatcgtctgattatcggtatcctgcaggtggccgtactggcgctgatgggcgcggtgggttggctgaatgggctgggctgggaatattactggtcgctgttcgtggcggcgggtctgtttggctggcagcagaagcttatcttcaatcgcgaccgcgataactgcttcaaagcgtttatgaacaataactacgtcgggctggtgctgttcctcggcctggcgatgagctatctgtaa

SEQ ID NO: 1320 - DNA, 483 bp, Klebsiella pneumoniae
gaatgtagaaaaggagaaagtatggttattaacatccgccgttcccggcctgatgaaggggataaactgactgcgatctggtgtcggtcggtcgacgccacgcatgattttctgacaaaagcgtatcgaaaggagctggaggagatggtacgcgcatttttaccggaggctccgctgtgggtggcggttaatacggaagaccagccgatcgcctttatgctgctgaccggagatcatatggatgcgctgttcgtcgatccggatgtccgcggctgtggcgtggggaagttgctgattgagcatgcgctgtcgttaacgccgaagctgacgaccaatgtaaatgagcagaatgaacaagcggtcgggttttatcagaagatgggttttagggtgacagggcgctctgaaacggacgatctggggcaaccgtatccgttattgaatttgatgtatgagcagcaggctgaagcagactacgattga

SEQ ID NO: 1321 - DNA, 825 bp, Klebsiella pneumoniae
cggcgcttgaaaaaatgtcaccgggagaggaatttgtcggcgcaggcttgcagaatcgatcagactgacactaattcccggcgggcagaggcaaaaatgaaaccagtcattttagtggtggatgatgacagggcgatgggcgagctgctcagcgatgtgctcggcgcgcacgcgtttgaagtgcttgtcagccagaccggcaacgacgcgctggcgacggtggcgcagcgggcggatatcgcgctggtcttactggacatgatcctgccggatacccatggcctgcaggtgctccagcagctgcagcgcacgcggcctgagctgccggtggtgatgctctccggtctgggcagtgagtctgatgtggtggtgggcctggagatgggcgccgatgattacatcgccaaaccgttcagctcgcgggtggtggtcgcccgggtgaaagcggtactgcgacgcagcggggcgctggccggcgaggcgtcgggcgccggtgctggcctgacgtttaacggctggcggctggataccacgcgctgtgaactgtataacccgcagcagcaggcgatcccgctgacccagggagaatatggcctgctgctggcgctggcgcagaacgcgcgccgggtattgaatcgcgaacagctgctggcgctgacccataacgaaagcaccgaggtattcgaccggaccatcgatgtgctgatcatgcgcctgcggcgcaaaattgagctcaacccgcatcagccgacgttgattaaaaccctgcgcggtctgggctatgtcttttccgccgacgtgacccacagcgagaaggcggcgtag

SEQ ID NO: 1322 - DNA, 1284 bp, Klebsiella pneumoniae
atcattatgaacaccgataacgcttccctgtacgtaaaatggctcaaacaagaggtcgccccggctttaggttgtactgaacccgtcgctatttccttcgcggccgcctacgccgcacaatatctggatcagccttgcactaaaattagcggttttatttccgccaatctttataaaaacgcgatgggcgtcaccatacccggcaccaccgtttgcggtgtaccgctggcagccgctattggcgcatttggcggcgactcgcaaaagggattaaaaacgctggaagatatcactccgcgacacgttgaaatggcgcagaagctgatcgccaataacgccgttgatattgccgtcgaagagaccccggattttattcatctcgatttaaccctctctgctggcgagaattactgtcgtgtcgtggtcaaaggaacccacaccaacgtggtcgaactttatattaatggccaaccgcagccattaagcgaaaaacagaatacgcgcacccagcgcgaaacgctgcccactttctcgctacaacaggcttacgaatttattaatcgcgtcgactttaatgatattcgctttattctcgacgccgcgcgcttaaactccgcgctggcggcagaaggcaaaacaaaaaaatatggcctgaacattaacggtaccttttctgacgcagtgaaaaacggcctgatgagcaacgatctgttaagcaaggtgatcatcaacaccgtcgccgcttcagatgcccgcatgggcggcgcgccggtggtagcgatgtctaacttcggctcaggcaatcagggcattacagcaaccatgccggtagtggtggttgcagagcatctcggcgtcgatgaagagaccctggctcgcgctttgtctctctctcatctcaccgccatctcaattcattctcgttatacgcgcttatctgcgctatgcgcagcctcaaccgccgctatgggcgccgccgccggtatggcctggctgtttacccgcgacatcaataccattaataccgcaattattaatatggtcagcgatattaccggcatgatttgtgatggcgcttccaacagctgcgcgatgaaagtctcgtcagtggtctccagcgcctttaaggcggtactaatggcaatgcaaaatagctgcgctggcgccaatgacggtattgtctgcgccgatgtcgagcagactattaataacctgtgccgtctggtgattaaaccaatgactctcaccgataaagaaattatcagcattatggtcgctaaataa

SEQ ID NO: 1323 - DNA, 693 bp, Klebsiella pneumoniae
atacaaatgaaatacctctttttatttctactggttttcaccagcggcgcagcggtggccaccgaacctggcagtcagtatcaacagcaggccgaagccggcgatcgacgcgcgcaatattaccttgccgatacctgggtcagctccggcgattatcaaaaagccgaatactgggcgcagaaggcggccgcccagggcgatggcgatgcgctggcgctgctggcgcagctcaaaatccgtaacccccaacaggcggactatccgcaggcccgccagctggcggaaaaagccgtcgaggccggcagtaaatccggagagatcgtcctcgcgcgggtgctggtcaaccgtcaggctggcgccaccgacgtagcgcacgccatcacgctgctgcaggatgctgcccgggatagcgaaagcgatgcggcggtagatgcccagatgctgctggggctgatctacgccagcggcgtacacggcccggaggatgatgtgaaagcaagtgaatactttaaaggcagttcatcactttcccgcaccggctatgccgaatactgggccgggatgatgttccagcagggagagaaaggctttatcgaaccgaataagcagaaggcgctgcactggctcaacgtcagttgcctggaggggtttgataccggctgcgaagagtttgaccggattagtaaaggataa

SEQ ID NO: 1324 - DNA, 246 bp, Klebsiella pneumoniae
agagtgatgaaacgccatttctgtttcatcaacttgtgtgaactatatcacacttggcgctttattcaccagtcaaaaaatgagcttttgctgcgtttaataactatgaagtttgtgtggatattggtgagcaatcccgggaagcatattttcattcactgcctaatgattattattctgcgggttttattacctgttcttgtttattacacggagaaaccgagtcagatgcgcgtctattcttaa

SEQ ID NO: 1325 - DNA, 1125 bp, Klebsiella pneumoniae
cgaagggagaagggcatggcgagcgtacagctgcgaaatgtaacgaaagcctggggtgacgtggtggtatcgaaagatatcaatctcgatatccacgaaggggaattcgtcgtgtttgtcgggccatcgggctgcggcaaatctaccctgctgcgtatgattgccgggttagaaactattaccagcggggacctgtttatcggtgacacccgcatgaacgagatcccaccggcagaacgtggcgttgggatggtattccagtcttatgcactctatccccacctttccgttgcggaaaatatgtcgtttggcctgaagctggccggcgcgaaaaaagatctgattaaccagcgggtgactcaggttgcggaagtgctgcagctggcccatctgctggagcgtaaaccgaaagccctctccggcggtcagcgccagcgcgtggcgattggtcgtacgctggtggcagagccaagcgttttcctgctggatgagccgctttccaacctcgatgccgccctgcgcgtccagatgcgtatcgaaatctcccgtctgcataagcgactgggccgcaccatgatctatgtcacccacgatcaggtggaagcgatgaccctcgccgacaagatcgtggtcctcgacgccggccgtgtggcgcaggttgggaaaccgctggagctctatcactatccggctgaccgcttcgttgccggcttcattggttcaccgaagatgaacttcctgccggtcaaagtcaccgcgacggctatcgatcaggtgcaggttgaactgccgaaccgtcagcaaatctggctaccggtggacagcgccaacgtgcaggcgggcgccaatatgtccttaggtattcgaccggagcatttactgcccagcgatatcgccgatgtaacccttgaaggcgaggtccaggtcgtcgaacagctcggtcacgaaacgcaaattcatatccagatccccgccatccgtcagaacctggtttaccgccagaacgacgtggtgttggtagaagagggagccacattcgctatcggtttgccgccagaacgttgccatttattccgtgaggatggcaccgcttgtcgtcggctgcataaagagccgggcgtgtaa

SEQ ID NO: 1326 - DNA, 960 bp, Klebsiella pneumoniae
caattcaggaatacgctaacgatggaacaccgcttcacctctctgccccccgatccctttatgtgcagcagcgacgaaaagcagagccgcagcccgctggcgctctactccgagtatcagcgtatggacatcgaactgcgcccgccgcacgccatgcccaccagccactggcacggccaggtggaggttaacgtgccgttcgatggcgacgtggagtatttgattaataacgaagtggtgcgcattgagaaaggctatatcactctgttctgggcctgtacgccgcatcagctgacccgccccggcgattgccagcagatggcgatattcaacctgccgatgcatctgtttctctcatggccgctggaccgggagcttatcaaccacgtcacccatgggatggtgattaaatccctcgccgcgcagcagttgagcgccttcgaagtgcgccgctggcagcaggaactgagccacgagaatgaacagatacgccagctggcgatcgatgaaatcgccctgatgctgaagcggctgagcctcgccggctggcagccgattctggtcaataaaacctcacgcacccacaagaacagcgtctcgcgccacgcgcagttttatgtcagccagatgctggagtttatcgctgcccactacgaccaggcgctgaccgtcaatgccgttgccgagcacgtgaagctcaacccgaactatgcgatgggggtctttcagcgggtgatgcagcagaccatgaagcagtacattaccgccatgcgtatcaatcatgtgcgggcgctgctgagcgataccgacaagaccatcctggatattgcccttaccgccggttttcgctccagcagccgcttctacagcacctttacccgctacgtgggcatgccgccgcagcagtaccgtaaactcagccagcagcggcgtcacggcctggccttgccgaaggcataa

SEQ ID NO: 1327 - DNA, 1320 bp, Klebsiella pneumoniae
aaaacaaggaaggcatatatgtttggtgcagaactggttattgtcctgctggcgatttatctcggcgcccggcttggcggcatcggtatcggctttgccggtggccttggcgtccttgtcctgacgcttatttttcaaattaaaccgggtgcgatccccttcgacgttattgaaatcattatggcggtgattgccgctatcgccgccatgcaggttgccggcgggatggattacctggtcagcctcgccgaacggatgctgcgccgccacccgaagtacattaccttccttgccccgctggtgacctggtttatgaccgtgctcgctggcaccggccataccgccttctccacgctgccggtgatcaccgaagttgccaaagagcaaggcattcgtccgtctcgtccactgtcgattgcggtggtggcctcccagatagcgatcaccgcctcgcccatttccgccgcagtggtctttttcgcaggtatccttgaaccgctgggcgttagctatttgacgctgctggccatctgtattccagtcacgctgctggcagtgatgctcaccgctatcgtctgcaacttcctcggctgcgaactgaaagacgatccggtttaccaggagcggctggccaagggggaagtcagactgcgcggcagccaggtatttgagctgcagccgcacgccaaacgctctgtcctgctgtttttgatcggcatcgtggcggtgatgttctacgccacggccatcagcgataccgtcggcctgattaagaacccggtgctgccgcgtaacgaggcgatcgtggtatttatgctgaccatcgccaccctgattagcatcacctgcaaaatcgacaccggcgaagtgctcaacgccagcacctttaagtccgggatgagcgcctgcgtctgcgtcctcggcgtcgcctggctgggagataccttcgttaaagcgcatatcagcgacatccaggccgtggccggcgatctgctgcataattacccatggctgctggcggtggtactgtttttcgccgccacgctgctctactcgcaggcagccaccaccaaggcgttgatgcctgccgcgctgctgctgggcgtcagcccgctgacggctatcgcctcgtttgccgcggtctcggcgctgttcgttctaccgacctacccaaccctgctggcggcggtagagatggacgacaccggctcaacccgcattggtaaatatgtctttaaccacgccttcctgatccccggcgttatcgctatcacgctgtgcgtgatcctcggctttatctttggcgggattatgctgtaa

SEQ ID NO: 1328 - DNA, 1806 bp, Klebsiella pneumoniae
aactggaggaatgtcgtgcaaacttttcaagccgatctcgccgtaattggcgccggcggggcaggccttcgtgccgctatcgccgccgctcaggccaaccccaacgctaaaatcgccctgatttctaaagtctatccgatgcgcagccatacggtcgctgcagaagggggatccgcagccgttgcccaggatcacgatagctttgagtaccattttcacgacaccgtcgcgggaggcgactggctgtgcgagcaggatgtcgtcgactattttgttcatcactgcccgacggaaatgacccagctggagcagtggggatgcccatggagccgccgccccgacggcagcgtcaacgtccggcgcttcggtggcatgaaaatcgaacgcacctggtttgccgccgacaaaaccggcttccacatgctgcataccctcttccagacctcccttcagtttccccaaattcagcgctttgacgaacatttcgtccttgacctgctggtcgatgacgggcaggcccgcggcctggtggcgatgaatatgatggaaggcaccctggtgcagatccgcgctaacgccgtggtgctggctaccggcggcgccgggcgcgtctaccgctacaacaccaacggcggcatcgtcaccggtgacgggatggggatggccctaggacacggcgtgccgctgcgcgacatggaattcgttcagtatcacccgaccggcctgccgggctccgggatcctgatgaccgaaggctgccgcggcgaaggcgggattctggtcaacaaaaacggctaccgctatctgcaggattacggcatgggcccggaaaccccgctcggcgaaccgaagaataaatatatggagctgggcccacgcgacaaagtgtcccaggccttctggcacgagtggcggaaagggaacaccatcccgacgccgcgcggcgacgtggtctacctcgatctccgccacctcggcgagaaaaaactgctggagcgtctgccgtttatctgtgaactagcgaaagcctacgtcggcgtcgatccggtgaaagagccgatcccggtgcgcccgaccgcgcactacaccatgggcggtattgaaaccgatcagcagtgcgaaacccggatcaaagggctgtttgccgtgggcgaatgctcgtccgttggcttacatggcgccaaccgtctgggctccaactcgctggccgagctggtggtcttcggccgcctggccggggagcaggccatgcagcgcgccgctcaggcgggcgaggcaaacggcgccgccctcgatgcgcaggctgccgatgtggagcagcgcctgaaagatctcgtcaaccaggaaggtaacgaaaactgggcgaaaattcgcgatgaaatggggctgtcgatggaggaaggctgcggcatctaccgcacgccggagctgatgcagaaaacgatcgacaagctggctgaactgcaggagcgctttaagcgcgtgcgcattaccgataactccagcgtgttcaataccgatctgctttacaccattgagctggggcacggtttaaacgttgccgaatgtatggcgcactcggccatcgcccgtaaagaatcgcgcggggcgcaccagcgtctggatgaaggctgtaccgaacgcgacgacgtcaacttcctcaagcacactctcgccttccgcgaggccgatggcactacccgtctggaatatggcgatgtgaagatcaccacgctgccgccggcaaaacgtgtctatggcgcagaagcggacgcggctgagaagaaggagaccacccatggctga

SEQ ID NO: 1329 - DNA, 2562 bp, Klebsiella pneumoniae
gtcattcacctgcagtgccagtcagctaaatgggaccatcctcatcctttaactcaccgtcaaaggacggtcgtgttgtgcaatggattcttgatgaacatatggcaaatagaaatggaaagatcaccttattcaaatacgttattgtttaatcgcaacacgaaactctcgctatcaatcggcttgcttttgctcttcccggcgctggttcagggagcggattcgctctatgaccagcaaatcttgcaagcgcgccaaggccagtacgccccctttctcagttaccttcagcagtaccagctgcggcatgccttaaccccttctcaggtggcggactggctgcaggtggccctctgggccggtcaggacgatgaagtggtgaaagtctggcgacgctaccaggtctatatgccgcttcccgcacggggcaccgccgccgcggcgcaggccctgcgcaaccagaagcagtggcaaacctcgctcaccctctggcagcaggcactcagccaggcccctggcagcgacgactatcgtatcggctatatcaaaacgctcgccgatgcccgcaaggacggcgaggcgctcagcgaagcgcgtcgcctggtggcggagcaggcgagcgttgcgcacctgcagacgctctcctatgtctacctgcggctgggcaaaagctgggaccagctgttggtggacacgcagatcctcgatcgtgatccgcaaaacaaaaccgcgctggccagcctgatggcgaccctgacccgcaaccggattgattcccctgctctcggcctggcgaatagcgtcgaactgacgcctgcggaaaagcgtaacttgcagttgaacgccgccgccgaactggtgcgccttgccgataccccttcccgcgaagaaaaggcgcgttacgcgctggcccgcacggcgctcacgcagtatgacgcgatgatcgccgcctggcaccccgacccacaggctgcgcccgacatcatccgggcgcgtattgatcgtctgggcgcgctgtacgccagcgccgagtacgcgcaggtcatccgcgaataccaaagcctgatcgcccagcagcagaccgttcccgactgggccatcggctgggtcatctcctcttttatcgcccttaagcaaattgagcctgcgctgacgcttatccaccagcatccttcgtggctgacaagccaacagaatgaggaacacgagcttttctacgctctgctggacaccggtcagtacccggcggcgcaacggtatgtcgcccgcctcaccaggaatgcgccctacatccgtcgtctctacggctcgccaacgccgcagccgaacgacgactggctcaccgcacagtcgcttaacgtgcactatttagcggctaccaacgacctgccgcaggccgaagcccgaatgcagcgcctggcggcgacggcccctggaaaccagggcctgcagatagactatgccgcccttctgcaggagagaggattgccacgggcagccgaacgccagctaaaagcggcggaatctctggaacccgccagcctgcagctggagcgccagcaggcctgggtcgccctcgatctgcaggagtggcggcaaatggatctgctggctgacgacgtcgtcgcccgctcgccacgggatctgaacacccagcgcctggccagagcgcgcgagatccatcatctctccgagctgcgcctgagcgttggcaaagggctgcattccgacaacccggtgagcggcacgcacgacctcagttttgagacggcgatctacagcccgccgctagccgacagctggcggttgttcggcgggcaccgcttcgctgaaggcaattttgaagaggggaaaggcagccgtcgccagctgtttgccggtattgaatggcgtccgcgcgactactggggcgagcttgagctctccagcgtcaattttcacggtgagaacaagcccggcgtccgcctttccgccgcccatgacgttagcgatcgctggcagctgggcggcgaactggagcggatttcgcagcagacgccgctgcgcgcgttacgcaacggcgtcagcgccaaccgcggcgaaggctggctgcgctggtctccaaacgaacgccgggagtaccgcgtcagcgcggccgccagccggtttaccgatcgcaaccgccgccaggagtacaccctctccggtaaagaacgcctctggcaaactccatggttaacgctggatttgcagcccggtctgtcggccagcgccaatagccgcaccgacaccgcctactacagtccggcacgggacctcgccgccaccgcggcgctggccgtcgatcacacgctttaccagcgctatgacaccgtctggagccagcagttactggccggcggcggcagctactggcaaaaaaatcacgccgccggggcgatcacggttctgggttacgggcagcgcctgcgctggaacaacgtcgtcgacaccgggctgatgctgaactgggataagcgcccctacgacggcaaacgtgaaaacaacctcgccatcactcttgatgcaaatatacggttttaa

SEQ ID NO: 1330 - DNA, 270 bp, Klebsiella pneumoniae
cttgaccctgacgccggtcaggaatcgggtcaaaacggagtaaaaagccccattagtatagctatcataaggcttttttctgttagccgcagaggcatgaaaaatccgcataaccgcagcgttgacatagctggcgttaagcctttatatatccgcagtgcttacgtattggtaggtatctattgctcgcgcatttcacgctacagcgaaagggtattcgcgggggatataatgtccctgttcccccggccaggtgaaagacgtcagtaa

SEQ ID NO: 1331 - DNA, 1647 bp, Klebsiella pneumoniae
ggagaagctgattccgtgttaactctgctacacctgttgtccgcggttgctctgctggtgtggggcacgcatatcgtgcgtaccggggtgatgcgcgtctatggcgctcgcctgcgtaccgttctcagtagcagcgtagagaaaaagccgctcgccttctgcgcgggtcttggcgtgactgcgctggtgcaaagcagtaacgccaccaccatgctggtgacctcatttgtcgcccaggatttagtgggtctgatgccagcgctggtgatggtgctgggggccgacgtcgggacggcgctgatggcgagggtgttgaccttcgacctgtcgtggctgtcgccgttgttgatatttatcggggtgattttcttcctcggtcgcaagcagacccgcgctgggcagcttggacgggtggggatcggtctggggctgatcctgttggccctcgagctgattgtccaggccgtacaccccataacccaggcgaacggcgtgcaggtgattttcgcctcgctgaccggcgatatcatgctggatgccttgatcggcgccgtatttgcaatcattagctactccagcctggcggcggtgctgttaacggcgacgctgaccgcggcgggagcgatctctttcccggtggcgctgtgtctggtgattggcgccaacctgggatcggggctgctggcgatgcttaacaacagcgcggcgaacgcggcggcgcgccgggtggcgctgggcagcctgctgtttaagctggtggggagcctgattattctgccgttcgtccatccgctggccgcggcgatgcacaagctgccgttggccgagtccgagctggttatctacttccacgtcttttacaacctgctgcgctgcatcgcgatggtgccctttgccggaccgatggcgaagctgtgccagcgtctgatccgcgatgagcccgagctggataaccatctcaaacccaagcatctcgacccgtcggcgctggacaccccggcgctggcgctggccaatgccgcgcgcgagacgctgcgcattggtgacgcgatggagcagatgctggagagcctgcacaaggtgatgcatggcgaaccgcgtcaggagaaagagctgcgccgtatggcggatgatatcaacgtactttacaccgctattaagctctatctggcgcgaatgccaaaggatgagctggcggaagaggaatcccggcgctgggcggaaattattgagatgtcgttaaacctcgaacaggcgtccgatatcgtcgagcgaatgggcagcgagatcgccgataaatcgctggcggcgcggcgcgccttctcggtagaagggttaaaggagctggacgccctgtacgatctgctgctcagcaacctgcagctggcgatgtcggtcttcttctccagcgatgtgcccagcgcccgccgcctgcggcgcagcaaacaccggttccgcattcttaaccgccgctactcgcatgcgcacgttgaccgtctgcatcagcagaacgtgcagagcatcgaaaccagtacgttgcacctggcgctgctgggggatatgaagcgtctgaacagcctgttctgctcggtggcttacagcgtgatggagcagccggatgaagacgacgaacgggatgactactga

SEQ ID NO: 1332 - DNA, 954 bp, Klebsiella pneumoniae
aagatgaatgatgtaaccgaggcgagcctgcccaaggcaatttttttaatgggcccgacggcctccggcaaaaccgcgctggcgatagccttacgtaaagttttgccagtagagttgattagcgttgattccgccctcatttatcggggaatggatattggcaccgccaaaccggatgctgcggagcttagcgctgcgccgcatcggctgctggatattttggatcctgcggaggcctattccgcggcggattttcgccgcgatgcgctggcggcgatggcggatattgtcgccgccgggcgaattccgctgttagtcggcggaacgatgttgtatttcaaagcgttgctggaaggattgtcgcccttaccgtcggctgacccagaggtcagagcgcggattgagcagcaggccgcagagcaggggtggaatgcgttacatcagcaattacaggagatcgatcccgtggctgctgcgcgtattcatccaaatgatccgcaaaggctttcccgggcactggaagtttttttcatttcgggtaaaactttaacggaactgacgcaaacgtcaggagacgctctgccatatcaggtgcatcagttcgccatcgccccggcgagccgtgaactgctccatcaacgcatagaacagcgttttcatcagatgttagcttcaggttttgaagcagaagtacgggcgctttttgcccgcggagatttgcatacggacatgccttccatccgttgtgtcggataccgccagatgtggtcatatctcaatggcgagatcccgtatgatgagatggtttatcgaggtgtttgcgccacgagacagttagccaaacgtcaggtcacctggctgcgcggttgggaaggtgtgcactggttagacagtgaacaacctgaacaagcgctcaacaaagtattacaggttgttggtgcgagccagaactga

SEQ ID NO: 1333 - DNA, 720 bp, Klebsiella pneumoniae
atttcgcttttcgcgccgacgtcgacgccgcgggtgggttcatcgaggattagaatgcgcgggccaatcgccacccagcgcgaaattaacagcttctgctggttgccgccggacagtccgccggcgcgcacctgggcgtgcggcacgcggatgttaagcaactggatggcgtcatcggagatggtttgcgccttccggcggttgagcatcccccaggtcgcgtcgcgctccagcgtcgccatggtgatgttttcctgggctgccagttcgagaaacaacccctgttctttgcggttttcggtcagaaagccgatcccgaggtcgatggcttcccgcggcgagtggatcaccaccggctcgccgtcgatctcaatcaccccggcggtggctttgcgcaccccgaagatcagctgcgccagttcggaacgcccggcgccgaccagcccggcgaggccgacgatttcgccggcatgcaccaccaggctgctgggcttaaccttgccgccatcggtcagatcctcgacccgcaggcgcggctggccgcggggaatgtcccgttctttattgaacagatcgctgagcggccgaccgaccatcatgcgcaccagctccggcgcgttgagcttgtcgcgcaccaggctgccgacatactgcccatcgcgcaggacgctgacccggtcggagagctcatacacttccgccatgcggtggctgatatag

SEQ ID NO: 1334 - DNA, 774 bp, Klebsiella pneumoniae
acaaaaggtgacacgatgagcctgaccctccgcttaaccggcaccggcggcgctcagctggtgccggtcttcggctgcgactgcgcggcctgccgccgcgctcgccgcgaggaaaatcaccgccgccgcccctgtagcggagtggtcacgttcaacagcgccgtgacgctgctcgatgccggacgaccggatctgatggaacatcatcccgccggcagctttcaacaggtgctgctgacccactaccatctggatcatgtgcaggggctgtttccgctgcgctggggagtcggcgcgtcgattccggtctatggcccgccggatgacgccggctgcgacgatctgctcaaacaccccggtctgcttgactttagccataccgtcacgccgtttgtgatgtttaacctgcaggggctgcgggtgacgcccctaccccttaatcactcgaagctgacctttggttatctgctggagtcggcccacagccggctggcctggctctcggataccgccgggctgccggacaagtcgctgaagtttttgctcaataaccgcccgcaggcgatgatcatcgactgcagtcatgagccgcgcgcgcagaccccgcgtaaccataacgatctaaacaccgtccgcagccttaaccaggtcattggctgtccgcgggtgatcctcacccatatcagccaccagtttgacgtctggatgatggataacccgctgccgacaggtttcgaagcgggctatgacgggatggaaatagcgctggattaa

SEQ ID NO: 1335 - DNA, 453 bp, Klebsiella pneumoniae
atgcacttcgataccgccacccgccagcgctggatgtccgtgctggcccacagtgaaccgcaggaccttctggcgcgcatgcagtccctgcagctggcgccggaatatgaattgattcgcaccccggaaaccgggctggtacagctccaggcccgcatgggcggtatcggcgaccgcttctttgccggcgacgccacccttacccgcgcagcggtacgcctggctgacggtaccctcggttacagctggatcttaggccgcgaccgcccgcacgctgaacgctgcgcggcgatcgacgccctgctgcagtcgccccgccattttcacaccttaatggaaactctgataaccccgctggaagcgctacgcagcgcgcgcattgaagcccgacgcgccgaagtcaacgccagccgggtcgacttctttaccctggttcgcggagataacgtatga

SEQ ID NO: 1336 - DNA, 279 bp, Klebsiella pneumoniae
cgcggttccgatggccagcgtgctcagcagcaggacggtgaggacttttctcatgctaattccctgtttggcgtcggggtggcctcgttatacgtcgcgccaccgctgtatgatgcgagcgattttgcgtcattcagccgggcggaaaaagcgattttgcccgttatgacgcttatttatacaattcagcggcgtagatggcgagaaaatgtccatttaaacaaaaaacgcaaaaaagtgatcgtcagggggttgcaggggcatcgaattctcgtataa

SEQ ID NO: 1337 - DNA, 1380 bp, Klebsiella pneumoniae
ccttttagcctgaaggatgacgggatgaagtatcgcataaccacctggcttgccgctgcactgatgctgtcgagtcttcacgccactgcggcgagtttatccgatatccaggtctctaacggagaccagcaggcccgtattaccctaagctttgtcggtgagccggagtactcctttaccccacagggtaaacgtctggtggcgctggatatcaagcagaccggcgtattgcagggactaccgctgcagtttagcggcagcaacctggtgaagagtattcgcgccggcacgccgcaggatacgcagacgctgcgtctgctggtggatctgacggaagatggcaaaacccgggcggtgaagcaacagaacggggcgaattacacggtggtctttaccatcaacgccgacgcgccgccgccgccgcctccgccgcccgtggtggtgaaacgggccgacccgccgccggtgatgccttcccggacgacgacgtcagggcgtaacccgttcagctcgtcgggtcatgaacggcagacggtgatgacctcctctcagccggcgatgaccaacaatcagaccgtgactcgcccggcggcccgcacggtgtcggcggatgataaagtcattatcgccattgatgccgggcacggcggccaggatcctggcgcgattggcccgaacggcaccaaagagaaaaacgtgactatcgctatcgcgcgcaagctgcgggcgttactgaacgccgatccgcagtttaagccggtgctgacccgcgacggggattactttatttcggtgatgggccgctctgacgtggcgcgtaagcaaaacgccaatttcctcgtctctatccatgctgacgccgcgccaaaccgcgatgccactggcgcctcggtgtgggtgctctcgaaccgtcgcgccaacagcgaaatggccggttggctcgagcagcatgagaagcagtctgaactgctcggcggtgcgggcgatgtgctggcaaacagccaggccgacccctacctgagccaggcggtgctggatctgcagtttggtcattcccagcgcgtcggctacgatgtggcgaccaacgtgctgagccagctgcagcgtattggcaacctgcacaaacgccgcccggagcatgccagccttggagtgctgcgctcgccggacatcccgtcgatcctcgtggaaacgggctttatcagtaacaacggcgaagagcggctgctggggagcgatgattaccaggagcagattgcggaggcgatttataacggcttacgcaactactttatgcagcatccgctgcagtcggcgcctcgcggcgaggcggcgcagaccgccagcgccgcggcgccgggcgggatgttgattaactaa

SEQ ID NO: 1338 - DNA, 771 bp, Klebsiella pneumoniae
atgaaaatagatgtgcttggctgcgggagcgccttttcctacacgcaaaatacctccgcgctgcgggtgatcgatgcggacaacaaacagtggttaatcgactgcggccccaccgttccccgcgcgctctggcagcgcggcggcgaggtcaacgatatcgacgcgatctacttcacccacgttcacccggaccactgcaccggcctgacggcgctactgaaccactggaaaagttattcccgtcagaagccagtcattatctactgccagccggcgcagcagccggtgctcatgcagctggccgcgctggcgaactggccgcaggcggaccttggtttcaccatcgactggcaggaatgccgcgaagcctggacgtggcaggactggcagatccgcactgcccccacccagcatgagctgagtaatcgcgccatccgcatcaccattgccgggcagacgctgttttacagcggcgatggccgaccgaccgccgactcgatagccctgatggccggcgccgggctggcgtttcaggagtgcgcctcggtagcagccctggacgatgacgcctcgcatggcgatttcccctcctgcctgatgctgttcagaacgctgcagctcccggcgatggggctctatcactgcgaggatgcttctctgtcggcgctaaagcaggcctgtcagccgtggccgggcttattcgtttcccgggatggactcaccttaacgctgccgcgtcccacgcccactgacgagacgtacctcctatga

SEQ ID NO: 1339 - DNA, 585 bp, Klebsiella pneumoniae
acaatttcagagggccttatggcgacttactatagcaacgattttcgtgctggtcttaaaatcatgttagatggcgaaccttatgcggtagaagccagcgaattcgttaaaccaggtaaaggccaggcgtttgcgcgcgttaagctgcgccgtctgctgaccggtacccgcgttgagaaaaccttcaaatctaccgattccgcagaaggcgcggacgttgtcgatatgaacctgacttacctgtacaacgacggtgagttctggcacttcatgaacaacgaaaccttcgagcagctgtctgctgacgcgaaagcgatcggtgacaacgctaaatggctgctggatcaggctgagtgcatcgtgaccctgtggaacggccagccgatcgcggtcaccccgccgaacttcgttgagctggaaatcattgaaaccgatccaggcctgaaaggcgacaccgcgggtaccggcggtaaaccggcgaccctgtctactggcgcggtggttaaagttccgctgttcgttcagatcggcgaagtgatcaaagtggatactcgctctggcgaatatgtatcccgcgtgaagtaa

SEQ ID NO: 1340 - DNA, 534 bp, Klebsiella pneumoniae
caccggccagaagcgcaggtcagcgaagtagtggtcaatcaggcacagggcgacgccattgacccggcgcagggtacgcaggtggatcacgttctcgccctcattgatgccaaaggcctcggcgacatgggcgctggcggggcgcagcaccgacagcagcttttcgctggtgggatcgctgccttgttccagcaggttttggctgaagcgcgcctgggcgttaagcgggtagtcgatggggcgcatcagcaccagcacacccacgccctgacggcgctgaacccagccgcgctcaaccagctggtcgatagcccggcgcagggtgtggcggttaacgtcgaagcgcgtcgccagctgctgctcggcgggcagatagtcgccgcagcgatagtggtggcgcagctcctgctcaagtcgggcggcgatttcctgatagcgcgtggggtaactggtcggatgtctggacaggtgcatggtcatcaagcctcacacagcataggcgaggagcttcctcgcgttgtgggccgatcctga

SEQ ID NO: 1341 - DNA, 1125 bp, Klebsiella pneumoniae
ggaataaaagaaatggcagcaaaagacgtaaaattcggtaacgacgctcgtgtaaaaatgctgcgcggcgtaaacgtactggcagatgcagttaaagtgaccctgggcccgaaaggccgtaacgtggttctggacaaatccttcggcgcgccgaccatcaccaaagatggtgtttccgttgcacgtgaaatcgaactggaagacaagttcgaaaacatgggcgcgcagatggtgaaagaagttgcctctaaagcgaacgacgcagcaggcgacggtaccaccaccgcaaccgtactggctcaggctatcgtgaacgaaggtctgaaagctgttgctgcaggcatgaacccgatggatctgaaacgcggtatcgacaaagcggtactggctgccgtagaagagctgaaagcgctgtccgttccgtgctctgactccaaagctatcgctcaggtaggtaccatctccgctaactccgacgaaaccgtcggtaaactgatcgcggaagcgatggataaagttggtaaagaaggcgtgatcaccgttgaagacggtaccggtctggaagacgaactggacgtagttgaaggtatgcagttcgaccgcggctacctgtctccgtacttcatcaacaagccggacaccggtgccgttgagctggaaagcccgttcatcctgctggctgacaaaaaaatctccaacatccgcgaaatgctgccggttctggaagccgtagcgaaagctggcaaaccgctggtcatcatcgctgaagacgttgaaggcgaagcgctggcgaccctggtggttaacaccatgcgcggcatcgttaaagtggctgcggtgaaagcaccgggcttcggcgaccgtcgtaaagctatgctgcaggacatcgctactctgactggcggtaccgttatctctgaagagatcggtatggagctggaaaaagcgactctggaagacctgggccaggcgaaacgcgtggttatcaacaaagacaccaccaccatcatcgatggcgttggcgaagaatccgcaatccagggccgcgtagctcagatccgtaagcagatccaagaaacgacctccgactacgatcgtgaaaaaactgcaggaacgtgtcgctaa

SEQ ID NO: 1342 - DNA, 1371 bp, Klebsiella pneumoniae
cctgatggagagtgcgtgatgtctgccccaaaaattacttttatcggcgccggttcgacggtgttcgtcaaaaatattctcggtgatgttttccagcgcccggcgctgaaatcggcgcatatcgcgctgatggatatcgatgaaacccggctggaagagtcgcatatcgtggtgcgcaagctgatggattccgtgggcgcgaacggcgaaatcagctgccaccgcgaccggaaaaccgccctgcagggcgccgattttgtcgtcgttgccttccagattggcggctatgagccctgtaccgtcaccgattttgcagtctgcaagcgccacggcctggagcagaccattgccgatacgctggggccgggaggcattatgcgcgcgctgcgcaccatcccgcacctgtgggctatctgcgacgatatgagcgaggtctgcccggacgccaccatgcttaactacgtcaacccgatggcgatgaacacctgggcgatgtacgcccgctacccgcatatcaagcaggtgggtctgtgccactcggtgcaaggcacagcggaagagctggcgcgcgacctcgatctcgatccggcggatttacgctaccgctgcgccgggattaaccatatggcgttctatctgtcgctggagaaaaagctcgcggatggcagctacgtcagtatctaccccgacctgctacaggcctacgccgacgggcgggcgccgaagccgaacctgcacggcaacccgcgctgcgaaaacattgtccgctatgaaatgttcaaaaagctgggctacttcgtcaccgagtcctcggagcatttcgcggaatacacgccatggtttatcaagccgggccgcgatgaccttatcgctcgctataaagtgccgctggatgaataccctaaacgctgcgtcgagcaactggccaactggcatcaggagctggagagctataagcgcggggagcgcattgaggtgaaaccctcccgcgaatatgccagcaccatcatgaacgccatctggaccggcgagccaagcgtggtgtacggcaacgtgcgcaacgataatctcatcgacaacctgcctcagggctgctgtgtggaagtggcctgcctggtggacgccaacggcatccagccgaccaaagtgggcgcgctgccggcgcatctggcggcgctcatgcagaccaatatcaacgtgcagacgctgctcacgcaggcgatcctcaccgaaaatcgcgattacgtctattacgccacgatgatggatccgcacaccgccgcggtgttggggatcgaagagatctacgcgctggtggacgatctgatcgccagccacggcgactggctgccggcctggctgcaccgttaa

SEQ ID NO: 1343 - DNA, 1413 bp, Klebsiella pneumoniae
ctggcagtggacggtccaccacgcatatcaacgaacgataaaaattttcaggggaagttttctatgtctacgccttcagcgcgtaccggcggttcattggacgcctggtttaaaatttcggcgcgcggcagcaccgtgcgtcaggagattgttgcaggtcttactacctttctggcgatggtgtactccgtcatcgtggtgccgggcatgctcggtaaagcgggcttcccgccggccgcggtgtttgtctcgacctgtctggtagcgggcgttggctcgctggcgatgggattatgggcgaatctgccgatggcgatcggttgcgctatctcgttgaccgccttcaccgccttcagcctggtgctggggcagcagatcagtattccggtagccctcggcgcagtattcctgatggggatcctgtttacggtgatctcggcaaccggcatccgcagctggatcttgcgtaacctgccgcagggcgtggcgcacggtaccgggatcggcattggcctgttcctgctgctgatcgccgccaacggcgttggtctggtgatcaaaaacccgctggacggtttgccggtggcgttgggcaactttgacagtttcccggtggtgatgtcgctgattggcctcgcggtgatcattggtctggaaaaaatgaaggtgccgggcggcattctgctgaccattatcggcgtgtcgattgtcggcctgattttcgatcccaacgtccatttctccggcattttcgctatgccatccctgagcgatggccagggtaattccttgatcggcagcctggatatcgtcggcgcgctcaacccggtcgtgctgccaagcgtgctggcgctggtgatgacggcggtctttgacgccaccggcaccatccgcgcggtggctggccaggcgaacctgctggataaggacggacagatcatcaacggcggtaaagcgctgaccaccgactccctgagcagcgtcttctccggtttagtcggggcggcgccggcggcggtttatatcgaatcggcggcgggtaccgcggccggtggtaaaaccggtctgaccgcggtgacggtcggtgtcctgttcctgctgatcctgttcctctccccgctctcttatctggtgccggcctacgcgaccgcgccggcgctgatgtacgttggcctgctgatgctgagcaacgtggcgaaaatcgatttcaatgactttgttgacgcgatggctggcctgatcaccgcggtgtttatcgtgctgacctgtaacatcgtgacgggcatcatgatcggtttcgcgaccctggttattggccgtctggtctccggcgagtggcgcaaactgaacctcggcacggtgattatcgctgtggcgctggtggtgttctacgccggcggctgggcgatttaa

SEQ ID NO: 1344 - DNA, 477 bp, Klebsiella pneumoniae
  unsure (472): Identity of nucleotide at the above locations are unknown.
ttaactaaggagcaggggatgccgattcaggttctgccgccgcagctcgccaaccagattgccgccggcgaggtggtggagcggcccgcgtcggtggtgaaagagctggttgagaacagtcttgatgcgggcgccacgcggattgacattgatatcgaacgcggcggcgcgaagcttattcgcatccgcgataacggcagcggcatcaaaaaagacgagctggcgctggccctagctcgtcatgcgaccagcaagatcgcctcgcttgacgatctggaggccattatcagcctcggctttcgcggcgaagcgctggccagtatcagttcgttagcgcgcttaacgctgacttcgcgcacggcggagcagcaggaagcctggcaggcgtatgctgaaggccgcgatcaggcggtgacggtgaagccggcggcgcacccggtcggtaccacttctggaagtcctcgatctgttntataa

SEQ ID NO: 1345 - DNA, 324 bp, Klebsiella pneumoniae
gacatgggggaaagcctgatggctacagtaacagtgacgtttaccattaccgaattgtgcctgcgtaccggggtgtcggaagaggagctgacggagatcgtcggcttagggatgattgagccacaccagccgcaggcggacacctggctgttcgacgacagcgcggtgacaatcgtgcatcgcgcggtacgcctgcgtaacgagctggagctggactggccgggaattgcggtggcgctgaccctgctggatgagaacgcgcggctaacccgcgaaaatcgcctgctgcagcagcgcctggcgcgcttcctcgcccacggatag

SEQ ID NO: 1346 - DNA, 495 bp, Klebsiella pneumoniae
  unsure (9),(16): Identity of nucleotide at the above locations are unknown.
gtaaggacngattccntacaccttttccctttccggggagaggataaaaataagtccttcccccaggatttcactcgcaggaacgccgtcagcaacacctgtcccggctccgtcgccggaggggttgctgtcgccagcgtccgccgagtggatgacgaaagggagacctctggagacgctaagatgaatgaacaactttgtcagcggatagaaaatagtgcgcatttcagggagttagttgcatcacggcaacggtttgccgccattctgtcagtgattatgttagtgatctacgtgggctttattttgcttatcgcctttgcacccggctggctcggcaccccgctgcacgccggaaccagcgtcacccgcgggatcccgctcggcattggcgtgatcgtcatttcgtttatcctgaccggtatttatgtctggcgagctaacggtgaattcgaccgtttgaccaaaagcgttctcaacgaggtaaaagcatga

SEQ ID NO: 1347 - DNA, 387 bp, Klebsiella pneumoniae
ggaattatactcgcctgcagacaaaacgacgaatcgagaattgagagaggccgctttatgtcccatcaggatataattcaaactttgattgaatggattgatgaacatatcgatcaaccacttaacattgatatagtcgccagaaagtcaggatactcgaagtggtacctgcagcggatgttccgtaccgtgatgcatcagacgctgggggactatattcgccagcgccgcctgcggctggcggcggaagcgttgcgaaccacccagcggccgatctttgatatcgccatggatctgggctacgtctcgcagcaaaccttctcccgggtgttccgccgcgagtttgaccgcactcccagcgactatcgccatcagatctccgcgtga

SEQ ID NO: 1348 - DNA, 1815 bp, Klebsiella pneumoniae
ggcataggtttcgccatcctgccgcctcccatcatcagccacagggaactgcgtatgacacgcttactcaagacaatcttgcccatcatcctctgcgccctcttcgggttatcgttcgcttcacccacgcaggctgtcgccagtctgccgatcgttcttcccgcgctgacatgcgatgcgctaagcgctaccgacttcagcgcggccgttggcgcaaaggtcactatcaaccacactgaaatgcagacctccgcgcagggaagctggtgcaaggtgagcgccactatcgcccctgagattggcgtgcagattgccctgccgactcaacgctggagtcaacgttttttgcaggtcggctgtggcggactgtgcgggagtattaacctgagtctgtcgaatgccagcggctgcctgccggcaatgaacggcgagtttgtggtggcagcaaccgatatggggcaccatggcagtatgatggatgcgtcatgggccgaagatccgcaaaagcgcatcgattttgcctggcgcgccaaccatctgaccgccgtgctggccaaagcggtgatgcagacgctttaccgccagccgccaaagtatgcctactttatgggctgctcagacggcggtcgcgaagcattgatggaagcgcagcgctttccgcaggattttgacggtatcagcgctggcgcgccagcggcctttttccagtttcagaactccttcttccacggctggaatgtggccgccaatcagcgcccggacggtaccgctatcctgctgaaaaatcgccttcctctgattcaccaggccgtgctggctcactgcccgacgctttccggcgtgcaggatggtatcctgcaaaatccgtatgcctgtcagttctctgagtcatggctcccccgctgtcctgccgatgctcgggaccgttctacctgcctgacgcaggaagagatcgaggtggtgaaaaagctctaccgcggcgcttacgacagccacggcgcccagttcgtcgcgggcggtctgccgctgggttccgagctacgctggccggtgcccgagacgccgaccggccactcaatgtcggaaatgatggtactaccggctctgcaatccgtgctcctgccaggagaaaaacagaagatccaatcgatgcgggattttccgcttaaccagcagaattttgacgccgtcgcccaactggcgccgctctataacgcggcaaataccaatcttcatgcctatcaacagcgcggcggcaagcttatcctctggcacggtctggccgatgactccgtcagtccggccttttctatcgcctattatcgcggcgtagaagcagagatgggccatgccgcaacggataccttcctgcggttattcctgctgcctggggtatcccattgcggttatggcgaaggttacgatcaaattgatctccttactccgctgatgcgctggaccgaggaaggtatcgcgccgcaggagatcatggccggcaaacgggcaacagccgctgccgacctgccgccgatgacagaaaaaccagatgcgcaaacgcagtttcacggcgtgcagaaagtcagtcagccttacgctgacgccgctccagcggttatcgcgactcgtccggtgtatcccttcccggccattgcccattataacgggcgcggcgacgtgaatgacggcgaaaattatcatgcagagcaaactaccgcctttggtcatctgcagctggcaaaacccgccagcgactatattggccctgataatcaaaaaaattatcaggttcgccacggcatactcactgttcaataa

SEQ ID NO: 1349 - DNA, 558 bp, Klebsiella pneumoniae
aaaaggaaactcatcatcgttaagccaccgaagtgtatccacgagtacaacaccaaaaaggacgggtatatgaaaatcaaaactggcgctcgcatcctcgcgctgtcggcactgaccacgatgatgttttccgcctctgccctcgcaaaaattgaagaagtaaagctggttatctggattaacggcgacaaaggctacaacggcctcgctgaagtgggtaaaaagtttgaaaaagacaccggcattaaagtttccgtagaacacccggacaagctggaagagaaattcccgcaggttgcggcgaccggcgacggcccggacatcatcttctgggcgcatgaccgtttcggcggctacgcgcagtcgggcctgctggcggaaatcaccccggacaaagcgttccaggacaaactctatccgttcacctgggatgcggttcgctataacggcaaactgatcgcttacccgatcgcagtcggaagccctgtccctgatttacaacaaagacctggtgccgaacccgccgaagacctgggaagagatcccggcgctggataa

SEQ ID NO: 1350 - DNA, 189 bp, Klebsiella pneumoniae
  unsure (25),(57),(71): Identity of nucleotide at the above locations are unknown.
gccatcatctggcgccagcagacgnagaggttgggcttcgccaactactgcctcgcngattttgtcgcgcngaagctgagcggccaaggcggactacatcggcgcgttcgccgtgaccggcggccttggaagaggacgcgctggcggacgcctatgaagcgcagcatgatgactataacaagatcatga

SEQ ID NO: 1351 - DNA, 984 bp, Klebsiella pneumoniae
gcggaatgctgttcacaagcccgacgaagcttctggagaatgaatcacacaatccaggttttttctcgcccacaaggtagggtatatttcgcttttacaggagaatctatgctgcccgactcatcaacccgattaaacaaatacatcagtgaaagcggcatctgctcgcgtcgcgaagcggaccgctttattgaacaaggcaacgtctttatcaatggcaagcgcgccacgattggcgatcaggtgaagcctggcgatttagtcaaagtgaacggacggttgattgagccgcgcgaagcggatgatctggtactgattgcgctgaataagccggtcggcattgtgagcaccaccgaagatggcgagcgcgacaacattgtcgatttcgtcaaccacagcaagcgtatcttccctattggccgtctggataaagattctcaggggctgatcttcctcaccaaccacggcgatctggtgaacaagatcctgcgcgccggcaacgaccatgaaaaagagtatctggtgacggtcgataagccggtgaccgatgagttcattcgcggcatgggcgcgggggtgccgattctcgggacggtgacgaaaaaatgtaaagtgaagaaagaggcgccgttcgttttccgcatcactctggtgcaggggctgaatcgccagatccgtcgcatgtgcgagcactttggctatgaagtgacgaagcttgagcgtacgcggattatgaatgtcagcctgacggggatcccactgggagagtggcgcgatctgaccgatgacgagctgatcgacctgttcaagctgattgaaaactcctcttccgaagcgaagccgaaagccaggccgaagcctaaagcggcgactcccggcatcaagcgcccggtagtgaaaatggaaaatagcaacgataagggccgcccggctggcaacgggaaacgtttcacccagccgggacgtaaaaagaaaggtcgttaa

SEQ ID NO: 1352 - DNA, 261 bp, Klebsiella pneumoniae
ggccagtgctgtttttccacgccggggagccaggttttctgcgttccccgctggtattttataaggggtttacgcttgtttgaccgttatgacgccggtgagcaggcggtactggtacacatctatttttcgcaagacaaagatatggaagatctccaggagtttgaaactctggcctcttccgccggtgtcgaagcaatgcaagtgattaccggtagccgtaaagcacccgacccgaagtattttgttggtgaaagttaa

SEQ ID NO: 1353 - DNA, 336 bp, Klebsiella pneumoniae
tggaggcgatggaaaatgagtaatagctattttatcgccctgacgctgggcatggccgcggtgacttttctcatccgtttctcgtttatcggcctggccggcaagatccagatgtccgagcgggtgaccaaaacgctacgcttcgtgccggtcaccgttctgccggccatcatcaccattcagatcctgagcgtgaattccagcatggagttcgacttaaaaaatccgaaggtgatcgccgccatcatctgcacgctcgccagcttccgtttaggcctggtgtgggtggtagtgagcggcgtcggctcgctggtgttgttaaattattttatgtaa

SEQ ID NO: 1354 - DNA, 438 bp, Klebsiella pneumoniae
atgcgaccgtggaaatcagcgggaggcggggtgaataagcgactgatagcgggggttgtagcggctgcggtaggtggttatctactatggcagtatctgtccccggttgagattgtggcagttcacgatggaaatacgattctggtcaggcattttccatacctgaaaagtcgtcagatagcctggtgggaagccaataaggccgtaatacaggcgaagtacgggattccacacgagggtaaagacggcttttaccatgtatggattgttgattttgggaatggatatcgcacggaaccggatgaaaacctactgttttctaccgatgaggttttttgttttaacgacatcccgacagaggatcggtgtattgatagaaagcccctttttgacgttaggtggagtaggaattacgggcttaaatatgagtcgtattaa

SEQ ID NO: 1355 - DNA, 249 bp, Klebsiella pneumoniae
attgaagcgtgggtgctatcgaagctggtgccgctaaacgcgatggtcaccgccgacgcatcggcggaacagctggaaaagaccagcttaaccggcacgctggcgccgctcgccccggcatgtccggagaacgtctgcgaggagacggtgcctaaatcgatactgttcgacggctccacggccacctcacaggaaggcgcttcgatggtgcccgtgacgttaaaattgaccgtgctgctgccctcataa

SEQ ID NO: 1356 - DNA, 1317 bp, Klebsiella pneumoniae
cagcttctgctggttgccgccggacagtccgccggcgcgcacctgggcgtgcggcacgcggatgttaagcaactggatggcgtcatcggagatggtttgcgccttccggcggttgagcatcccccaggtcgcgtcgcgctccagcgtcgccatggtgatgttttcctgggctgccagttcgagaaacaacccctgttctttgcggttttcggtcagaaagccgatcccgaggtcgatggcttcccgcggcgagtggatcaccaccggctcgccgtcgatctcaatcaccccggcggtggctttgcgcaccccgaagatcagctgcgccagttcggaacgcccggcgccgaccagcccggcgaggccgacgatttcgccggcatgcaccaccaggctgctgggcttaaccttgccgccatcggtcagatcctcgacccgcaggcgcggctggccgcggggaatgtcccgttctttattgaacagatcgctgagcggccgaccgaccatcatgcgcaccagctccggcgcgttgagcttgtcgcgcaccaggctgccgacatactgcccatcgcgcaggacgctgacccggtcggagagctcatacacttccgccatgcggtggctgatatagatgatcgccatcccctcatcgcgcaggcgcaggatgagctcgaacaggcgctgggtttcccgcgaggagagggcggcggtgggttcatccatcaccagaatgcggctttgacggtgcagggcgcgggcgatctccacctgctgttgttcggcgatggtcagggtcatcacccggtcgctggctttgaactgggcgccgagacggtcgatcaccgcctgcgcctggctgagcatggctttgcgctgcaccagaccaccgcgcgccagctcgctgccgaggaaaatgttttccgcgacggtcaggttcggcgccagctgcatctcctggtagatcaatgtgatcccggcggccagcgcgtccttggggccgcggatcgtttgcggttttccgtcgatcaggatctcgccgctggtggcggtataggcgccggcgaggatcttcatcagcgtgctttttccggcgccgttctcccccatcagagcatggatctcgccgggccagaccgtcaggtcgacgcccttcagcgcgtagaatttgccaaaagctttggcgatatggcgcatttccagtaccggggtggcggtcatcgcggcgctcctgtctgtaagaacaatagctgcagtccaccatcggaaaataaatgcagaatgtcagaatccattcatatttgtcatagtgataaatag

SEQ ID NO: 1357 - DNA, 612 bp, Klebsiella pneumoniae
gaaaaaggtcgccaaatcgctgttctgggtgatctggttcccgatggtctactggatgatcggcctgctgaccacgctggtcgcttttccgaaagtgatggtgaaacgtcaacgttcccgcgcgcgctgggtgagcccggaccggggaaaaggaagcctgtgatgaatgaaaatacgctcatcttaaccgaacatcgggtgctgccccggctggtcgacgccggcttaacgctgctggcctggctcggttttctgttctttctgtacgccaatttgctgatgcagttcatcgcgccgccctctccgcgctgggaatcgctgatggactccctgaatacggcgctggtgtatctgctgattgccgcgctgaacggctggctgttgatcctctggtatcactacaaccggcgccgcgcccgtacccggcgtcataccgcggtgctcgctctgcgcgacgatgagctggcgagcagctttaacgttgcgccgcagattatctcggagatgagccgctataatttgctcatcgtttaccacgatcaaatcgggcagattattgatttaaaaagccacgcgttaccgccgccgcaagaagagagcgatgacgcatga

SEQ ID NO: 1358 - DNA, 792 bp, Klebsiella pneumoniae
acagcattccgcttacccacatcatgcgccatatcagcgcgtcggtatgggggcgatgctagaatttctgcttcaataatatttttaaaacaggaagaaaagatggaactgctgttactcagtaactccacgctgccggggaaagcctggctggaacacgccctgccgctgatcgccgctcaggtcaaaggccgccgtaaggcggtattcatccccttcgctggcgtgacgcaatcctgggatgattatacggccaaagtggctgcggttatggcgcccatggcggtcagcgtaaccggtatccacagcgtcgacgaccctatcgccgccattgaaagcaccgagatggtgatcgtcggcggcgggaacaccttccagctgttgaaagagtgccgcagccgcggtctgttggcgccgattgtcgatgtcgtcaaacgcggggcgctgtatatcggctggagcgcaggttcaaaccttgcctgcccgaccattcgcaccaccaacgatatgccgattgtcgatccgcagggatttgatgcgctggggctgttcccgctacagattaacccgcacttcaccaacgcgttgccgaccgggcatcagggcgaaacccgcgaacagcgtatccgcgaactactggtcgtggcgccggaattaacggtgattggtttgccggaaggaaactggatccaggtcaccgatggtcacgcgacgctcggtggcccgaacccgacgctgttgttcaaagcgggggaagaagcgataaccctgcctgcgggccaccgcttctga

SEQ ID NO: 1359 - DNA, 225 bp, Klebsiella pneumoniae
gttttcatccggttccgtgcgatatccattcccaaaatcaacaatccatacatggtaaaagccgtctttaccctcgtgtggaatcccgtacttcgcctgtattacggccttattggcttcccaccaggctatctgacgacttttcaggtatggaaaatgcctgaccagaatcgtatttccatcgtgaactgccacaatctcaaccggggacagatactgccatag

SEQ ID NO: 1360 - DNA, 189 bp, Klebsiella pneumoniae
gcccgggtccgatcaataaccccggaattggcacagggcgttccagggttaagtttctgggcccgatctaggggcatgatcaaaaagcacgcccaaagcgccgttcgcttaacgggcttcagcaattttggattgcttaactttcaccaacaaaatacttcgggtcgggtgctttacggctaccggtaa

SEQ ID NO: 1361 - DNA, 804 bp, Klebsiella pneumoniae
tcgcttacccgatcgcagtcggaagccctgtccctgatttacaacaaagacctggtgccgaacccgccgaagacctgggaagagatcccggcgctggataaagaactgaaagcgaaaggtaagagcgcgctgatgttcaacctgcaggaaccgtacttcacctggccgctgatcgctgccgacggcggatacgcgttcaagtttgaaaacggcaagtacgatgtgaaagacgtcggcgtggacagcgcaggcgcgaaagcgggcctgaccttcctggttgacctgatcaagaacaagcacatgaatgccgacaccgactactccatcgcggaagcggccttcaacaaaggcgaaaccgcgatgaccatcaacggtccgtgggcgtggtctaacatcgataagagcaaggttaactacggcgtgaccctgctgccaacctttaaaggcaaaccatcgaaaccgttcgttggcgtgctgagcgcggggatcaacgccgccagcccgaacaaagagctggccaaagagttcctcgaaaactacctgatgaccgatcagggtctggaagccgttaacaacgacaaaccgctgggtgccgtggcgctgaaatccttccaggaaaaactggaaaaagatccgcgcatcgctgccaccatggcgaacgcccagaaaggcgaaatcatgcctaacatcccgcagatgtctgccttctggtatgccgttcgtaccgcggttatcaacgccgccagcggtcgccagactgtcgatgctgcgctgaaagatgcacagagccgtatcactaagtaa

SEQ ID NO: 1362 - DNA, 606 bp, Klebsiella pneumoniae
agtatgacccgtatcacctgccggctctcggtgttttctgaggaacgtgataaagtaacagattcaaattcacgcaacccgaggatgctcatggataagaccccttcgcaagagatgttagcgcatgctgaaaagctttgcgcacagcgcggcgtacgcctgactccacagcgtctggaagtgttgcgcctgatgagcctgcagcaaggggcaatcagcgcctacgatctgctggacttgctacgtgagaaagagccgcaggcgaagccgccgacggtttaccgtgcgctggagtttttactcgagcagggttttgtccataaggtagagtcaaccaatagctatgtgctgtgccatctgttcgaccagccgacccatagctcggccatgtttatctgcgaccgctgcggcgtggtaaaagaagaagcggcggaaggggtggaagatatcatgcatacgctggcggcccgcatggggtttgccctgcgccacaatgtgatagaagctcacgggctttgcgcgggctgcgtggaagtcgaagcctgcagcaccccgggacactgccagcatgatcatactattcagctcaaaaagaaagcccgctga

SEQ ID NO: 1363 - DNA, 2370 bp, Klebsiella pneumoniae
atagttaaccgcgatcacagttacgcggcgtcattttctgcaccgtcacgcttatctgccgaccgatccttcaccggagttgttatgaccgctcgccgatacccgtttttcaccagcgcccgtggccgcctgctctcctttaatctgctgatggtcgtggtcaccctgttggtcagcggcgtggcggtgttcggctttcatcacgccagccagctgcaggagcaggtgcagcgccagactctcaacgacatgcgcggcagtatggatctggcgcgggacacggcgaatgtcgccacggcggcggtgcgcctgtcgcaggtggtgggggcgctggagtacaaaagcgaagcggaacggctgctggcgacgcagcaggcgctgaagcactcgctggcccagctggcggcggccccgctggcgcagcaggagcaggcgcgggtggccaatattattcgccgcagcaacgcgctgcagcagagcgtggcggagatgctggagcgcggccagcgccgccatctgcagcgcaatgcgctgctgagttcgctttaccagaatcagagtaacctgcgccatctcgccgatcttaacgatcgcggcggggataaggcgatcgatccgcgccggctggccgagatggaccggctgatcgtggctgcgatccataccgtcacgccgcggtcgatcgtcctgcaactcgaccagctgcgcggcgccctgccgacacgcagcgccgatcccgcgctggcgtttgtcctccctgatgtgacccgcgaactggcgacgctggccccgctgtcggcccagctggaggagagcgacctgacgatcagctggtacatgtatcacatcaaagcgctggtcgcgttgcttaacgaagatatcaatcagtacgtgacccgggtggcggaagcctcagagcagcgggcggcgcagagccatcgggagctgcgctccatcagtatgtttattctgctttccgcgctgctggcgctggcgatcaccggctgcgccgggtggtacatctaccgtaatctcggctcgaacctgaccgccatctcgcgggcgatgtcgcggctggctcagggagagccgaacgtctcggtgccggccctgcagcggcgcgacgagctgggggagctggcgcgggcctttaacgttttcgcccgcaatatggcgtcgctggagcacaccacccggctgctgaaagagaagaccaaccagatggagatcgatcggattaagcgccaggagctggaggaggcgctgctgcatagtcagaagatgaaggccgtcggccagctgaccggaggtctggcgcatgactttaacaacctgctggcggtgattatcggcagccttgagctggtggagccggatgcgcgcgatgcgccgcgcctctccagggcgctgaaggcggcggagcgtggggcgcttctgacccagcggctgctggccttttcgcgcaagcaggcgctgcatccccaggcggtggcgatggcgccgctactggagaacctcagcgagctgatgcgtcactccctgccggcgaccttaagcctggagattgaggcgcagtcgccggcgtggccggcatggatagacgttggccagctggaaaacgccctgatcaatctggtgatgaacgcccgcgacgccatggcggggcgcgacggggtcatcaaaatacgcacctggaatcagcgggtcacccgcagcagcggccagcggcaggatatggtggccctggaggtgatcgatcatggcagcgggatgtcgcaggcggtgaaagcccgggtgtttgaacctttcttcaccaccaaagccaccggcagcggcagcggcctggggctgtcgatggtgtatggctttgtgcgccagtcgggcggccgggtggcgctggagagcgcgccggggcaggggacgacggtgcggctgcagctgccgcgagcgttgaccgaggttgagaaggaggtggcgccagcggtggacgagccgtccccggcgggcgagcggctggcgctggtgctggaagatgaagaggatgtccgccagacgctatgtgaacagctgcatcagctgggctggctgacgctggaaaccgccagcggtgaagaggcgctgcagctgctggaggcctcgccggatattgccctgctgattagcgatctgatgctgcccggcgccctgagcggcgccgatgtgatccataccgcccgacgccgctttccggcgctgccggtgctactgatcagcggccaggatttgcgtccagcgcagaacccggccctgccggaggttgagtggctgcgtaagccgtttacccgagcccagctggcgcaggcgctgagcgcggcgtacgcgaggatttga

SEQ ID NO: 1364 - DNA, 393 bp, Klebsiella pneumoniae
aggataaaccgtatgattattaccaccgctgacgcgcctgccgctatcggcccgtacgtgcagggcgtcaatctcggcgcgatgaccatcacctccggtcagctgccgattaatccgctggacggcaccatgcccgaggacattgccgaacaggcgcgccagtcgctggagaacgtgaaagccatcgttgaagctgccggactcacggtcgggcagatcgttaaaactacggtgtttgtcaaagacctggcggattttgccgccatcaatgccgcctacgaggccttctttatcgaacaccaggcggcctttccggcgcgctcctgtgtggaggtagcaaggttaccgaaagatgccggcgtcgaaatcgaagcgatcgctttcgcccgctaa

SEQ ID NO: 1365 - DNA, 810 bp, Klebsiella pneumoniae
agatcaccacgctgccgccggcaaaacgtgtctatggcgcagaagcggacgcggctgagaagaaggagaccacccatggctgagatgaaaaacctgaaagtcgaagtggtgcgctacaatccggaggtcgacaccgcaccgcacagcgcgttctatgacgtgccttacgatgaacagacctcgctgctggacgcgctgggctacatcaaagacaacctggcgccagacctgagctaccgctggtcctgccgaatggcaatctgcggttcctgcggcatgatggtcaacaaggtgccgaagctggcctgcaaaaccttcctgcgcgattacaccaaaggcatcaaagttgaggcgctggccaacttcccgatcgagcgcgatctggtggtggacatgacccactttatcgaaagcctggaagccattaagccgtatatcatcggcaataaccgcacgcctgaccaggggccaaacaagcagaccccggcccagatggcgaaataccatcagttttccggctgcatcaactgcgggctgtgctatgccgcctgtccacagttcggcctgaacccggaatttatcggcccggcggcgatcaccctcgcccaccgctataacgaagacagccgcgaccacggtaaaaaggaacgcatggcgcagcttaacggccagaatggcgtctggacctgtactttcgttggctactgctcggaagtgtgtccgaagcacgtcgacccggcggccgcgatccagcagggcaaggtggaaagctcgaaagactttcttatcgccaccctgaaaccacgctaa

SEQ ID NO: 1366 - DNA, 939 bp, Klebsiella pneumoniae
cttcagatgcgagacgaagccggccgcttcgacgttatcggcgtgagccagcacaaactcttcatcctgcgccgggccggcaatctcttcgtcatagtccggcgcctgcagcgcacggtcgaccagcgccatggccatcgctttgcgctcgctcatgccgaaggtcaggccgtagccgcgggtgaagtgcggcggctcctcctgcggggcgacgaagccattaaccatctcgcactcggtcagcagcagctcgccaatattgacgctaaagcccagctcttccgggacgatttccacctgcacgtagccgctgcggatctcgccggcaaacggatggttgcggccatagccgcgctgggtcgaataggccagcgccagcaggtagccttcatcgccgcgcatcagctgctgcaggcgcgaggaacgcgagcaggggtagaccggcggggtgcgggtgatatcgtcgggcggcgtgccgcgatcttcctcggtcttcgccagcccctgctgcgtgagcaggctaaagacgtgcggcgtcggctctgcttcgccatcggcttgctgcacagacggcgcttcgccattggccagcagggtaaaatcgagcaggcggtgggtgtagtcgtaagtggggcccagcagctggccgccggggatatctttatacactgcggagatgcggcgttcgaggcgcatctccgcggtattaatcggttcgctgaccgccagccgcggcagggtggtgcggtaggcgcgcagcagaaatattgcttcgacgttatcgccgctggcctgcttcagcgccagcgccgccagttcgcggtcggcgatgccgccctcggtcatcacccggtccaccgccaggctgagctggtcgcctatctgttcgacgctcagttcgggaagccgtccatcgccccgtcgtttctgttcctgtaa

SEQ ID NO: 1367 - DNA, 501 bp, Klebsiella pneumoniae
cggtatcagcgccgagcagctcaacgtcctttccgctggcaccgtcaccgcgccggaaactggcgtcacactgatcgttcagcttgccagcctcagcggcggacgcatgctgcgcctgaccggggcaggcattgccgaagagcgaatgatcgcgccgcagctgccggactgcatcatcgacgaattaaccgaacgcccgcacccgttcccgctgggcatcgacctgatcctcacctgcggcgagcgcctgctggcgatcccgcgcaccacccacgtggaggtgtgctaaatgtacgttgccgtcaagggcggcgagaaggcgatccgcgccgctcacgccttacaggaacagaaacgacggggcgatggacggcttcccgaactgagcgtcgaacagataggcgaccagctcagcctggcggtggaccgggtgatgaccgagggcggcatcgccgaccgcgaactggcggcgctggcgctgaagcaggccagcggcgataa

SEQ ID NO: 1368 - DNA, 606 bp, Klebsiella pneumoniae
agtcaacagcgggttggcagcaaacccgccctacgccgccttctcgctgtgggtcacgtcggcggaaaagacatagcccagaccgcgcagggttttaatcaacgtcggctgatgcgggttgagctcaattttgcgccgcaggcgcatgatcagcacatcgatggtccggtcgaatacctcggtgctttcgttatgggtcagcgccagcagctgttcgcgattcaatacccggcgcgcgttctgcgccagcgccagcagcaggccatattctccctgggtcagcgggatcgcctgctgctgcgggttatacagttcacagcgcgtggtatccagccgccagccgttaaacgtcaggccagcaccggcgcccgacgcctcgccggccagcgccccgctgcgtcgcagtaccgctttcacccgggcgaccaccacccgcgagctgaacggtttggcgatgtaatcatcggcgcccatctccaggcccaccaccacatcagactcactgcccagaccggagagcatcaccaccggcagctcaggccgcgtgcgctgcagctgctggagcacctgcaggccatgggtatccggcaggatcatgtccagtaa

SEQ ID NO: 1369 - DNA, 1170 bp, Klebsiella pneumoniae
aacgaacagcgccgagaccgcggcaaacgaggcgatagccgtcagcgggctgacgcccagcagcagcgcggcaggcatcaacgccttggtggtggctgcctgcgagtagagcagcgtggcggcgaaaaacagtaccaccgccagcagccatgggtaattatgcagcagatcgccggccacggcctggatgtcgctgatatgcgctttaacgaaggtatctcccagccaggcgacgccgaggacgcagacgcaggcgctcatcccggacttaaaggtgctggcgttgagcacttcgccggtgtcgattttgcaggtgatgctaatcagggtggcgatggtcagcataaataccacgatcgcctcgttacgcggcagcaccgggttcttaatcaggccgacggtatcgctgatggccgtggcgtagaacatcaccgccacgatgccgatcaaaaacagcaggacagagcgtttggcgtgcggctgcagctcaaatacctggctgccgcgcagtctgacttcccccttggccagccgctcctggtaaaccggatcgtctttcagttcgcagccgaggaagttgcagacgatagcggtgagcatcactgccagcagcgtgactggaatacagatggccagcagcgtcaaatagctaacgcccagcggttcaaggatacctgcgaaaaagaccactgcggcggaaatgggcgaggcggtgatcgctatctgggaggccaccaccgcaatcgacagtggacgagacggacgaatgccttgctctttggcaacttcggtgatcaccggcagcgtggagaaggcggtatggccggtgccagcgagcacggtcataaaccaggtcaccagcggggcaaggaaggtaatgtacttcgggtggcggcgcagcatccgttcggcgaggctgaccaggtaatccatcccgccggcaacctgcatggcggcgatagcggcaatcaccgccataatgatttcaataacgtcgaaggggatcgcacccggtttaatttgaaaaataagcgtcaggacaaggacgccaaggccaccggcaaagccgataccgatgccgccaagccgggcgccgagataaatcgccagcaggacaataaccagttctgcaccaaacatatatgccttccttgttttttaacaagttga

SEQ ID NO: 1370 - DNA, 1086 bp, Klebsiella pneumoniae
ggggcgaagcgcggcgcactatgcgcctgtggtgtatctttatgctatagtagcgcccctttttacccggatgcttatttattcgccatgatgcctgaatcaacgtcacctgttttccctgctcaccgcttctccatcgcgccgatgctcgattggaccgaccgacactgccgctacttcctgcggctgctgtcgcggcatacgctgctgtataccgaaatggtgaccaccggggcgattattcacggcaaaggggactatctggcctatagcgaagaagagcacccggttgctctgcagctcggcggcagcgatccccaggccctggcgcagtgcgcgaagctggccgaggcgcgcggctatgatgagatcaacctcaacgtcggctgcccctccgaccgcgtgcagaacgggatgtttggcgcttgcctgatgggcaatgcgccactggtggccgactgcatcaaggcgatgcgcgatgtggtgtcgattccggtcacggtgaaaacccgtatcggcattgacgaccaggacagctatgagtttctgtgcgatttcattgagacggtctccggcaagggcgagtgtgagatgtttattattcacgcccgcaaagcctggctctccggcctgagtccaaaagagaaccgcgagatcccgccgctggattacccccgcgtctggcagctgaagcgcgatttcccccaccttacgatggcgatcaacggcggcatcaaatcgctggacgaagccagagtacagcttgagcatatggatggggtgatggtcgggcgtgaggcctatcagaacccgggcattctggcctcggtcgaccgcgaaattttcggcgtcgccggcgcggatgccgatccggtagcggtggtgcgagccatgtacccctatattgagcgcgagctcagcaagggcacctatctgggccatattacccgccatatgctggggctgtttcaggggatccccggcgctcgccagtggcgtcgctacctgagcgaaaatgcgcataaagccggcgccgatattgcagtgctggagcatgccctgaagctggtggcagataaacgttaa

SEQ ID NO: 1371 - DNA, 1035 bp, Klebsiella pneumoniae
  unsure (269),(273): Identity of nucleotide at the above locations are unknown.
acccaccggcgggctggatgtgtccgtgcaggcgcggctgctagacctgctgcgcggcctggcggtggagctgaatctggcggtggtgattgttacccacgatctcggcgtcgctcgcctgctggcgaaccgtctgctggtgatgaagcagggccaggtggtggagagtggcttaaccgaccgggtgctcgacgatccgcaccatccttacacccagctgctggtgtcgtcggtgttgcagaattaatgctgttttgccgggtggcggntgcnccttacccgggccacaggtgcgttattcgtaggccgggtaagcgaagcgccacccggcaactcaaccccgtgagagctaacatgatccgcgttgaaaacgtccataaaacctttgttctgcaccagcagcacggcgtgcgtctgccggtgctggccgacgcctcgctgaccgttaacgccggggagtgcgtggtgctccacggtcactccggcagcggcaaatcgaccctgctgcgttcgctgtacgccaattatctgccggacagcggccatatccatatccgccacggcgacgaatgggtggacctggtcaccgccaccccacgcaaggtgctggaagtgcgcaaaaccaccatcggctgggtcagccagtttctgcgggtgatcccgcgcatttcggcgctggaggtggtgatgcagccgctgctcgatcttgggacgccgcgcgaagcgagcgccgcgaaagccgcccagctcctgacccgcctcaacgttccggaacgcctgtggcaccttgcgccgtccaccttttccggcggcgagcagcagcgggtcaacatcgcccgcggttttgcggtcgactatccgatcctgctccttgatgaacccaccgcctcactggatgacaaaaacagtgctgccgtggtcaacctgatccacgatgccaaagcgcgcggcgcggccatcgtggggattttccatgacgaaggggtacgccgtcaggtcgccgaccgactgcactctatgggaatgacagcatga

SEQ ID NO: 1372 - DNA, 675 bp, Klebsiella pneumoniae
cgatcgcggcgtcatcgccgagggaaaacgcgccgacctggtgctggcgcaccgtcgcggcgaacatatccagatcgaccatgtctggcgccagggaaagagggtcttttaatgccaggaaaactgatttggctggtgggcccctccggctccggtaaagatagcctgctggcggcgctgcgccagcgcgagcacccacagctgctggtggcccatcgttacataacccgcccgtttaacgcgggcagcgagaatcatatcgccctcagcgaacatgagttttttacccgcgccgagcagcatctttttgctctcagctggcacgccaacaatacttactatggcattggcgtggagatcgacctctggctgcacgccggctttgacgtggtggccaacggctcccgcgcccacctggcgctggcccgggaacgttacggcgaggtgctggtgccgatctgtctcgccgtctcgccgccggtgctgcgccagcggctggagcagcgcggccgggaaaacgcgctggaaatcgcccagcgtctggaacgcgccgcgcgctataagccggacaactgcctgacattgaataacgacggcagtctccgacaatcggtcgatgaatttttccgcctgctgcgcagccacgcggcgcgcgaagcggatcaactggtataa

SEQ ID NO: 1373 - DNA, 1458 bp, Klebsiella pneumoniae
  unsure (51): Identity of nucleotide at the above locations are unknown.
agccggcggcgcacccggtcggtaccacttctggaagtcctcgatctgttntataacaccccggcgcggcgcaaatttatgcgcaccgaaaagaccgagttcggccacattgacgaggtggtgcgccgcattgcgctggcgcgcttcgacgtcactatcaacctcagccataacggcaaggtgatgcgccagtatcgggccgtcgctcaggatggccagcgcgagcgccggctggggacaatttgcggcgccgcttttctcgaacatgcgctggcgatcgagtggcagcatggcgatctgaccctgcgcggctgggtcgccgatccgctgcataccaccccggcgctggcggaaattcagtattgctacgttaacgggcggatgatgcgcgatcggctgatcaaccatgctatccgccaggcctgtgaagacaagctgggggccgatcagcaaccggcgtttgtgctgtatttggagatcgatccccatcaggtggatgtagacgtccacccggccaagcatgagttgcgttttcatcagtcgcgcctggtgcacgactttatctaccagggcgtactgagcttactgcagcagcagcttgacgcgccgctggcggaaaaagacgacccgccggcgccgcgcccgatgccggaaaaccgcatcgccgcgggcggaaaccagtttgcgcggccagcggaagcgcgggaaactgcggcccgcttcagcatcacgccatcgcgtgagcctgcggccaccagcggcaaaccgggcggcgcgagctggccgcatgcgcagccgggttaccagaagcagcagggagcgctttatcgtcaactgctcgacacgccaacggcgccaaagccagcgttgcagcctccggcggcggcagagttggccggtcacagtcagagctttggcagagtgctgacgattgttggcggcgactgcgcgctgctggagcgcgagggcggtctggcgctgctgtcgttgaccgttgccgagcgctggctgcgccaggcgcagttgaccccgggagcggaggcggtatgtgctcagccgctgctgatcccgctgcggttaaaagttacggaaggggaaaagcaggcgctggccgccgctcagccggcgctggcgcagctagggatcgatgtgcataccgatgccctgcacgtgacggtgcgcgcggtccctttacccttaagacaacaaaatttacaaatcttgattcctgaactgataggctacctggcgcagcaaaacgcattcgacgtcggcaatatcgcccaatggatggcgcgtaatctgacgagcgaacagacgtcatggaatatggcgcaggcgattgcgctgctggcggacgttgagcgtctttgcccgcagctggtgagaacgccgccgggtggcctgttacaacctgtagatctccattcggcgatgaatgccctgaaagatgaatga

SEQ ID NO: 1374 - DNA, 1398 bp, Klebsiella pneumoniae
agagccgggcgtgtaaggcttcccattaaaaaagcgcgaacccggctggcgatataccggcgaagcgtgcaaagaaaagcaatgatctcaggagatagaatgatgattactctgcgcaaacttcctctggcggtcgccgtcgcagcaggcgtgatgtctgctcaggcgctggctgtcgatttccatggctacgcgcgttccggcattggctggaccggcagcggcggcgaacagcagtgtttccaggctaccggcgcccaaagtaaataccgtcttggtaacgaatgtgaaacttacgccgaattgaaactgggccaggaagtctggaaagaaggcgataagagcttctactttgacaccaacgtcgcttactcggtatcgcaacagaacgactgggaatccactaaccccgctttccgtgaggtgaacgtacagggtaaaaacctgattgactggctgccgggctccacgctgtgggcaggtaagcgcttctatcagcgtcatgatgtccacatgatcgacttctactactgggatatctctggtccaggcgccggtattgaaaacattgatctgggcttcggtaaactgtctctggcagcgacccgttcttctgaatccggtggctcggcaacctatgcagaccgcgatccgctgactggtgaccgtgtttacgatcatctggtaccaaacgacgtattcgacgtgcgtttagcgcaaatggaaaccaacccaggcggtacgctggagctgggcgtggactatggccacacgaacattcctgacgactactacctgcaaccgggtgcatctaaagatggctggatgttcaccgcggaacatacccagagcatcctgaaaggctacaacaagtttgtgctgcaatacgcgaccgatgccatgacctccaacggtaaaggcgtaccgcagggcggcagcattaacaacgatggctccatgtggcgtgtgcttgaccacggcgcggtttctctggcggatgattgggacatgatgtacgtcgccatgtatcaggacgtcgatctggacaacaacaacggtactaagtggtggaccgtcggcgtgcgtcctatgtacaaatggacgccgatcatgagcaccctgcttgaagtcggttacgacaacgtcaagtcgcagaaaacgggcgacagcaacaaccagtacaaaatcaccctggcgcaacagtggcaagcgggcgatagcatctggtctcgtccagccattcgtctgttcgcaacctatgcgaagtgggatgagaagtggggttacactgacagcggcgtggccatgcgcgatacctctggtaccggcatcaacacttccagccgcggcgatagcgatgagtggaccttcggcgctcagatggaaatctggtggtaa

SEQ ID NO: 1375 - DNA, 930 bp, Klebsiella pneumoniae
gacatgttcagcttcactcctccgatgagtccggttgtgattgcattattgccaaataaaacgaaaattatttccacgatacagaaaaaggagttcgcgatggccactacccccattcccgcgaaacgcggcagaaaacccgcggctgccactgcccagcaggctggcggtcaggttcagtcgctgacccgcggcctgaaattactcgaatggattgccgagtcccacagcagcgtcgcgctgaccgaactggcgcagcaggcgggtctgcccaactccacgactcaccgtctgctgaccaccatgcaacagctgggcttcgtccgccaggttggcgagctgggtcactgggccgtcggggcgcatgctttcgtggtcggcagcagctttctacaaagccgcaatctgctggccattgtccacccgatcctgcgccagctaatggaagattccggtgaaacggtgaatctggcggtgctcgaccagagcgaccaccaggcgatcattatcgatcaggtgcagtgcacccagctgatgcggatgtcggcgccaatcggcggtaaactgccgatgcacgcttccggcgccgggaaggcgtttctcgcgcagctgagcgaagagcaggtcaccagtctgctgcaccgtaaagggctgcatgcctatacgcatgccacgctggtctccccgctgcatctgaaggaagatttagcccagacccgcaagcggggctactctttcgatgatgaggagcacgcgctcggcctgcgctgcgtcgccgcctgcatttacgatgaacatcgcgaaccgttcgcggcaatctccatctcaggccccatctcgcgtatgaccgatgatcgggtgactgagctgggcgcgctggtgatcaaggcggcgaaggaagtgacgctggcgtatggcggggttaaataa

SEQ ID NO: 1376 - DNA, 384 bp, Klebsiella pneumoniae
agatttgccagacccggaaagcccggtgacgacaatgagtttgtcgcgcgggataacgaggttgatgtttttgagattatgggtgcgggcgccccgaacttcgatcttatccattcacctttcccggtaggtagatacacggattgcctggtttgcttgaaggacaaacggcagaaacggctaattatgacacaatttaacctgaatgaatatacagtatcggaatgcaaattcgggtcgagtgtgcaacaatgtcgtagccgggtactatctctggaatcagcctcgcagctattaaaatgctacgtggaaatggtacactcgcgcgtttacactattaagaaacgtattcaggagacacgaacatggccagcagaggcgtaa

SEQ ID NO: 1377 - DNA, 345 bp, Klebsiella pneumoniae
ttgccatacagggtatcagtaaaatattcattgccgtacactgggtgctctggtctgactgagggcaccaccatggcactcccccgtattacacaaaaagagatgaccgagcgcgaacagcgcgaattgaaaacgctgcttgaccgcgcgcgtattgcgcatggccgcccgctgagcaatgcggaaacgaacagcgtgaaaaaggaatatatcgataagctgatggcgcagcgtgaagcggaagcgaagaaagcccgccaggtgagaaaacagcaggcttataaaacggataaggaagcgaccttttcctggtcggcgaatacgccgacccgcggcaggcgttaa

SEQ ID NO: 1378 - DNA, 375 bp, Klebsiella pneumoniae
aggatgaacagcggatcttcggcgttcatttcgacgggccggtgttcggcgctggcgttcgcaatcaggtcgctccaccacagatcgcggccttcctgccagtcgatattgccgccggtgcgtttcaggaccaccacgtgctcaatgcttttcacgttcgggtttttcagcgcgtcatcgacgtttttcttcagcgggatggcgcgaccggcgcgcagcccttcgtcagcggtgatcaccaggcgtgagctggagtcgataatgcgtccggccaccgcctccggcgagaagccgccgaaaatgaccgagtggattgccccgatgcgggcgcaggccagcatcgccaccgcggcttccggcaccatcggcatatag

SEQ ID NO: 1379 - DNA, 1605 bp, Klebsiella pneumoniae
atgggtgacagtgcgccgcataaggcgctaagactcatcggaacaggtttggttattttattgccagtggtgctggcattgtggtttgcccagctgcgggctaaagccgaaaccattgatcaattacactcattttcgcagctggcgctgcaaaaaacggaaatggtcatccgggaagcggatcaggctcgggctaaagccagccagtatcgcggtgagttgtgttcagcggatcaccagcgttatttactgcatattgtgcgcggcctgctgtatgtggaagatctgatctacgctaacggccagcgctttatctgttcaacgtccgttcatcagcaaaccggctggcggatgccggcggctaattacaccaaaaagccggatgtcgcgatttactattaccgggacacgccgttttatccgggctttgccatgaattatatgcagaaggggccctatgttgtggtggttaatcccttctcgtacagctcggtgatcgccagcgaccgcgatttagcctatggcgttttcgataccaaaaccaacctctttttctcggtaagtaacaatgtcgagcccgcggaactccatgcgttaattcgcgaaggcgataccttttttaatcagaatggccgggtgtatacgatcgcccgctccgctattcgccccatcgccgtcattatgtccacctcgcgggccagctactatcacaacttttgtgaccaggccagtctgacgctgccgctggggataatttgcagtattttactggtgctggtgtggtcgcgcacccgccgacagtatcactcgccgcgcaatatgctgcagcgggctctgagctgccgccagctgcgcctgcactaccagccgattatcgatattaaaaataaccgctgcgttggggcggaagcgctgctgcgctggcctgggtttgacggtccggtgatgaacccggcggagtttattccgctggcggaaaatgaaggcatgattgcccaggtcacggactacgtggtggatgaactgttttatgaaatgggtgagtttctggccagccatccacagttgtatatagccatcaatctctctgcgtcggatttccattcggcgcggctgatttcacagatcagtgagaaagcgcacagctacgcggtctgtatcggacaaatcaaaatcgaagtgaccgagcgcgggtttatcgacgtaccgaagaccacgccggtgatccaggcgttccgcgaagcaggctatgaaattgccatcgacgatttcggcaccggctactcgaatctgcataatctgcacgcgctgaacgtcgatatcctcaaaatcgataaaaccttcgtcgatacgctcaccaccaacaacaccagccacctgattgctgagcatatcatcgagatggcgcgcgggttgcggttaaagacgattgcagaaggcgtggagacgccggagcaggtaagctggctctacaagcgcggcgtacagtattgccagggctggctgtttgcgaaagcgatgccggcgcgggagtttatgcagtggttagccaatgctcccgcgcccgcgaacgtgcctcagccgccgcgtcacgcggagatctga

SEQ ID NO: 1380 - DNA, 1281 bp, Klebsiella pneumoniae
ccgaccagcagccccttggccccggcgaccagtatctctatacctttggggacgatgcggatatccatacctttaatatggtggcacgtatgtattcgccctatggccaggcgaaccccggcatcgtcgggtttaccgccacgtttgatgtggtctacaaataatatttcgacagggatgagtatgaaaaaactgatcttcttatgcatgctggtactgtgccccctctatagctgggcgacctgcagcggaactaactctggcgatgtctcaatgaccaacctgccggaaaagatcctggtcaacgccgggagctataccgccggcaccgtgctgtatgactcgggaaaaattacccgcgcgcaaacagcatttaccaactgtcagggcaacgtctatgcggtatttgcctggtcctcgaacaatgccggggcgctgataggggataatatctatgccacctcggtgcaggggattggcctccgcgtcaaggtgtggctcaatatcagcggtgaatatgaaggtgatactgatgatttcagccccgactcgcaggtacattatatcggggatgtgaactattacctcggtaagcctaccggtctgtttgattattatgcctcgacccattacaccccggcatatcagctgcagctggtggccaccggcggcgctattgccagcaacagtcaattatcgttcagcgatccggtggccacggtatcggcaaaagataatggcgggacaatctccatttcccggctgcacattagcggcaccaccagcatccagatgatcccgatgggatgcatcgttagtagcaataatctcagtttttccatgggcagcatcaatgccagcgagtttaacacggcgacgaaagtggggtcagcacgccagtctttgactctctcctgcgaaccggggaccaacgtctcaatgcgagtggcggcggcgcaagcgagtggggataatcctggcaacacggtgatggccttaacggcaggggagaatgtcgccaccggggtgggggttcagttgaatatggatggcgaagcgctgccgttaaataccgatatcagcctctatacttcgagccgcacgacggtgaccaacagcggcgcggacgccagctacagctatttcaccaatcccgacagccccggaggcgcagcggccatgcagacgctcgctttatccactaactattacaggacggggagcgcggtgaccgcggggacagccaacgccaccggggtgatcacctttacttataactga

SEQ ID NO: 1381 - DNA, 387 bp, Klebsiella pneumoniae
ggtagcggcaggactctgatgagattggccccgatgaaacgttacgcaaccgcactgctcttttgcactctgtcgctgaccagcctggccgctcgcgccgatattatcgatgacgcgatcggcaatattcagcaagccattaacgacgcctataacccgggcagcagtcgctccgatgacgacgacagatacgatgacgatggccggtatgatgacgggcgctatcaggggagccgtcagcagagccgtgacagtcagcgccagtatgacgagcggcaacgccagctggacgagcgccgccgccagctggatgaacgccagcgtcagctcgaccgcgatcgtcgtcagttagaaagcgaccagcgtcgtctggatgatagctactga

SEQ ID NO: 1382 - DNA, 402 bp, Klebsiella pneumoniae
acccctgggctcctcactgaggagccctgcgttatgggattggccgcaattatgcgtagcaaaacgctccagcaatcggtcttaagcgacctgctcttgtggatcgataataatctggataagaaactgaccgtcgacgatctgagcgatatctctggttattccccctggcatttgtttcggctcttccgtcattattttgatcgttcgccaatggaatatatccgccagcagcgcatgtcgctgtgttgccgtttattactgacaacgcctggttaccgaatcgtcgatatttgtatgatggtcggttatgacgatctcagtgcgtttaatcgtaccttcaaaaaatatcatgcgctcacgcccactcagtatcgctatcagatcacgcggcaaaaataa

SEQ ID NO: 1383 - DNA, 3369 bp, Klebsiella pneumoniae
acaagaccaaggttaattcttcagcaaaagggttatgccgtgcgcctgatatacactttcctgttggccttgagcctcagtttcggggcgtacgctgcgacagccccggatgctaaacagataacccaggaactggaacaggcgaaggcggcaaagcccgcccagcctgaaaccgttgaagttctgcagtccgcgctgaacgcgcttgaggagcgaaaatcatccctcgagcgcgcccgtcagtatcaggacgttatcgacaatttccccaaactgtttcaaagcctgcgtgcccagctcaataatctgagcgaagagccgcgccaggtgccaaccggcctgaccgccgatgcgctgaaccaggagatcctgcaggtcagcagccagctgctggaatcgagccgccaggcgcagcaggagcaggatcgcgcgcgtgaaatcgccgactccctgaaccagctgccgcagcagcaaaccgatgcccgtcgtcagctcaatgaggttgagcgccgcatcggcacgcaaaccggcaacaatgctctcgcccaggcgcaaaatcttgccctgcaggcggaatcagcgcgtctgaaggcgctggtggatgaactcgacctcgcccagctctccgccaacaaccgccaggagctgtcgcgcgcccgttccgagctggcgcaaaaacagagcgagcagctggatgcctatctgcaggcgctgcgcaatctgcaaaacagccagcgccagcgggaggcggaaaaggcgctggagagtaccgaactgctggcggagaacagtgaaaacctgccgccggacatcaccgcccagtttaaggtcaaccgtgaactctcccaggcgctgaaccagcaggcgcagcgcatggatctggtggcgtcccagcagcggcaggcgacgaatcaaacgctgcaggtgcgccaggcgttaaacaccctgcgcgagcagtcgcagtggctgggctcctccaatctgctgggcgaagccctgcgcgcccaggtggcgcggctgccggagcgccctcgcccgcaacagctggatacggaaatggcgcagctgcgcgtgcagcgtctgcgctttgaggatttactcagtaagcagccgcagctgcggcagatccgccaggccgacggcgaaccgctgaccagcgagcagaacaagatcctgcaggcgcagctgcgcacgcagaacgagctgctgaactcgctgctgcgcggcggcgacaccctgatgctggagctcaccaagctgaaggtcgccaacggccagctggaagacgcgctgaaagagatcaacgaagccacccaccgctatctgttctggacttcggacgtcagccccatcggcttctcctggccgctggagatcgtccaggatctgcggcgcctgatctccctggataccatcagcgaactgggcaaagccagcgcgatgatgcttaccagcaaagagaccctgctgccgctgtttgccgccctgctgctggttggctttagcatcagctcgcggcgccatttcacccgctttctcgagcgctccagcgcccgggtggggaaagtcacccaggatcacttctggctgacgctgcgcacggtcttctggtcgatactggtggcctcgccgctgccggtgctgtggatgacgctcggctatggtctgcagtccgcctggccgttcccgctggcggtggcgattggcgatggagtcaccgcgacggtgcctttgctgtgggtggtgatgatctgcgccaccttcgcccggccaaacgggctgtttatcgcccacttcggctggccgcgtagccgcgtggcgaaggcgatgcgctactacctgatgagcatcgggctgattgtgccgctgattatggcgctgatcatgttcgataatcttaacgaccgcgaattctccgcttcgctgggccgcctgtgcttcctgctgatctgcggcgcgctggcggtggtcaccctgagccttaagcacgccggtattccgctctatctggataaagaggggaatggcgacaatatggtgaaccgcctgctgtggaacctgatgcttggcgccccgctggtggccatgctggcggccgccgtcggctacctcgccaccgcccaggcgctgcttgcgcgtctggaaacctcggtcgccatctggttcctgctgctggtggtctatcacatcatccgccgctggatgctgatccagcgccgccggctggccttcgaccgggcccgccatcgtcgcgcggaaattctcgctcagcgcgcccgcggcgaagatgagcccgttcacgtcagcagcccggaagggtcggtggagacggaggtcagcgaggtcgacctcgatgccatcagtacccagtcgctgcggcttgtgcgctccctgctgatgctgatcgcgctgctatcggtcatcgtgctgtggtcggagattcactcggcgtttggcttccttgagaatatctcgctgtgggacgtgacctcgacggtacaaggggtggaaagccttgagcctattacgcttggcgcggtgttgattgccattctggtgctgatcatcaccactcagctggtacgcaacctgcccgcgctgctggaactggcgatcctccagcatctcgatttaacgcccggcaccggctacgccatcaccaccatcactaagtatctgctgatgctggtcggcgggctggtgggcttctcgatgatcggtattgagtggtcgaagctgcagtggctggtcgccgcgctgggtgtgggtctcgggtttggcctgcaggagatcttcgccaactttatctccggcctgattatcctgtttgagaagccgatccgcatcggcgatacggtcaccattcgcgacctgacgggcagcgtcacccgcattaatacccgtgcgaccaccatcagcgactgggaccgaaaagagattatcgtgccgaacaaggcgttcattaccgaacagtttatcaactggtcgctgtcggactcggttacccgcgtggtgctgacggtgccggcgcctgtggacgccgataccgaagaggtgacgaaaattctcatcgccgcggcgcatcgctgctcgctggtcatcgataccccggcgccggaggcgtttctcgtcgacctgcagcaggggatccagattttcgagctacgtatttttgccgcggagatggggcaccgcatgccgctgcgccatgagatgcatcagctgatcctggcgggcttccgcgagcatggcattgatatgccgttccctccgttccagatgcgtctggaaagtattgacggcaggcaaagcagtaaaaccatgacctcggccggaaaaaccagccgccgtacggctggtagcctgtaa

SEQ ID NO: 1384 - DNA, 249 bp, Klebsiella pneumoniae
gcccgcgcaagcggagcgccgccgggcatggccacagccagggagccgccggtatgccgggtggcggctacgccttacccggcctacaaacggcactgggcccaccattacactggatccgtaggcccgcgcaagcgtagcgccgccgggcatggccccagccagggagccgcctgtatgccgggtggcggctacgccttacccggcctacaaacggcactggagcccaccattgaactggatccgtag

SEQ ID NO: 1385 - DNA, 273 bp, Klebsiella pneumoniae
gcccgcgcaagcgtagcgccgccgggcatggccccagcctgggagccgcctgtatgccgggtggcggctacgccttacccggcctacaaatggcactggacccaccattacactggatccgtaggcccgcgcaagcgtagcgccgccgggcatggccccagccagggagtcgcctgtatgccgggtggcggctacgccatacccggcctacaaactaagcgcagcgcaagccggggagtttcccgggtcgcgcaaaccgggaatagcgcttaa

SEQ ID NO: 1386 - DNA, 1983 bp, Klebsiella pneumoniae
caagttcaaaggagaaaaaaagccatgagccaaattcacaaacaccctattcccgctaatattgcggaacgttgcctgattaacccggatcagtacaaggcgcagtaccaacaatccataaccgaccctgatacattttggggcgagcagggcaagatccttgactggatgcggccctatacccgtgtaaagaacacctccttcgcaccgggtaatatttccatcaaatggtatgaagatggcaccctgaacctcgccgctaactgtctcgaccgccacctcgccgaacgcggcgatcaaaccgccatcatctgggaaggcgacgacgccagccaaagcaagcacatcacctaccgtgaactgcatgccgacgtgtgccgtttcgccaatgtgctgctcgacctcgggattaaaaaaggcgacgtggttgctatctatatgccgatggtgccggaagccgcggtggcgatgctggcctgcgcccgcatcggggcaatccactcggtcattttcggcggcttctcgccggaggcggtggccggacgcattatcgactccagctcacgcctggtgatcaccgctgacgaagggctgcgcgccggtcgcgccatcccgctgaagaaaaacgtcgatgacgcgctgaaaaacccgaacgtgaaaagcattgagcacgtggtggtcctgaaacgcaccggcggcaatatcgactggcaggaaggccgcgatctgtggtggagcgacctgattgcgaacgccagcgccgaacaccggcccgtcgaaatgaacgccgaagatccgctgttcatcctctatacctccggctccaccggtaaaccgaaaggggtgctgcacaccaccggcggctatctggtctatgcggccaccacctttaaatacgttttcgactaccatccgggcgatatttattggtgcaccgccgacgtgggctgggtcaccggccatagctatctgctgtacggcccactggcctgcggcgccaccaccctgatgttcgaaggggtgccgaactggcctacgccggcgcgcatgtgccaggtcgtcgataagcataaggtcagcattctctataccgccccgacggctattcgcgccctgatggcggaaggcgacaaagctatcgaaggcacagaccgctcctcgctgcgcattcttggctcggtcggtgaaccgattaacccggaagcctgggagtggtactggaagaagatcggtaacgagaagtgcccggtgatggacacctggtggcagaccgaaaccggcggctttatgatcactccgctgccgggcgcgattgagctgaaggccggctccgcgacgcgtccgttcttcggcgtccagccggtgctggtggataacgaaggcctgccgctggatggcgccaccgagggcaacctcgccatcgccgactcctggcccggccaggcgcgtaccctgttcggcgaccatgagcgctttgagcaaacctacttctccactttcaaaaatatgtactttagcggcgacggcgcgcgtcgtgatgaagatggctattactggatcaccggccgggtggatgacgtcctgaacgtctccggacaccgtctggggaccgccgagatcgaatcggcgctggtctcgcacccaaaaatcgccgaagcggcggtggtggggatcccgcataacatcaaaggccaagccatctatgcctacgtgacgctcaatcacggcgaagaaccgacgccggagttgtatgccgaagtgcgtaactgggtacgcaaagagatcggtccgctggcgacgccggatgtgctgcactggaccgattcgctgccgaaaacccgctcgggcaaaatcatgcgccgcattctgcgtaagattgccgcaggcgacaccagcaacctcggcgatacctcgaccctcgccgatcctggcgtcgtggaaaaactgctcgaagagaagcaggccattaccatgccatcgtaa

SEQ ID NO: 1387 - DNA, 1284 bp, Klebsiella pneumoniae
  unsure (1270): Identity of nucleotide at the above locations are unknown.
acgagatcgaggggctgtgacatgatggaccatacaatgacgaaaaaccctgacagtataccatacaacatttggcctgcggaggcgctgcgcctggccgaacgagaggcggcggacagcctggggctgacgctgttcgaactcatgcagcgcgcgggcgaggcggcgttccagctggccagcggcgcttatcctgccagcgcgcactggctgatcctctgcggacatggcaacaacggcggcgacggatatgtcgttgcgcgtctggcacaggccgcggggcggcgggtgacgctgctggcggtggagagtgacagcccgctgccggaaaaagcgcaggcggcgcgggaggcgtggcttaacgccggcggcgtgatccatgcggcgactatcccatggcccgacgatatctcactgattattgatggcctgctcggcaccggtctgcacagcgcgccgcgcgatcccgttgcggcgctcatccaccaggcgaaccaccacccggcgccggtggtggcgctggatatcccttccggcctgaatgcgcagacgggcgcgacgccaggtgcagtggtacaggccgaccatacgctgacctttatcgccctcaagccggggctgctgaccggcaaggcgcgggatgtcgtcgggcaactccaccatcatgcgctggggctcgaacgctggctcgccggacaaagcactcctctgacgcggttttgcgctgcccacctcgccgactggctgccgccgcggcgggccacctcccataaaggcgatcacggtaaactggtgattgtcggcggcgatcgcggcacggcaggagctatccgtatgtgcggtgaagcggccctacgcagcggcgcgggactggtgcgagtacttactcacccggagaacgtggcgcccattgtcaccgtgcggccggaattaatggtagatgaactgacgccgcagactctgaaagccgcgctggagtgggcggacgtggtggcgattggccctggcctggggcagcgcgaatggggacgcagcgccctgcggacggtggaaagttttaacaaaccgatggtctgggacgccgacgcgctgaacctgctggcattcaatcccgataaacgtcacaatcgcgtgctaacgccgcaccccggcgaagcggcccgtctgctgaacgtcagcgtggcagaaattgaaagcgatcgcttactttctgcgcagcgtctggtaaaacggtatggcggcgtggttgtgctgaaagggcgcgggcacngtagtgcccagtga

SEQ ID NO: 1388 - DNA, 264 bp, Klebsiella pneumoniae
gcccgcgcgagcgtagcgccgccgggcatggccccagccaggaagccgcctgtatgccgggtggcggctacgccatacccggcctacaaacggcactggacccaccattacactggatccgtaggcccgcgcaagcgtagcgccgccgggcatggccccagccagggagccacctgtatgccgggtggcggctacgccttacccggcctacaaatggcactggtcccaccattgcactggatttgtagacccgcgcaagcgtag

SEQ ID NO: 1389 - DNA, 321 bp, Klebsiella pneumoniae
ggaaaagagagaatggctaaggggcaatctttacaagatccgttcctgaacgctttgcgtcgggaacgcgttccggtttctatttatttggtgaatggtatcaagctgcaagggcaaattgagtctttcgatcagttcgtgatcctgttgaagaacacggtcagccagatggtctataagcacgcaatttctactgttgtcccgtctcgcccggtgtctcaccacagcaacaatgctggcggcggttccagtaactatcaccacggtggtagcgcgcagggttcttctgcgccgcaacaagacagcgacgacgccgaataa

SEQ ID NO: 1390 - DNA, 2610 bp, Klebsiella pneumoniae
ttatggcggagcagggtcgctctattcctcatcgctgtaataagaaatttattttatcattatagggatgtgtctatgccaaataagaataatggattattcaaactatccaccgtctttctcgcaatgcttccggcattgctttctggtttgaataataaagcgcaagcacgtgactttttcgatccctcattcattagctcattgaatggtagcgatccatcaaccactcccgatttatccatatttcagactcagaacgcgcaggcgccaggggattatcgggtcgatattatgtttaatggccgctacctggacaccaggacgataaagtttgttgccaacaatcgcgccagcagcgataaccgcgaaccaactctggttccctgcctgagtctaaaaacactcgcggaatatggcgtaaggataaaagcctttccagagttagccgaggataaaaacggctgcgcaaacttttctgtcattccggacaccaaagcggattttgacttcaccgcccagcgcttaaatatctctattccgcaggcggccttatccaccaccgcgcagggatatattccaccggatcagtttgatgatggcatcaacgcgttattggtgaactatcagttcagcggctcaaacgacatgcaggccaatgatgaatactacagtctgaatctgcagtccggcctcaacgttggcccgtggcgcatccgtaacctcagcacctggaataaaaacaacagcggtgccggggactgggattccgcctatctctatatgcagcgcagcatccgctccatcaacagtaaccttgtgatgggtgagagttcatcgctcaacggtatcttcgacagcgtgccgtttaccggtattcagctggccaccgatacgacgatgttgccggaaagtatgcgcggctatgcgccgattattcgcggtatcgccagaaccaatgcccgcgtcatcattaaacaaaacggctatcaggtataccagacctatgtcgctcccggggcatttgaaatcaccgatatgtacccgagcggcggtagcggcgacctttacgtcagcgtggaagagtccgacggatccaagcaagaatttgttgtgccgttcgccaccctgccggtcatggtgcgtgaaaatcaactggaatatgagattacttccggtaaatatcgtccttacgatggtggagttgatgaaacgccgtttacccaagccaccgcgacctacggcgtctccagcagcctgacgctatatggcggcatgcaggcggcctcgcgctatcaggcgctgtcaacaggtctcggctataacctgggtgaactgggcgccgcctcggcagacgtcacccaggcttggtcaaaaatgaaagacgatgaaaagacctccggacagtcctggcgagttcgttacgggaaaaacatcgttgaaaccggcactaacgtcaccatcgccggctaccgctactccacccgcggatttcataccctctcggaggtcctggatagctactctaatgacggctactacacttcgcgctcgctgcgcaaccgcaccaatctgacggttaaccaaagcctgggtaaaggtctcggtagcctgtcgataagcggtttaatcgaagattactgggatgataagcgtactaacaagtcgattagcgtgggctataacggcggcttccgcaatgtgaactactacctcggctacagctataaccgctatacctggggtggagataactcagggaaagacgctcaggacgaccaacgtattacactgaccgtaacgctgccgttgagcaattggttgcctggcacctacaccagctatcagttaaccaacagcaatccgggatcaaccgatcagtcggtttccatcggtggtaatgcgctggagaacgatagtctggagtggagcctgcagcaaggatacagcaaccgggaatactacagcggcgatatgcgcgcgacctataatggcgcccgcggcagcgtcaatgccggctacagttacgatcgcagtagcgagcgcattgactacggcgccaacggcagtatcgttgcccatgccgatggcatcacgctgggtcaggacatcactgatgcagcggtactggttaaagcgccggggctggataacgtcaagctcaccaatgataacaccatctctaccgactatcgcggctacgccatcgttccctacgtaacaccataccgtcgcaccgatatcacgctcgacagttccacgttaggcgaagatatggagctgcctgaaaccacgcagagcgtcgttccgacccgtggtgccatcgtgcgtgctaattatgccggcaatattggacgtagagcactcatacaactagaaatgcctggagataaaccggttccttatggttccacggtaacgataaaaaacagtgccaatactcaagccaacattgtcagtgatgaagggatggtttatctctctggcttgcaagatagtggtgagttacttgttttatggggccaacggcaggatcaacgttgcaatgcaacgtatcaattacttcccacgcaaggaagtctcacaacatccaaagctatttgccgctag

SEQ ID NO: 1391 - DNA, 375 bp, Klebsiella pneumoniae
ccaaaacctggtgaaattgaccacgcctcgcgcaccgtcgcggggcgttttgttttaaagtcaaaagcttatggttggcatgctttttgtaatacctgcagagtgaagtattcattctttggggagagaaccatgctggaactgctatttgtcattggattttttgtcatgctgctggtcaccggcgtatcgctgctggggattatcgcggcaatcgtggtggcgacggcgctgatgttcgtcggcgggttgttcgccttgatgatcaaattactgccgtggctgctgctggcggtggcggtggtgtggattattcgggcgctgaaatccccgaacggaaacgcttttcgcgacaataaccgttggcgttactaa

SEQ ID NO: 1392 - DNA, 420 bp, Klebsiella pneumoniae
tctgctgatggtcgtggtcaccctgttggtcagcggcgtggcggtgttcggctttcatcacgccagccagctgcaggagcaggtgcagcgccagactctcaacgacatgcgcggcagtatggatctggcgcgggacacggcgaatgtcgccacggcggcggtgcgcctgtcgcaggtggtgggggcgctggagtacaaaagcgaagcggaacggctgctggcgacgcagcaggcgctgaagcactcgctggcccagctggcggcggccccgctggcgcagcaggagcaggcgcgggtggccaatattattcgccgcagcaacgcgctgcagcagagcgtggcggagatgctggagcgcggccagcgccgccatctgcagcgcaatgcgctgctgagttcgctttaccagaatcagagtaa

SEQ ID NO: 1393 - DNA, 483 bp, Klebsiella pneumoniae
cttaaggatggaagcatacaccgcaatgcggaacccggtggggtaagcatcgttggtggactggcatttgttgacgtgatcgtttgggttcaggtactggtattcgcctttctggtggcccatcagctcaaggccaatgttcgccaggacttcgttggtgttcatgtttacggaggtaccggccccgccctggaagacatcgaccgggaactggtccatgcatttgccgttattcaggacttcgtcacaggcggcgataatcgcatttgccgcgcttttgggaatggtctgcagctccttgttcgccagcgcggcggctttcttaaccatgaccatgccgcgcacgaattctggtatgtcgctgattttgctgttgctaatgtagaagttttcaatcgctcgcagagtatgaacgccgtagtaagcgtccgcgggaacttccctggtgcccaacagatcttcttcgatacgaatgttgtttaa

SEQ ID NO: 1394 - DNA, 1254 bp, Klebsiella pneumoniae
atcatgagtggtttaaaacaggagttagggctgggacagggagttgggttgctttccacctcattgctgggtaccggcgtcttcgccgtcccggcgctggcggcgctggtcgctggcgataacagcctgtgggcatggccgctgctcattctccttgttttcccgattgccatcgtcttcgccctgctcggccgccattttcccagcgcgggcggcgtggcccactttgtcgatatggcctttgggccacgtctggccagcgtcaccggctggctgtttttatcggttatcccggtaggactccccgccgccctgcacatcgccaccggttttggccaggcgctgttcggctggcatgatgcgcagctgctgctggcggagctgggcaccctggccatcgtctggtgggtcggttcgcgtggcgccagctccagcgccaacctgcagacgttggttgccgtactgattgtggcgctgatcgtcgtagtctggtggcgcggcgggataagcccggcgcagatccccttcccggccccggcggagattgaccgcgggcagctctttttggcgctgtcggtgatgttctggtgctttgtcggtctggaagccttcgcgcatctcgcctcggagtttaaacatcccgagcgtgatttccccagggcgctgatgataggcctgctgcttgccggctcggtctactgggcctgcaccgtgctggtgctgcacttccacgcctttggcgaggagatggcggcggcggcgtcattaccgaatatcgtggtccgtctgttcggcgtcgaagcgctgtgggtagcctgcgtcatcggctatctcgcctgtttcgccagcctcaacatctatattcaaagctttgcccgcctggtctggtcgcaagcgcagcataagccacacagctacctcgcaaggctgtcgccacggcagatcccgcgcaacgccctcaacgccgtgctgggatcctgcgtagttagcacccttggcatctatctgctcgatatcaatctggacgcgctgatcgtttacgccaatggcattttcatcatgatctatctgctgtgcatgctggcgggttgtcgtttgctgcgcggtcgctatcggctattggcggtggtgggcagcattctctgtctgctgctgctggcgatggtcggctggaaaagcctgtacgcgctggtgatgctggcggggctgtggctgtttttacccaggcgcaagctggcgacgggaagcgtgtag

SEQ ID NO: 1395 - DNA, 354 bp, Klebsiella pneumoniae
accgcgttcggcccggcgtcacccataactgataatgactttctcgaaggagagctatcaatgagtattcgtccgttacatgatcgtgtgatcgtcaaacgtaaagaagttgaaaccaaatctgcgggcggcatcgttctgaccggttctgcagcagctaagtcaactcgtggcgaaatcatcgctgtcggtaaaggccgcatcctggaaaacgggaccgtgcagccgctggacgttaaagttggtgacatcgtgattttcaacgatggctacggcgtgaagactgaaaagatcgacaacgaagaagtactgatcatgtccgaaagcgacatcctggcaattgttgaagcttaa

SEQ ID NO: 1396 - DNA, 999 bp, Klebsiella pneumoniae
tttgcaatcggagaaagtaccatgagcgagacggcaacctggcagccgagcgcacccattcccaatctgttgaagcgcgcggcggtgatggcggaaatccgccgtttctttaccgatcgcggcgtgctggaggtggagacgccttgcatgagtcaggcgacggtaacggatattcatttgttcccgttcgaaacccgtttcgtcggcccgggccattctcaggggcttaacctgtacctgatgaccagtccggaataccacatgaagcgcctgctggcggcaggttgcggcccggtcttccagctgtgccgcagcttccgtaatgaagagatggggcgtcatcacaatccggaattcaccatgctggagtggtatcgtccatgctatgacatgtatcgcctgatcaatgaggtggacgatctgctgcagcaggtgctggagtgccaaccggcggaaagtctctcctatcagcaggcgtttcagcgccatctggaaattgacccgctctctgccgataaagcacagctgcgtgaagtcgcagcgaagctggatctgagcaatatcgccgatactgaagaagatcgcgataccctgctgcagctgctgttcaccatgggcgtggagccgcacatcggcaaagatcgaccaacgttcatttatcatttcccggcgactcaggcctctttagcgcagatcagcccggaagatcatcgggtcgctgagcgctttgaggtctattacaaaggtattgagctggcgaacggtttccacgagctgaccgacgcccatgaacagcgcctgcggtttgagcaggataaccgcaaacgcgccgcgcgcggccttccgcagcaacccatcgataacaacctgctggcggcgctggaggcgggtctgccggactgctccggcgtggcgctgggcgttgaccgcgtggtcatgctggcgctgggcgctgaaagcatcggcgaagtgatcgcctttacggtagaccgcgcctga

SEQ ID NO: 1397 - DNA, 975 bp, Klebsiella pneumoniae
gcattacccggattatcgttgcccatcggccatccactattgcctctgcagatcgcgttatcgatctgtcgcagacaaagactctcgcgccagcataaaaaggagagaactatgcaaggaacgtttattggatttaataccgcaggtattacctttgaaaatcgctttatggcattgctgttgaaaataaagcaggaaaatggtttctgtcagcagtattatctgcaagcaccgatagtgctcgatcttcttcttatcctgcaaaaccgtctgcttgtaacatttaaatctttgcaagatcaaggcgaaacgtataaagaaaagctgatcgcttataatgaatcgttgatcgcaaatatccctgctgtagagatgaccgagattcagcagccaaatccggaacgtcgcattatgtcgatcactcacaaaccagacgaaacctggtcaacgcttatactggttctccagaatgagcaagtttgtacgctatgtattgaagacaggcaggtagaagctctccttgctggcattgagtacacattgaaaaccgtaggcgatcaagcgtttattcattacttaagctcgaatcttgaattcttaatgtgctatgccgtggacttaaccactcaacccaatattgattaccagcagtatccccaggaagaatggaagctaaacctgttttcgcattatctgggcgtgctgtactgctgcgagacagacgaaggcaagaaaattgtctccggggcggtggtgaaaaccagcgcgccgcatttatcggaactggaaaacaacgtcgtgacgcggcttatcgagaaaagccccaagctcaaggcgatgcacgcggagctggcgccatgccagatcttcagtaccattatcccttcccagccgggaagaatgctcagtctggaagagtgcctgcgtcctctgcacgccttctatctggagaagaaagcagagcttagcgtctga

SEQ ID NO: 1398 - DNA, 1809 bp, Klebsiella pneumoniae
cgtggcgccggatgggggaaagcgatgacgcgtggtctggaattactgattgcccaaacgatattgcagggatttgacgcgcagtatgggcgttttcttgaagtcacttccggcgcgcagcagcgctttgaacaggctgactggcacgccgtgcagcaggcgatgaagcagcggatccatctctacgatcaccacgtgggcctggtagtagagcagctgcgctgcatcaccgaagggaaaagcaccgacgtcgattttcttctgcgggtgaaacagcagtacacccaacttttaccggattaccctcgctttgaaattgctgagagctttttcaattcggtctactgccgcctgtttgaccaccgctcgctgacccccgagcggctctttattttcagctcgcagcccgagcgaccctttcgtaccctcccgcgaccgctggcgaaagatttctttccggaacgcggttggtcgcacctgctgggtaaagtactgtccgatctgccgctgcggctaccgtggcaaaacaaagcgcgggatatcggctatatcattgccagtctgcaggaggcgctgggggaggaactgctcgccacctgtcatctgcaggtcgccaatgagctgttctaccgcaataaagccgcctggctggtgggcaaactggtcatgccgatggcgacgctgccttttttgctgccgatccaccgcagcgaagagggtgagctgtttgttgacacctgcctcacaacccatgccgaagcgagtatcgtttttggcttcgcgcgttcctattttatggtttatgcgccgttgcccggcgccctggtggaatggctgcgcgagatcttgccgggtaaaacgacggccgagctgtacatggcgattggctgtcagaagcacgccaaaaccgaaagctatcgcgaatatctacactacattactcgctgcgatgagcagtttattgaagcgccgggtattcgcgggatggtgatgctggtgtttaccctgccgggctttgaccgggtgtttaaggtgatcaaggaccgcttcgcgccgcagaaagagatgaccgccgcccatgtgcgggcttgctatcagctggtaaaggagcatgaccgcgtcgggcggatggcggacacccaggagtttgaaaatttcgtgctggataaacggcaaatcgcgccggcgctgctggcgctgctgcaggcggaagcggggaacaaactcaccgatctcggcgaccgcatcgtcatcagccatctctatattgaacggcgaatggtgccgctcaacctgtggctggagcaggttaacggccaggcattgcgtgatgcggtagaagagtatggcaatgctatccgccagctggccgccgccaacatctttcccggcgatatgttatttaaaaacttcggcgtcacccgccatggccgggtggtgttctacgactatgatgaaatctgctatatgacggaagtgaattttcgcgagatcccgccgccgcgctatccggaggatgagctggccagcgagccgtggtacagcgtttcgcctggcgatgtgtttccggaggagttccgccactggctgtgcgccgacccgcgcattgggccactgtttgaagaaatgcatgccgacctgctgcgcgccgactactggcgcgcactgcagatgcggattaaaaacggccatgtggaagatgtctacgcctaccggcgcaagcagcgttttagcgtgcgctatggcgccgacagtagaccggataaggcgtttacgccgccatccggcaaggtgcgccgatctgcctga

SEQ ID NO: 1399 - DNA, 1578 bp, Klebsiella pneumoniae
ccagattacgggcgatctgcagacgctgctgcatgccgccggagaaggtggtgggcaggtcgtcgatgcgcgagggcgggatctccacctcctgcagccacttttcggcggtggcgcgaatgttgccgtagtggcgggcgccggtggccattagccgttcgccgatgttgcccccggcggagacctggcgacgcagaccgtccatcgggtgctgatgcactacgccccattcggtgcgcaacaggcggcggcgttcggcttcgctcatggcgtacagcgagcgctgctggtacagcacctcgccctgctgcggcgtcaggcgggcggagattgccttcagcagggtggttttaccggagccggactcgccgacgatgccgagcacttctcccggccacagctcgaaggagacattgcgaaaacctttatccggggcgtagagatgggtcaggttattcacagcaagtaatggctggttcattttttctgcccctcgctctgctggcggcaatagtcggtatcggagcagacaaacatccgctggccgctgtcatccagtaccacttcgtcgaggtagctgtggcgcgagccgcagatggcgcagggctcatcccactcctgcacggtaaagggatggtcgtcgaaatcgagactctccaccggggtatagggcggcacggcgtagatccgcttttcgcgcccggcgccgaacagctgcagcgccggcatcatgtgcattttcgggttatcgaatttcgggatcggcgaagggtccatcacgtagcggccattgaccttcaccggataggcgtaggtggtggcgatatggccgaagcgggcgatatcttcatacagtttcacctgcatgacgccgtactcttccagggcgtgcatggtgcgggtttcggtttcacgcggctcgataaagcgcagtggctccgggatcggcacctggtagatcaggatctgatcttccaccagcggcgtctccgggatccggtggcgggtctggatcagggtggcgtcttcggtacgctcggtggtggcgacgccggtgacgcgcttaaagaactgacgaatcgacaccgcgttggtggtgtcatccgcgccctggtcaatcaccttcagcacgtcattctcaccgatgacgctggcggtcagctggatgccgccggtgccccagccgtagggcattggcatttcgcgcccgccgaacggcacctggtagccgggaatcgctaccgctttgagaatagcccggcggatcatgcgcttggtttgctcgtcgaggtaagcaaagttatagccagtcagtgggttagccacgttcgttctcccgttgcaggcgtttcagcagcgccagttcggcctggaaatcgacatagtgcggtagcttcagatgcgagacgaagccggccgcttcgacgttatcggcgtgagccagcacaaactcttcatcctgcgccgggccggcaatctcttcgtcatagtccggcgcctgcagcgcacggtcgaccagcgccatggccatcgctttgcgctcgctcatgccgaaggtcaggccgtagccgcgggtga

SEQ ID NO: 1400 - DNA, 369 bp, Klebsiella pneumoniae
ggatggtgcggatcgtcgagcacccggtcggttaagccactctccaccacctggccctgcttcatcaccagcagacggttcgccagcaggcgagcgacgccgagatcgtgggtaacaatcaccaccgccagattcagctccaccgccaggccgcgcagcaggtctagcagccgcgcctgcacggacacatccagcccgccggtgggttcatccataaacaccagcttcggctgggtgaccagattacgggcgatctgcagacgctgctgcatgccgccggagaaggtggtgggcaggtcgtcgatgcgcgagggcgggatctccacctcctgcagccacttttcggcggtggcgcgaatgttgccgtag

SEQ ID NO: 1401 - DNA, 657 bp, Klebsiella pneumoniae
tttcgggtaggcggcacgattattttttcacataaccgtcgccgctcccgatatcctggtggccgtttgtccccggcgcatcctgttatttccctcgccggcaaccgctatttacactgtcgcctgccgtcatatttcagcgccccttttcgccctgccgtctggctcaatcgcctgccgggcgactacgctttacgggttacggtcactgaggtattcaccatgtccttaagtccctaccttgcctttgcgggcaactgcgccgaggcgatcgccttctaccagcagacgctgggcgcggagctgatgtttaaaatgacctttggcgaaatgccgcccccggcgcaggaagcgtcagacggctgcccgtctggccagaagatggcggatgatgctatcgcccacgccagcctgcgcatcaataatggcgagctgatgctgagcgacagcgccttcgggcccgatgtgcattacgccggcttcaccctcgtcctcgatcccagcgatgtcgctgaaggccagcgctggttcgacgcgctggctgtcggcgggcgcattgagatggcctggcaggaaaccttctgggcccacggcttcggcaaagtcgtcgaccgctttggcgtcccctggatgatcaacgtggtcaaacaaggctga

SEQ ID NO: 1402 - DNA, 252 bp, Klebsiella pneumoniae
actctcccaggcgctgaaccagcaggcgcagcgcatggatctggtggcgtcccagcagcggcaggcgacgaatcaaacgctgcaggtgcgccaggcgttaaacaccctgcgcgagcagtcgcagtggctgggctcctccaatctgctgggcgaagccctgcgcgcccaggtggcgcggctgccggagcgccctcgcccgcaacagctggatacggaaatggcgcagctgcgcgtgcagcgtctgcgctttga

SEQ ID NO: 1403 - DNA, 1689 bp, Klebsiella pneumoniae
cgccttacaggtataaaagaaaacgcagcaaacagggaacacatggaaatattctttaccatcctcatcatgacccttgtggtctcactctccggggtagtgacgcgcgtactgccctttcaggttccacttccactgatgcaaatcgccattggcgcgcttctggcgtggccgacctttggtttgcacgttgaatttgatccagagctgtttctggtactgtttatcccgccgctgctattcgccgacggctggaaaacgccaacccgcgaatttattgaacacgggcgcgagatcctcggcctggcgctagcgctggtggtcgtgacggtagtcggcatcggctttctgatctactggattgtgccgggcattccgctgatcccggcgttcgcgctggcggccgtgctgtcgccgaccgacgccgtggcgctttcgggcatcgttggggaagggcggataccgaagaaaatcatgggcattctgcagggggaggcgctaatgaacgacgcctccggcctggtctcgctcaagtttgccgtcgcggtggcgatgggcaccatggtctttaccgttggcggcgccaccgtagaatttctgaaggtggcgattggcggcgtgctggccgggtttgtggtgagctggtcgtatggccgctcgatgcgcttcctcagccgctggggcggggatgaacccgccacgcagattgtcctgctgttcctgctgccgtttgcctcctatctgattgccgaacatatcggtgtctccggcatcctggcggcggtagcggcggggatgaccatcacccgttccggcgtgatgcgcaccgcgcccttggccatgcgcctgcgcgccaacagcacctgggcaatgttggagtttgtcttcaacggcatggtcttcctgttgttgggcctgcaactgccggatatcctctccagttcgctggtggcggcggaggccgaccccaacgttgagacctggatgctgtttaccgacattatcctgatctatgccgcgctgatgctggtgcgttttggctggctgtggtcgatgcgtaagctcagtcagcgcttcctgaagaagaagccgatggagtttggctcctggactacgcgcgagctgctgatctcctccgttgccggggtgcgcggggcgattaccctcgccggtgtgctctccattcctctgctgctgccggacgggaatgtctttccggcgcgctatgaactgattttcctcgccgccggggtgatcctgttctcgctgttcgtcggggtgattgcgctgccgatcctgctacgtcacattgaatcgagcgataatgtgcagcagcggaaagaggagcgtctggcgcgcgcggcaacggctgacgtggcgattgtggcgatccagaagatggaagagcgtctggcggcggataccaaagagaatatcgatacccagctgctgaccgaagtcagttcgcgggtgatcggtaacctgcgccggcgcgccgatggtcgtaacgacgtggaaacctctatgctcgaagagagtctggaacgccgcttccgcctggcggcgctgcgctctgagcgcggcgagctgtatcatctgcgcgccacccggcagatcagtaacgagacgctgcagaagctgctccacgatctcgacctgctggaagcgctgttaatcgaagatcaataa

SEQ ID NO: 1404 - DNA, 2106 bp, Klebsiella pneumoniae
ttgctgacagggattgatatgcgcgcgttcttctgggctgcctggctgggcctctgctctacgcccctgctggcggctcccctgcaaggtatttcctttgcacaaaaagactgggagctcgcctgcgataataccggcgcttgccgggcggcgggttacggcgtccgcatgggtgaggtcagcgtgctgttgacccgcaacgcgggcagcgaacagcacctcaccgccacggtaacctttgcgcaaatcgagcacgatatccccgccgactccaccgccagcctgctgatcgacgaccgggattttggcgcgctggacgctctcgacgacagccactttcgcttcgacagcgatcagaccaccgccctgctacaggcgttaacgaatcagcgcaaaatcgaattcacccttaacggccagcacctgccgctttccagcgccggcagccgcgaggtgctgggaaaaatggatgcgtttcagcgacgcaccggcaccgccgatgcgctgctggataaaggcgatgccggcgacgatgccattttgccagccactcccgccccggaaattatcgccgccccggttctccataacgcgcagccagtgccgttgagtatgcttcagcgccagaaactgctgcccatcctgacgccgctgctgaaccagcgctgcgacgactggcagaatcaggccattccggcggcagatcgccagatcacgctgaccgcgctggataaaacccattctctggcgcaggcgctctgctggcgagcgccctataacgacggttacgccctgtggctggtcgataacgcccagttgagcaaaccgcggctgctcactaccgaggcctccagctacgccgacggcgctatcgtctttttgcacaaagaacggggcatggccgactgcgttaccggcgagacgcgcgtttgggatggtaaaacctttacccccagcctgaagtacagcaccggtatgtgtcgggaaatcaccccgggtggcacctggatgctgccgacctttgtcagccaggtgatccccaggcagcagaaagaggcggataacctggctctgcgcacgttgtataacgcagtgttgaaagcgcaaaaaagcgatccagaattgtctctgaataaggtcgccgagcagtttccgttaaccggccatattaccgacttcacgctcacttacgccgacgatacgctgatcacgaccagtaaaccgtccccggatatcagcgatgatgagtggcaggcgtttctgcgctcctcgattagcgcggattcagaaaacggcaaagtcagctttacccttatcgacctcgacggcgacggcaaacgcgacctgatcatcgacagctacgtgggcggcaccgggctcttcagctacaccggggtgctcaagcgaggtaatgatgattttgccgccgtcaacggcagcgacagtgataatggtgatgatttcgatgccggggtgcccggcgccctcttttccattaatggccgcggggctaaccagtggaaccactgggtcaaaatcaacggccaggtgtatgccctgtggtacaacggccagtttggcgaagataacctctacctgctacgcccgttcagcaccaccagccagacgcccgcggtgacggttcgctatcgctatacgctgaacagcatccgctccccggagaaagaccagccgctgacccccagcctgagcgacggcgataaagcggacctgctgcgctcgctggaggtaatgcagggcagcctgctgaaagacagacccgccagcgacaacgacgcgccgatctgccccatcccgccgggcacctccgctgacgaggcggataactactacagcggcgtcgccgttaactatatctatgagacggtggcttatattccggtctggctgaacgggaagtgttatatcggcaccattttcagccatcatggcgcctatcgccacggcgtggatgcggaaattaccctgagctcgccgcgtgaggacgaggaggtcattggcgattatctcatctccggactacgccacgttatcgccattaccagcggctggaaaacccgcgagggcgataactggatgcagtga

SEQ ID NO: 1405 - DNA, 1419 bp, Klebsiella pneumoniae
gctatggcaggaaataaacccttcaacaaaccacagacagaaacccgcgaacgcgatccgcagctcgccgggctgaaagtcccgccgcactcgattgaagcggagcagtcggtgttgggcggtttaatgctggataacgagcgctgggacgacgtcgccgaacgcgtcgttgccgacgacttttatacccgtccgcaccgtcatatttttaccgagatggcgcgcctgcaggagtccggcagtccgattgacctgattacgctcgccgagtcgctggagcgtcaagggcagctggacagcgtgggcggcttcgcctatctggccgaactgtccaaaaatacgcccagcgcggctaacatcagcgcctatgccgacatcgtgcgcgaacgcgcggtggtgcgcgaaatgatttcggtggccaacgagatcgccgaagccggcttcgacccgcaggggcgaaccagcgaagatctgctcgaccttgccgaatcccgggttttcaaaatcgccgaaagccgggccaacaaagacgaagggccgaagaacatcgccgatgtcctcgatgccactgtcgcccgtatcgaacagctgttccagcagccccatgacggcgtcaccggggtcaataccggctacgacgacctcaacaaaaagaccgccggcctgcagccgtcggatctgattatcgtcgccgcccgtccatcgatgggtaaaacgaccttcgcgatgaacctcgtggaaaacgcggcgatgctgcaggacaagccggtattaatcttcagtctcgagatgccctcggaacagatcatgatgcgttctctggcctcgctgtcgcgcgtcgatcagacccgcattcgtaccggtcaactggacgacgaagactgggcgcggatctccggcaccatgggcatcctgctggaaaagcgcaatatctatatcgatgactcctccggcctgacgccgacggaggtgcgctcccgcgcgcggcgtatcgcccgcgagcacggcggcatcggactgattatgatcgactacctgcagctgatgcgcgtgccgtcgctctccgacaaccgtacccttgagattgccgaaatctcccgctcgctgaaggcgctggcgaaagagctgcaggtgccggtggtggcgctgtcgcagcttaaccgctcgctggagcagcgcgccgataagcgcccggtcaactccgacctgcgtgagtccggctctatcgaacaggatgccgacttaatcatgttcatttaccgtgatgaggtctatcacgagaacagcgatcttaaaggcatcgcggaaattatcattggtaaacaacgtaacggtccgatcggcaccgtgcgactgacctttaacggccagtggtcgcgtttcgataattatgccggtcctcagtatgatgatgagtaa

SEQ ID NO: 1406 - DNA, 2448 bp, Klebsiella pneumoniae
ttaaccagaggcttcacatcgtttatgtccggctggcaacgaatttactataaattactgaatttaccattacaggtgctggtaaaaagcaagtctattccggcagagcctgcccaggaattaggactcgatacctcgcgtccggtcatgtacgtcctgccctataattcgaaggcggacctgctgacgctgcgcgcccaatgcctggcgcatgatttacctgacccgcttgaaccgctggaaatcgacggcgccctgctgccgcgttacgtattcatccacggtgggccgcgcgtatttacttattacacgccaaaagaagagtccatcaagctgttccacgattacctcgatctgcaccgcaaccatccggacctcgatgtgcaaatggtgccggtttcggtcatgttcggccgttcgccgggtcgcgagaaaggagaagtcaatccgccgctgcggatgctgaacggtattcagaaatttttcgccgtctcctggctcggccgcgacagcttcgtgcgcttctcgccgtccgtttcgctgcgccgcatggcggatgagcacggtaccgataagatcatcgcccagaagctggctcgcgtcgctcgcatgcattttgcccgccagcggctggccgccgtcggcccgcgtctgccggcccgccaggatctgtttaataaactgctggcctcgaaagcgattgcccgcgcggtggaagacgaagcgcgcagcaagaaaatttcgcacgagaaggcacagcagaacgctatcgcgctgatggaagagattgcggcgaacttctcatacgagatgatccgcctgaccgaccgcattctcggcttcacctggaaccgcctgtaccagggcatcaacgtgcataacgccgagcgcgtacgccagctggcgcacgacggccatgaaattgtctatgtcccctgccaccgcagccacatggactatctgctgctctcctacgtcctgtaccatcaggggctggtccctccgcatatcgcggcgggcatcaacctcaacttctggccggccgggccgatcttccgccgcctcggcgccttctttattcgccgcacctttaagggcaacaagctctattccaccgtgttccgcgaataccttggcgaactgttcagccgcggctattccgtggagtatttcgtcgaaggcggccgctcccgtaccggccgcctgctcgatccgaagaccggtacgctgtcgatgaccatccaggcgatgctgcgcggcggaacccgaccgatcaccctggtgccgatttacatcggctatgagcacgtgatggaggtaggaacctacgccaaagagctgcgcggcgccactaaagagaaagagagtctgccgcagatggtgcgcggtttaagcaagttgcgcaacctgggccagggttacgttaacttcggcgaaccgctgccgctgatgacctatcttaaccagcatgtgccggattggcgggaagcgatcgacccgatcgaagcggttcgcccctcctggctgacgccgacggtgaatagcatcgccgctgacctgatggtgcgcatcaataacgccggcgcggccaacgccatgaacctgtgctgtacggcgctactggcctcccgccagcgttcgctgacccgtgagcagctcacccagcagttagagtgctacctcgcgctgctgcgcaatgtgccctattctccggatgcgaccgccccatccgcttcggccagcgagctcatcgatcatgcgctgcagatgaacaagttcgaagtggagaaggacaccattggcgacatcatcatcctgccgcgcgagcaggcggtgctgatgacctactatcgcaacaatatcgcccatatgctggtgatgccgtcgctgttagccgctctggtgactcagcatcgtcatctcagccgcgccgaagtgctgcgtcatgtggaaacactctatccgttcctcaaggccgagctgttcctgcgctgggaaaaagcggagctggccggagtggtggatgcgctgattgccgagatgctgcgtcaggagctgatcgtcgtcgatggcgatgtcatgagcctcaacccgtcgcactctcgctccctgcagctgctggccgctggcgcccgcgagacgctgcagcgctatgccatcaccttctggctgctgagcgctaacccggcgatcaaccgcagctcgctggaaaaagagagtcgcaccgtggcccagcgtctgtcggtgctacacggcatcaatgcgccggagttcttcgacaaagcggtgttcagcaccctggtgttgaccctacgcgatgaaggctatatcagcgacaccggcgacgccgagccggaagagaccctgaaggtttatcggatgctggcggatttgattacgtcggatgtccgactgaccattgagagcgtcacgcaggacgacgcgtaa

SEQ ID NO: 1407 - DNA, 294 bp, Klebsiella pneumoniae
  unsure (15): Identity of nucleotide at the above locations are unknown.
aagggcgcgggcacngtagtgcccagtgaaagcggggcgatgggcattatcgatgccggcaatgccgggatggccacgggcgggatgggcgatgtgctcaccggcatcatcgccgcgttgttaggacagcacctgacgccgtatgatgctgcctgtgccgggtgcgtcgctcatggtgataccgccgacggactggccgcccgcgagggcacccgcggcatgctggcgaccgatctcttttccacgctcaggcgtgttgttaacccggatgtgattgacgtagaccatgattaa

SEQ ID NO: 1408 - DNA, 597 bp, Klebsiella pneumoniae
atgttaaagggacgatttgtggcaactttaatgatattggttacccaggattactatctttttcaaggtgttaagaatttttttcctgatatcattcagttagattctagcggaaaagcgattttagataatgaggttgatgaagtctctctgctggttgatagccgctcgccgctttgccattacgattatctcgtgctggcagcggcgaaatccagaaagcgaatatgttgtatcgtcctcgatatgcgccatcgggaagagcatttactgagcctgaaatcgtttttaaacatgtcattatcacccgcggatatggcgacattatttggcctttttctggagatgaatagcaagcgtctgaccaaagagtggtttgacgatctgcgcttaagtttgtctgaacagttaatgttacgtttactcatggcggggatgaccatggaggaggtggccgtcaatctcaatacgtcactaaaaagcctttaccgcaagcgtactgcgctttatgagcggttggggttagataattttaatgaagcttgcttatttatctttcgaaataagctgctggagcagaccgaacgttcgttatga

SEQ ID NO: 1409 - DNA, 228 bp, Klebsiella pneumoniae
acgtcgaaggggctgaccacggtgacgcccggcggcggggcgggcgtgctgcaggcgacagacaggaacgagacggcaatcgcggtgattatcggcaggatacgcatggcatgctccttgctggcttttaagctaagtgtagagtccagcagggaaaaggcggcaagatttttctatgaagcgagcccggtagcagaaatgcgaccgggctcttgcaggatcagataa

SEQ ID NO: 1410 - DNA, 570 bp, Klebsiella pneumoniae
ttgtcgtttataatggatatgggaataaatatgaagatgagtaaaaaatttctggcgggtgccctgattttctctgcctgcagcgcgctgtctatcgttgcgcaggctgataacaccattacctttaatggtattgtttccgataccacctgtacggcgaccattgatggcggtgtaacggctattgatatgggcaccacctcagtggcggatctgaaagcgtataccttcggcgctgccaagaacttctcctttagcttagctgattgcccgaccgcggaagaaggtggcaacagtatcgcccgcgtcacttttggcggtgtttccgataccgtgaacagcgattattttaaaaaccaggcaactgatgagccggcaaccggcgtcgcagtggcccttttcgacgaagcgggcaatgtgatgaagaataacgaagagggttctgatgttgatatctcttcgggtgcagcaaccattccgttcaccgttaaaatggtgaaatcgggtgatgccgatccgacgaaaggtaccgttcagacaaccgtgacttataacgtgacctatcattaa

SEQ ID NO: 1411 - DNA, 2583 bp, Klebsiella pneumoniae
ttaatgattatggtatgtcagggaagaaatataccgctatcattcagtagcgttgagctgctattttcaactaaaagtatctgcgtcgctattattctgtgcctaagtactctgccctctcgcgcggaggccggcgaatatttcaacccaaatttactcgaagtcgctgagagtcctgcggcttcggttgatctatcctatttttcgcaagatggcataccgccgggcacctatcacctggatgtttacatcaacgataagtacgtcagttcagactcgctgacttttcaggaaattagccatgacgcaggcgcgactgcttctccctgtctgtccgcggagtatctgaattcatggttgattaataccaccgcctatccgcagctgttcgaggcaggggaaacctgcgcccggctgtcggcgatccccgggatgacgttctcggtatctcttgcccagcagcggattgattttaccgtgccgcaggccgccatgctgaatcgccccagagactatattcccgagagccagtggcaacaggggatcaacgccggtcttctcaactatagcgtcaccgggcagcgtaatgcgccgcggcataacggcgccactatcgacagtcagttcgtcagcctgcagccagggctgaatctgggaccatggcgcctgcgcaactacagcacctatagccacagcgataacaacagccgctgggagtcggtttactcctatctttcccgcgatattcacaccctacgcagccagctggtggtcggtaatacgtatacctcttccggcattttcgacagtttgagttttaccggtctgcagctcagttcggacaaagagatgctgccggatagcctgcatggctttgcgccgacgattcgagggatcgcgcgcaccaccgcggaggtctcggtttatcagaatggttacagcatttataaaaccaccgtcgctcccggcgcctttgaaattaacgatctgtacgccaccggcagcgccggcgacctgtacgtcaacattaaagagtctgacggcagcgagcaaaactttgtggtgcctttcgcgtcgctggcgatcctgcaacgtgagggccagctggactatgcgctgagcagcggcaggacgcgatcgggcagctccgacgataaagaatataactttattcagtcttccctggcctatggcgccaccagcaacatcactctttatactggtttccagcaggcggaagataaatacaccaacctgttgttaggcgctggctttaacctcggtactatcggtgcgctgtcgtttgatggctctcagtcgtgggccgacgtgaaaaccagcgatacggcctcgtcaaccagtaaagagcaagggcaatcgtatcccgtccgcttcagtaaaagctttctgcagacgggcaccagcttttccgtggctggttatcgctactccacctcgggatattattcgtttcaggactttgtcgataactcttccacacagcgcgactgctgtacgcagagcggcagaacgaaaggccgatttgacgcatcgctgtcgcagacgctgtttggctatggttcgctctcgctttcgttggtcaatgagacctactgggacagttcgcgtatggaatcggtgggcgtgggctatagcgggtcgattggcaaggcctcctactttattaactattcctataaccgcaatgtgcaaagcaccgatgacagcgacaataaccggccggccagcgatacggtcgtctccctgacgttaagtattccgcttggcgagacgctctcggcaaattacaccctgaaccatggtcggcataacgataccacgcacagcgtggggctcaacggctcggcgttcgaggatcgctccctgaactggagcttgatggaagggtacaacacgcaggataaaagcacctccggtaacctcagcgtcaactaccagggttcgaaaggggatgtggctggcggctatggctacgaccgctacagcaatcactacaactattcgctgcgcgggggcatggtcgcccatgcgggcggactcacgctatcacgctttctgggcgagagttctgcgctggtcgaaacgcctggcgtcagcgatgtgacagtgcgcggtcagacaaacgtgacgacggatgccgccggatatgcggtggtgccttacgtccgtccgtaccatcgtaacagcctggcgctggatgaacaggaaatacctggcgctgaagtggataacgtcgccagaacggtggttccgacgcgcaatgcgatcgtcaaagtgaagtacgacacgcgaattggctataaggcgatgctcaccctgcgtacccgcaatggcgtggtgcctttcggcgcgctggtgaccctcgataatgatcacggtagcgcgtcgcgcagcaatatcgttggcgatgaggggcaggtgtatctgacggggctgcagaaaaaaggccagctgttagcgcgctggggggagaaaagcagtgagcagtgcaccgttcattatgacttctccagcatggcccttggcgacgatattctgttctatcaggccgaatgtcggtaa

SEQ ID NO: 1412 - DNA, 381 bp, Klebsiella pneumoniae
ggagcgtctatgactctggatcgcagaaaagtgctgatttacctgcgcccggatatcagcgccagcgagcgcttcgcggacgcaaaaattgaggcccatcaccgtggcgaccgcggcgatatgtcgcgtaccgcgctgctggcggggctggcgttaggggaagtcgatagccgcttgccgtcgatgctggcggcgctgctggcggaagatactaaaccggaaacgctgcgtaagatgctggcctcgttccttgagatccagccggcctctcccgccccggcagccgcggcagcagccgccccggctaaggcgccggagccgcccgcgccggtgagcgagagcgtctccgcgcgtaatctcgccggttcgttaccggattaa

SEQ ID NO: 1413 - DNA, 1050 bp, Klebsiella pneumoniae
acaatacctatagccgggctcgaacccggcttttttataacaacatcaacacaaccagctgacctgctcgccgcccatcgggatggcgcggcccggttcgcgtatcgcaaggaacacaacatgctcgcaactctgacgcggctgttcccgttatgggcactgctgctctccgttctggcctattacactcccaccaccttcaccccaattggcccatgggtcaccaccctgctgatgctgatcatgttcggtatgggcgtgcatctgaagctggaggatttcaaacgcgtcctgtcgcgcccggcgccggtcgctgcggggatctttcttcattatctggtgatgccgctcgccgcctggctgctggcgctgctgtttcatatgccgccggagctttccgccgggatggtgctggtcggcagcgtcgccagcgggaccgcctccaacgtgatgatctttcttgccaaaggggatgtggcgctgtcggtgaccatctcctcggtctccaccctcgtcggcgtcgtggcaacaccgctgctcacccgtctgtacgtcgacgcgcatattcaggtcgacgtcatgggcatgttgctcagcattctgcagattgtggtcattcctatcgcgctgggactgattgtccatcatctgctgccgaaggtggtgaaagcggtagagccgttcctgcccgccttctcgatggtgtgcattctggcgatcatcagcgcggtggtggcgggttccgccgcccatatcgcctccgtcggcctggtggtgattatcgcggtgatcctgcataacactattggtctgcttggcgggtactggggcggacgtctgtttggttttgatgaatccacctgccgtacgctggcgatcgaggtggggatgcagaactccggcctggcggccgcgctgggtaaaatttacttcggcccgctggcggcgctgccgggcgcgctgttctccgtctggcataacctgtccggttcgctgctggccgggtactggtcaggaaagcccatcgccaaaaaagccgacaagcgctga

SEQ ID NO: 1414 - DNA, 420 bp, Klebsiella pneumoniae
ggtgtcactatgccgtcggtatatcgtccgctggttaatttcgttgcgaaggccatgcaggccgtgctgaatctggcactgctgtgcctgggaattattctggtggtgttcctgggaaaggagaccctgcatctggcgcacgtactgtttacgccggagccggtgagtaagtacaagctggtcgaagggctggtggtctattttctctactttgagtttatcgcgctgattgttaaatattttgaatccggttttcactttccactgcgctatttcgtctatatcggtattaccgcaattgtgcggcttattatcgtcgatcatgagtcgccgctggcggtgctcatttactccgcggcgatcctgatcctggtgattacgctctggctgtgtaactccaatcgcctgaaacgcgaataa

SEQ ID NO: 1415 - DNA, 699 bp, Klebsiella pneumoniae
attaaacatatgagatatcctttttttgcgatcggtttattgctgtcttcttccttcgcgcaggccagcgtggtcgttggcggtacgcgtctggtttttgatggtacgaaaaataacgctgtaataacggttgagaataaagatcagaacagcaatatcgttcagtcctggctctcggtggttgatgccgcctcacctgccaaagacgcatttattattacgccgccgctgtttcgtctcaaagccggggagaaaggatttgtccgcgtagttcgatcaggaaagaaattacccgacgatcgcgagtcgatgttttggctcaatattaaagggatcccggcaacagaatatgtacctgataaaaatgtcgtacagtttgcgattaattcgaaaataaaattgatttatcgacccgctgcgttaaaaggtaatacaccggaatcgtacgctgaaaaattacagtgggggaaagaggggacgtcggtgacggtaaaaaataactcaccgctgtatatgaatttctcacaggttagccttaacggtaaaaatatttctggcgcatggtttgctgccccgttttccaccttaaaaatacccgtgcagagtagcctgtcggcgacaggaaaaaaagagatcacatggagcgtgattaatgattatggtatgtcagggaagaaatataccgctatcattcagtag

SEQ ID NO: 1416 - DNA, 363 bp, Klebsiella pneumoniae
ggaaggaatatgaaatggactattcttaataccctgatctgcccgcaatctggtatcgccttctcggctatatccagtctgcgtttcttgaaatttatcatgtggtacgaggctgatgtaatcctgttgcccggtgagtcgataagactctattcctcgagagttttaattaatgaccagtatcattcattaaaaatctataatattacggtgtacgacgaggcgcagtgggaaaaattacgtgagcgaccatcgtgcccttaccatgccggtggcgagcggtctgactcctgtttttaccagtccttttgcacgattaagcgttgcccgaataatattccccgcagtgaaccctggcgttag

SEQ ID NO: 1417 - DNA, 357 bp, Klebsiella pneumoniae
gcgtttctcatccggggacggccccagcaaaggagccttatgtcctggatagtcttgtttatcgctggcctgctggaagtggtgtgggccgtcggcctgaaatatacccatggctttagccgcctggttcccagcgttatcaccatcgtggcgatggtggccagcatggcgctgctctcatgggcgatgaaaaccctaccggtaggtaccgcctacgccgtctggaccgggatcggcgcggtgggcgccgccgtgaccggtattgtgctgttaggggaatccgccagcgccatgcgtatcgccagccttgtctgtatcgtgattggcatcattggcctgaagatcagcgcgcactaa

SEQ ID NO: 1418 - DNA, 3138 bp, Klebsiella pneumoniae
  unsure (3075): Identity of nucleotide at the above locations are unknown.
acatgtctcatattgcccgttgttgtcttttccgctccggtggtttatgccagtatggtttgttggctatttggcctgagtcgagcgttgtcgggagcaagtgtgagcagcaaagttgagcaactgcatcagcagttaaaagaacgtattctggttctggatgggggcatgggcaccatgatccagggctatcgtctgagtgagcaggactttcgcggtgagcgctttgctgactggccgtgcgacctgaaaggcaacaacgacctgctggtgctcagcaaacccgaagtgatccgcgagatccacgacgcctatttcgaggccggcgcggatatcattgagaccaacacctttaactcgacgaccatcgcgatggcggattaccagatggaatccctgtcggccgagatcaactttgccgcggcgaagctggcccgcgccagcgccgacgcctggacggcccgcacgccggaaaaaccgcgctatgtcgcgggcgtgcttggcccgaccaaccgcaccgcttctatttcgcctgatgtgaacgatccggcgttccgtaatattacctttgaccagctggtggccgcctatcgcgaatccacccgtgcgctggtggaaggcggcgtggatctgatcctgattgaaacggtgtttgatactctgaacgctaaagcggccatctatgcggtgaaagaggagctggaggcgttaggcgttgacctgccgctgatgatctccgggaccattaccgatgcctctggccgcacgctttccggacagaccaccgaagccttttataactcgctgcgtcacgccgaagccttatcgtttggtctgaactgcgccctcgggccggacgagctgcggcagtacgtccaggagctgtcgcgcattgccgaatgctacgtcaccgcgcacccgaacgccggcctgcccaacgccttcggcgaatacgatctggacgccgacaccatggcgacgcaaattcgcgaatgggcggaagccggtttcctcaatatcgttggcggctgctgcggtaccaccccggagcatatcgccgccatgagccgggcggtagcgggcctgccgccgcgtcagttgccggaaattgcggtggcctgccgcctcgccggcctggagccgttgaatatcggcgacgatagcctgttcgttaacgtcggtgaacgaactaacgtcaccggctcggcgaaatttaagcggctgattaaagaagagaagtacagcgaagcgctggacgttgcgcgtcagcaggtggaaagcggcgcgcagattatcgatatcaacatggacgaggggatgctcgacgcggaagcggcgatggtgcgtttccttaacctgattgccggcgagccggacattgcccgcgtgccgatcatgattgactcctccaagtgggaagtcattgaaaagggcctgaaatgtattcagggcaaaagcatcgttaactcgatttcgatgaaagagggcgtcgaatcctttatccaccatgcgaaactggttcgccgctacggcgccgcggtggtggtgatggctttcgacgaggttggtcaggccgacacccgcgaacgtaaaattgagatttgccgtcgcgcctacaaaatcctcaccgaagaggtcggcttcccgccggaagatattatcttcgaccccaatatctttgccgtcgccaccggtatcgaagagcataacaactacgcacaggactttatcggcgcctgcgaagacatcaaacgcgagctgccgcatgcgctaatctccggcggggtctccaacgtctccttctccttccgcggtaatgacccggtacgtgaggcgatccacgccgtattcctctactacgcgatccgcaacggcatggacatggggatcgtcaacgccggtcagctggccatctatgatgacctcccgggcgagctgcgcgacgcggtcgaagacgtgatcctcaaccgccgcgatgacagtaccgaacggttacttgagctggcggaaaaatatcgcggcagcaaagcggacgacggcgcgaatgcccagcaggcggagtggcgcacctgggaagtgaaaaaacgcctcgaatattcgctggtgaagggcattaccgaatttatcgaacaggacaccgaagaagcgcgtcagcaggccgcccgcccgattgaggtcattgaagggccgctgatggacggcatgaacgtggtcggcgatctgttcggcgaaggcaaaatgttcctgccgcaggtggtgaaatccgcccgtgtaatgaaacaggcggtggcctaccttgagccgtttattgaagccagtaaagagcagggctccagtaacggcaaaatggtgattgccacggtaaaaggcgacgttcatgacattggcaaaaacatcgtcggcgtggtgctgcagtgcaataactacgaaatcatcgatcttggcgtgatggtcccggcggataaaattctcaaaacggccaaagaggtaaacgcggatctaattggtctttccgggctgattactccatcgctggacgagatggttaatgtggcgaaagagatggagcgccagggctttaccatcccgctgctgataggcggcgcgaccacctcgaaagcgcatacggcggtgaaaatcgagcagaactacagcggcccgaccgtttacgtacagaacgcctcgcgcaccgtcggcgtggtgtctgcgctgctctcggacacgcagcgcgacgagtttgtcgcccgcacgcgcaaagagtatgaaacggtgcgtatccagcatgggcgtaaaaaaccgcgtacgccgccagtgacccttgccgccgcgcgggaaaacgatctggcctttgactgggagagctacacgccgccggtggctcatcgtctgggagtacagacggtggaagccagtatcgagactctgcgcaactacatcgactggacgccgttcttcatgacctggtcgctggcgggtaaatatccgcgcattctggaagatgaaatggtaagggaagaggcgcaccgcctgttcaaagacgctaacgagctgctggataagctgagcgcagagaanaccctgaacccgcccggcgtggtgggtctgttcccgggccaaccgcgtgggcgacgatattga

SEQ ID NO: 1419 - DNA, 927 bp, Klebsiella pneumoniae
gaaaaaatcatggaattgaaggattattatgccattctcggggtgcaaccaaccgacgatctgaaaaccatcaagaccgcctaccgccgcctggcgcgcaaatatcaccccgacgtcagtaaagaaaacgatgccgaagccaaatttaaggatctcgccgaagcctgggaagtcctgaaagatgagcaacggcgcgccgaatacgatcagctctggcagcatcgcaacgatcccggcttcggtcgccagcgacagacccacgagcagagctacagtcagcaagatttcgacgacatcttctcctccatgtttggccagcaggcgcatcagcgtcgtcgtcaacacgcggcgcgcggccacgatctggagatcgaagtggcggtgttccttgaagagacgctggccgagcagacgcgcaccatcagctataacctgccggtgtacaacgtgtttggcatgatcgaaagcgaaacgccgaaaacgctgaatgtgaagatccccgccggggtagtcgatggtcagcgtatccgcctgaaaggccaggggacgccgggggagaatggcggcccgaacggcgatctgtggctggttatccacatcgccccgcatccgctattcgatattgtcggtcataacctggagatcgtcctgccgctggcgccatgggaggccgcgctgggcgcgaaagtgacggtgcccaccctgaaagagagcattctgctgacggtgccgccgggcagtcaggcagggcagcgactgcgtatcaaagggaaaggactcgtgagcaaaacccacaccggcgatttgttcgccgttattaaaatagtgatgccgccaaaaccagatgaaaaagcgcgtgagctctggcaacaattggccgccgccgaagccagcttcgatccgcgtaagacatgggggaaagcctga

SEQ ID NO: 1420 - DNA, 1332 bp, Klebsiella pneumoniae
caaaggcccattccgggcctttttacatcggtaaataaacaaaaaatgacaagaagattatatcgcaaggaagcgattgagtacaaaagagtatattggaaagggaaagctttattgctggctggaatgccgacttggttaatcatagtattatctttgctattccttggtttgcttatatcagccatgatcttttgtagctttactcagcggatagatgttaatggggaggttatcaccttacctcattctgtaaatgtttatgcgccacaacaaggttttatcgtatcacaatatgtgaaagttggtgatctggttaaaaaaggacaacctctctatgaaatagatatctctcgtgacacgactactggaaatgttagttctgtacagatagaagttaataaagaaaagatagccaatgctgaagaaataataaacaagctttctcaaaacaagcaagaaacattgtcttcaatagaaaagcaacttaaagccaataaagaatcattgaaagagatcaatcgtcttcttgctaatgccttagctggattaaagaaaatgcacgataatttatccagctatgatagttatcttagagatggactcatcacaaaagatcaatataactatcaacattcattatatttccaacaacagagcacatatcaatctcttgtaagtcaaaagatgcaattagaatcgcaaatcacacaatataatagcgataaaataactaaaatcgctgattttgacaatcagataacagcacaacagaatcaaataaatgatttcaaaaaccaattagttgaatcaaatgccaaaggcaatgctattataaaagctacgacagaaggacgcattgagtcactctcggtaactaaaggacagatggttgataatggcagtagcttggctcaaatcaagcctacaggtaacattgagtattatcttatattatggctgccgaataatagcataccttatgtaaaacctggtgatgttataaatattcgctatgatgcttttccttctgataaatttggacaattccctggcgaagtcatatcaatatcttccgtccccgcagcgaggcaggaaatgtcagaatatactaacgtgagtaatggaactaatcagcaagaactggcactttataaaacaattgtaaagattaaaaataaaactttttcttataatgggaaaacacttaagctctcaaatggacttaaagcacgggcagttgttttccttgaaaaacgtcctctttacatgtggatgtttactcctttttataaaatgtctcaaagtgtaagtgggccgatccatgactaa

SEQ ID NO: 1421 - DNA, 696 bp, Klebsiella pneumoniae
agaaaagccatgttcaggaccttattaaatctcaccgcatcctgtgcattactcctcagcagtattgctcatgccggtattgtcgttgaatccacccgctacctctataaggaaggtgcgcgtgaaattaccgcgcaaatcgaaaataaagatgatattccctatctgattaaatcctgggttgaaacgcctgcagggaaagcgccttcgtttatggctaccccaccgctttttcgcctcgaggggaaacaacagaatacggttcgtctgtttgccaccggcaacgttaatgcaccgaccgaccgggaatccatgtactattttaacgtcatggcgattcctccggcagatgatgccaaagcgaataacaatactattcaactggcggttcgtcaccgcatgcgtctggtctatcgtcccaaaacacttttcgacctctcccctaatacggaagcgaaaaagctcgaatggcgtaaggccggcaaaaagctgaccatcaaaaatccgacaccgtttttcttttatttcaatagcatccagattggtggaaaagaagtgaagccggaagtcaactccgtcgccccaatgacgaccaaagaagtgacgctaaaagaaaatattaatgcctccagcattacctggaaagtggtcaatgattatggcggagcagggtcgctctattcctcatcgctgtaa

SEQ ID NO: 1422 - DNA, 975 bp, Klebsiella pneumoniae
cgctcggccataggaattgaggtgataacaatgaatatgaagaaaagtctcgttgccctctgcctgtccgccggcctgctggccagcgtacccgcagtcagttttgctgatgtgaattttgtgccgcagaacaccgctgccgcaccgtctattccggcctccgcgctgcagcagctcacctggacaccggtcgatcaatcgaaaacccaaacctctaaagtggcgaccgccggacaaacgctgaatgtacccggcatcaccgggccggtggtggcctatagcgtaccggcaaatattggcgagttaaccctaacgctgaccagcgaagtcgacaaacagaccagcgtctatgcgccaaacgttctgatcctcgatcagagcatgacgccgtctgccttcttcccgagcagctatttcacctatctggaaccgggcgtgatgagcgccgaccgactggaaggggtgatgcgcctgacgccggcgctgggacagcagaaaatttatgtactggtgtttaccaccccgcaggacctgcagcagaccaccaaattaatcgacccggcgaaagcctacgcgaaaggcaccggtaacgcggtaccggatattccggatcctatcgctaaacataccactgacggcacgctgagcctgaaagtgaagacctcttcgagctccagcgtactggttggcccgttgtttggctcctctggcccaggtccggtgaccgtcggcaataccgcggcgccggtctataacgcaccagctacagcgcctgctgcagccgccgccgcggcgccggccgccaaaagcgaaccgatgctcagcgataccgaaacctacttcaacaatggtattaagcaggcggtgaaacaaggtgacatcgacaaagccctgaaattgatgaacgaagctgagcgcctcggctcgaaatccgctcgttccacctttatcagcagtgtaaaaggcaaggggtaa

SEQ ID NO: 1423 - DNA, 405 bp, Klebsiella pneumoniae
cagatttacatccgggccagtgcgtccagctcatcgatcatggggaataacatgcaggtaaaatatttagcagggattgtcggcgcagccttactgttggcaggttgcagttccagcaatgaattaacctctgccggccagaatgtgcgcttcgtgcaggagaagccgggcgcagagtgtcagctgttagggaccgcgacgggtaaacagagcaactggctttccggccagaatggcgatgagggcggttccatgcgcggtgctgcgaacgccttgcgcaaccaggcggcagcgatgggcggcaacgtgatttacggcgtcagcagcccgacgcagaacctgctgtcgagctttgtacctaccgacagcgaaatgaacggccaggtttataagtgcccgaactga

SEQ ID NO: 1424 - DNA, 378 bp, Klebsiella pneumoniae
tatccccgcatcttgcgtgttatagtgcctcttttcgctgatacgaggttcatgatgactacgcctgatgctgttgttgtgctctgtaccgcgccggacgaagcgaccgcccaggatctggcggcaaaagcgctggcggaaaaggtggcagcctgcgccacgctgctgccgggggccacctctctgtattactgggaagggaaactcgagcaggagtatgaagttcagatgctactcaaaactgaccttgcccatcagcaggcgctgctggactgcctgaagtcacaccacccgtatcaaaccccagaactgctggttctacccgtcacgcatggagacaacgattacctctcatggcttaccgcatcattacgctga

SEQ ID NO: 1425 - DNA, 360 bp, Klebsiella pneumoniae
aagatgacaatttcggagttattacagtactgcatggcgaaaccgggagcagagcagagcgtccacagcgactggaaagccacgcagattaaggtctcagacgtgctgtttgccatggtgaaggaggttgaggaccagcggccggcggtcgcgctgaaggcgagtccgaagctggctgagctgctgcgtcagcagcatcgcgatgtccggcccagccagcatctcaataaagcgcactggagcaccgtctatctggatggctcgctgccggattcgcaaatctactacctggtcgatgcgtcttatcagcaggcggtgaaaatgctgccggagccggtccggcagcagcttacccgctaa

SEQ ID NO: 1426 - DNA, 1089 bp, Klebsiella pneumoniae
ggaattcaaatgcaagcggcaactgtagttatcaaccgccgcgctctgcgacacaacctgcaacgtctgcgtgaactggcgcccgccagcaaactggttgcggtagtgaaagcgaacgcctacggacacggtcttctcgagaccgcgcgaacgctgaccgacgccgacgcctttggcgtcgcccgcctggaagaggcgctgcgcctgcgagcggggggcatcgcccagccgatcctcctgctggaaggcttttttgctgcggaagacctggcggtgatcgccgcccagcgcctgcatacggcggtgcatagccccgaacagctggcggcgctggagcaagccgatctccccgagccggtgaccgtgtggatgaagctggataccggcatgcatcgcttaggagtgcgcccggaggaagccgaggcgttttatcagcgtctgagccagtgtaaaaacgtccgccagccggtgaacgtggtgagccacttcgcgcgcgccgatgagccgacctgcggcgccaccgaacgccagctggacatcttcaccacctttaccgaaggcaagccgggcttgcgctctatcgccgcctcgggcggcattctgctgtggccgcaatcgcattacgactgggtgcgccccggaattatcctgtatggcgtgtcgccgctggacgatcgctccaccggcagagatttcggctgccagccggtgatgactctaacgtccagcctgattgcggtgcgcgagcataaagcaggggagcccgtcggctacggcggcacctggatcagcgaacgcgatacccgtctcggcgtggtggcgatgggctatggtgacgtttatccgcgcgcggcaccgtcgggcacgccggtgctggtcaatggccgggaagtgccgattgtcggccgggtggcgatggatatgatctgcgttgacctcggaccgcaggcccaggataaggccggcgatgcggtagtgctgtggggagaggggctcccggtagagcgcatcgccgagataacgaaagtgagtgcttacgaacttattacgcgactgacctcccgcgtcggcatgaaatacttcgactaa

SEQ ID NO: 1427 - DNA, 219 bp, Klebsiella pneumoniae
  unsure (219): Identity of nucleotide at the above locations are unknown.
ctccctgaaatgcgcactattttctatccgctgacaaagttgttcattcatcttagcgtctccagaggtctccctttcgtcatccactcggcggacgctggcgacagcaacccctccggcgacggagccgggacaggtgttgctgacggcgttcctgcgagtgaaatcctgggggaaggacttatttttatcctctccccggaaagggaaaaggtgtan

SEQ ID NO: 1428 - DNA, 213 bp, Klebsiella pneumoniae
gttaaagaaatcaacttgaacacttccgttcgaatgaagtcgattttacagaattatcttaaaacgcagaccataatttatccatatttatcggttgccgtatcgggtataaattacccattcatttatcaacaggagatatgtttattagtttgcaataggtcattcacctgcagtgccagtcagctaaatgggaccatcctcatcctttaa

SEQ ID NO: 1429 - DNA, 897 bp, Klebsiella pneumoniae
tctcagggaataattatggatatccgaacgctgcgctatttcgttgaagtggttcgtcagcagagttttactcgcgcggcggaaaagctgtttgtcacacagcccaccatcagcaagatgctcaagaatctcgaagatgagctgaactgcacgctgttgatccgcgacggccgcaaactactgctcaccgataccgggcgcgtcgtttttgaacgcggccaggcgatcttaggcgagttcagccagctggagtcagagctgagcgatatcaaccacctgcataaaggggtgctgcggcttggcattccgccgatggtcgggatgttgatggctgaaccgatcagtcgcttccgccagcgctacccgggcgtcgagctgaagatcgccgagtttggcggcctgacggtccagcaggcggtcagcaatggcgaacttgatatggcgatgaccgccctgcctgtcgaggaggatagcagcctcaccatcctgccgttgttcaatcacccgctgtgcgtcctgacgccaagaaccgcggagtgggaaggtaaaacctcgctctcgccggccgagctggcgtcgcatccgctggttatctacaacgaggaatttgcccttagccagcagctgatgcggctgtttgccgagcatgacgtgaagccacgtatcgcggtgcgcagcggccagtgggattttctcgccgccatggtgcaggcgggcattggcgtagcgatcctgccggagccgatttgccagcgtctcgaccggcagaatttttgctggatcccgttgcaaagcgagctgcgctgggagctggggatgatttggcgggaaggcgtatatatgtcgcgcagcgctgaggcctggctgacgtgcagcaaagcgttctggctggaataa

SEQ ID NO: 1430 - DNA, 588 bp, Klebsiella pneumoniae
cgtatgaccttacaacccgcttttaccctggctgtgcaggatgcccaacacagttttcgtcgcctgctgaaagcgatgagcgagccgggggtgattgtctccctgcagcagcttcagcacggctggcagccattgaatgtggcctccaccagcctgctgttgacccttgccgatcatgaaacaccggtctggctcgccagcgctctgcgtaacgatctggtgggacagaatctgcgctttcataccggcgcgccgctggtggaccagccgcagcaggcggtctttgccgtcgccaatgacggtatcagcgccgagcagctcaacgtcctttccgctggcaccgtcaccgcgccggaaactggcgtcacactgatcgttcagcttgccagcctcagcggcggacgcatgctgcgcctgaccggggcaggcattgccgaagagcgaatgatcgcgccgcagctgccggactgcatcatcgacgaattaaccgaacgcccgcacccgttcccgctgggcatcgacctgatcctcacctgcggcgagcgcctgctggcgatcccgcgcaccacccacgtggaggtgtgctaa

SEQ ID NO: 1431 - DNA, 183 bp, Klebsiella pneumoniae
tgttacctgatgcttagaggcttttcctggaagcagggcatttgttacttcagcaccgtagtgcctcgtcatcacacctcagccttgattatccggatttgcctggacaaccagcctacatgcttaaaccgggacaaccgtcgcccggctaacatagccttctccgtccccccttcgcagtaa

SEQ ID NO: 1432 - DNA, 204 bp, Klebsiella pneumoniae
cctgccgccttaatgatccgggttaacccggtggtattattggccatcacaaaacctttttacgtaaatgacgtcgatgagtgtgcgcgtttgccgcgtggtaacggaaattttgcccactttctgttattcttgccgcgcatttgcatgattaaccagaggcttcacatcgtttatgtccggctggcaacgaatttactataa

SEQ ID NO: 1433 - DNA, 375 bp, Klebsiella pneumoniae
ctgacgacgatcgcggtcgagctgacgctggcgttcatccagctggcggcggcgctcgtccagctggcgttgccgctcgtcatactggcgctgactgtcacggctctgctgacggctcccctgatagcgcccgtcatcataccggccatcgtcatcgtatctgtcgtcgtcatcggagcgactgctgcccgggttataggcgtcgttaatggcttgctgaatattgccgatcgcgtcatcgataatatcggcgcgagcggccaggctggtcagcgacagagtgcaaaagagcagtgcggttgcgtaacgtttcatcggggccaatctcatcagagtcctgccgctaccttaatcatccgcatgaaacccgggtag

SEQ ID NO: 1434 - DNA, 1044 bp, Klebsiella pneumoniae
tcggcggcgattttgccgattttcgcctcctgttccggggtgaaagtcgccggcgcgtcagcggcagaggccatcgccggcagtaagacagcgctcagcatggcgacagagaggtatttcttgtggccagacatagtggggatccttgcgataagtgaacggcacgtgagtctgggtgacaaaatatcaccctttttcgccgaagccttgcccaacggcgccttgattcgtaactttatttttcaggctctctctttcccgcgcgatagcgcaggtctgcgccagtggtcaacgcggccccaggcggagtaccctgcgcagcggtttttcttgctcttttttcaggtggtttctctcgatatgtatgcatttcttcaacaatgggacatggcagtgattatgctgcagattgtcgccatcgacttactgctgggtggcgacaatgccgtggtgattgccatggcctgccgcaaactgccgccgcagaaacgcactaaagcgatcatcatcggtaccgtgggcgccatcctggcgcgcgttctgctgctggcgatcgctttgtatctcctgtcgctgccgtggctgaaaatagtcggcgcgctgctcctgctgtggattggcatcaagctggtcaggaatgaggaagaagagagcgaggttagcagctctggcagcctgtggcgcaccgcgatcaccatcactgttgccgatgtgattatgtcgctggataacgtactggcggtagctgctgcggggaaagggcacattgcgctggtcgccctcggcgtggcgatcagcattccggttattgtcgccggcagcaagctggtgctggtcctgctcacccgctttcccgcggtggtgctgctgggcgggatgctcatcggctggattgccgggtcaatgctggtcagcgaccctaccgttcgccagctgtttcccagcgccggcgagggcaccgcgcgcctggctggcgccgtcggcgcgctgctggtgctattcaccggatggcgccgccgcccacggccgcaggcgaaagactaa

SEQ ID NO: 1435 - DNA, 495 bp, Klebsiella pneumoniae
ccggcggccttggaagaggacgcgctggcggacgcctatgaagcgcagcatgatgactataacaagatcatgattaaagccatcgccgatcgcctggcggaggcctttgccgagtatctgcatgagaaagtgcgcaaggtttactggggatatgcggccaatgagaacctcagcaatgaggagcttattcgcgagaactaccaggggatccgaccggcgccgggatatccggcctgtccggagcacaccgaaaaggggaccatctggcagctactggacgtcgaagcccataccggcatgaagctcaccgaatcgttcgccatgtggccgggcgcatcggtttccggctggtacttcagccatccggacagcaagtacttcgccgtggcgcagatccagcgcgatcaggtcgaagattacgcgctgcgtaaaggaatgacgccggcggagatcgagcgctggttagcgcctaatctgggctatgatgcggactag

SEQ ID NO: 1436 - DNA, 2826 bp, Klebsiella pneumoniae
atggataagatcgaagttcggggcgcccgcacccataatctcaaaaacatcaacctcgttatcccgcgcgacaaactcattgtcgtcaccgggctttccgggtctggcaaatcttcactcgctttcgacaccctgtatgccgaaggccagcgtcgctacgtcgaatcgctctccgcctatgcgcgacagttcctgtcgctgatggagaagccggacgtcgaccatatcgaagggctgtcgccggcgatttccatcgaacagaaatcaacctctcacaacccccgctcgacggtgggtactattaccgaaattcacgactatctgcgtctgctgtacgcccgcgtcggcgaaccgcgctgtccggatcacgacgtgccgctggcggcgcaaaccgtcagtcagatggtcgataatgtcctcgcccagccggaaggcctgcgcctgatgctgctggcgcccattattaaagagcgcaaaggcgagcacactaaaaccctggaaaacctcgccagtcagggctacatccgcgcgcggatcgacggcgaggtctgcgatctgtcggatccgccgaagctggagctgcagaagaagcacaccattgaggtagtcatcgaccgcttcaaggtgcgcgacgatctggcacagcgcctggccgagtcgtttgaaaccgcgctggagctctccggcgggaccgccattgtggctaatatggatgatgagaaagcggaagaactgctgttttccgccaacttcgcctgcccgatctgcggctacagcatgcgcgagctggagccgcgtctgttctcctttaacaacccggcgggcgcctgcccgacctgcgacggcctcggcgtgcagcaatatttcgatcccgatcgcgtggtgcaaaatcccgagctgtcgctggcgggcggcgccatccgcggctgggatcggcgtaacttctactacttccagatgctgaagtcgctggcggagcactataaattcgacgtcgaagcgccatggggcaccctcagcgccaacgtgcagaaagtggtgctgtacggttcaggtaaagaaagtattgaattcaaatacatgaacgaccgcggcgatacctcggtgcgccgccatccgttcgaaggcgtgctgcataacatggagcgccgttacaaagagacggaatccagcgcggtgcgcgaagagctggcgaagttcatcagcaaccgtccgtgcgccagctgcgacggcacgcgtctgcgtcgcgaggcgcgccacgtgtttgtggaaaacaccccgctgccgaccatctccgatatgagcatcggccatgcgatggatttcttcaacaatctgaagctctccggccagcgggcgaaaatcgccgaaaaagtgctgaaagagattggcgatcgtctgaaattcctcgtcaacgtcggcctcaactacctgacgctctcccgctcggcggaaacgctctccggcggcgaagcccagcgtatccgtctggcaagccagattggcgccgggctggttggcgtgatgtacgtgctggatgaaccctctatcggcctgcaccagcgcgataacgaacgcctgctcggcaccctgatccacctgcgtaatttaggcaacacggtgatcgtcgttgagcacgacgaagacgccattcgcgccgccgaccatgtgatcgatatcggtcccggcgctggcgttcacggcggccaggtagtagcggaagggccgctggaggccattatggcggtcccggaatccctgaccggccagttcatgagcggtaaacgcaaaattgaagtgccgaaacagcgcgtgcccgtcaacccggagaaagtcctcaagctgaccggcgcgcgcggcaacaacctgaaggatgtaacgctcaccctgccagtgggcctgtttacctgcatcaccggcgtctccggctcgggtaaatccacgctgatcaacgataccctgttcccgattgcccagcgccagctcaacggcgcgaccatcgccgaaccagcgccgtatcgcgatatccaggggctggaacatttcgataaagtgatcgatatcgaccagagcccgatcggccggacgccgcgctccaacccggcaacctataccggggtgtttaccccggtgcgcgagctgttcgccggcgtaccggagtctcgctcacgcggctatacgccggggcgctttagctttaacgttcgcggtgggcgctgcgaagcctgccagggtgacggcgtcattaaggttgagatgcacttcctgccggatatctacgtgccgtgcgaccagtgcaaaggcaaacgctataaccgtgaaacgctggagattaagtacaagggtaagaccatccacgaagtgctggatatgaccatcgaagaggcgcgtgaattctttgatgccgtaccggcgctggcgcgtaagctgcaaaccctgatggacgtcggcctgacctatatccgccttggccagtcggcgacgaccctgtccggcggcgaggcgcagcgcgtgaagctggcgcgcgagctgtccaagcgcggtaccggccagacgctgtatatcctcgatgagccgaccaccggtctgcacttcgccgatatccagcagttgctggaagtcctgcaccagctgcgcgatcagggcaataccatcgtggtgattgagcacaacctcgatgtgattaaaactgccgactggattgtcgatctcggcccggaaggcggcagcggcggcggcgaaatcctggtctccggtacgccggaaaccgtcgccgagtgcgaagcctcgcacaccgcgcgcttcctcaagcccatgctgaaataa

SEQ ID NO: 1437 - DNA, 909 bp, Klebsiella pneumoniae
ttaagggagataacgataatggctatggtccaacccaaatcgcagaagctacgtttatttaccacgcatctcctgctactgatttttatcgccgcgattatgtttccgctgctgatggttatcgccatctcgctgcgcgagggtaacttcgccaccggcagcctgatcccggataccatctcctgggagcactggcgtctggcgttaggcttcagcgtcgaacacgccgatggccgcgtcacgccgccgccgttcccggtcctgctgtggctgtggaactcgattaaggtcgccgggatcaccgcgatcggtatcgtcgctctctccaccacctgcgcttacgctttcgcccgtatgcgcttcccggggaaagcgaccctgctgaaagggatgctgattttccagatgttcccggcggtgctgtcgctggttgccctgtacgcgttgtttgaccgcctgggccagtacatcccgttcgtcggcctcaacacccacggcggcgtcatctttgcctacatgggcggtatcgcgctgcacgtctggacgattaaaggctacttcgaaaccatcgatggctcgctggaagaagcggcggcgctggatggcgcgaccccatggcaggctttccgtctggtgctgctgccgctgtcggtgccgattctggcagtcgtgtttattctgtcgttcatcgcggccatcaccgaagtgccggtcgcctcgctgctgctgcgcgatgtgaacagctataccctggcggtaggtatgcaacagtatctcaacccgcagaactatctgtggggcgactttgccgccgcggcggtgctctccgccattccgatcacggttgtcttcctgctggcgcagcgctggctggttaatggcctgacggcgggtggagtgaaaggttaa

SEQ ID NO: 1438 - DNA, 1782 bp, Klebsiella pneumoniae
tggggctttttactccgttttgacccgattcctgaccggcgtcagggtcaagtcacaaaaatcatcacaattttccgtcaccggcgctacaatcgaccgaagtcacaatctcaaatcagaagagtattgctaatgaaaaacatcaacccaacgcagacctctgcctggcaggcattacagaaacacttcgacgaaatgaaagatgtcactatcagcgagcttttcgccaaagatagcgaccgtttttctaaattttccgcgacgttcgacgatctgatgctggtggacttctccaaaaatcgcatcactgaagagacgctggctaaactgcaggatctggcgaaagagactgacctggcgggcgctatcaagtcgatgttctcaggtgagaagatcaaccgcaccgaagaccgcgcggtactgcacgtcgcgctgcgtaaccgcagcaatacgccgattgtggttgatggcaaagatgtgatgccggaagtgaacgctgtgctggagaagatgaaaaccttctccgaagcgattatctccggtagctggaaaggctacaccggcaaaccgatcaccgacgtggttaacatcggcatcggcggctccgacctcggtcctttcatggtgaccgaggcgctgcgtccgtataaaaaccacctcaacatgcactttgtctctaacgtcgatggcacccatatcgccgaagtgctgaagaacgtgaatccggaaacgactctgttcctggtggcgtccaagactttcactacccaggaaaccatgaccaacgcccacagcgcgcgcgactggttcctggcaaccgcgggcgacgacaagcacgtggcgaaacacttcgccgcgctttccaccaacgcgaaagcggttggcgagttcggtatcgacaccgccaacatgttcgaattctgggactgggttggcggccgttactccctgtggtcggcgattggtctgtccatcattctctccgtgggcttcgacaacttcgttgagctgctgtccggcgcgcatgcaatggataagcacttctccaccactccggcggagaaaaacctgccggtgctgctggcgctgatcggcatctggtacaacaacttcttcggtgcggaaaccgaagcgattctgccgtacgaccagtacatgcaccgctttgccgcttacttccagcagggcaacatggagtccaacggtaagtatgttgaccgtaacggccacgcggtagactaccagactggcccaatcatctggggtgagccgggcaccaacggtcagcacgcgttctaccagctgatccaccagggcaccaaaatggtaccgtgcgatttcatcgctccggctatcacccacaacccgctgtctgaccaccatcagaaactgctgtctaacttcttcgcccagaccgaggccctggcctttggtaaatcccgcgaagtggttgagcaggaatatcgcgatcagggtaaagacccggcgaccctggagcacgtggtgccgttcaaagtgttcgaaggtaaccgcccgactaactccatcctgctgcgtgagatcaccccgttcagcctcggggcgctgattgccctgtacgagcacaaaatcttcacccagggcgcgatcctcaacatcttcacctttgaccagtggggcgttgagctgggcaaacagctggctaaccgcatcctgccggagctgaaagacggcagcgaagttagcagccacgacagctctactaacggcctgattaaccgttataaagcctggcgcgcataa

SEQ ID NO: 1439 - DNA, 381 bp, Klebsiella pneumoniae
aaaggttttgtgatggccaataataccaccgggttaacccggatcattaaggcggcaggttactcctggaaaggatttcgcgcggcgtggatcaacgaggctgcgtttcgtcaggaaggcgtcgccgctatcgtggccgtcgcggtagcctgctggctggacgtcgacgccatcacccgcgtattgctgattggctcggtcctgctagtgatgatagtcgaaattctcaacagcgcgattgaagcggttgtggaccgtatcggctcggattttcacgagctttcagggcgcgccaaagatatggggtcggcggcggttctgctggcgattatcatcgcgctgatcacctggggaacgctgctgtggagccattatcactaa

SEQ ID NO: 1440 - DNA, 1362 bp, Klebsiella pneumoniae
cacgaggttgttatgacagatctagtcgtcgccaaatttggcggcaccagcgttgctgattttgacgcaatgaaccgcagcatcgatgtggcgctgctcgatgccaatacccgtattgttgtgctctccgcctctgccggcgtgaccaacattctggtggccttagcgggagggctggaacccaccgaacgtttttcccagctggacgctctgcgtcagatccagttcaatattctggagcgtttgcgttatcccagcgtgatccgcgaagagattgagcgcttgctggaaaatatcacgacgctggcggaagccgccgcgctcgcctcctcaaccgccctgaccgacgaactggtcagccatggcgaactgatgtccaccctgctgtttgtggaaattctgcgtgaacgcggtattcaggcgcagtggtttgacgcccgtaaagtgctgcgcactaacgatcgctttggccgcgccgaaccggacatcgccgccgtcgccgaactgacccagcagcagctggcgccgcgcctggcggaaggcctggtggtgacccagggctttatcggcagcgaagcgaaaggccgcaccaccaccctcggccgcggcggcagcgattataccgccgctctgctcggcgaagcgctgaatgccacccgcgtcgatatctggaccgatgtcccggggatctatactaccgacccgcgcgtcgcgccggcggcgaaacgcatcgacgtcatcgcctttgaagaggcagcggaaatggccacctttggcgccaaagtgctgcatccggcgaccctgctgcctgccgtgcgcagcgatatcccggtgtttgtcggctccagtaaagagcctaaagcgggcggtacgctggtgtgtaaaaccaccgagaacccgccgctgttccgcgcgctggcgctgcgtcgccggcaaacgctgctgacgctgcacagcctgaatatgctgcactcccgcggcttcctcgccgaagtgttcggtattctggcgcgccataacatctcagttgatttgatcaccacctccgaagtgagcgtggccctgaccatggacaccaccggctcgacctctgcgggcgataccctgctgacccaggcgctgctgaccgagctctcttcgctgtgccgcgtggaagtggaagaaaatctggcgctggtcgccctgattggcaatgagctgtcgaaagcctgcggcgtcggcaaagaggtctttggcgtcctcgagccgtttaacatccgcatgatctgctatggcgcctccagccacaacctgtgcttcctggtgccgggcgacgatgcggagaaggttgtgcagaagctgcatcataatttgtttgaataa

SEQ ID NO: 1441 - DNA, 477 bp, Klebsiella pneumoniae
ttcatttctgtccgcttcggcggctctctatactgctcgcctgacttctttttttcaggactatcgcacatggccttcgcgccagctcgcgttgcccccgccgtggcgcaacgacttcagatcccggtacaggtacttctctacgtcgggttattcatcttcgcacaatatctggtgaacaggtggcaggtaccgctgccggctaacctggtcggcatggtgatgctcctgctgctgatcgtctgccgggtgataccggtaagctgggtgcgcgccggcgcccgctggctgctggcggagatgctgctgtttttcgtcccggcggtggtcgcggtggtgaactacgcccagctgttgatggtcgatggttggcggatttttctggtgattgccttaagcacgctgatggtgctcggcgccaccgcctgggtcgttgacaaggtctatcgttacgaagtaggcaggttaaaaaaatga

SEQ ID NO: 1442 - DNA, 609 bp, Klebsiella pneumoniae
aagttggctgtggctggaagtactcgccgcgaatcccgccgcgcgccgtttttacgaacgccaggggatgcagcacatcagagacacgactttccactccgccagccagcaaagcaccttacatattctggccaaaccgatttgagaggaactatgcctgagcttcgtgataccggcgtacgtaacgtcgtttgtggggaaaatgtcgttatttaccagcccgccaacctctatgattgccagctcggcgataacgtcttcgtcgggccgttcgttgagatccaggggaatacccgcatcggcgcgaacagtaaaattcaatcccatacctttatctgcgagtacgtcaccatcggccagcgctgctttatcggtcacggcgtgatgtttgccaacgacctgtttcgcgagggtaaaccaaacgccgaccgcgccagctgggggcggatcgagattggcgatgacgtgtcgatcggcagcggcgccacgattctggccgtcagcatctgcgatggggtggtgataggcgcgggcagcgtggtaacgaagtccattaccgagaaaggcgtgtgggcggggaatccggcgaggctgctgcggcggctataa

SEQ ID NO: 1443 - DNA, 570 bp, Klebsiella pneumoniae
aaccaccatgtccgatttaatcacaacacgcccgaccctgggtatgctatatctgaagtgtctcattttcgggagaaaacgatgaaacgacctgattgcattcgccactggcgcgaactggaagggcccgacgatgctacttatcccgacagcccggagcgtttttcaatcggcgcgccgctggggcgaggtttacgtctcaaccggctggggatccaccacgagcggctgccgcccgggcggcgcacctcttatccacacgcggagagcgatgaggaagagttcatctacgtgctggagggctatccggaagtgtggataaacggctatctctggaagctggagcccggcgacagcgtgggttttcccgctggtaccggcatctgccacacctttctcaataacaccgagcaggaagttcgtctgctggtggtgggcgaggccaacaagaagtacaaccgcatttattacccgctcaatcccggctatgccgcgacgcgccaggatcgttgggttgaccatccgccgcagttcttcggtccacacgacggcaagccgcggaaaaagtaa

SEQ ID NO: 1444 - DNA, 723 bp, Klebsiella pneumoniae
aacaagaatgttcacataatcgtttggttgaaatcatttgattttattatggataatagggttacgtggggcaaggatatggatgacgcagtattatttaatgggtgtataattaatcaggagattatatttaatgccaatatgaatgagctgcggccgcttgccggggacggggagtgcatcagcctcaatgcgccaaccgccagatgcttgctgctgcttttgcagaattgcggcaaagtcatttcacgggatgagttcctggcggctgtatgggaaacacggggggtggtcgtttcgcaaaatacgttctatcaaaatatctctttgctgcgaaaatcgctggtaaaagctgggctatctgaggatatcattatcaccgtccggcaaaaaggctttagcgtcgccccgaatacattggtcattcctctctctgatgaagagtgcaagaatatgaatcgggtgacattaacgcattatcagaataataaagttgtcgactttatttctgaagaaaaggaaaagcctgacactcatttaaatcttccactaatagaaaactcatcaaagcatggcagtgatttgatggcaaataaaccggaagaaggtgaaaaagcatctgagcggttgcatgttacttttaaaatacccatatggttaatcgcgctaattgtagtgatgattgtaattaatattattgtgttggtcgcgctaaatcggtag

SEQ ID NO: 1445 - DNA, 471 bp, Klebsiella pneumoniae
cctcctgatgtccgaccaggattagctaaccttcgtgctcctccgttacgctttgggaggagaccgccccagtcaaactacccaccagacactgtccgcaaccccggtcaggggccaacgttagaacatcaaacattaaagggtggtatttcaaggttggctccacgcagactggcgtccacgcttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttctccttacggataaccccatcaattaa

SEQ ID NO: 1446 - DNA, 255 bp, Klebsiella pneumoniae
catgaatgtgtcgtctacgagataatgagcaatagcagtgttctgctggcgttgagcttatttgttcaggatgcatctctaaaatatgcgacagaaaataacctgagcgaggcgcagaattacatgcaattatggcgacaaaatggagaaaaaatggatgttaaagcatctttaaaaatatatttaatgatggaactttttctgaagcgcatggttctaatggccaacaccagtactatatttagatttgcctga

SEQ ID NO: 1447 - DNA, 786 bp, Klebsiella pneumoniae
aactacggtgtttgtcaaagacctggcggattttgccgccatcaatgccgcctacgaggccttctttatcgaacaccaggcggcctttccggcgcgctcctgtgtggaggtagcaaggttaccgaaagatgccggcgtcgaaatcgaagcgatcgctttcgcccgctaacccccaggctggagggagcgcctccagccttctcccaccgatttttgtcgttccacattgttcactttacaggcaatatagccgcagaacgacgcgaggaacgcagcatgttaactattcgacaggcatgtcccgaggacgcgccccagcttagcgcgatgggctatgccagctatcatcaccactttgctcatctctggcgcgatgccgatgaactggcgttatttcttaagcaagaatatgccgaagatgcgctacgtcggagtcttgcggatgcgacccaacactggctcatcgccgaagccccctctcctgttggtttcgctaaatatagctatcagcagcgaatggctgacgacggcaagattggtacgctgctgcataagctctacctgatgccggggaagactggccaccgctacggcgagcatatttttcacgccgtcgagacgcgagcaaaaacggccggtgaaagttggctgtggctggaagtactcgccgcgaatcccgccgcgcgccgtttttacgaacgccaggggatgcagcacatcagagacacgactttccactccgccagccagcaaagcaccttacatattctggccaaaccgatttga

SEQ ID NO: 1448 - DNA, 609 bp, Klebsiella pneumoniae
ctcagatccgtaagcagatccaagaaacgacctccgactacgatcgtgaaaaaactgcaggaacgtgtcgctaaactggctggcggcgtagcagtaatcaaagtcggtgcggctaccgaagttgaaatgaaagagaaaaaagcacgcgtcgacgacgccctgcacgcaacccgtgctgcggttgaagaaggcgtggtggctggcggcggcgtagcgctggttcgcgttgcggcgaaactcgctggcctgaccggtcagaacgaagatcaaaacgtcggtatcaaagttgcgctgcgcgcaatggaagcaccgctgcgtcagatcgtttccaacgccggcgaagagccgtctgttgtggctaacaacgtgaaagctggtgacggtaactacggttacaacgcagcaactgaagaatacggcaacatgatcgacttcggtatcctggacccaaccaaagtcacccgttctgcactgcagtacgcggcttccgtggctggcctgatgatcaccaccgagtgcatggtgaccgacctgccgaaaggcgacgcgcctgacttaggtgctgctggcggtatgggcggcatgggcggtatgggcggcatgatgtaa

SEQ ID NO: 1449 - DNA, 1629 bp, Klebsiella pneumoniae
  unsure (13),(84),(85),(112),(145): Identity of nucleotide at the above locations are unknown.
cggcggcccgttntgctaaaatatcacatcccctgcgagtatttcttcaatgaacgcctactcgctatcacgtctgttatcgcnntggctcacctgcctcgcgacactgtanttcgctcctctgctgccgccagtagagcggaanaagcgccgccggcagcagccgaagacaacacgctatcgattcatatcgacgatatgctacggccatggagaggcgatttgcctggcatgatcgaccgtcgtaccattcgggtattaaccacctacagcaagaccttcttttttattgataaaggcacccagcgcggggcgacgcacgacattttaatcgcgctggaaaacgagctgaataaacagctagcgaaggataaaaagctcaaacagcgccacctgaagctgcatatcgtttttgtgccggtcagtcgggataatctctttatcgcgcttaatgaaggtaaaggcgatattgcggctgccaatctgactatcacgccctcgcgggaagcccaggtcgatttcgcccagccgctctacagcaacgtgaaagaattactgatctccggcccggcttcaccgaaggtcgacagtctggagcaactctctggtcaaaccgtctttgttcgccgctcctccagctattacgacagcctgcaagcgctgaacgcccgatttgccggtgaatcgcgcccaccggtgatactggaggcggcgccggaagcgctggaggatgaagatctgctggaaatgctcaacgccgggctgattccgctgatcgtcgtcgatcagcataaggcgttgttctggaaacaggtgtttccaaaaattcaggtccatgacaacgtggtgctgcgcgacggcggcgacattgcctgggcggtacgcaaagacagcccgcagctgctgacggtactgaacaacttcgtcaaaaagaatcgtcagggcaccacgctgggcaatactctcctgctgcgttacctgaaaaatgctaaatatgtcaaaaatgccgcggcgagtaaggaacgacgcaaattcctcgcgatggtagatgtcttccgcaagtacggcgatcgttacgacgtcgactggctgctgatggcggcccagggataccaggagtcgcggctgaatcagtcggtacggagccacgtcggcgccatcggcgttatgcaggtgatgcccagcactggaaaagagctgaaggtgggcgatattaaacagctggatcccaatatccatgccggcgtgaaatacatgcgctggatgatggatcggtactatgccgatgagcccatgacccggctcgataaagcgctgtttacctttgcctcctataacgcgggtccggcgcgtatcgcccgcctgcgcaccatgactaaacagcgaggatttgacccgaacgtctggttcggtaacgtcgaaaatatggcggcagaaaaaattggcgccgagacggtaacctacgtcagcaatatctataagtattacatcgcctatcggctgatcgtcgatgacatggcccgcaaacagaaagcgacggccgtaccgcggcaggagccggtggcgcagccagtcaaaccgcagcccagcgtggcgacagccgccaccgctcaggtgcccgtcatctga

SEQ ID NO: 1450 - DNA, 192 bp, Klebsiella pneumoniae
ttctttcacgttgctgtagagcggctgggcgaaatcgacctgggcttcccgcgagggcgtgatagtcagattggcagccgcaatatcgcctttaccttcattaagcgcgataaagagattatcccgactgaccggcacaaaaacgatatgcagcttcaggtggcgctgtttgagctttttatccttcgctag

SEQ ID NO: 1451 - DNA, 378 bp, Klebsiella pneumoniae
aggaccaacgtcctgtttttcgacgacatcatgaggagcgtcatgcaactgccacactgcccaaaatgcgattcgacttacacttatgaagatagcggcatgtacatctgcccggaatgtgcccatgagtggaaccctgccgaggcgacggaagagagcgacattctgatcgttaaagatgccaatggcaatttactggccgatggcgacagcgttaccgtcgtgaaagatctgaaggttaaaggcagctcttcgatgctgaaaatcggcaccaaagtgaaaaatatccgtctggtcgaaggcgatcacaatattgactgcaaaattgacggttttggtccgatgaagctcaaatcggaatttgtgaaaaagaactga

SEQ ID NO: 1452 - DNA, 942 bp, Klebsiella pneumoniae
ggtaatacagttatgccaattcgggtgcaggacgagctgccagccgtcaatttcttgcgcaatgaaaacgtcttcgtaatgacgacaacacgtgcaacgactcaggaaatccgccccctgaaggtgttaatcctcaacctgatgccgaagaaaatcgagacggaaaatcagttcctgcgtctgctatcaaactctccgctgcaggtggatatccagttattacgtatcgatgcgcgcgagtcgcgtaatacccctgcggagcatctgaataacttttactgtaatttcgatgagatctgcgatcagaactttgacggcctgattgttaccggcgctcctttaggcctggttgagtttaacgatgttgcttactggccgcagatcaaacaggtgctggagtgggccaaggatcacgtcacttcgacgctgttcgtctgttgggcggttcaggccgcgctgaacattctgtacggcattcccaagcagacccgcgccgaaaagatttccggcgtctatgaacaccatattcttcatccgcacgccttactgacccgcggtttcgacgactctttcctggccccgcactcacgctatgctgattttccggccggacttattcgcgactataccgatctcgagatcctcgcggagacggaagagggcgatgcgtatttgttcgccagcaaagataagcgcatcgcctttgtcaccggccacccggagtacgatgccaataccctggcaagtgaatatttccgcgatgtggaagccggtttgaaccctgagatacctcataactatttcccacaaaacgacccgcagaacaaaccgcgcgccacctggcgcagccacggcaatctgctgttcgctaactggcttaactattacgtctaccagattacgccatacgatctgcgccatatgaatccgacgctggaataa

SEQ ID NO: 1453 - DNA, 204 bp, Klebsiella pneumoniae
attgtcagagtggctgcatttttcgccagaactgacgacagcttagcggaagaatcggcccattttctctcctttttgctcaatctgttcccgaaatctcagattttgtggcgcttaatggccgatctgagctttcgggaatgctccggcgggaacagggcagcgcagcggggagcggcgtgccactctgcaagtgttcaatga

SEQ ID NO: 1454 - DNA, 1026 bp, Klebsiella pneumoniae
cggcgcggagtagcgatcatggaacggaaaggcattattgccgcaggcaacatgctggtcgatcatgtccaccagatcgggcagtggccggagcgcggctggctggtggaaattgtccatagcgaacgcgccaccggcggcgcgccgctgaatgtcctgctgaccctggccaaaatgcacgccgggctgccgctgcaggcggtcggcctgattggcgaggataacgatggcgactacatcaccgccatgctcgatcagtaccatatcaatcgccagctcgtacagcgcaccagctccgcccccacctcgatgacccaggtgatgaccgacgccgaaggccagcgcactttctttcactctcccggcgccaaccgcctgcttgatctcccggcttttgagccgctggatgcgccgctgaaaattttccatctcggctatctgctgctgctcgaaagcctcgatcgccccgatgaagtgtacggcacccgcagcgcgcgactgctggcgcagatgcgcgagcgaggctatgaggtgtccctcgatctggtgtcgcgcaagggcgacccgcgctaccggccgctggtcctgccggcgctgaagcatcttgactacctgaccatcaatgaactggaagccagcgagtttagcgggctggagattcgtctacccaacggcgagccgcacgtcgccaatatcgcccgcgccgccagcgcattgcttgacgccggcgtacgccagcgggtagtgatccattgtccggagggggcatggggcgtctcccgtaccgaagccgggcgctgggtaccgtcatggcggctgccgccggaggagattatcggcagcgtcggcgcgggggacgccttctgtgccggcctgctgtacggcagtcacgaacgctggccgttaaccgccagtctgcagctggctcacgcctgcgcccgcgccagcctgcaggccgccaatgcgatcgacggcgccaaaacgctccctgagctgcaggcgtttatacaattgcaggatggttag

SEQ ID NO: 1455 - DNA, 516 bp, Klebsiella pneumoniae
gccagtacggttgcggtggtggtaccgtcgcctgctgcgtcgttcgctttagaggcaacttctttcaccatctgcgcgcccatgttttcgaacttgtcttccagttcgatttcacgtgcaacggaaacaccatctttggtgatggtcggcgcgccgaaggatttgtccagaaccacgttacggcctttcgggcccagggtcactttaactgcatctgccagtacgtttacgccgcgcagcatttttacacgagcgtcgttaccgaattttacgtcttttgctgccatttcttttattcctcaaattcgttcagggtcgtgcgaattaagcttcaacaattgccaggatgtcgctttcggacatgatcagtacttcttcgttgtcgatcttttcagtcttcacgccgtagccatcgttgaaaatcacgatgtcaccaactttaacgtccagcggctgcacggtcccgttttccaggatgcggcctttaccgacagcgatgatttcgccacgagttga

SEQ ID NO: 1456 - DNA, 1584 bp, Klebsiella pneumoniae
cattctgcatttattttccgatggtggactgcagctattgttcttacagacaggagcgccgcgatgaccgccaccccggtactggaaatgcgccatatcgccaaagcttttggcaaattctacgcgctgaagggcgtcgacctgacggtctggcccggcgagatccatgctctgatgggggagaacggcgccggaaaaagcacgctgatgaagatcctcgccggcgcctataccgccaccagcggcgagatcctgatcgacggaaaaccgcaaacgatccgcggccccaaggacgcgctggccgccgggatcacattgatctaccaggagatgcagctggcgccgaacctgaccgtcgcggaaaacattttcctcggcagcgagctggcgcgcggtggtctggtgcagcgcaaagccatgctcagccaggcgcaggcggtgatcgaccgtctcggcgcccagttcaaagccagcgaccgggtgatgaccctgaccatcgccgaacaacagcaggtggagatcgcccgcgccctgcaccgtcaaagccgcattctggtgatggatgaacccaccgccgccctctcctcgcgggaaacccagcgcctgttcgagctcatcctgcgcctgcgcgatgaggggatggcgatcatctatatcagccaccgcatggcggaagtgtatgagctctccgaccgggtcagcgtcctgcgcgatgggcagtatgtcggcagcctggtgcgcgacaagctcaacgcgccggagctggtgcgcatgatggtcggtcggccgctcagcgatctgttcaataaagaacgggacattccccgcggccagccgcgcctgcgggtcgaggatctgaccgatggcggcaaggttaagcccagcagcctggtggtgcatgccggcgaaatcgtcggcctcgccgggctggtcggcgccgggcgttccgaactggcgcagctgatcttcggggtgcgcaaagccaccgccggggtgattgagatcgacggcgagccggtggtgatccactcgccgcgggaagccatcgacctcgggatcggctttctgaccgaaaaccgcaaagaacaggggttgtttctcgaactggcagcccaggaaaacatcaccatggcgacgctggagcgcgacgcgacctgggggatgctcaaccgccggaaggcgcaaaccatctccgatgacgccatccagttgcttaacatccgcgtgccgcacgcccaggtgcgcgccggcggactgtccggcggcaaccagcagaagctgttaatttcgcgctgggtggcgattggcccgcgcattctaatcctcgatgaacccacccgcggcgtcgacgtcggcgcgaaaagcgaaatttaccgcatcatgaacgacatggcgcgccagggcgtcgccattctgatgatctccagcgagctgcccgaagttgtgggcatgagcgaccgggtctatgtgatgcgcgagggcgttatcgccggcgagctacaggccggtgatattagccaggaaagtatcatgacgctggccaccggcgtgaccgattctcaccttaaggcagggcaactatga

SEQ ID NO: 1457 - DNA, 414 bp, Klebsiella pneumoniae
ccgaccgcattctcggcttcacctggaaccgcctgtaccagggcatcaacgtgcataacgccgagcgcgtacgccagctggcgcacgacggccatgaaattgtctatgtcccctgccaccgcagccacatggactatctgctgctctcctacgtcctgtaccatcaggggctggtccctccgcatatcgcggcgggcatcaacctcaacttctggccggccgggccgatcttccgccgcctcggcgccttctttattcgccgcacctttaagggcaacaagctctattccaccgtgttccgcgaataccttggcgaactgttcagccgcggctattccgtggagtatttcgtcgaaggcggccgctcccgtaccggccgcctgctcgatccgaagaccggtacgctgtcgatga

SEQ ID NO: 1458 - DNA, 192 bp, Klebsiella pneumoniae
aacccccctttaaacacccaccgcgggtttttggcgttacccgctcatgtcaatatcctgtgtcgggttgggaaaaaatcaaaaaaaacatctgacaagggggcggggttcccgttcaaaaacccaaatttctcccgcggctcttggggggtattcaccaccccgaaaaatataacctttttacacaaataa

SEQ ID NO: 1459 - DNA, 1728 bp, Klebsiella pneumoniae
cacggcccttcggttgcaggtctgcaccagtcggtcggtaacggcgccatgagtaatgccatcacggagattgataacaccgatctggtgtttatcttcggttacaacccggcggattcccaccctatcgtggcgaatcacgtcattaacgctaaacgcaacggggcgaaaattatcgtctgcgacccgcgcaaaattgaaaccgcgcgcatcgccgatatgcacattgcgctgaagaacggctcgaacatcgcgctgctcaacgccattggccacgtgattattgaagaggatctgtacgataaatccttcgtcgccagccgttccgaaggcttcgaggagtatcgcaaaatcgttgaaggctatacgccggagtcggtggaggagatcactggggtcagcgcccaggagatccgcgcctgcgcccggatgtatgccagcgccaaatccgccgccatcctgtggggcatgggcgtcacccagttctaccagggcgtggagacggtgcggtcgctgaccagcctcgcgatcctcaccggcaacctcggcaagccgagcgtcggcgtcaacccggtacgcggccaaaacaacgttcagggcgcctgcgatatgggtgcgctaccggatacctatccgggctatcagtacgtcaagttcccggagaaccgcgaaaaattcgccaaagcctggggcgtggaaagcctgcctgcgcataccggctatcgcatcagcgaattgccgcaccgcgcggcgcacggtgaagtgcgggcggcgtacattatgggtgaggatccgctgcagaccgacgccgaactctcggcggtccgcaaagcgttcgacgatctggaactggttatcgtccaggacattttcatgaccaaaaccgcctccgcggccgacgtcatcctgccgtccacctcgtggggcgagcacgaaggcgtgtataccgcagcggaccgcggcttccagcgcttctttaaagcggtggagccgaagtgggacctgaaaaccgactggcagatcatcagcgaaatcgccacccggatgggctatccgatgcactacaacaacacccaggagatctgggacgagttgcggcatctgtgcccggacttctacggcgccacctacgagaaaatgggtgagctcggctatgtcatgtggccgtgccgcgatgagtccgacgccgatcagggaacgtcgtatctgtttaaagagaagttcgataccccgaacggactggcgcagttcttcacctgcgactgggtcgcgccgatcgataagcttaccgatgagtacccgatggtattgtcgacggtgcgcgaggtcggccattactcgtgccgttcaatgaccggtaactgcgcggcgctggcggcgctggcggatgaaccaggctatgcgcaaatcaacaccgccgacgccgaacggctaggcatcgaagatgaagagctggtatgggtcaattcgcgtaaggggcgcatcatcacccgcgcgcaggtcagcgatcggccgaataaaggcgcggtgtacatgacctaccagtggtggatcggcgcctgtaacgaactggtctcagagaacctgagtccgataaccaaaacgccggagtacaagtactgcgcggtcaacgttgagcggattgccgatcagcgcgccgcggaacagtacgtgatcggcgagtacaacaagctgaaatcccgcctgcgcgaaagcgcgatgggttaa

SEQ ID NO: 1460 - DNA, 549 bp, Klebsiella pneumoniae
gaaacgtattcaggagacacgaacatggccagcagaggcgtaaacaaggtgattctcgtcggtaatctggggcaggacccggaagtacgctacatgccaagtggcggcgctgtcgccaacttcacgctggcaacttccgaatcctggcgtgacaagcagaccggcgaaatgaaagagcagaccgagtggcaccgcgttgtgctgttcggcaaactggcggaagtcgctggtgagtatcttcgtaaaggctcacaggtgtacattgaaggccagctgcgtacccgcaagtggaccgatcaatccggtcaggacaaatacaccaccgaagtggtggtgaacgtgggcggcaccatgcagatgctgggcggccgtcagggcggcggcgcaccggcaggcggcggccagcagcagggcggttggggtcagccgcagcagccgcagggcggcaaccagttcagcggcggcgcgcagtcccgtccgcagcagcaggccccggcagcgccttccaacgaaccgccgatggacttcgacgacgacatcccgttctaa

SEQ ID NO: 1461 - DNA, 1047 bp, Klebsiella pneumoniae
tgcgcaatctcatacaatattcctgcccgacacccttctacactgcagacaacggtaatgacaacggatgcaatgatgattagtggtgtgttatacgccctgctggcggggctgatgtggggtttaattttcgtcggacctttgctggtgccagagtatccggcgatgctgcagtcgatgggacgctatctggcgctgggcctgatcgctctgccgctggcgtggctcgggcgcgcgcgactgcgccagttgagccggcacgactggtggaccgcgctgggcctgacaatgatggggaaccttatctattacgtctgcctggccagcgccattcagcgcaccggggcgccggtttccaccatgattatcggcacgctgccggtggtactgccggtgttcgccaatctgctctacagccagcgcgacgggaagctgccgtggcggcgcctttttccggcgctgatctgcatcgccgtgggcctgatctgcgttaacgtcgcggagctgcgccaggggctgccgaattttagcccgtggcgctacggctccggcattgcgctggcgctgggatcggtggtctgctgggcctggtatgctctgcgcaacgcccgctggctgcgggagaacccgcatcaaccgccaatgatgtgggctaccgctcaggctctggtgacgcttccggtttcgctggccggctatctcgccgcctgcgcctggctgcacggtcagcaggccgggtttcccctgcccttcggcccgcgtccggcggtgtttattacgctgatgctggccatcgcggtgctctgctcatgggtcggcgcgctatgctggaatattgccagccagcggctgccgacggtgatcctcggcccgcttatcgtcttcgaaaccctggccggactgctgtataccttcctgctgcggcaaagcttaccgccgctgctgaccctgagcggcatcctgctgctggtgctcggcgtggtctccgccgtacgcgccagaccggaaaaaccgatgctgcagccgctggcggacgaaaaaaagtag

SEQ ID NO: 1462 - DNA, 480 bp, Klebsiella pneumoniae
aataaatcctcgccatgcccactgtgtcaccctgtaccacaatggtttcacctgcgaagccgatacccttggcagttgcggctacgtatacatcgccgtttacctcactcatcgttaactactttcacaagagcaaatatgaaaactctacctgcaacaactccgcaggcggcgacgctatgtctgtcgcctgtggcagtctggcaaatgctgcttgctcgcctgctggaacaacattatggcctgacgctaaacgacacgccgttcagtgatgaaaaggtaattcaggaacatatcgatgccggtatatctttggccgatgccgttaattttctggtggaaaagtacgggctggttcgtattgatcgcaggggattcgactggctagaacagtccccatatctgcgggcagtcgatattctgcgggcgcgacaggcaactggtttattgaaaagaaatcgtattagcgcggcacagtga

SEQ ID NO: 1463 - DNA, 510 bp, Klebsiella pneumoniae
agaatgtcctctcctatgacgcctactaccgctactttatggggcagcaggataagatcctcagcgatgcggagtggcgccagcgttactgatcgccgggaagtatgttatgctttgtactcgttgaagagtacattcgacgggcagcgtaagctgcccgtctcaatatggtggcgcgatatgacccaacaatctccctattccgcggccgttgccgaacaacgtcatcaggagtggctgcgctttgttgccctgcttcagcaggcctatgctgaggatctgcatctgccgttgctgcagctgatgctgacgcccgacgagcgcgaagccctgggtacccgggtgcgcattatcgaagagttgctgcgcggcgagatgagccagcgtgagctgaaaaatgagctcggcgccggaattgcgaccattacccgcgggtcgaacagcctgaaatcggcgccggtagagctgcgccagtggctggagcagacgctgctggctagcgataaatag

SEQ ID NO: 1464 - DNA, 741 bp, Klebsiella pneumoniae
aaggtggcctccatgccttactccatcggcgaatttgcccgactttgcgggataaatgcgaccacgcttcgcgcctggcagcgccgctacggcctgcttaagccgctgcgcaccgatggtggacaccgtctgtacagcgatgacgacgtccagcaggcgctgaagatcctcgactgggtgaaaaaaggggtgccggttagccaggtgaagcccctgctgtcgcgccccggcgcgcggcgcaccaacaactggctgacgctgcaggagaccatgctgcagcggctgaaagagggaaaaatcgagtccttgcgccagctgatctacgacgccgggcgcgaatatccgcgccaggagctggtaaccgaagtgctgcgtccgctgcgcagccaggtctccgccaacgtgccggccatcatgacgctgcgcgaaattctcgacggcatcatcatcgcctatacctcgttttgcctcgaaggcgacaagaaggcgcccggggacaactttctgatcaccggctggcacctgaccgacgcctgcgaaatctggcttgaggcgctcaaacgtaccggccagggccatcgcatcgacgtcctgccggtgcctcccgccgccctggcgccggagatttttccccagcgcaactggctgctggtcaccagcggcaaactctccgctgcccgccagaggcaggtcgaactctggcagcagcaggtcgtctccctcgaggtgatcccgctctaa

SEQ ID NO: 1465 - DNA, 1239 bp, Klebsiella pneumoniae
cacaatcgattcagcaaaaagggaataaaaatgaaaaagacattggttctgacgacgatcgccctgctggtttctggctcggccgcggcaaaaacatgggtgctgacgaacgctgaagaggggatggataaaggaaactggcagatcaacagcgatcagctgaaggtgaaagaccatgcgttcagcattgagcaaaaagtcctgcacggcggtaagcaggaaggcagcaaaatcctcaccattcatagtaaagacggcctgaccattaccttgagcccgacacgcggcatgaacttactgcgtattgagggtttcggcagccggatgggctgggattcgccggttaaagaggtcgtcaacccggcgtttatcaacctggaaagccgcaatggcctcggctggctggaaggattcaacgagatgatggtccgctgcggctatgaatggaccggccatccggtgaccgcggacgggcaaatttataccctacacggcaaggcgggcaacacgccggcctctctggtggaggtggaggtggccgacagcgcgccgtatgaaatccgcatccgcgggctggtgaaagaaagcacctttaaaaaagccgatctgcagaccctgaccgaactgcgctacgtgccgggtagcaacagcttcagcttacatgacgtcttaaccaaccatgccgactatccgcatgattatcagatcatctaccacagcaacttcggcaccccgatcctcgaagaaggcgcgcgcttcctcgccccgatgtccagcatcagcccgttcaatgattacgcgaagagcgggttaaaaacctggcagacctatcagggaccgaccaaagattttgacgagatggtatttaatattcagccgctggccgatgaaaatcaccagaccctggccgcggtggtcaacaaagcgggcgataaaggggcctctattcagtttgatacccgtcagctgccggtcctgacgctgtggaaaaacaccgataccgtcaagcagggctatgtcaccggtatcgagccggggaccagctacgcctatccggtgaccattgaacgcgaacaaaaacgcgtgaagcagctgcagccgggcgccagcgcgcagtttgatctaacctacaccctgctgcacgacagcgcccaggtagccgccgttgagcagaaaatcgctaagattcagggcgataacaaagtcgcggagaacgagacgccgatcgccaaagagtaa

SEQ ID NO: 1466 - DNA, 1518 bp, Klebsiella pneumoniae
atggaggaatcgaccatgagctcacccctgttgattgcgcgcacgctggataacgcgctctatttactgcccgcgatggccaaccgccatgggcttatcaccggtgcgaccggcaccggtaaaaccgtcaccctgcagaagctggctgagtcgttctcggagattggcgtgccggtatttatggccgacgtcaagggcgacctgaccggcattgccgccgcggggcagagctcagagaaactgcaggcgcggctggagaagatcggcgtcagcgactgggagccgcacgccaacccggtggtgctctgggatatctttggcgagaagggccacccggtgcgggcgacggtctccgatctcggccccctgctgctggcgcgcctgctcaatctcaacgaggtgcagagcggcgtactgaacattattttccgcatcgcggacgaccgcggcctgctgctgctcgacttcaaagacctccgcgccatcacccagtttatcggcgataacgccaagtctttccagaaccagtacggcaatattaacagcgcctcgatcggcgccatccagcgcgggctgttgaccctggagcaacagggcgccgagcacttcttcggcgagccgatgctggatattgccgactggatgcgcgtcgatgccagcggtaaaggggtgatcaatatccttagcgccgaaaagctctaccagatgccgaagctgtacgccgccagcctgctgtggatgctctccgagctctacgagcgcctgccggaagccggcgacctcgataaaccgaagctggtgttcttcttcgatgaggcgcatctgctgttcaacgacgcgccgcaggtgctgctggataaaattgaacaggtgatccgccttatccgctccaagggcgtcggcgtctactttgtctcgcagaacccggcggatattcccgacgccgtgctcggccagctgggcaaccgcgtgcagcatgccctgcgcgcttttacgccgaaggaccagaaggcggtgaaaaccgccgcccagaccatgcgcgccaacccggccttcagtaccgagcaggcgatccaggagctgggcaccggcgaggcgctgatctccttcctcgatgagaaaggcagcccgtcggtggtcgagcgggcgatggttatcgccccctgctcgcgaatggggccggtcagcgatgacgagcgcaatggtctgctgaaccactcgccgctgtacggtaagtatgaggaggaggtggaccgcgagtcggctttcgaaatgctgcagcaaggggtgcaggtcgccaccgggcagcagtcggctccgccggcgaagggccagcagaacggcgatgacgacgggctgcttggcggcctgaaagatatcctgttcggcagcaccggcccgcgcggcggaaaacgcgacggtatcgtgcagaccgcagcgaaaagcgcggttcgccaggtcaccaatcagatcgtccgcggcatgctgggcagcctgctgggcggacgcaagcgctaa

SEQ ID NO: 1467 - DNA, 972 bp, Klebsiella pneumoniae
ggggctttttttttgcccaggcgtcaggagataagcatggctaacccgctatatcaaaaacatatcatttccataaacgatctcagccgcgaagacctcgaactggtgctggcgacggcggcaaagctgaaagccaatccacaacccgagctgctgaagcataaggttatcgccagctgcttctttgaagcctcgacccgcacccgcctctcttttgaaacctcgatgcaccgcctgggcgccagcgtggtcggcttttccgacagcgccaacacctcactgggcaaaaaaggggaaacgctggcggataccatctccgtcatcagcacctacgtcgacgccatcgtgatgcgtcatccgcaggagggcgccgcgcgcctggcgaccgaattctccggcggcgtgccggtactgaacgccggcgacggcgctaaccagcacccgacccaaaccctgctcgacctgttcaccattcaggagacccagggccgcctcgaaaacctcaacgtggcgatggtcggcgatctgaagtatggccgtaccgtccactccctgacccaggcgctggccaaattcaacggcaaccgcttctacttcatcgccccggacgcgctggccatgccgcagtacatcctcgatatgctcgatgaaaaaggcatcgcctggagcctgcatagcgccatcgacgacgtgatggcggaagtggatattctgtacatgacccgcgtgcagaaagagcgtctggatccgtcggaatacgccaacgtcaaagcgcagttcgtcctgcgcgccgccgacctcgaaggggcgcgcgccaacatgaaagtgctgcacccgctgccgcgcattgatgaaatcaccaccgatgtcgataaaacaccgcacgcctggtacttccagcaggccggtaacggcatcttcgcccgccaggcgttactggcactggtactgaatagcgagctggcactgtaa

SEQ ID NO: 1468 - DNA, 267 bp, Klebsiella pneumoniae
atgctcccgtcgctactgaacccgcgagcccactcagcatcactccaggtattacaatatatcttgattccagaaaaactggcaccgccagccacgccagccacgccagccacgccagccacgccagccacgccagccacgccagccccgttgccgcgaggctggagccgatcatacgccttgcatgatgataaacaaacccggactcatggcctgcgccgaatcgccgtaagtcgcggtgtaccagcccgtcaatcagccctataa

SEQ ID NO: 1469 - DNA, 225 bp, Klebsiella pneumoniae
gcggtggcgtcggtaccgtgctgggaacgctgttccggggtggcgatccaggggctgattcagacctacatcaacttcgacggtaccctcagctcatggtggacgaaaatcgccatcggcattttgctgtttatctttatcgcgctgcagcgtgggctgaccgtgctgtgggaaaatcggcagaatgcggcggtgacgcgggtgagcggggcggggagtcgctaa

SEQ ID NO: 1470 - DNA, 984 bp, Klebsiella pneumoniae
cggaggtggtcaatggctaatctgttgaaacgacatgaattctggttaggcatgttcattattgcgctgtgcctactgctgggctggcgcagtgaggaatttttcactttcggcaatatttacgacctcgctaataactatgcgatgctgaccattctcgcctgtggtctgttcgtggtgctgatcgccggcgggattgatatctccttcccggctatgaccattatcgcccagtacggcatggtggtgatgctgcaaaaagtaggcggcaacttcgcggtggcttttgtgcttgccggcggcatcggcgtgctgctggggctggtgaacgcgctgttggttaatcgtctgcgggtgccctcgatcattatcaccatttctacgctcaacattttctacggtttgctgctgtggttaagcaaaggtgtctggctctacgacttccctccgtggtttgaaaagggggttatgctgttcaaatataccgatgccgatggttacgattacggcctggggctgccgctgctgacgatgatcgccgtggtgctgttgaccgcgtttatcatgaatttcaccaccgttggccgcaagatctatgccatgggcggcaaccgggaatccgccagccgcgtcggcttcagcgtgctccgcctgcagctgttcgtttatggctatatggggctaatgtcgggggccgcaggtgtcgtgcaggcgtggacagtgatgaccgttgcgccggattcactgctgggctatgagctgacggtgctggcggcggtggtgctgggcggcaccagcctgattggcgggcgcggaactctcaccggtacgctgctgggggtgattttactggcggtgatgcagaacggcctgaacctgctaggggtctcctcctactggcagaccctgatcactggggcgatcatcgtcgtcagcatcagcgtaacggcatggagccagcatcagaaccggagcttgttatga

SEQ ID NO: 1471 - DNA, 309 bp, Klebsiella pneumoniae
agtctccggtctttcttccatctcacagagaggcacatcgccatgaaaaagacccgctataccgaagaacagattgcgtttgctctgaaacaggccgaaaccggcacccgcgacggggaagtctgccgaaagatgggcatttctgaagccactttttataactggaagaagaaattcgccggtctgggcgtgaccgaactgcggcgtctgcggcaactggaggatgaaaatctgcggctgaagaaactggtggctgacctgagtctggacaaggagatgctgcaggaggtactgaaacaaaagttctga

SEQ ID NO: 1472 - DNA, 1038 bp, Klebsiella pneumoniae
agaattcttccgcgaacgtcagcaggcccgctacggcggcgacggcaaaggcggcgtacgctgctgttaatggaggcaataatggcaccgattgcagtcaccctactcaccggttttctcggcgcaggaaaaaccaccctcctgcgccatatcctcaatgagcagcacggtttcaaaatcgccgtaattgaaaacgaattcggcgaagtctccgtcgacgatcagctcatcggcgaccgcgccacgcagattaaaaccctgaccaacggctgtatctgctgtacacgctccaacgaactggaagacgccctgctcgatctcctcgacagtcgcgatcgcggcgaaatcgagtttgaccggctggtgattgaatgcaccggcatggccgacccggggccgattatccagacctttttctcccatcaggtgctctgcgagcgctatctgctggacggcgtgatcgccctggttgacgccgtccatgccgaccagcagatggatcagttcaccatcgcccagtcgcaggtcggctacgcggaccggatcctgttaaccaaaaccgacgtcgccggcgacaccgaaaagctgcgtgaacggctggcgcgcattaacgcgcgggcgccgatttataccgtcattcacggcgatatcgatttaagccagttgtttaacaccagcggttttatgctggaagagaaggttgtcagcgccacaccgcgctttcattttgtggcagaaaaacagaatgacgtctcgtcgattgtggtcgagctcgactatccggtggatatcagtgaagtttcacgggtaatggaaaatctgctgctctccttcgccgagcaattgatgcgttataaaggcatgctgtggatcgacggcgagccaaatcgcctgctgttccagggcgtgcagcgcctctacagcgccgactgggatcgcccgtggggcgatgaaacgccgcacagcacgctggtgtttatcggcattcagttgccggaagaggaaattcgcgcggcgtttgccgggttacgacgctaa

SEQ ID NO: 1473 - DNA, 1053 bp, Klebsiella pneumoniae
acggcgattccatcaccgttgacttcaaccatccgctggccgggcgcactgttcattttgatattgaagtgctggagatcgatccggcgctggaggagtaacatgcagatcctgttggctaacccgcgcggtttttgcgctggcgttgaccgcgctatcagcattgtagaaaacgcgctgacgctgtatggcgcaccgatctatgttcgtcatgaagtggtgcacaaccgctatgtggtggatagcctgcgcaagcgtggcgccatttttatcgaacagatcagcgaagtgccggacggcgcgatcctgattttctccgcccacggcgtgtcgcaggcggtacgcaacgaagcgaagagccgcgacctgacggtattcgatgccacctgtccgctggtgaccaaagtccatatggaagtcgcccgcgccagccgccgcggcgaagagtcgattctgattggccatgccggccatccggaagtcgaaggcaccatgggacagtacaacaacccgcaaggggggatgtacctggtcgagtcgccggaagacgtgctgaagctggaagtgaaaaatgacgcccggctgtcgtttatgacccagaccacgctctccgtcgacgatacctcggatgtgattgacgccctgcgcgcgcgttttccgaaaatcgtcggcccgcgcaaagacgacatttgctatgctaccactaaccgtcaggaagccgtgcgcgcgctggcggagcaggctgacgtagtgctggtggtcgggtcgaaaaactcctccaactctaaccgcctcgccgagctggcgcagcggatgggtaaggcggcttacctgattgacgacgcctccgatatccaggaagcgtgggtcaaggatgcggcctgcgtcggcgtgacggcgggcgcgtcggcgccggatattctggtgcagaacgtcattacccgcctgcaggagctgggcggcggcgaagccgtgccgctggaaggccgggaagagaatatcgtctttgaagtgccgaaagagctgcgtgtggatgtccgtgaagtagagtaa

SEQ ID NO: 1474 - DNA, 1197 bp, Klebsiella pneumoniae
ttgatggttccgcgtttcgccaccttaggccgtatccccaaaggcgtttgggtactcggcggcgtcagcctgctgatggatgtctcctccgagatgatccacagcctcttaccgctgtttatggccactaccctcggcgccagcgtgataattatcggtcttatcgagggactggcggaagccaccgccctgatcctgaaggtcttctccggcgcaatcagcgactatgtcggcaagcgtaaaggactggcgctgctgggctacggcctgggcgcgctcagtaagccgctgtttgccttcgcccctaccgccggggtggtgtttagcgcccgcatgattgaccgcgtaggcaaaggtattcgcggcgcgccgcgcgatgcgctggtcgccgacgtcaccccgccggagatccgcggcgccgcctacggactacgccaggcgctggataccgtcggcgcctttctcggcccgctgctggcggtgctgctgatgtttatctgggccaacgattttcacgctattttctgggtggcggtcattcccgccgtgctctccattctcctgctcggattcggcctacaggagccaaaatccgccatcgcgcacaaacgcagcaatccgctgaagcgcgaaaacctgaaaaagctctccgccgcctactggtgggtggtcgcgatcggcagcattttcaccctcgcccgcttcagcgaagcctttctggtgctgcgcgcccagcagatggagatcccgctctataccatcccgctggtgatggtggcgatgaacctggtctacagcctcacggcttacccgttcggtaaactctcagacagcatgagccacagcaaactgctgcagtgggggctgctggtgctgatcctcgccgatatcgtgctggcgctcagcggccactggagcacgctgctgatcggcgtcgcgctgtgggggattcatatgggaatgacccagggcctgctggcggcgatggtcgcccatacggcgccaccggagctacgcggcacggcgttcggtatgtttaatctgatgagtggcctggctctgctgctggccagcaccggcgcgggggtactgtgggaaaccttcggcgccgcctcgacgttttacgccggggcgataatttgcgtggtcacgctcatcggcatgcgcgtgatgccgtcggcctatcgtcaggattaa

SEQ ID NO: 1475 - DNA, 2355 bp, Klebsiella pneumoniae
atgtacgctcctggggattccttcgtttgccgccttgctctgacgctaattgctttgcgaaaacggaggtgctgtgcatttgtaaagggaacggctcccggcgtcgctgcgctcgcccaggctacgaaaagccgcatacgcggttgtagcccgggtaaggcgctatgcgccgcgatccgggaccggctccttagtggccaaacggctacggggccggtcccttctccccgttggggagagggggaggggctaaaccagctggaattaaccaatctgcccattacccaggtgcttcacgcggcgcttcacttcttcctgcttgccggcgttgaacggccgcgcgtccgggctgccgagataaccgcacacccggcgggtaacggaaacgcgggcggcgtcgtggttaccgcatttcgggcaggtaaagcccttgctggtgcactcgaactcgccggtaaaaccgcactcgtagcactcatcgatcggcgtattggtcccgtagtacggcacgtgctgatagctgtaatcccacacgtcttccagcgccttgaggttatgctggatattcgggtactcgccgtagcaaatgaaccccccgttggccagcggcgggtacggcgcttcgaaatcgatcttgtcgtacgggttgaccttcttctccacgtcgaggtggaagctgttggtgtagtaacctttgtcggttaccccttccaccacgccaaactcggcggtgtcgagacggcagaagcgatcgcacaggttttcgctcggcgtgctgtacaggctaaagccgtagccggtttcttccttccacaaatcgacagcgtcgcgcaggcgctggacgatggccacgcctttctcacgcagcgcctcgctgtcgtacatatgctggttgccgtacagcgcattgatggtttcatggataccgatatagcccagagaaatggacgcgcggccgtttttgaagatctcggagacgtcgtcgtcggctttcagccgcacgccgcaggcgccttccatatacaggatcggcgccacgcgagccttcactccttccaggcgggcgatacgggtcatcagcgctttacgcgccagctgcaggcgctcgtccagcagcgcccagaaggcggcttcatcgcctttcgcttccagggcgatgcgcggcaggttgagactgatcacgccgaggttattgcgtccatcatgcacctgctcgccgttctcgttttcccataccccgaggaagctgcggcagcccatcggcgttttaaacgacccggtgactttcaccacctgatcgtagttgaggatatccgggtacatgcgcttgctggcgcactccagcgccagctgtttgatgtcgtagttcgggtcgccgaacttatggttcaggccgtcgcggatcgcgaacaccagtttcgggaacaccgcggttttgcgatttttaccgaggccggcaatgcggttgcgaagaatcgactgctggatcagccgcgattcccagctggtgccaaggccgaacccgaaggtgacgaacggcgtctggccgttggcggtatgcagtgtgttgacctcatactccagcgactggaaggcgtcgtagcactctttttcggtacgggcgcgggcatagccttcggcatccgggatctgccactcttcggcgattttgcgatgctttttgaagctttcgctgacgaacggcgccagcacttcatcgatgcggttgatggtggtgccgccgtaaatatggctggcgacctgggcgatgatctgcgccgtcaccgcggtggcggtagagatagacttcggcggctcgatctccgcgttgcccatcttaaagccctgggtcagcatgcctttcaggtcgatcagcatgcagttgaacatcgggaagaagggcgagtaatcgaggtcatgatagtggatcatgccgcgctcgtgggccatcaccacatcgtggggcagcaggtgctgccgggcgtagtgcttggcgacgatcccggccagcaggtcgcgctgggtcgggatgactttactgtccttgttggcgttttcgttgagcagcgcggagttggtctgctcgacgaggccgcggatctcctgattgaggcggccgcgcttctcacgctggctatcgcggtcatggcgatactcaatgtaggcgcgcgccagctgcttataggggccggacatcagctggttttccaccgcggtctggatctcgttgatgtcgacctgggcgcggccctgcatttgttggctaacgacttctgcgacggtggcgcaatagtctgcgtcatcgactcccgctgctttagctgcacgcagaattgcttcctgaatgcgctctga

SEQ ID NO: 1476 - DNA, 525 bp, Klebsiella pneumoniae
acagattatccgacacgaaatccatactccagcactgatcgataccgatcaggaccggacgttgctgacgatgacatgcatgcgggggcgctttttgcgcaggttgaggccttccagacagtaaatccggtgtgttttcttgtggttaacaggccagccttcccgccgcagctgaatatgaatacgcgggcaaccgtagcggatccgggtttccgctatttaccggatacgcagggttatcgcccgatcatcccgccggctctgccagtggtaaacggttctgctctgcatcagcagtccgcatccccgtcggacactgatacggtaagccccccgcagaaaatgcaccgcctgacgtttctgagccggcctcagaacttttgtttcagtacctcctgcagcatctccttgtccagactcaggtcagccaccagtttcttcagccgcagattttcatcctccagttgccgcagacgccgcagttcggtcacgcccagaccggcgaatttcttcttccagttataa

SEQ ID NO: 1477 - DNA, 429 bp, Klebsiella pneumoniae
ttttctcatcccgtttttcatcatcatcacgtgcggtcctggcgatcgcgcgcggcgctctgtatgccgaaaatccgaaaagaggacactatgcaagcactgaaaattgccgttatcggcggcggcagcagctacacgccggagcttattgaagggattatcgttcgttacgagcagcttccggttacagagctggcgctggtagatgtcgaatccggccgggaaaaggtggagatcatcgccgcgctgacccggcggatgctgaaacataaagggctggagcaggtggcggtcagcgtccactttacgctcgatgaggccatccgcggcgccagctttgtgctgacccaactgcgtgtcggacagctggcggcgcgcgccgccgatgagcggctgggtctcaagtaccacctgctggggcccggataa

SEQ ID NO: 1478 - DNA, 774 bp, Klebsiella pneumoniae
ggcaaccatccgccgcaactactatcctacgaccgacggacgcgaagacgccattattatggctctgccaatcagtatgtaacacaaggtgatacgatgaaatgggactggattttctttgatgccgatgaaacgctgtttacgtttgattctttcagcggcttgcagcggatgtttctcgactacagcgtgacctttaccgccgaagattttcaggactatcaggccgtgaacaagccgctatgggtggattaccaaaacggcgccatcacctcgctgcagctgcagcaccagcgttttgacagctgggcggaacgtttgaatgtgccgcccggggaactcaacgacgcgtttatgaatgcgatggcggaaatctgtgccccgttgccgggcgcggtctcgctgctcaacgcgctgcagggcaaggtcagaatgggcatcatcaccaacggctttacctcgctgcagcagactcgtctggagcggacaggtttacgcgatcactttgatttgctgattatttctgaacaggtgggtgtcgccaagccggacgcgcgtattttcgattatgcgctggcgcaggcgggtaacccaccgcgctcgcgggtgctgatggtcggtgataccgccgagtcggatattcgcggcggcgtgaacgccggactggcgacctgctggctcaatgcgcatcagcgcgagctgccggcggatctcgagccggactggacggtgacctcgttaagcgaactggagcagctcctgtgtaaacactga

SEQ ID NO: 1479 - DNA, 1221 bp, Klebsiella pneumoniae
tgcccttgtccctcaccctcaaagggtgaggggcagcttatcccactgaaccatcaaggagttgctatgcctgtcgctcgtcatctgcttgtcgcttcactgtccctgtttgccgccgccgcgggcgccgcgcaaacccactatgcctgggtaggcacctataaccccaatggcgaaggtctgtatcgctttaccgtcgatgccaaaaccggcgccctgcgcgataagacgctggtgagctcgttgccgaatgtcgcgcagttaaccgtgtcgcgcgatggcaaaacgctgtatgccgccagtgaagtcgaaaaaggcgtggtgcaggcgtggcgcattgaaaagaacggcgagctgaccgcgctcaatcaggtcgcctccggcggcgccgggccggtgtatctctccctgacgccggacggtaagcatctgctggtggctaactatgtcagcggcagcaccgccgtgctaccggtgcaagaagatggtagcctggctgaggcggtggacaggcatcaggatgaaggcccggcaggcgccgaacgcccggcggcggccgtcgagggcagcttcgccatcagcgatcacaacggcccgcatgcccatatgatcgccgccgatcccagcgggaaatacgtttactctaccgatctggggctggatcggatctatcagtatcggctggatagcgccagcggcaagctaacgccgaacgatccgccgtttatcgccgcctcgtcgccgggagccggcccgcgccacttcgtctttacgccacagggcgacggcctgtggctgattaacgaggaagcgtcgacgctgaccttctatcatctggataagcaaagcggcctgctgcgtgaaggcaaaactgtctccgcgctgccggaagggtataaaggcaccagctttgccgccggacttgtgttgagcaacgatggcaaacagctatatgtcgccaaccgcctgcataacagcattgcccacttcacggtgctggccgacggcagcctgagtcaccaggaagatatctggacgcgtggcgattatccccgcaccctgacgctggataatcaggggcagtggctgtacgtcatgaaccagcgtagcgataatattacccgcttcagcgtggcgccgaaggatggcaaattaacctttgccttcgactatacgccggtcggtagcccatcgcagatggtgatatccgcccaaccctga

SEQ ID NO: 1480 - DNA, 828 bp, Klebsiella pneumoniae
ttcatgctgttagcgcacatttccgatacccatttccgcagccgcggcgagaagctgtacggttttatcgacgtcaatgccgccaacgccgacgtggtctcccagcttaacgcgctgcgcgagcgcccggacgcggtggtggtgagcggggatatcgtcaactgcggccgcccggaggagtatcaggtggcccgccagatcctcggcagcctgaactatccgctgtatctgatccccggcaaccacgacgacaaagcccattttctcgagcatcttcacccgctgtgcccgcagctgggcaacgatccgcaaaatatgcgctatgcggtggatgacttcgccacccgcttgctgtttatcgactccagtcatgccggcacgtcaaaaggctggctgaccgacgagaccatcagctggctggaggcgcaactgttcgagggcggagacaaaccggcaacgatctttatgcaccacccgccgctgccgctgggcaatgcgcagatggatccgatcgcctgcgaaaacggccaccgtctgctggcgctggtggagcgtttcccgtcgctgacgcgcatcttctgcggccacaaccacagcctgaccatgacccagtatcgccaggcgctgatctccaccattcccggcaccgtccatcaggtgccgtactgccacgaagacacccggccctattacgacctctccccggcctcgtgcctgatgcaccgtcaggtcggtgagcagtgggtgagctaccagcactcgctggcccactacgccggcccgtggctgtacgacgaaaacatcagttgcccaacggaagagcgctaa

SEQ ID NO: 1481 - DNA, 198 bp, Klebsiella pneumoniae
cgaagacgtcctgatcggccatctgtaggccgccgtgacggtgcagcaccgccagcaggatcgccagacggttctgttccagccccaccgcaacgcggcgcgggttggacatcatcgagtgatcgaccagcgcctggatctccaccagcagcgggcgggtcccttcccagaccaccatcaccgagctaccggaggtga

SEQ ID NO: 1482 - DNA, 855 bp, Klebsiella pneumoniae
tcccacccccctcagccgccactgcgcttcaggttaaagtatcggcagataccaggcgtcgtgaacaatagaggaagtatgcaggttgatcggacacagcagcgggcaatcacacgtttatgcatccagtgtggtctttttctgttacagcacggcgccgagagtgcgctggtggaggaactgtcaacacgtctcgggctggcgttggggatggacagcgttgaaagtgccatctcttcgaatgccatcgtcctgaccaccattaaaaatggcgaatgtcttacctctacgcgcaaaaatgtcgatcgcggcattaatatgcatgtggtgacggaagtgcagcacattgtgatcctcgccgagcataagctgctggactatcgcgacgtcgagaagcgttttgcgcagatcgttcccctgcgctatccgcgctggctgctggtgctgatggtgggtctttcctgcgcctgtttctgcaaactgaataacggcggttgggatggggcgctggtcagcttctgcgccagcacggtagccatgtacattcgccaggtgctgacccatcgctccatgcatccgcagatcaacttctgcatcaccgcctttgtcgccaccaccatctccgggctgctgctgcgcctcccggcgtttgccagcacgccgactattgccatggccgccagcgtcctgctgctagtcccgggttttccattaatcaatgccgtcgccgatatgtttaaagggcatatcaataccggactcgcccgctgggcgatcgccagcctgctaaccctcgccacctgtattggcgtggtgatggccatgaccgtatgggggctgcgcggatgggcataa

SEQ ID NO: 1483 - DNA, 1488 bp, Klebsiella pneumoniae
atgagcttacctgaggagaaaatagctaaacgagcactgaaagccattgaatttatttgtcgacagctctcgcgctttgcaaaaatgacacccgttgagcttatggcttacttacgaaagaatcccaaagatgccttttgtaatattccccatccgaaaggaaatggacatatccattgtggttctcttgcctggaacaagctgaatgagcttgtagacctcactatcgaattggatcacggtcttgggcgacgagtaggccgcaaactcgcaaaggaagccgtaataaatgcttttgttaaaagagtattacaggaggcacgtggagttgatcaggaaaccgcaatgctgcttcttaaagacgctttaacgattttgagagaaaagcttgtagttatcgaacattacctaccgtgtgtgcttttccctggggatacacctactgaattcagcgttggtcctgtcacattcgtccgtcgctccaagttcttcgatgataaaaaatcagtactaaaacatagtattcatgttaacacgaaggcgcatattcagtgcgtaaaggaagcgattgctcaaggtttcccacaagaacgcacgcacactaaagataaatcaagacaactagtgcgtaaattacagtcccgagcagtcaaagcctacaaagactatccatggattgcttgtgtgaaagtgagtgattgtgatgaagcaatctctaaagaacgagcgatccaagctacagagatggcgcttcacatcatccgtatcctcttgggagctaaaccgacaagggaaattaggctagcatggtcacgcagcggagctctgcgctcggcacatttgcacgctgatgtacatggtgtgattcacgcaagtctctgcgctgattctttagaaccggttggtgtaataaactggcatgaagcattgataagggcaaatttagaattagacatcctcggttctgctttgatacccatagtcaatccagtagaaactactcaccttcaccagcgccttattgacgctatcaattggttcggggacgcggttacagatccaaatatacattcgagtatagtgaaatacgtttctgcaattgagcggttgttcttcggtaaattcgaagcagggcgtacaaaattgtttgccggtcgggttagggatgtgttgaaagcattcagttgtgatgaaggggatcgtgtttattctcaagctctggaactatacaaaactcgttcgactttggtacatggagaacaatttcgtaccgaagatgaatcctttaacattattaatcttgcatcagagttaagtaggatgtgccttctatgctctgcacagctttactccatgatgctacaagcattcgaaaatcctgatagtgcaaaattagaagaaatcatgaagcgcataaacgatgaagggttgaattggctggcagaggctgcagcattaggcagtgcaaaaaactccccattcagctaa

SEQ ID NO: 1484 - DNA, 1230 bp, Klebsiella pneumoniae
cccgccataccgattttgtggtgcgcaacctgttcgacatgggcccggattacgcccgcaccctggcccactggcggcagcgttttacccacgcctggcaggatattgaaaagctcggctttgatgagcgtttccgccggatgtggctctactacttcggctactgcgaagccggatttaacgcccgcaccatcagcgtggtgcagctcaccgcggagcgggtatgacacgcccggcgcagcatctgctgatggccctcgcgttcgatgtttactggacgctggtggtgatgttgcgcgagcgcggtctgctgatctggctgatgctggccattttcgcctggctgcggttgccggcggccagtcgtccgcccgccctgctgttggccgcggcgggctgcggtctggacgcctgctgggcgctggcgggactgatcgattttcgcggcgacagcctgctgcccctgtggatggtggccctgtggctgatgttcgccgtcgtctggacccgactgacccgcaccgcgacgcttcccggctgggtgctggccacggccgccaccgtcggcggcccggtggcctacctgatcggcgctcgcctcggagccatgaccctgctggtgccgacggcgcttggcgtggccgccatggcctgcggctggctggtgctcatgctgttattccatctggggatggggaggcaaaaatgagattcgccctgttactgctgtggctgaccatcctcgccccggcggcccacgccgccgactggctgacgtggcgccgcgtcggcgaggcgaccctcacctgggggccgttcaccgtctatcactcgcagctgcgtacgcccaatggccggtatgacggcccgcagcaggatcgggcgctgatcatcacctaccggcgcgacatcgatcgcgaggcgctggtggaggccacccgcgaccagtggcaggcacagggcattctgcagcaggaaccgcgcagcgaagcctggctacgcatgctgcaggggatctggccggacgtcgcgccgggcagccagctggcgttcgtggtcagcggcggcgaggggcagttctggtaccgcgccagcgccgcgcagaccgcctttaccccgctcggcccgcgccagtcggcggcgttcagcacccgctttctcgccatctggctcgatccgcgcaccacttatcccgaactgcgtcagcagttgatcggaggtacaccatga

SEQ ID NO: 1485 - DNA, 870 bp, Klebsiella pneumoniae
ttttcatcacctcagcatagcagccttcgggagaaaagtatggagctgaccgccgttcccgccacgcagttcagcagcgtgcagttaacggatattctcaacgcctgttttgaagcctacctggtgcctgttacccagtcggtagagggatttgttcagcgttttagcgccgaggggatgagcctggtcgattcccgcgtctggctggccggagatgaaccggcggcgatcgcgatcgtcgcgcgccgggggaatgctgctcgcctggcggcctttgccctgcgcccggcctggcgcggcaaaggcctgggccggaaactgatgcaggagctgctgatgcttttgcaacagcaggggatcgagacggtattcctggaggtgatccgcgataaccatgcggccgtcgcgcagtatcagtcgctgggctttacgcgacgctatgggctctgcggctacctgagtacagaacttctggccccggtgccgggcgtattgcagctttatcccaccctgtccctgcttcggcgcgccattgaggagagtaacagccagcttccctggctgctggatccgctcacctttgccactctgccatgtcaggtcgtgacgctggaacagcgcgccttcgcggttctaacgacggcgggctcgcgccctgtactgtcgtttttgtgggtggagcccgccgcccgccgccaggggctggcgcgtgagctgctgatggcgctggcgcagcagttcccgggcattggtacttcggtgacggtcccggaaacttttacgccgctgtttgccgcggccggctatacgccgctctcgctgcagcagtatgaaatgacgatggatctggccgacgcgaagtcggcttag

SEQ ID NO: 1486 - DNA, 1347 bp, Klebsiella pneumoniae
atttggccaccctggactgcccccaccactccggtagacgattctgccctaaagtttgagtataggaggttcgactggcgcttcgtcaacatcatcacccgcgccctggtggcactgggccagcgcccggactacgcccgtatcgcccgccacgttatcaacatcgacgaactatttatcgactacgcccgcgtctttttgcccagccacgaccgccaggcatgggacaacgtggtacggattgccggtggcatcactgagaaaaacacgccacgtaatcttcagggaagggacagctacgtcgtcgcgctggagcagtacctttcaaccacccgattacacgacacgatcctcgacggtctacgtactgccgtgcgctatgacaaaacctatttcgataagatcgtcgcctcgctgctgccactgctggaaaaactgaccaccagaaaaatctcccaactgctggccccggactacggcgaccttaacgacccgcgcccggtattcaactggcagcaggccattcgccagcgggcgattatttatgtcgggctggatgcattgtctgacgcagaaattgccgccgctgtcggcaactcaatgttcgccgatctggtcagcgtcgccggacatatctacaagcacggcgtgatggatggcctgccgcagacggaagagaacccggccattaagctgcactgcgatgagttcagcgagctgatgggcgatgaatttattccgctaataaataaaggcggcggcgcaggtgtagaggttacggcctacacccagacgctctccgatatcgaagcccgcatcggcgaccgcgccaaagcggaccaggtcgtcggcaacttcaacagtcggatcatgatgcgggtgcgggaatctgccaccgccgaattgttgacgaagcaactgccgcaggtggatgtgctcagcaacagcatcagttccggcattgccgacagcgccgacgcacagggcaacatcggtttttccagcaacacccaggatcggatgagcagcatacaggtgccgttactggaacccgcctcactggtacagcttcccaaagggcaggcgttcgctctgctggaaggcggccagctctggaagctacgcatcccattaccggacgcagcacacgatccgctgatgccggaaagcatcacactcatagcccgctatatggaaaaacagtacgacagcacgcccatatggtgggaccgcccggagacagttgtaacggcgaaaaatgaccctattttagggctgaacgacagcgaaaccacggagaaacagaccgatgataccccggacacaccgccagctcgtgagcgttga

SEQ ID NO: 1487 - DNA, 1065 bp, Klebsiella pneumoniae
gctatgcgaccaacaatgatgacatatatcagtgaagagccggcctgtctggcgcagatcctgcgcgactaccggcaaaagctggcgccgattgaaaccttcgcccgccagcacccggtacggcggatattattgctcgcgaccggatcgtcgctgaatgccgcgctgtgcgcgcgctatttctttgagcaacgcttcggtgtgctgcttgacattaaagagccgtacaacttcacccattacgacgcgatcgacccgcatgccgatctggtggtggcgatttcacagagcggaaaaagcgcgtcgacgctggaggcgatgcgtaaggtacaggcttccggcaagtcggttttcgccctgacctcagatccgcaaagcccgataggaggcgccagcgatggcgttctggatattaataccgggatcgagagcgtagggtttgtgacccgcggctttagcgcgacggtgctcaacctgttgctgatagcgctgatcattgctcgtaagcaggagaaagccagcgaggtcgaggagcagcactatctcgctgaattgcagcggctggtagcggcgatcccggaggttatcgtccgcacctcgcgctttattgaccgccatagcgaaacgctgcgcagcggcgagcgctttgtcgccaccggctacggcgcgttggttggcgtggcgaaggagttcgaaaccaaatttaccgagacggtgcgcgtgccttccagcggctttgagctggaagcctatatgcatggcccctatctggaagccaatgcccgccatgtgatgctgtttattgaagatacgccggacgcgcgaacccgggcgctgcgcgactatctggcgccgtccattggccgggcctttaccctgacgctgggtgacgaagaggatgctcaaacgctggcgctaaactgtccgtgcgagcatcacctggcgcctctgctgctgattgtcccagtgcagatgctcgcctggcataccgcaggactgaaaggcatcgatctggctaaacgtattttcgacgattttgaccgcgtcttaaaaagtaaaatctga

SEQ ID NO: 1488 - DNA, 1020 bp, Klebsiella pneumoniae
ttgaagagaccggcgtcgccgcgggcgtactcaatcatccggccaacggcgtggcctggctggccaacaagctggcgccgtacgatgtccagctcgaagccgggcagattatcctcggcggctccttcacccgcccggtcccggcgcgcaagggcgataccttccacgtcgactacggcaacatgggcgccatcagctgccgctttgtttgaggagagcaacatgaacaacgcatttaaagaggcgctcaaggccgggcgtccgcaaatcggcctgtggctggggctgtgcagcagctacagcgccgaactgctggccggcgcgggcttcgactggctgctgatcgacggcgaacacgcgcccaacaatgtaccaacggtgctgacccagctgcaggccattgcgccctaccccagccagccggtggtgcgtccgtcgtggaacgatccggtgcagatcaaacagctgctggatgtcggcgcgcaaaccctgctggtgccgatggtgcagaatgccgaagaggcgcggctggcggtcagagccacccgctatccgccagccggcatccgcggcgtcggcagcgcgctggcccgcgcctcacgctggaatcgcgtcccggattatatccaccaggccaatgacgccatgtgcgtcctggtacagattgagactcgcgaagcgctgaaaaatctgccgcagatcctcgatgtcgacggggtagatggtgtgtttatcggcccggcggatctcagcgctgatatgggccacggcggcaatccgcagcacccggaagtgcaggccgccattgaagatgccatccagcaaatccgtcaggccggcaaggcgccggggatcctgatggccaatgaacagctggcgaaacgctatctcgaactgggcgcgctgttcgtcgccgtcggcgtcgataccaccctgctggcccgcggcgcagaagcgctggcggcccggtttacccacaccgcaaccaccacaaccgataacaataaatccgtctattga

SEQ ID NO: 1489 - DNA, 1158 bp, Klebsiella pneumoniae
acagaaacgttatcgttacctacccccgccgttggtggctgcctgcataacaggcggcacgatacacgtttccattttcaaagccgccggaaggcggctttggtgttttcaggacgtctttcggctgaacagtctgataaggagtccctgatgaaccatccacaaaccatcctcaccggcgaccgcccgaccggccaacttcatcttggccactacgtcggctcgctgcgccagcgcgtcgcgctgcagcataaccaccagcaatttatcctgatcgccgacctgcaagggctcacggacaacggcagcaatccgcaaaaaatcagccaccatatcctcgaagtcatggccgattatctggccgtcggcatcgacaccaggctcaccactatttgcctgcagtccgccctgccggcgctggcggagctcagcgcgctgtatatgaatatcgtcaccgtcgcccgcgtagaacgtaatccgacggtcaaaaatgagattgcccagaagggattcgcccgctcgctgccggtgggttttctcgcctatccgattagccaggcggccgatatcaccgcgttcaaggccgaactggtgccggtgggtgacgatcagctaccgatgattgagcagaccaacgagatcgtccacaagatgaatagcctcaccggcgagccggtgctgcgccactgcaaggcgctactcagcgaagtgagtcgcctgccgggcgtcgatggcaacgccaaaatgtcgaaatcgctgggcaatacgctgacgttatcggccacagaggaggagatccaccacgcggtcagcgcgatgtataccgacccgacgcacctgagagtcagcgatccggggcatgtcgagggcaacgtggtgtttacctatctcgatgcattccacagcgataaggcgcgggtggcagagatgaaaacccactatcaacgcggcgggctgggcgatcgccagtgtaagaatgagctggagacctgcttgcagacgctactggcgccgatccgcgaacgcagggccacttttattcaggataaagggatgctgctggagctgctgcgccagggcagcgaacgcgcccaccacctcacacagcagacgctgcatgaggtgaagcgcgggctggggctgccggtgctgttctga

SEQ ID NO: 1490 - DNA, 1029 bp, Klebsiella pneumoniae
tggcctatgccaggtgagggaaccatgtctgcgttttaccagaagcattttttaaagttactcgattttacgcctgcagaaatcaccgccctgctcgagctggcggcaaagctgaaagccgataagaaaaacggtatcgaagtccagaaactggcagggaaaaacatcgcgctcatcttcgaaaaagactcaacccgtacacgatgctctttcgaagttgccgcatacgatcagggtgcccgcgtcacctatctggggcccagcggcagccagattggccataaagagtcgatcaaggacaccgcccgcgtgctcggacggatgtacgacggcattcagtaccgcggccacggccaggaagtggtagagaccctggcgcaatacgccggcgtgccggtgtggaacggcctcaccaacgagttccaccccacccagctgctggcggacctgctgaccatgaaagagcatctgccgggcaaagcctttaaccagatgacgctggtctacgccggcgacgcgcgcaacaacatgggcaattcgatgctggaagccgccgccttgaccggtctggatctgcgcctggtggcgccatcggcctgctggccggaggccgcgctggtggagacctgcaccgcgctggccaaacagcagggcggcaacatcaccctgacggaagatatcgccgcgggggtgaaaggcgccgattttatctataccgacgtctgggtctcaatgggcgaggcgaaggaaaaatgggccgaacgtatcgccctgctgcgcgactatcaggttaacagcgcgatgctggcgctgaccggcaacccgcaggtcaagttcctccactgcctgccggcgttccacgacgaccagaccacgctgggcaaacagatggctgccgattacggcctgcacggcggcatggaggtgactgacgaggtgtttgagtcggcggcgagcgtggtcttcgaccaggcggaaaaccggatgcacaccatcaaagcggtgatggtggcgacgctgagcaaatag

SEQ ID NO: 1491 - DNA, 1029 bp, Klebsiella pneumoniae
cccatgatgcctcgatctctttcgcaaaccggcccggagaagcgacgcttcacctggccgaagggcaccccgcagattattgccctgctgctggttctgctggtagacagcctggtggcgccccatttttatcaggtggtgctccaggatggccgcctgtttggcagcccgatcgatattctcaaccgcgccgcgccggtggcgctgctggcgattggcatgacgctggtgatcgccaccggcggcatcgacctgtcggtaggggcggtgatggcgattgccggcgcgacggccgcctcgatgaccgtcgccgggcacagcctgccggtggtgctgttggccgcgctggccgcgggcgcgctggccggattgtggaacggcatcctcgtggcggtccttaagatccagccctttgtggcgacgctgatcctgatggtggccgggcgcggggtggcgcagttgatcaccgccgggcagatcgtcacctttgattccccggccctggcgtggctcggcagcggatcgtttctgctgtttccgacgccggtgatcgtcgccgccgctacgctgctgctgttctggctgtttacccgtaaaacggcgctgggcatgtttattgaggcggtagggatcaacatccgcgcggcgaaaaacgccggcgtcaatacccgcatcgtggtgatgctggcctatgtcctgagcggcgtctgcgcggcgatcgccgggatcatcgtggcggcggacattcgcggcgcggatgccaataacgccgggctatggcttgagctggacgccattctggcggtggtcatcggcggcgcctcgctgatgggcgggcgctttaacctgctgctctcggtggtgggggcgctgattatccagggaatgaacaccgggattttgctctccggcttcccgccggagctcaaccaggtggtgaaagcggtggtggtgctgtgcgtactgattgtccagtcgccgcgctttatcggtttactgaaaggggtacgcggccgtgataaaacgtaa

SEQ ID NO: 1492 - DNA, 2016 bp, Klebsiella pneumoniae
gtaaagccgcctgccgaaccggcaggggtttttaagcggcacgatgctgcgaaaatgcaccggaaagaggaagagcttgtggaaaaagccaaaaaaatggcgtggcatcttttggctgccagcgttggtttgttgacgttgagtcagctggcgcatgcggattcactggatgaacagcgcagccgctacgcacaaattaagcaggcgtgggataaccggcagatggatgtagtcgaccagctgatgcccacgttaagcacctatcccctgtatccctatttgcagtaccgacagatcaccgacgatctgatgaaccagccggcgctggtggtgaaaaactttattgacgccaatccgacgctgccccctgcgcgttcattacgttcgcgcttcgtgaatgaactggcccggcgcagcgactggcgcggcttgctggcgtttagcccggataagccgaccagcaccgaggcgcagtgcaactattactacgccaagctgagcgtggggcagtcgcaggaggcctggagcggggcgaaagagctgtggttgacgggcaagaatcagcccggcgcctgtgaaccgctgttcagcgcctggcgcgactccggtcagcaggatccgctggcctatctcgaacggatccgcctggcgatgaaggccggcaatatcgggctggtgaaatcgctggcccagcaaatgcccgccaactaccagagcatcgccagcgccgtggtcgccctggctaacgatccaaacagcgtcctcaccttcgcccgcaccaccggggcgacggactttacccgtcagatggccgccgtcgccttcgccagcgtcgcccgccaggacgtggaaaatgcccgcctgatgatcccttcgctggtacaggctcagcagctcaatgaggatcagacccaggaactgcgcgatattgtcgcctggcgcctgatgggtagcgatgtaaccgaagagcaggccatctggcgcgatgacgcaatcatgcgttcgcagtccacgccgctggtggagcggcgggtacggatggcgttggggacgggcgatcgccatggcctcaacacctggctggcgcgcctgccgatggaggcgaaagagaaagacgaatggcgctactggcaggcggatctgctgctggagcgcggcagggatgaggaggcgcaggcgatccttcgctcgttgatgcaacagcgaggcttctacccgatggtcgccgcgcagcgtcttggcgaggagtataccttccgcatcgataaagcctcgggcaccatcgatccggcgctggcctccgggccggagatggcgcgggtacgtgagctgatgtactggaatatggataacaccgcgcgcaccgaatgggccaacctggtcactagtcgcaccaaatcccagcaggcgcagctggcgcgctatgccttcgatcagcactggtgggatctgagcgtgcaggcgacgatcgccggtaagctgtgggatcagctggaagaacgtttcccgctggcctataacgacctgtttgcccgctatgttagcggcaaagatattccgcagagctacgcgatggcgattgcccgtcaggagagcgcctggaacccgaaagtgcgctcgccggtcggcgccagcggactgatgcagattatgccgggcaccgcgacgcataccgtcagtatgttcagcattcccggctacagcggcccgtcgcagctgttggatccggaaaccaacatcaatatcggcaccagctatctgcagtacgtttatcagcagttcggcaataaccgtatctacgcctcagcggcctataacgccgggccgggccgggtacgcagctggcaggggaatagcgccggacggatcgacgccgtggcgtttgtcgagagtattccgttttcggaaacccgcggctacgtgaagaatgtcctctcctatgacgcctactaccgctactttatggggcagcaggataagatcctcagcgatgcggagtggcgccagcgttactga

SEQ ID NO: 1493 - DNA, 237 bp, Klebsiella pneumoniae
cgctggccgccctgggcggcgcgctggagttttatgactttatcattttcgttttcttcgccgccgtcgtcggcgagctcttcttccctgcggatattcccgaatggctgcgccaggtgcaaacttttggcattttcgccgccggttacctggcgcgtccgctgggggggatcatcatggcccactttggcgatctggtggggcgcaagaaaatgttcaccctcagcatcctgctga

SEQ ID NO: 1494 - DNA, 693 bp, Klebsiella pneumoniae
tcaaaaacgccaccgcggcggctgtttaaaaggaacactatcatgtcattacctatgttacaggtcgccctggacaaccaaacgctggccagcgcttatgaaacaacccgtctgatcgccgaagaggtagatatcattgaagtcggcactatcctctgcgtcggtgaaggtgtacgcgcggtgcgcgatctgaaagcgctgtatccgcataaaatcgtgctggcggacgccaaaattgccgatgccggcaagatcctgtcgcggatgtgcttcgaagccaacgccgactgggtcacggtgatctgctgcgccgatatcaacaccgccaaaggggcgctggatgtcgccaaagagttcaacggcgatgtgcaaattgagctgaccggcttctggacctgggagcaggcgcaggcgtggcgcgaggcgggtattcagcaggtggtctatcaccgcagccgcgacgcgcaggcggcaggcgtggcgtggagtgaggcggatatcagcgcgattaagcgtctgtctgatatgggcttcaaagtgaccgtcaccggcgggctggcgctggaagacctgccgctgtttgccgggatccctgttcacgtctttattgccggacgcagcatccgcgatgctgcctcgccggtggaagcggcgcgccagtttaaacgctctatcgcccagctgtggggttaa

SEQ ID NO: 1495 - DNA, 1299 bp, Klebsiella pneumoniae
ttcctgacgcccgctctgaggctgcggattcagattatgctgctcagcgtatcgggcaatattatccagcgacatctgcccgctcataattttctgccccagctcgccctgccagccggcatagcgttttgccagaccctgatcgagcttgccatcctcaatcatgcgcgcggccagcttgagggacagcgccatcacgtccatggcgccaatatggccataaaacatgtcgtatttgtcggtgctctgccgacgaactttggcgtcaaagttcaggccgccggtggtgaatcccccggctttaaggatctcgtacatcaccagggtattttcttccacactgttcgggaactgatcggtatcccagccgagctgcgcatcgccgcggttggcatcaacggagccgaaaatgcccagcgcgatggcgctggcgatttcatggtggaaagagtgccccgccagagtggcgtggttggcttcaatgttcaccttgatctcattttccagaccaaactgcttcaggaaaccatacaccgtcgcgacatcgtaatcgtactgatgcttggtgggctcctgcggtttcggctcgataagcagcgtgccgccaaagccaatcttatgcttgtgctccaccaccatctgcaggaagcggccaatctgctcgcgctcctggcgcagatcggtattcagcagcgattcgtaaccttcgcggccgccccacagcacatagttttcgccgccgagctggtgggtggcgttcatggcggtcactacctgcgtggccgcccaggcaaatacctccgggtcggggttggtcgccgccccggcgccatagcgcgggtgggtaaagcagttggcggtgccccacagcagtttcacgccggtttgctgctgtttctccgccagcacctcggtcatgatggcgaaattatgcaaatactctttcagcgacgcgccttctggcgagacgtcgacatcgtggaagcagtaatacggtacgttgagcttgtagaaaaattcaaacgccacgtccgctttgcgtttggccatttccagcgcatcgcccgtggcctgccagggacgctcaaacgagccggcgccaaacatatccgcgccattccagcagaaattatgccagtaacaggcggcaaaacgcagatgatctgccatgcgttttcccagcacgatttcatccggattatagtggcgaaacgccagcggattatcggttttgggtccggcaaagcgaacgcgatcaacctggtcgaaataggtttgcatgatgaactccgaaattga

SEQ ID NO: 1496 - DNA, 1959 bp, Klebsiella pneumoniae
aaaaggacgcctctgatgattaagtttagcgcaacgctcctggccacgctgatcgccgccagcgtcaacgccgcgacggtcgacctgcggatcatggaaaccaccgatctgcacagcaatatgatggacttcgactattacaaagatgccgccacggagaaattcggcctggtgcgtaccgccagcctgatcgaacaggcgcgagcagaagttaaaaacagcgtgctggtggataacggggatgtgatccaggggagcccgttaggcgactatatggcggcaaaagggctcaaagagggcgatgtacatccggtatataaggcgatgaacaccctgaattacgccgtcggcaacctgggcaaccatgagttcaattacggtctcgacttcctgcacaaggcgctggccggggcgaagttcccctacgtgaacgccaatatcatcgatgccaaaaccggaaaaccgatgtttacgccgtacctgatccaggatacccgggtcgtggacagcgacggtcaaatccacaccctgcgcatcggctatatcggctttgtgccgccgcagatcatgacctgggataaagccaatcttaacggcaaggtgacggtcaatgacattaccgaaaccgcgcgcaaatatatcccggagatgcgggcgaaaggggctgatgtggtggtagtggtcgctcactccggcctctccgccgacccgtatcaggcgatggccgagaattcggtttactacttaagccaggtgcccggcgtggacgccattatgttcggccatgcccacgcggtgttcccgggtaaagacttcgccaacatcaaaggcgcggatatcgccaaagggacgctaaacggcgtaccggcggtgatgccgggaatgtggggcgatcatctcggggtggtcgatctggtgctaaataacgacagcggtaaatggcaggtaactcagagtaaagcggaagcgcggccaatctatgacgcggtggcgaagaaatcactggcggccgaagatgccaagctggtggcggtgctgaaagccgatcatgacgccactcgcgaattcgtcagcaagccgatcggcaagtccgccgacaacatgtacagctatctggcgctggtgcaggacgacccgacggtgcaggtggtcaacatggcgcagaaagcctacgtagaacactatattcagggcgacccggatctggcgaagctgccggtgctctccgccgccgcgccgtttaaagtcggtgggcgtaaaaacgatccggcgagctttgtcgaagtggagaaaggccagctcaccttccgcaatgccgccgacctctatctctaccccaacaccctggtggtgatgaaggtcagcgggaaagaggttaaggagtggctggaatgctctgccggacagtttaaccagatcgatcccgccagcagcaagccgcagtcgctgatcaactgggacggcttccgcacctacaacttcgacgtcattgacggggtgaactaccagatcgacgtcactcagccggcccgctacgacggcgaatgtcagatgatccatccgcaggcagagcgtattaagcacctgaccttcaatggaaaaccggttgatccgcaggctactttcctggtcgcgaccaataactatcgcgcttacggcggcaaattcgccggcaccggtgagagccatatcgccttcgcctcaccggatgaaaaccgttcggtgctggcggcgtggattggcgcgcaatcgaagaaggaaggcgcgatccatccggcggcggataacaactggcgtctggcgccgatccacagcaacacgccgttggatattcgttttgagacctcgcctggcgacaaagccgcggcgtttatcaaagagaaagcgcagtatccaatgcgccaggtggccaccgatgatatcggcttcgccatttatcagctggatttgagcaagtaa

SEQ ID NO: 1497 - DNA, 939 bp, Klebsiella pneumoniae
attgctgcgccgctaaggcgcagcggcaggagccctactatgaacaaagataacgtcaaactggctatcgccccgatcggctggactaacgatgatatgccggagctcggcagcgaaaacaccttccagcagatcgtcagcgaaatggcgctggccggttttaccggtagcgaagtcggcagcaaatatccgcgcgacccggcggtcctcaagccgatgctggatattcgcggcattcagatctgcaacgcctggttcagcacctttttcgccaacggccagcgggaaaaaaccattgatgaattcgtcaatcacatgaacttccttcatgcgatgggggcgaaagtgattggctgctccgagcagagcggtagcatccaggggctggataaaccgatcctcggcgatgcgaagccgtgcttcagcgaagaagagtggcagcgggtggcagaaggctacaacaccctcggccgcctggcggcggagaaggggatgcaggtctgtctgcaccaccacatgggcaccggcattcagaccaccgcggaaatcgacaaatttatgtcgctggtggacgagcgcgtcttcctgctgttcgacaccggccacgcctggtattccgaaggcggcgaagcgccgatgctggcgatcctcaaaaagtatctgccgcgcatcaaccacgttcacctgaaagacgtccgcccgcccgtgatcgaccaggtgcgccgcgacggcctgtcgttcctcgacggcgtgaaaaaaggcaccttcaccgtcccgggcgacggggtgatcgatttccgtccggtgttcaagctgctggacgactttggctataaaggctggatggtggtggaagccgagcaggatcctgctctggccaatcctttcgaatacgccgtcaaagcgcgcaaatatatccgcgaaacggcagggatctaa

SEQ ID NO: 1498 - DNA, 369 bp, Klebsiella pneumoniae
tacggtaagccccccgcagaaaatgcaccgcctgacgtttctgagccggcctcagaacttttgtttcagtacctcctgcagcatctccttgtccagactcaggtcagccaccagtttcttcagccgcagattttcatcctccagttgccgcagacgccgcagttcggtcacgcccagaccggcgaatttcttcttccagttataaaaagtggcttcagaaatgcccatctttcggcagacttccccgtcgcgggtgccggtttcggcctgtttcagagcaaacgcaatctgttcttcggtatagcgggtctttttcatggcgatgtgcctctctgtgagatggaagaaagaccggagacttcagtttag

SEQ ID NO: 1499 - DNA, 861 bp, Klebsiella pneumoniae
atttgtaggccggataagcgaagcgccatccggcaatgcaatgccacaggaatctctatgctcgataaacagacccgtaccctgattgcccagcggctgaaccaggccgaaaagcagcgtgaacagatccgcgcgatctcgctggattatccgtcgatcaccattgaggacgcctacgccgtccagcgcgagtgggtcgagatgaagatcgccgaaggccgcgtgctcaaaggccacaagatcggcctgacctctaaagcgatgcaggccagctcgcagattagcgagccggactacggcgcgctgctcgacgatatgttcttccacgacggcagcgatattcccaccgaccgctttatcgttccgcgtatcgaagtcgagctggccttcgtgctggccaaaccgctgcgcggcccgaactgtacgctgtttgatgtctacaacgccaccgactacgttatcccggcgctggagcttatcgacgcgcgctgccacaacatcgacccggaaacccagcgtccgcgcaaagtgttcgacaccatctccgacaacgccgccaacgccggggtgatcctcggcggccggccgattaaaccggacgagctcgacctgcgctggatctccgccctgctgtatcgcaacggcgtaattgaagagaccggcgtcgccgcgggcgtactcaatcatccggccaacggcgtggcctggctggccaacaagctggcgccgtacgatgtccagctcgaagccgggcagattatcctcggcggctccttcacccgcccggtcccggcgcgcaagggcgataccttccacgtcgactacggcaacatgggcgccatcagctgccgctttgtttga

SEQ ID NO: 1500 - DNA, 2874 bp, Klebsiella pneumoniae
ccagccaggcctgagccactggtgtttatcaaaccgaaatacggaaccgagaatctgatgagtgactataaatcgaccctgaatttgccggaaacagggttccctatgcgtggcgacctcgccaaacgcgaaccgggaatgctggcgcgttggaccgatgatgacctgtacggcatcattcgtgcagccaaaaaaggcaaaaaaaccttcattctgcatgatggccctccttatgcgaatggcagcattcatattggtcactcggtaaacaagattctgaaagacattatcgttaagtccaaaggactgacgggctatgactcgccttacgttccgggctgggactgccacggtctgccgatcgagctgaaagtggagcaggaatacggcaagccgggtgagaaatttaccgctgccgaattccgcgctaagtgccgcgaatatgccgccgagcagatcgatggccagcgtaaagactttatccgtctcggcgtgctgggcgactggtcgcatccgtacctgaccatggacttcaaaaccgaagccaacatcatccgcgcgctgggcaaaatcatcggtaatggccacctgcataaaggcgccaaaccggtgcactggtgcgtagactgccgttccgcgctggcggaagcggaagtggagtattacgacaaaacctctccgtctatcgatgtcgcgttccacgcggtagacaaagccgcggtactggcgaaattcggcgtagccgacgtcaacggtccggtgtcgctggttatctggaccaccacgccgtggaccctgccggccaaccgcgctatctctctgtctcctgagttcgactatgcgctggtgcaggttgacggccaggcgctgatcctggcgaaagacctggttgagagcgtaatgaagcgcgttggcgcgacggactacactattctggcggcggtacaaggttctgagcttgagctgatgcgctttaagcatccgttcctcgatttcgacgtgccggcgatccttggcgaccacgtgacgctggatgccggtaccggtgcggtgcataccgctggcggccacggtccggacgactacaccatcagccagaaatacggtctggaaatcgccaacccggttggcccggacggcgcttacctgcctggcacctggccgtccctggacggcattaatgttttcaaagccaatgacatcatcgttgagatgctgcgtgagcgtggcgcgctgttacacgttgagaaactgcagcacagctatccatgctgctggcgccacaagtcgccgatcatcttccgcgccactccgcagtggttcgtgagcatggatcagaaaggcctgcgcgcgcagtcgctgaaagagatcaaaggcgtgcagtggatcccggactggggccaggcgcgtatcgaatcgatggtcgctaaccgccctgactggtgtatctcccgtcagcgcacctggggcgtgccgatgtcgctgttcgtgcataaagaaacccatgaactgcacccgcgtacccttgaactgatggaagaagtggcaaaacgcgttgaagttgacggcatccaggcgtggtgggatctcgattcccgcgacattcttggcgatgacgccgacagctacgagaaagtgccggataccctcgacgtctggtttgactccgggtcgacccactcttccgtggttgacgtgcgtccggaattcgccggtcacgccgccgatatgtatctggaaggttctgaccagcatcgcggctggttcatgtcctcgctgatgatttccacggcgatgaaaggcaaagcgccatatcgtcaggtactgacccacggcttcaccgtcgacggtcagggccgcaaaatgtccaagtctatcggcaacaccgttagcccgcaggacgtgatgaacaagctcggcgccgatatcctgcgcctgtgggtggcttccaccgactacaccggcgaaatggcggtctctgacgagatcctcaaacgcgctgcggacagctatcgtcgtatccgtaataccgcgcgcttcctgctggcgaaccttaacggtttcgatccggcgaaagacatggttaaaccggaagagatggtggtgctggaccgctgggcggtcggctgcgcgcaggcggcacaggaagatatcctgaaagcctacgaatcctacgacttccatgaagtggtgcagcgcctgatgcgcttctgctccatcgagatgggctcgttctacctcgacatcatcaaagaccgccagtacaccgccaaggcggacagcgtggcgcgtcgcagctgtcagaccgcgctgttccatatcgtggaagcgctggtgcgctggatggcgccgatcatgtccttcaccgcagatgaaatctggggctatctgccgggcgagcgtgagaaatatgtcttcaccggcgagtggtatgaaggtctgttcggcctggccgacgacgaagcgatgaacgacgatttctgggatgagctgctgaaggtgcgtggcgaagtcaacaaggtgatcgagcaggcgcgtgcggataagaaagtcggcggctcgctggaagcggcagtcacgctgtatgctgatgccgatctggcggctaagctcaatgcgctgggcgatgaattgcgatttgtcctgttgacctccggggcgaacgtcgcagactatgcgagcgcgtccgctgatgcgcagcaaagcgaactgctcaaagggctgaaagtcgcattgagtaaagctgaaggtgagaaatgcccgcgctgctggcattacaccaccgatatcggcaaggtggcggaacacgcggaaatctgcggacgctgtgtgagcaacgtcgccggtgacggcgagcaacgtaaattcgcctga

SEQ ID NO: 1501 - DNA, 858 bp, Klebsiella pneumoniae
aaaaaagctttaaaaccagcgataaagcgtgagttggtcagctatctgaccgcgcagtttgccatgagcttacgtcaggcatgcaggatattgtcgctgagcaggacggtatttcgttatcagccggatacgcaacgtgatgagccagtcattatggcgctgaccgtggcggctgaacgctatccgcgatacggatttaaaaagctttttcaggtgctgcgcaggcagggcaaaagctggaaccataagcgcgttcaccggatttactgcctgctgaaactgaattttcgccgtaagggaaaacagcgcctgccagtgcgcaatccggttccgctggtgacgccagaggcgatgaaccagagctggtccatcgattttatgcacgatgcgctggtgtgcggcagacgcttccggaccttcaacgtggtggatgattttaaccgcgaagcactggcgatcgaaattgatctgaatatcccggcgcagcgggtcgtgagagtgctggacaggatcgtggcaaaccgcggatatccgctaaagatgcggatggataacggtccggaactggtctcgctgacgctggcacaatgggcagaagagcatggtgtgatgctggagtttatcaggcccggcaagccaacgcagaatgcctttatcgaacggttcaaccggacatacagaacagaaatactggatttttatctgttcagaacactgaatgaagcacgggaaattacagagcgctggctggctgaatataacggcgagcgcccccacgaatccctgaataacctgacgccgaaagaataccggctgatggctgaaaccccggaaatctcaaaaagtgcgtggaactaa

SEQ ID NO: 1502 - DNA, 396 bp, Klebsiella pneumoniae
atctgctttacacagctttgcgtccattcacgttctcctgtgcataataacgttcggccagccacctggcaggacgttagcaacggactgcccttgggactacgtgaaatggagctgacgatgaaacgatcttttaccctatccagcctgctgttaaccgctgcgacggccaatacgtccgcgcagtcagccgaattcgccagcgcggattgcgtcactggcctgaatgaaatcggtctgatctccgtcactaatctttccggtagccaacaggatgtagagcacgccattgcccgcaaagcagacgagcaaggcgcctcctggtatcgcattattcagatgtacgaggaacaacagccggacagctggcgcgtgcaggccattctctacgcctga

SEQ ID NO: 1503 - DNA, 303 bp, Klebsiella pneumoniae
tcattgcttacctcaaatataaaacagcatttcatttctttgttttatacccccatcaccgctgccataccagtacagtttcacgcttctttgcgctggcgcacttttcgacaggcaaacgattacctgtttgtgaatgaatcgcttgatcgtcataacggtctgcgtataatgccagtcgttttgccgggaggaagcatggccaattgcgtacgacattctgtcttagcgcgtctcaatgcagacgctggcctgccgtttttctttccgttgctcattggattcccgaagccccttatttaa

SEQ ID NO: 1504 - DNA, 846 bp, Klebsiella pneumoniae
ttaatttctactatagcgtcagctttcctactctgcagctctccatacgccagaggtgatattatgaaagtactgctgatttacgcccatccggaaccgcgctcgctcaatggcgcgctgaaaaatttcgccatccgccatctgcagcaggccgggcatgaagtgcaggtttccgatctctacgctatgcgctggaaggccggatatgacgccgacgacagcggcgcgccgccggtcggcgagttctggcggccgaccctcgattccaaacaggcctttgcccagggcacccaaagtgcggatatcgtagccgagcaggaaaaactgctgtgggccgatatagtgattttccagttcccgctatggtggttctcgatgcccgccatcatgaagggctggatcgacagggtgtacgcctggggctttgcctatggcgtcggcgagcacagcgaccgccactggggcgatcgctacggggaaggcactttcgtcggcaaacgggcgatgctgatcgtcaccgccggcggctgggcggaacactattcaccgcgcgggatcaatggccccatcgacgacatcctgttccccattcagcacggtatgctgttctatcccggctttgaggtgcttccgccgctggtgttctaccgcacggataaaaccgatgccgggcagttcgccgatcagtgcgccgccctggccgagcggctggacacgctgtggcaaaccgagcccattccattccgccggcagaatcatggcgattatctgatcccgtcgctgacgctgcgcccggagctggcgccggggcaaagcggcctggcggtgcatttgcgtagcgaataa

SEQ ID NO: 1505 - DNA, 324 bp, Klebsiella pneumoniae
tcatcacctaccggcgcgacatcgatcgcgaggcgctggtggaggccacccgcgaccagtggcaggcacagggcattctgcagcaggaaccgcgcagcgaagcctggctacgcatgctgcaggggatctggccggacgtcgcgccgggcagccagctggcgttcgtggtcagcggcggcgaggggcagttctggtaccgcgccagcgccgcgcagaccgcctttaccccgctcggcccgcgccagtcggcggcgttcagcacccgctttctcgccatctggctcgatccgcgcaccacttatcccgaactgcgtcagcagttga

SEQ ID NO: 1506 - DNA, 750 bp, Klebsiella pneumoniae
ttcatagagttaacttctcaggagaaatctttcatgacgcttcaggagcggcgacatgaccggcttgccgtcaggttgtcgttgattatcagccgcctggtgtccggtgaaactctgtttattcgcaaactggcaactgaattcggggtgtcagagcgcacgttacgtcgtgactttcgggaacgtctgatgtatctcgacctggattattaccaggggcagtgtagtctgcgctcggatattcacagtacgcggcaggaaatagatattctgacctttgctcaccgcacggggctggccggggttttcccgggctttgaccggcgactggtcagcagcctgctggactgtgatgagcgaccctgtctcgtatggcatcaggacagacctcatcccccggcaggaaagctctgcttctacaggctggtcagagctatttcgggatgtcagcgcatcaccattctgactgaaggggagcgtcatgaggccgttgcaccttaccggctaatcgctctggacggttactggtaccttgtcgctgaacataacaggcaattacgtgtcttccggctggatgagattcatctggtaaggccatcccgggaaacatttattcgcagtgagcttctccatcagctgtcggaggacaaacattttatctctgccttacctcatttccgttttattcagcagtcgctgaattcattttctccctcagaaagtcgggggcaatccggacaaactgattag

SEQ ID NO: 1507 - DNA, 1002 bp, Klebsiella pneumoniae
tacaggtatacaaaagtggatagagatcaaacaaacagcagcctgttcaatgatgatcccgtacttcatgcaacatggctgtactatcaggaaggcaaaagccagactgaagttgcagccatcatgggggtatcccgcgtcacggttgtcaaatatctgcaaacggcccgggaaaatggcctggttcacatcaacctggatgtgaatgtttttggatctatcgatgccgctttgcagatccgcgataaattcaatctccagagagtgatcatcgtgccggatggcgaacatgccggaaaacgtgatgatacaaagctgatgcggactcgtctttcacgtgccggtggcatgtatctgaatcaggtgattgagaatggtgatgtgctgggggttgcctggggaagaacaatccatcagatgagcaaaaccatgacgccgaagtcatgtaaaaatgtcaccgttatacagatgctcggctctatgccctctcagccagacctgacgattattgaatcctcatcgcaaatcgcctacaagctttcaggtcgtgtcgcttcgctgcacgttcctgccgtggtatcaagcgccagactggccatggagttacaggcagagcctattattcgatcgaattttgacgttctgactcgctgtacgaaagccttttttgtcgtgggtaacgcgcttgatgaaaatcccctgattcgggtgggcgtactgaataagaaggagatgcagacgtatcgggatttaggcgcagtaggtgtcatttgtggccgcttctatgacaaggaaggaatgcccgtcgtggctgatgttgaccagcgtattctgggaatcagtctggctcagttaaggcagattgaacggaagatcttccttgctggtggggaaagaggctatgacgcaacgttgggtgccctgctgggaggatatgtcacggacctgattgttgatgaaggaacggcagagtttttgctggcgtgtgaattaccacactaa

SEQ ID NO: 1508 - DNA, 1050 bp, Klebsiella pneumoniae
  unsure (1032): Identity of nucleotide at the above locations are unknown.
tgcatggagttcagtgtaaaaagcggtagcccggagaagcagcggagcgcctgtatcgtggtcggcgtctttgaaccacgtcgcctctcccccatcgccgaacaactcgataaaatcagcgacggctacatcagcgccctgctgcgtcgcggcgagctggaaggcaaacctggccagacgttattgctgcaccatgtgccaaacattctgtctgagcgcattctgctgattggctgcggcaaagagcgcgagctggatgagcgtcagtataagcaggtcatccagaaaaccatcaataccctgaatgataccggctcaatggaagccgtctgcttcctgaccgagctgcacgtcaaaggccgtaacaactactggaaagttcgccaggcggttgaaaccgccaaagagacgctgtacagcttcgaccagctgaagaccaacaaaagcgagccgcgtcgcccgctgcgtaaaatggtctttaacgtgccgacccgtcgcgagctgaccagcggcgaacgcgccattcagcatggcctggcgattgccgccggcatcaaagcggcgaaagatcttggcaatatgccgccgaacatctgtaacgccgcctatctggcttcccaggcgcgtcagctggccgatacctacagcaaaaacgtcatcacccgggtgatcggcgaacagcagatgcgcgagctggggatgaacgcctacctcgccgtcggcaatgggtcgcagaacgagtcgctgatgtcggtcatcgaatataaaggtaacccggctgaggacgcgcgccctatcgtgctggtcggtaaaggcctgaccttcgactccggcggtatctccatcaagcctgccgaacgcatggacgagatgaagtacgacatgtgcggcgcggcggcggtgtacggcgtgatgcggatggttgccgaactgcagctgccgctgaacgtcatcggcgtgctggcgggctgtgaaaacatgcctggcgggcgcgcctatcgttcgggtgacgtcctgaccactatgtccggncagacggtgaagtgctga

SEQ ID NO: 1509 - DNA, 1425 bp, Klebsiella pneumoniae
ggcgtagatacggttattgccgaactgctgataaacgtactgcagatagctggtgccgatattgatgttggtttccggatccaacagctgcgacgggccgctgtagccgggaatgctgaacatactgacggtatgcgtcgcggtgcccggcataatctgcatcagtccgctggcgccgaccggcgagcgcactttcgggttccaggcgctctcctgacgggcaatcgccatcgcgtagctctgcggaatatctttgccgctaacatagcgggcaaacaggtcgttataggccagcgggaaacgttcttccagctgatcccacagcttaccggcgatcgtcgcctgcacgctcagatcccaccagtgctgatcgaaggcatagcgcgccagctgcgcctgctgggatttggtgcgactagtgaccaggttggcccattcggtgcgcgcggtgttatccatattccagtacatcagctcacgtacccgcgccatctccggcccggaggccagcgccggatcgatggtgcccgaggctttatcgatgcggaaggtatactcctcgccaagacgctgcgcggcgaccatcgggtagaagcctcgctgttgcatcaacgagcgaaggatcgcctgcgcctcctcatccctgccgcgctccagcagcagatccgcctgccagtagcgccattcgtctttctctttcgcctccatcggcaggcgcgccagccaggtgttgaggccatggcgatcgcccgtccccaacgccatccgtacccgccgctccaccagcggcgtggactgcgaacgcatgattgcgtcatcgcgccagatggcctgctcttcggttacatcgctacccatcaggcgccaggcgacaatatcgcgcagttcctgggtctgatcctcattgagctgctgagcctgtaccagcgaagggatcatcaggcgggcattttccacgtcctggcgggcgacgctggcgaaggcgacggcggccatctgacgggtaaagtccgtcgccccggtggtgcgggcgaaggtgaggacgctgtttggatcgttagccagggcgaccacggcgctggcgatgctctggtagttggcgggcatttgctgggccagcgatttcaccagcccgatattgccggccttcatcgccaggcggatccgttcgagataggccagcggatcctgctgaccggagtcgcgccaggcgctgaacagcggttcacaggcgccgggctgattcttgcccgtcaaccacagctctttcgccccgctccaggcctcctgcgactgccccacgctcagcttggcgtagtaatagttgcactgcgcctcggtgctggtcggcttatccgggctaaacgccagcaagccgcgccagtcgctgcgccgggccagttcattcacgaagcgcgaacgtaa

SEQ ID NO: 1510 - DNA, 633 bp, Klebsiella pneumoniae
atgaaaggtaccatcttcgccgttgcgctcaatcatcgcagccagctcgacgcctggcgcgaggcgtttcaacaggccccctacaagacgccgccgaaaaccgcggtctggtttatcaagccacgcaataccgtaattggcgatggcgaagcgatcccgtatccgcagggcgagaccgtacaaagcggcgcaacggtggcgctgattgtcggcaaaaccgcgcgtaaagtggcggcggaagaggcggcgaactatatcgccggctacgcgctggctaacgatgtgagtctgccggaagagagtttttatcgcccggcgatcaaagccaagtgccgcgatggcttctgtcccatcggcacgctatcggcggtacgcaacgtcgacgatctgaccatcatcaccgaaattaacggccgcgaggcggatagctggcataccggcgatctgcagcgtaatgccgcgcagctgctgagcgccttgagcgagttcgccaccctcaatcccggcgacgcgatccttatcggcacgccccactctcgcgtcacgctgcgccccggcgaccgggtacgtattctcgccgatggtttcccggcgctcgaaaacccggttgtcgcagaaggagagctggcatga

SEQ ID NO: 1511 - DNA, 1581 bp, Klebsiella pneumoniae
gcgccaatcacttcggcattgccatccatacccgcggcaattttaccggtggagccttcatgcgctttcaccagacccagacgggtcaggttcggtaaattcagcgggcctttgcggccgtggtcagcctcgcctttggcgcaggcttctgcaatgtggcccagcgtatcggcgccgacgtcgccaaagcggtctgcgtcttccgttgcgccaatcccaaaggagtccagcaccatgataaatgcacgtttcatcttgttctccatacatcttgcgctgcaaaaaagcgatcagatcagtatatcgctattcagtgatacggcgatagactgtcggtgtaatttccggggctttatcgtccagtttaatggccgctttgaccgctttcgcggcctcctgccagctgttctcgtctttggcatggatcaccgccagcggacgctgtccgtcgacgcggtcacccagacgcgccatctcggtaaagccaacgctatagtcaatggtgtccgatgcctgacggcggccgccgcccatagaaaccactgccatgcccagcgcgcgagtatccatcgcgctgataaaaccttcggtatcagcatagactgctttgctcagcatcgccgtcggcagataattagcataattctcgacaaagtcgctcggccctttctgcgccgcgaccatgcggccaaagacttccgccgctttaccgttatccagcaccgcctgcagcttcgcgcgcgcctcggcatcgtccgccgccagcttgccggagatcagcatttccacacacagcgccattgtcacgtcgaacaggcgcgggttgcggtattcgccggtcaggaactgcaccgcttcgcgaacttcaacggcgttgccggcgctggaggccagtacctgattcatatcggtcagcagcgcggtggtgcgcacgccggcgccgttggcgacacccacgatcgcttcggccagcgcggcagagagttcataagtcggcataaaggcgccgctgccgactttgacgtccatcaccagcgcatccagcccttccgccagcttcttcgccagaatcgaggcggtaatcagcgggatggagtccaccgtcgcggtaatatcgcgggtggcatagaaacgtttgtcggccggggcaagggagctggtctgcccgataattgccacgccaacatctttaataatctcgcggaagcggttgtcgtccgggaagatatcgaagcccgggatcgcttccagtttgtccagcgtaccgccggtatggccgaggccgcggccggagatcatcggtacgtaaccaccgcaggcggccaccatcggccccagcatcagcgaagtgacatccccgacgccgccggtagagtgtttatcgacgatcggaccgttaaggttgaggcttttccagtccagaacggtaccggaatcccgcatcgccatggtcagcgaaacgcgctccggcatagacatatcgtggaagaagatggtcatcgccagcgcggcgatctgcctttcagagatagtattgtcgcggatgccgttgatgaaaaagcggatctcttcatcgcttaa

SEQ ID NO: 1512 - DNA, 1206 bp, Klebsiella pneumoniae
cgtcctgccacgacaaccgctgcccggcgcgaaaattcgccgggcaggattgcgttagccttcgcttttcaccactttgatctccaccatgccgatccccaactgacgcggggagtggccgaggatattgccctcgttagtggtttgcgggtccggcggggtgatgatcagcgtgttgctgcgcgttgggttgtcaaaatgcagcgtcgtggtagtcacgtcattatccagagtgagcacttgctcactttctccaactcgcaccggaatcggcttattagcgtttgggccataagctttggcggtgatcaccagatcaaatttctccggcagcggctctttatattcaatcttcacgtcgctgcccaactgagcattggaccaccgcccccacgactcgggacgcgaaataccgctgaactgtttaacctcttccggggcgccagcgacgttaaacacgaagctgtcggccttatagcgaatatcgttgtcgacaattttcagcgtatcgacgttgcccttatagcgctccatatcgataagggtgtccctgaaggcggtcttgccgtgccactgcggcttatcaacgtgctggaccttctgctcaccccccagctgtccctgcgagacgcaccagtcggtggagagcgccagctcaggcgaccacagctggcccattttatagcagcgatcgacccacacgaaattatcccgtggcgcgaaatcggccagctggaagcgcagcggcgcagagtattcactctccggcagcggttctacgcgctggtcagatacccgcagcagcagcggcaggcggaaatggctgccggagaaagcgatcatatttttttgcgagtcgatggtgaaattcttcatttctttggggaaattccacaggcggatcacgtcaggcttccatgccaggactttctctttcatattcatgaaaataccggagagcgactggccggagaggctgctacgcccgaggccgatatagttatcgccgccgagaatatccagcaccgtcgcgccgttatccatggtgttgcgtttcaccgccagggtctcctgctgcggtttatcgccgcgcaggacgaagaacagattgctgcgatcgtgcttgttgagataatcccaggcgctgttcttcatggccaggtgatcggaagagaccacgatgaccgtgtttttgaaatagggtga

SEQ ID NO: 1513 - DNA, 1290 bp, Klebsiella pneumoniae
cagcgcgccacgctcacgcagcatctcaacgatgatgtcattggctttgaaaacattaatgccgtccagggacggccaggtgccaggcaggtaagcgccgtccgggccaaccgggttggcgatttccagaccgtatttctggctgatggtgtagtcgtccggaccgtggccgccagcggtatgcaccgcaccggtaccggcatccagcgtcacgtggtcgccaaggatcgccggcacgtcgaaatcgaggaacggatgcttaaagcgcatcagctcaagctcagaaccttgtaccgccgccagaatagtgtagtccgtcgcgccaacgcgcttcattacgctctcaaccaggtctttcgccaggatcagcgcctggccgtcaacctgcaccagcgcatagtcgaactcaggagacagagagatagcgcggttggccggcagggtccacggcgtggtggtccagataaccagcgacaccggaccgttgacgtcggctacgccgaatttcgccagtaccgcggctttgtctaccgcgtggaacgcgacatcgatagacggagaggttttgtcgtaatactccacttccgcttccgccagcgcggaacggcagtctacgcaccagtgcaccggtttggcgcctttatgcaggtggccattaccgatgattttgcccagcgcgcggatgatgttggcttcggttttgaagtccatggtcaggtacggatgcgaccagtcgcccagcacgccgagacggataaagtctttacgctggccatcgatctgctcggcggcatattcgcggcacttagcgcggaattcggcagcggtaaatttctcacccggcttgccgtattcctgctccactttcagctcgatcggcagaccgtggcagtcccagcccggaacgtaaggcgagtcatagcccgtcagtcctttggacttaacgataatgtctttcagaatcttgtttaccgagtgaccaatatgaatgctgccattcgcataaggagggccatcatgcagaatgaaggtttttttgccttttttggctgcacgaatgatgccgtacaggtcatcatcggtccaacgcgccagcattcccggttcgcgtttggcgaggtcgccacgcatagggaaccctgtttccggcaaattcagggtcgatttatagtcactcatcagattctcggttccgtatttcggtttgataaacaccagtggctcaggcctggctggtcagcccaaataattcgcgggccgttaactcatcacgtgcgatttgcgccttaa

SEQ ID NO: 1514 - DNA, 1077 bp, Klebsiella pneumoniae
gctggttgcactatgtctattaataccctggcgcatgtctttaccccgcacggcaatatcgtctacacggcgaatgattttcgccagacggtgcgtatcgccgtggccgggaccattgcgctcagcatctccaccttctacgacgtacagtacggcgtatttttcgtcgtttatccgctgatgctgatgtcgctggtaccgatgttcaacctgcacgtcgcccgccagtttatatttagcgcggcggtaaactgtgtcgaaatggtgctaattgtcggctatttgtcgcagtggccggtgatcatgaccctggtggtgtttgccctgtacgtgatgcgtttccgctttatgagccagggaccgctgttcctgttgggatcaatgggggtggtgtgccagagcacgatgctcaactttatgagctatcccaccagcaactggcacaccctgatgttctccaatatggaagcctgcgtgatggccgtggcgctgagcgcgctgctgcattacctgatcccggacatcgaaccgcgcaagccgccgccgcggattgagaaagacgccgcccgcatccgtcatgagtcgctgctctccggtacggtagcgacgatcatctttgtggtgtttcagatctgcgatctcagcgactcgctgtcggcgctgatggccgggatcctgatcctgttcccgatgcactatcgtggggcggtgatcagctcgatctggcgcgtcgtcggggtggtgctggcctgtctctatatactggtggtgcagctgattatctatgatttcagcaaccacatgatcctgatgatgccgctgattggtctcgggctggccttcagcgcccgcctacacgtgatggagaaagtgggcgccggggtgggcttcgccagcatcactaccatcggcattatgttcggccagaatttgcatccgtatcaggatctggtgttcagcgatctgtaccgcatcacctcggtgacggtctcgctggtggtgacgctgaccctggtttttctcatgcaccgcctgctgaactgtttcgcggcgacgcgttttgtggtgagcgattaa

SEQ ID NO: 1515 - DNA, 1374 bp, Klebsiella pneumoniae
cggctctgcacgctctcgatctgcgcgccccagccggcctgccagccgctgtccgccagcgccgcgtcgagagcggtcatcgcttcccgggcgtccgccagcatggcaatgccgtccagcttccaggcgtcgaagttgctgacgttaatattcaggaaacgcacctccgggtgctggaaaatccatttcgaggcggtggtaaaatcgctgaagcgggtgccgacgccgatcaccaggtcggcatctgtcgcgcagcagcttctcgcccaggcagcctgtgtcgctgacgccgccgaggttcaggggatgagacgagaccacggtcccattcccggcgtggttttcggcgaagggcaccccgtagcgctcggcaaaacgggacagcggttcgcccgcgccggagtatttcacccggccgccgcagacgatcagcggtctacggctgcttttgatggccgccacggcgtccgccagctgcgcgtcgctggccgggcggcggtcgagacggtgcacgcggcgcgcaaagaaggattccgggtaatcccaggcttcgccctgcacgtcctgcggcaggcacagcgttaccgcgccggtttccgcagggtcggtcaggacgcgcatggcgttgatgcaggcgctcatcagctgttccgggcgggtaatgcggtcccagtatttgctgactgcgcggaaagcgtcattggtgctgatgctgagatcgtagctctgttcaatctgctggagcaccggatccggctggcgggtggcgaagacatcgcccggcagcagcagcagtgggatgcggttggcgctggcggtgccggcggcggtgatcatgttggccgctcccggaccgatggaggaggtgcaggcgataatctgccggcgcagggcctggcgggcaaaaccggtagccgcgtgggccatcccctgctcgttgcgcccctgatagacgcgcatatcgccgctgtcctgctccagcgcctgccccagccccaggacgttgccatggccgaaaatcgcgaaaatgcctttcacgaacttcagctctacgccatccacttccaggtactggttatcgaggaacttcaccagcgcctgcgccgttgtcagtctctgtttgcccatgatgcacaatccttattgttcagtatttgtgtgtggcgtcgcgccgatgccgccggggccgtcgttcacgtcactggaatacctgtggattataggcaaacatttttttcattaaatacaaatacagaagaaatatttcattttgcgagaaggatcaaactctctacccatttcatacgtttcacttacattccagacacgttttcgggcccttttttgccgcaccagacggcaatatccccttaa

SEQ ID NO: 1516 - DNA, 438 bp, Klebsiella pneumoniae
tccatgagcacctcgccgtccgtgattcgtcgtttcgttgagtactacgccgggctggatgcacagccgcccgcggcgctggccgcgctgtaccatccggacgccacgctgagcgatccttttggtcagcatcaggggctgttcgccattcagcgctactttacccatctgctggccaacgtggagcagtgccggttcaccatcgacacgccgctttgcgacggccagcggttcgccgtgacctggaccatgcactggtcgcatccgcgcattgccggcggagaaaccctggccctgccgggctgctcggtggtggacatcgccggggagcaggttctccatcagcgcgactactacgacgccggggagatgatctacgagcatcttcccctgctgggctgggcggtgcgcggcgtgaagcggagggtgcgctcatga

SEQ ID NO: 1517 - DNA, 195 bp, Klebsiella pneumoniae
cagaaaaggtttatagatcacagctttacaaaattatcgttcaaatcccctgacctaccgcatttaaaagcaaaaaaaacactgaatgctaaaacatcaaaaaatgctattatccgctactttaatatcaggcacctgtgtttaaggatggggacattttatggatcaagcagggattattcgcgatctccttag

SEQ ID NO: 1518 - DNA, 1410 bp, Klebsiella pneumoniae
ataaaattaacctatattgagaaactcatgacaatgataaaaaagcttccattaaccatggcggttatcgccgcgttttttccgcttacctctgtaatggcgcaagaatttactcaggaacagatcgacgccatcgtcgccaaagccgttgataaagcgctggccgaccgccaggcgaaaatcgacgccgcggccgacaaaaaggtcgacgtgatcaccaacccgcagaccaccgccgcctcgccggatatggccattccgtttggcctcaagttcagcggctacgcccgctatggcgcccacttccagaccggcgaccagaaatatgtcggcgtcgacggctcctataacggcgcctcggcgatcggccgtctgggcaacgaaagcaacggcggcgaattccagatcagcaaggccttcaaaagcgcgcagggggctatctgggatcttaacgtgatgttcgaccactggagcgacgaagttaacctgaagaaggcctacgtcggggtcaccaacgtgctggaatccaaccccaacgcctatatctgggccggccgcgacttccaccagcgtccgcaacaggggatcaacgactacttctggatgaaccacgacggccagggcgccggggtgaagaactttgatatcggcggcgtgcagttcgacgtggcggcggtgtcgcaggtgaaatcctgtagtccggaagtgatggccgacgagaccaacccgtcgcgcatcacctgtaccggcagctccgacaccggcgacaacggccactacgcgctgaccaccaaaacccacaacatcaaggccgggccgatcgacgtcgaggtgtacgccaactacggctttgactcaaaggcggtggacagcgacgcgcgtctcgaagcctggcagggcgggctggtgctgagccacaccaacgacagcggggtaaacaaggtgatcctgcgctactccgacaactcggataacagcgtctacaacaaaaccgacgccctgaccacggtctacgccagcttcgagggcagccataagttcacccagcaggcgcagatcgagtatctgctggccttccatgactacgacaacggcaaggacaacaccgacaaccgtaaaaactacggtgccatcgtccggccgatgtatttctggaacgacgtgcactccacctggctggaagcgggctaccagcgcgtggactacgaccagggcggggataaccatggctggaagctgacgctgtcgcagaacatcgccatcggcatggggccggagttccgtccgatgctgcgcttctacgtgaccggcggccaggtggataacgagcacaccgcgaaggtaaacggcacccaggaccagcagctggattcgctgaacgtcggcgggatgtttgaggcgtggttctga

SEQ ID NO: 1519 - DNA, 423 bp, Klebsiella pneumoniae
ttttgcgtaacattactcagttcatctggagataacatgagcaaaactattgcgacggaaaatgcaccagcggcgattggcccctacgttcagggcgttgacctcggcagcatgatcatcacctctggccagatcccggtcgacccgaaaaccggcagcgtcccggaagacgtgtccgcgcaggcgcgccagtcgctgaacaacgtgaaagcgatcgttgaagccgcaggcctcaccgtcggcgatatcgtcaagaccaccgtattcgtcaaagatctcaacgatttcgctaccgttaacgccacctacgaagcgttcttcaccgagcataacgccaccttcccggcgcgctcctgcgttgaagtcgcacgtctgccgaaagacgtgaagatcgagatcgaagccatcgccgtgcgtcgctga

SEQ ID NO: 1520 - DNA, 483 bp, Klebsiella pneumoniae
ttcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtaatccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtag

SEQ ID NO: 1521 - DNA, 201 bp, Klebsiella pneumoniae
  unsure (176): Identity of nucleotide at the above locations are unknown.
tctatcaaaacgattatctttcttgcaaccagcctggttatccttgtcttacattgctcgcagaaaagcccttttattacggttagttatctagctgaggcttgctacgcccattttccatgtaccccaaataacgaggtcacaaaggcgcggaaagatgaagagatgtgcacgtngcaacaaaaaaagaagcgtccttga

SEQ ID NO: 1522 - DNA, 1623 bp, Klebsiella pneumoniae
acaacaaaaacaaaacataaatttaacatcgcattccgattaatactgaagaggtcacctatgaaacctgaagatttccgcgccgacgcgaaacgcccgttaaccggtgaagagtatttaaaaagcctgcaggatggccgcgaaatttatatctacggcgagcgcgtgaaagacgtcaccacgcatccggccttccgtaatgccgcggcctccgtcgctcagctgtacgatgcgctgcacaaaccggagatgcaggattccctgtgctggggcaccgataccggcagcggcggctacacccataaattcttccgcgtggcgaaaagcgccgacgatctgcgccagcagcgcgacgccatcgccgaatggtcgcgcttaagctacggctggatgggccgcaccccagactacaaagccgccttcggctgcgcgctgggcgccaacccggcgttttacggccagttcgagcagaacgcccgcaactggtacacgcgcattcaggaaaccggcctgtactttaaccacgctatcgtcaacccgccgattgaccgccacaagccggctgatgaagtgaaggatgtctacatcaagctggaaaaagagaccgatgccgggatcatcgttagcggcgcgaaagtggtcgccaccaactcggcgctgacccactacaacatgatcggcttcggctccgcacaggtgatgggcgagaacccggacttcgcgctgatgttcgtcgcgccgatggatgccgaaggcgtcaagcttatctcccgcgcctcctatgagatggtcgccggcgcgaccggatcgccgtacgactatccgctttccagccgtttcgacgagaacgacgcgattctggtaatggataaggtgctgatcccatgggagaacgtactaatttatcgcgactttgaccgctgccgtcgctggaccatggaaggtggtttcgcccgcatgtacccgctgcaggcctgcgtgcgcctggcggtaaaactcgactttatcaccgccctgctgaaacgttctctggaatgtaccggcaccctcgaattccgtggcgtgcaggccgaccttggcgaagtggtggcgtggcgcaacatgttctgggcgttaagcgattccatgtgctcggaagcgacgccgtgggtcaacggcgcatggctgccggatcacgccgcgctgcagacctatcgcgtgatggccccgatggcctacgccaagatcaagaacatcatcgagcgcaacgtcaccagcggcctgatttatctgccatccagcgcccgcgatctgaacaacccgcagatcgaccagtatctggcgaagtacgtgcgcggctccaacggtatggaccacgttgaacgtatcaaaatcctcaaactgatgtgggacgccatcggcagcgaattcggcggccgccatgaactgtatgagatcaactactccggtagccaggatgaaattcgcctgcagtgtctgcgccaggcgcagagctccggcaatatggacaaaatgatggcgatggtcgaccgctgcctgtccgagtacgaccagaacggctggacggtgccgcatctgcacaataatgctgatatcaacatgttggataagctgctgaagtaa

SEQ ID NO: 1523 - DNA, 1407 bp, Klebsiella pneumoniae
atcgtcgaaacttctgccaccatgcgctcaatacagctacttaccctcagcgtgatatttgccttaaccggctgtctctcgctcgctccggactaccagcgccctgtcgcgccggtgccgcagcagttctctctcagccagaacaagctggttactgcgaaagtgggctatcaagagaccggctggcgcacctttttcgtcgacccgcaggtgaaaagcctgattagcaccgcgctgaccaacaaccgcgatctacggatggcgacgctgaaagtgcaggaagcccgcgcccagtaccgggtaaccgacgccgaccgctacccgcagcttaacggtgacggcagcaccacctatggcggcaagctcaaaggcgacaccaccaccagcagcgattatgccgccggcttaaacctcagctacgacctcgacttctttggccggctgaaaaaccttagcgaggccgaccgacagaacttcttcgccagcgaagaggcacggcgcgcagtgcatatcctgttgattgctaacgtttcacaaagctacttcaaccagcggctggcggcagcgcagctgcaggtggccaacgataccttacagaactatcagcagtcttacgccttcgttgaaaaacagctgctgaccgggagcaccaccgtgctggcgctggagcaggcgcgcggcatgatcgaaagcacccgcgccgatatcgccaaacgtcagggccagctggcgcaggccaataacgccctgcaactgctgctcggcagctatcaacatctgccggacgatagtgccagcagcgccgtggacctgcaaggcgtaaccctgccgccatcgctctcctcagcgatcctgctgcagcggccagatattctggaagccgaacacagcctgcaagcggccaacgccaatatcggcaccgcgcgggcggccttcttcccgtcgattaccctgaccagctcgctctctggcagcagcagcgagctctccagcctgtttaacgccggcagcgcgatgtggaacttcatccccaaaatcgaactgccgattttcaacgccgggcgtaatcaggccagcctcgatctggcggagatccgccagcagcagcaggtggtcaactatgagcaaaaaatacagtccgcctttaaagaggtggccgacgcgctggccctgcgccagagcctggccgatcaaattgccgcccaggagcgctatctcgcttcactaaatatcaccctgcagcgcgctactgcgctctatcgtcacggcgcagtcagctacatcgaagtcctgagcgcccagcgcgacatttttaccacccgacaaaccctgctggaactcaactattcccgtcaggctaatgaaatcaccctgttcaccgccctcggcggcggctggatggaataa

SEQ ID NO: 1524 - DNA, 1275 bp, Klebsiella pneumoniae
acaaggagaactgttatgacggattcaattccatcaggttacaagccgctgacatgtgacacgctgcctggttatctctcgtccagactgaccccttcatgcgaaccgggaggtttacctgatgagtggaaagtttcagaagtgggggacggaaacctgaacatggtgtttatcgttgaggggacacataaaatcatcattgtaaaacaagctctgccctggcttcgcgcacggggcgaaggatggcctttatctctgagccgtgcacgctttgagtacaacgtcttatgtcaggaagccaagtacgcgggtcatacactgattccccaagtctatttttacgacccggaaatggcactgtttgccatggagtatctgacgcctcacgtaattctgcgtaaggaactgattaacggaaaaaaattccctaagctagctgaagatattggcacgtttttagcccagactctcttcaatacgtctgacattggcatgccagcagatcagaaaaaagcgcttaccgccgagttcgcgttgaattatgagctgtgcaaaattacggaagatttgatcttcactgagccctattaccacgctgaacggaataactggacttctcctgagctggacgatgccgtccataaggcctgggctgatgtagagatgatccaggttgccatgcgttataagtacaaatttatgacagaggcgcaggcattgttacatggtgaccttcattcaggctcaatcatggtgaccgacacggataccaaagtgattgatcctgaattcggtttcatggggccaatggcgtttgatatcggcaactatataggcaatcttctgttagcgttcttctcacgtccagggtgggatgcgaatgagcaacgtcgcgctgactatcaggaatggctgcttcagcagattgtcgaaacctggttcgttttcacccgggagttccgtctgttgtgggacaacaaaacacagggcgacgcgtggccgacagaaatgtatcaacagaacagggccgctcttgaggacgcacaggctcaattttttgccacgctgcttgaagattccttggtgaatgccggcatggaaatgaatcgccggattatcggttttgctggcgttgccgagctgaaactgattgaaaatacagagcttcgcgcagaatgtgaacgacgtgcgttgaccatggcgcgcgatcttatcgtcaatgcccgccagtttaaaaatatggattccgtcatccagtctgcgaaggttaagtaa

SEQ ID NO: 1525 - DNA, 1926 bp, Klebsiella pneumoniae
ttacaaggaactgacatgcgatttcccaaccaacgcttagcgcaactcttcaccctgctgcgaaatgaaacgctgccgcaggatgagctggcgcaacgcctgtcggtttccacccgtaccgtgcgcgccgatattaccgccctgaatacgctgctggcgcagtatggcgcgcagtttatccttaaccgcggcagcggttatcagctgaagatagataatccgacgagtttccaggcgctggaggagaccgcgccgaaggcgcagcacgtgccgcgtaccgcccaggatcgcatcacgtttctgctggtgcgtttcctgacctcggcgttctctatcaagctggaagacctggcggatgagtggttcgtcagccgcgccacgctgcaaaatgacatggttgaggtgcgcgagcgcttccagcgctatcagctgactcttgaaacccgcccgcgccacggcatgaagctgttcggcagcgaggtgtcaattcgcgcctgcctgaccgacctgctgtgggagctgacccagcaaggcgatatcgcgccgccgatcggcgccgaggcctttgcggaggaggtgccagcgctgctggagccggtgctgcaggagacgctcacgcggcatcatattcgcctcaccgacgccggcgagcgctttgtctgcctgtatggcgcggtggtggtgcgccgcgtcagcgaaggctacccgctggccgatttcagcgctgaagatgtggcgcagaacgtccgcgacgccgcgcgcgagctgacgggtgagctgcagcggctggccgggaaacctttatcgcccgccgaagaagagtggctatgcgtgcatatcgcggcccgtcaggtgcaggatgtcgatccggaaactatcagcgccgacgatgatgaagcgctggtcaattacatcctgcgctacatcaacagccagtataactacaacctgctggacgacgcccagctgcatgccgatctgctgacccacattaaaaccatgatcacccgggtgcgctaccagatcatgatccccaatccgctgctggataacatcaaacagcactacccgatggcctgggatatgaccctggctgcggtctccagttgggggaaatatactccgtacaccatcagcgaaaacgaaatcggctttctggtgctgcatatcggcgtcgggctggagcgccactacaacatcggctaccagcgtcagccgcaggtgctgctggtgtgcgataccagcaatgcgatggtacggatgatcgaggcgatcatgcagcgtaaatatccgcagctggagatcgccgctaccatctcccagcgcgagtacgaacagcgggacgcgatcgaggcggatttcgttatctcaacggtgcggatcggcgaaaaagacaagccggtagtgaccatcgcgccgttccccaccgactatcagctggatcaaatcggcaagctggtgctggtggaccgtacccgtccgtggatgctgaataaatacttcgatgccgcccacttccgggtggtggataagccgatggatcagcaaacgctgttcgccgagctgtgccagcagctgctggaggaaggctttgtcgatgcggagtttcatgcttcggtggtggaacgtgaagcgatcgtcagcaccatgttgggggatggcattgcgctgccgcactccctggggctgctggcgaaaaagacggtggtttataccgttatcgccccgcagggcatcgcctggggcgacgaaaccgcccatctcatcttcctgctcgctatcagcaagcgcgagtatgaagaggcgatggcgatctacgatattttcgtgactttcctgcgcgagcgcgccatgagtcgcctcgccgcgacccgcagctttgatgagtttaaaacggtggcgatggagtgcgtcagccggttttga

SEQ ID NO: 1526 - DNA, 1227 bp, Klebsiella pneumoniae
acgctcatgaccgatcccgtctttgcgcttgaaccagatgtgccgcgcaacgtgcggctcgcgcgctggctgctctttcgtctgttgagcggcctccgcgaaggctcgctcaccgtgcgcgaaggggcgcagacttttcagtttggcgaccccgccgccgcgctgcgcgccgaggcgcgggtctgcgcgccggaggtgtactggcgtctgctgaccggcggcagcctggcggcggccgaggcctggatggacggcgactgggagagccaccagctgacggcgctgctgcagatccttgcgcgcaacggcgaggtgctggggcgtctggagcgcggctttcgtctgctgggtaagcctgtcgcccgcctgcgccactggactcgccgcaacacccgcgcccaggcgcgggagaacattgccgcccattacgacctcggcaacgaattttatgcccactttctggatgacgacctgctctactccagcgcgctgtttaccgacgacgagcaggatctgacccaggcccagcgggccaagatggcgcgtctgtgcgaccagctggcgctcaaccccggcgatcatctgctggagattggcaccggctggggggcgctggccgagtacgccgcccgccattacggttgccgggtcaccaccaccaccctttcccgggagcagcaccgctgggctaccgagcgcatggcccgcgccgggctgcaggatcgcgtcgaggtgctgctctgcgactaccgcgatctgcgcggcgagtacgacaaactggtgtcggtggagatgattgaggcggtgggccagcgctacctcccggccttcttccgcacctgccaggcgcgcctgcgcccgggcggtaaaatggccctgcaggcgatcaccattcaggatcagcgctatcgcgactacagcaaaagcgtcgattttatccagcgctacatcttcccgggcggctttttgcccagcatcacggcaatgagcgagctgatgacccgccataccgattttgtggtgcgcaacctgttcgacatgggcccggattacgcccgcaccctggcccactggcggcagcgttttacccacgcctggcaggatattgaaaagctcggctttgatgagcgtttccgccggatgtggctctactacttcggctactgcgaagccggatttaacgcccgcaccatcagcgtggtgcagctcaccgcggagcgggtatga

SEQ ID NO: 1527 - DNA, 807 bp, Klebsiella pneumoniae
tccggcatgacgccggcggagtatgaaatgactgatttaaaagcaagcagcctgcgcgcgttaaaactgatggacctgaccactctgaatgacgacgacaccaatgagaaagtcattgccctgtgtcatcaggcgaaaacgccggtgggtaacaccgcggcggtctgcatctacccgcgcttcatcccgatcgcccgtaaaacgctgaatgagcaggggacgccggatattcgcatcgccacggtcaccaacttcccgcacgggaatgacgatatcgacattgcgctggcggaaacccgcgcggcgatcgcttacggcgctgacgaagtggacgtggtcttcccgtaccgcgcgctgatcgccggcaacgagcaggtcggtttcgagctggtgaaagcctgtaaggatgcctgtgcggcggctaacgtgctgctgaaagtgatcatcgaaaccggtgagctgaaagaagaagcgctgatccgtaaagcgtctgaaatctctatcaaagccggggccgatttcatcaaaacctcgaccggtaaagtgccggtgaatgccacgccggaaagcgcgcgcatcatgatggaagtgatccgcgatatgggcgttgagaaaaccgttggcttcaaaccggcgggcggcgtgcgcagcgcggaagacgcgcagcagttcctggcgatcgctgatgaactgttcggcgccgactgggccgattctcgtcactatcgttttggcgcatccagcctgctggctagcctgttgaaagccctgggtcacggcgacggcaagagcgccagcagctactaa

SEQ ID NO: 1528 - DNA, 276 bp, Klebsiella pneumoniae
gtgctgatgacggagatggtatccgccagcgtttccccttttttgcccagtgaggtgttggcgctgtcggaaaagccgaccacgctggcgcccaggcggtgcatcgaggtttcaaaagagaggcgggtgcgggtcgaggcttcaaagaagcagctggcgataaccttatgcttcagcagctcgggttgtggattggctttcagctttgccgccgtcgccagcaccagttcgaggtcttcgcggctgagatcgtttatggaaatgatatgtttttga

SEQ ID NO: 1529 - DNA, 291 bp, Klebsiella pneumoniae
gtctggatgacctatgaactggagtttgatccacgagcctggcgcgaatggcagaagcctggcgagacggtcaaaaaacagttcaaaaataagctccagcagattgtgcagaatctgcgaattgagtcggccaggctgagcgatttaccggattgctacaaaatcaagcttaaggcgtcaggttatcggttggtgtatcaagtacgagatagtgtggtggtggtttacgttattgccattggcaaaagagagaaagcggccgtttatcatcaggcgaataaacggctctaa

SEQ ID NO: 1530 - DNA, 213 bp, Klebsiella pneumoniae
cgtcaatcgacaaggttattaaccttatcgccttcctccccgctgaaagtgctttacaacccgaaggccttcttcacacacgcggcatggctgcatcaggcttgcgcccattgtgcaatattccccactgctgcctcccgtaggagtctggaccgtgtctcagttccagtgtggctggtcatcctctcagaccagctagggatcgtcgcctag

SEQ ID NO: 1531 - DNA, 1077 bp, Klebsiella pneumoniae
aatttaacgactaataatgattcttccgatatgactgcacaaacctggcgagcacactacgcacaaaaatatcaatattccttacggctttttttactgcttaatttcatttcttcctcgctgtcgctggtcacccccctatttacggtagttcgttttacgctgccctgcgccctgatcgtcgtctgcagcgggctgctgctgctctggcactggaaatggccgcaatcgaaaataaatattcccactatctcgttgttatttggcatgctatgggcatggcacgtagtgacaaaagcgatgctattgacaccgccgcattttaactatctggtgatcgccctattaagcattctgtttatcggcaccatcgctttttccaataatatcactgcctttaccctccactctttaccaactttccttgcctgcctgataatggcggagggggaacaatggttgcgtatgacttactgctttatgctgcctatagccggtattaccctgcaaaatattatccagaagcgcagcgatgcctttacgcagggtttaatggataaactgatgcatgaacgcaatacgctcaacgatctcagtatgctcgatcccctgaccggtttgtataatcgccgcggactgcagaaccgcctcgataccctgctggcgctggacggcgacaaccactacgtgctgctcctcgatatcgatcacttcaaggcctataacgatcactatggtcatatgatgggtgaccaggcgcttattcgcgtctcagctgccattcgcaacgctgtacgctcacgcgatattgtcgcccgctttggtggagaggagtttatggtgctgctgaccaatagcagcgaagaaacggcctggaagacagccgaacgtatacgtcagcgggtctatgacctgaagatcccgcatatgtttaatgaaagcgtcgccaccaacgtcaccatcagtattggcctgacgccgctcattaatgacaacattgaacaagcgctggcgcgcgccgacggcgcactctatgaggcaaaaaataaaggccgcaacattattcttgccagttga

SEQ ID NO: 1532 - DNA, 783 bp, Klebsiella pneumoniae
acaacacagacaggtacaacaggaagaaatcacatggtagatcaggttaaagtcgctgctgtcgagcaggagccgactgaacaatcgctacggcgaaatctcacaaaccgacatattcagctgatcgcgattggcggagcgatcggcaccgggttatttatgggttctggcaaaaccatcagccttgccggaccatccattatctttgtttatatgattatcggttttatgctgtttttcgtgatgcgtgccatgggcgaattactgctgtcgaacctcgaatataaatcctttagcgacttcgcggccgatctgctggggccgtgggcgggctactttaccggctggacctactggttctgctgggtagtgaccgggatggcggacgttgtcgccatcaccgcctacgcgcagttctggtttcccggactctccgactgggtcgcctcgctggcggtgatcctgctgctgctgggcctgaacctggccaccgtcaagatgtttggcgaaatggagttctggttcgcgatgatcaaaattgtcgccatcgtggcgctgatcgtggtcggcctggtaatggtgatgatgcatttcaaatcgccgaccggggtcgaagcctctttcgcccacctgtggaatgacggcggctggttcccgaaagggctgagcggcttcttcgccggcttccagattgcggtgtttgccttcgtggggattgagctggtgggtaccaccgccgccgaaaccaaagacccgggaaaagtccctgccgcgagcgattaa

SEQ ID NO: 1533 - DNA, 246 bp, Klebsiella pneumoniae
attctggagactagccatatggcacgttatttccgtcgtcgcaagttctgccgtttcaccgcggaaggcgttcaagagatcgactataaagatatcgctacgctgaaaaactacatcaccgaaagcggtaagattgtcccgagccgtatcaccggtacccgtgcaaaataccagcgtcagctggctcgcgctatcaaacgcgctcgctacctgtccctgctgccgtacactgatcgtcatcagtaa

SEQ ID NO: 1534 - DNA, 216 bp, Klebsiella pneumoniae
tttgcagggacaggaactacggctgtgcagtgttccggctactcttttaccatgtatttcgtcactatcaaggccaccgcagatacgataatgccctggatgtttgccgcaggttactttatggccttcacatgccatatctttatcgaaaaattgatggttggggcatccttcaagaatcctgccaccgcaagcggtcttatcacccctaaataa

SEQ ID NO: 1535 - DNA, 1188 bp, Klebsiella pneumoniae
gtgatttttgctgctaacgctaacttacccatatcagactccccatttcgggatcggatggtcgcccatcgagatgcagacgtttttcatttcggcgaacacttcaaagctgtactcgccgccttcgcggccggtgccggaggccttcacgccgccgaacggctgacgcaggtcgcgcacgttctgggtgttgacgaacaccatcccggcttcaataccgcgcgccagacgcagcactttgctgacgtcctgggtccagatatacgacgccaggccgtattccacatcgttcgccaggcgcagcccttccgcttcgtctttgaacggcagcaggcaggcgaccgggccaaaaatctcttcctgggcgacgcgcatacggttgtcgacatccgccagcaccgtcgggcgcaggaagttgccggctttcagatgcgccggcaggtcggacggtttatccgcgccgccggccagcagggtggccccctcttcgatgccgaggcgaatgtagccggacactttctcccagtgctgctggctaatcagcgcgccgacctgggtgttcggatcggtcggatcgcctacgcgcaggcgattggcgcgctcggcgaagcgtttaacgaactcggggtagatactctgctgaataaagatgcgcgagccggcggtgcagcgttcgccgttgatcgagaagatggtgaacagcgcggcgtcaagcgcgcgctcgatatcggcatcttcaaaaatcagcaccggcgattttccgcccagctccatggagtactttttcagaccggcgtttttcatgatgttgcggccggtggcggtgccgccggtgaaggagacggcgcgcacatcatgatggcgcaccagcgcgtcgccggcggtggcgccgtagccctgcaccacattgagtacgccagccgggatcccggcttccagcgccagctcgcccagacgatcggcggtcagcggcgacagctcggacattttcagcaccgcggtattccccagcgccaggcacggcgccaccttccaggtggcggtcataaacggcacgttccacggcgacaccagcgcgcagacgccaaccggctgcacgagggtgtagttcagcatcttgtcgtcgaccggataggtcttgccgttcatctgctggcatacttcggcgaaaaattcgaaattgtgtga

SEQ ID NO: 1536 - DNA, 582 bp, Klebsiella pneumoniae
tggcggtttgccatggtaaaaataggttttatcgttgaaggtgatactgagtcaatcatagtgaattcaccagcgttcattgcatttctgcgcacgaataattttgaattggtaactcccgttattgatgccaaaggtggtggtaacctgttaccgaagtatgttgataatttcgttgcaaggctcagaaatgtaggcgctgaacgggtctgtattctgaccgatctggaagatgcggcatctgttgctgatgtgcgggcccgaattgcccatcaagatgtcgacatctcgtttatcgcagtcaaagcagttgaggcctggtttcttgccgattcagaggcaatgaaaaaatggcttaaagtagacacatttaatgaagagttacctgaagctacaactgaaatgccatgggatcgtttaaaagaaatttcacgtgagctaggaaagcagggtccggggagttctaaaaccgcatttgccaagagaatggtaacgcatcacggttttgatattcagagttcagccagccacccagcctgccctagcgcccatgaactggtcgactggtttgagaatcaataa

SEQ ID NO: 1537 - DNA, 756 bp, Klebsiella pneumoniae
tatttcattgctatccggaggcgctcctctaaaattgaatacccgcacaaagcgcgcgtgaaggagcctgccgtgaagattttgattgtcgaagatgagaagaaaaccggagagtacctgaccaaagggctcaccgaggccggcttcgtcgtcgacctggccgataacggcctcaacggctatcacctggcgatgaccagcgattacgatctgctgatcctcgacatcatgctgccggatgtgaacggttgggatatcgtgcgcatgctgcgcgccgccgggaaaggcatgccgatcctgctgcttaccgcgttgggcaccattgagcatcgggtgaaggggctggagctgggcgctgacgactatctggtaaaaccgttcgcctttgcggagctgctggcgcgggtgcgtactctgctgcgccgcggggcggcggtcatcgtcgaaagccagtttcaggcggccgatctcagcgtcgatttggtcagccgcaaggtgacgcgcggcgccacccgcatcaccctgaccagtaaggaattcacgctgctggagttcttcctgcgtcatcagggcgaggtgctgccgcggtcgttaattgcctcgcaggtctgggatatgaattttgacagcgacactaacgccatcgacgtggcggtgaagcggctgcgcgctaaaatcgataacgacttcgagccgaagctgatccagaccgtgcgtggggtcggttatatgcttgaggtgccggatggccgctaa

SEQ ID NO: 1538 - DNA, 2469 bp, Klebsiella pneumoniae
cgccactctgccggagatgacaacggaggaaccgatatgtcacaagatccattccaggaacgcgaagctgagaagtacgcgaaccctatcccgagccgggaatttatcctcgaacatttaactaaacgggaaaagcctgccagccgcgatgagctggccatcgagttaaatatcgagggcgaagagcaaaccgaagcgctgcgccgccgcctgcgcgcgatggagcgcgacggtcagctggtcttcacccgccgccagtgctatgccctgccggaacgcctcgatctcctcaaaggaaccgttattggccaccgcgatggctatggtttcctgcgcgttgaagggcgcaaagacgatctgtacctgtcgtcagaacagatgaaaacctgtattcacggcgaccaggtgctggctcagccgctgggcgcggaccgtaagggccgccgcgaagcgcgcatcgtccgcgtcctcgtgccgaaaaccagccagatagttggtcgttacttcaccgacgctggcgtcggctttgtcgtcccggacgacagccgcctgagctttgatatcctgatcccgccggaagagataatgggcgcgcggatgggctacgtggtcgtggtcgagctgacccagcgaccaacccgccgcaccaaagcggtgggtaagatcgtcgaagtgctgggcgacaacatgggcaccggcatggccgtcgatatggcgctgcgtacccatgaaattccgtatgtctggccgccggcggtggaaaaacaggtttccggtctcaaagaacaggtgccggaagaggcgaaggccggccgcgtcgatttacgctcgctgccgctggttaccattgacggcgaagatgcccgcgacttcgatgacgcggtgtactgcgagaagaaacgcggcggcggctggcgcctgtgggtagccattgccgatgtcagctactacgtgcgcccggggacgccgctggatgcggaagcgcgcagtcgtggcacctcggtctacttcccgtcgcaggtagtgccgatgctgccggaagtgctgtctaacggtctatgctcgctgaacccgcaggtcgatcgcctgtgtatggtgtgcgagatgacgatttcgtcaaaaggccgtctgaccggttataaattctatgaagcggtgatgagttcacatgctcgcctgacctacaccaaagtgtggcatatgctgcagggtgaccaggaactgcgcgaacactacgcgccgctggtgaagcacattgaagagctgcataacctctacaaagtgctggagagcgcccgcgaagagcgcggtggtatctcatttgaaagtgaagaagctaaattcatcttcaatgccgaacgccgtattgagcgtatcgaacagactcagcgtaacgatgcgcataagctgattgaagagtgcatgatcctggcgaacatctccgccgcgcgcttcgttgagaaggcgcaggagccggcgctgttccgtatccatgataagccaaccaccgaagcgattacctccttccgtaccgtgctggctgagctgggactggagctgcctggcggcaacaagccggagccgcgtgattacgcagagctgctaacctccatcgccgatcgcccggatgcggaaatgctgcagacgatgctcctgcgctccatgaagcaggcggtctacgatccggaaaaccgcggtcactttggcctggcgctgcagtcatacgcccacttcacctcgccgattcgtcgttacccggacctgtcgctgcaccgcgctatcaagtatctgctggccaaagagcagggacataaaggcaacagcaccgagaccggcggctggcactacagcatggaagagatgctccagctgggtcagcactgttcgatgaccgagcgccgcgccgacgaagcgacgcgcgaagtgtctgactggctgaagtgcgacttcatgcaggatcaggtgggcaacatcttctccggcgtgatcgccagcgtgaccggctttggcttcttcgtccgcctgaacgatctgtttatcgacggtctggtgcatgtttccagcctggataacgactattatcgtttcgatcaggtggggcagcgtctcattggtgagtccggcggccagacctatcgcctgggcgaccgcgtggaagtccgtgtggaagcggtcaacatggacgagcggaaaatcgactttaccctgatctccagcgagcgtgcgccgcgtaatgtcggcaagaccgcccgtgagaaagcgaaaaagagtacctctggcaagccgggcggccgtcgccgccaggtgggtaagcaggtaaacttcgagccggacagcgctttccgtaaagagaaagagaccgcccgaccgaagaaagagaaaaaagcgaaaaaaccgtcggcgaaaacacagaaaatcgccgccgcgacgaaagccaagcgcgcggcaaagaagaagatcgccgagtga

SEQ ID NO: 1539 - DNA, 912 bp, Klebsiella pneumoniae
aaaacgtctgcatctcgatgggcgaccatccgatcccgaaatggggagtctgatatgggtaagttagcgttagcagcaaaaatcactcacgtgccgtcgatgtatctgtctgagctgccggggaaaaaccacggctgccgtcagggcgcgatcgacgggcataaagaaattggcaagcgctgccgtgaaatgggcgtcgataccattatcgtgtttgatacccactggctggtcaacagcgcctaccacatcaactgcgccgaccattttcagggcgtctacaccagtaacgaactgccgcatttcattcgcgacatgacctacgactacgacggcaacccggagctgggccagcttatcgccgacgaggcggtgaagctcggggtgcgtgccaaagcgcacaatatccccagcctgaagctggagtacggcaccctggtgccgatgcgctacatgaatagcgataagcatttcaaagtggtatctatctctgctttctgtaccgttcacgactttgccgatagccgcaggctgggcgaagcgatcctcaaagccattgagaaatacgacggcaccgtggcggtgctggccagcggttcgctgtcgcaccgctttatcgacgaccagcgcgccgaagagggcatgaacagctatacccgcgagtttgaccatcagatggatgagcgggtggtgaagctgtggcgcgagggcaaattcaaagagttctgcaccatgctgccggagtatgccgactactgctacggcgaaggcaacatgcacgacacggtgatgctgctcggtctgctgggttgggataaatacgacggtaaggtggagtttatcaccgagctgttcgccagctccggtaccggccaggttaacgccgtgttcccgctgccggcgcaggcttaa

SEQ ID NO: 1540 - DNA, 261 bp, Klebsiella pneumoniae
attcaccatgctggccgagacgcccgcgagggcggcaatgatacttttcaattagggttgacgatgaactccaccatttggctggcgctggcgctggttttagtacttgaagggcttggcccgctgctttatccgcgcgcctggcgcaaaatggtcgccagcctgagccagctaccggataatttattgcgtcgttttggcggcggacttgtggttgccgggattgtgatctactacatgttgaggaaatcgattggctga

SEQ ID NO: 1541 - DNA, 510 bp, Klebsiella pneumoniae
gatgctgatgctgtggcacgagcgctggcaccgcgacccggcgcatcaatggctgcgtcagttcattgtgaattcactggaggaacagacatgctgagtggactgaatcacctgaccctggcagtcagccagctggcgccgagcgtggcgttttatcagcagctgctgggcatgacgctgcatgcccgctgggacagcggggcttatctctcctgcggcgatttgtggctgtgcctgtcgctggatccgcagcggcgcgttactccgccggaagagagcgactacacccattatgcgtttagtattagcgaagccgattttgctagcttcgccgcccgccttgaggctgccggcgtggcgatctggaagctgaaccgtagcgaaggtgcctcgcactatttcctcgatcccgatggccataagctggagctgcacgtcggcagtctcgcccagcgtctggccgcctgccgcgaacagccgtataaggggatggtgttttttgatcagtga

SEQ ID NO: 1542 - DNA, 1179 bp, Klebsiella pneumoniae
gctgacggtgctggcggcggtggtgctgggcggcaccagcctgattggcgggcgcggaactctcaccggtacgctgctgggggtgattttactggcggtgatgcagaacggcctgaacctgctaggggtctcctcctactggcagaccctgatcactggggcgatcatcgtcgtcagcatcagcgtaacggcatggagccagcatcagaaccggagcttgttatgaaaaaatcgtggcgcaacaacgttgagttttacctgatcggcctgctgctgctgatggttatcgcctttagcatcgccatgccaaacatcttctggtctgtcagcaatttccagtcgattgcctcgcaaatgccggtgctggggatcctggcgctggcgatggccatgactatgctttgcggcggcattaatttgtcaattatcgcgacggctaacgcctgctcgctggtgatggcctgggtggcgacgagctatccgcctgggggcgctaccgcgctggcgacgctgctggctggcggaggggtggcgatgatcattggcctgtgcaacgggatattgatcgccgggatccgcgtttcgccgatcctggctacccttggcatgatgaccctgctcaaagggataaatattctgatcaccggcggcagcgccatcgctaactatccgcagtgggtgctgtggctgaatcacgcccagtggttcggtattccgctgccaatgtggctttttgcggtggtggcggccgggctgtgggtgctgctggagaaaagcccgctgggtcgggcgatcatgttgatcggatccaacgaacgggcgacccattattccgggatcaatacccggcgggtgttgatgtgggtatatgtcatctcggccctgctctgcgcggtggctgcgtttctgatgatgtcgaagctgaactcagccaaagcatcttatggggaatcgtatttgctggtgtcgatcctcgcggcggtgcttggcggcgtgaatccggatggcggtagcgggcgcatcgttgggatggtgctcgcgctgttcctgctgcagattattgagagtgggttcaatatcctcggtatcagcccctatctgacgatggcgctgtggggcgtattgctgctgtgctttatccaggcgcgaggcatgctgggactggagagagccgggtaa

SEQ ID NO: 1543 - DNA, 360 bp, Klebsiella pneumoniae
cgccgcttcgccatcactgatggtcatacttttcaccggcatgcggccattttccgcaatgtattgaaacagcaggcgtaccgcctccgttggtgtcatatcgagtttctccagcacggcataagcctcttttttgagtttatcgtccagtcgaacattgagcgtggccattatgcctccggaaaggggaattttgtaatgcagtatagcattacatttgaattacactcgaatctggaaaacgcctctcaaaaccggctgacgcactccatcgccaccgttttaaactcatcaaagctgcgggtcgcggcgaggcgactcatggcgcgctcgcgcaggaaagtcacgaaaatatcgtag

SEQ ID NO: 1544 - DNA, 1077 bp, Klebsiella pneumoniae
cagccattcgcggaatggctgctatcccctctgtccacaacgattgattataactaccacaaggagttatttatgtttatcgtggaatcgtatgctgtcgccataataatgtgttttattaccatgatttgctggggttcatgggcgaatacaaccaaacttgtcagcaataaaaaatgggagttccctctattctattgggattattcaattggattattgctgtgttctttgttatttgccttcacgctgggttctatgggcgaagccggtcgcagttttatacctgatattcagcaggcgagcagcagtagtctgatgtcggcaatactggcagggattatcttcaatatttccaatatccttctggtggcttctattaatcttgccggtatggcggtagcttttcctgtgggtgtggggctggcactggctctgggtgtgatcaccacctatatcggcaatccgcagggcgatccgctcattctgttcctcggtgtcgcctgcgttgtgatcgccattatttttaccgcgatagcctatggtcgtgtcacgctggaggcggataaatctcgccgtaataaaggtctcatcactgccattctggcgggtatcatcatgggatggtttttccgcttcctggcggactccatgtctgacaatttcagccagcctgccagcggtctgatgacgccctactcagcacttgttctgtttgccgtggggctgtttttgtcgaactttgtccttaacacgctggtcatgaaaaagcctatttcaggagaaccggtcaacgggaaaatgtatttttccgggagtttacgggatcatgtttgtggctggctgggcggtatgatttggtgtgtcggtctggcattcagtctgattgcgtctggtcaggcgggttatgccatttcctacggtctgggacagggtgccacgatgattgccgtgatctggggggtcttcatctggagagaatttgccagtgcgccagtcggaaccaataaactgctgctgaccatgtttatttcatacattgtgggtattgttcttattatcgccgctaatcaataa

SEQ ID NO: 1545 - DNA, 582 bp, Klebsiella pneumoniae
aacatcctcgcttgcgctttcccctgtcgcgatgttattaacatcatcattcgtcttttttgggtaatgagtcattgtatgaatacgagcgtccccgcggcgacgttgctgcgtcgcattacggcggcagacaatgccgccatcgccagggtcatccgccaggtctcggctgaatatggcctgaccgccgataaaggctatacggtcgccgacccgaatctcgatgaactgtatgagctgtacagccagccgggctccgcctactgggtggtggagcaagaaggggaagtggttggcggcggcggcgtcgcgccgctcgcctgcagcgagccggatatctgcgagctgcagaaaatgtattttatgaccagcgcccgcggccaggggctggcgaagaagctggcgctgctggcgctggactacgcccgcgaacaagggtttaagcgctgctatctggaaaccaccgccttcctgacggaggcgatcggcttatatgaacatctcggcttcgagcacattgacggaccgctgggctgcaccggccacgtggactgcgaagtacggatgctgaaaacgctgtag

SEQ ID NO: 1546 - DNA, 270 bp, Klebsiella pneumoniae
cgtatgcccgcacttaaaaagcagcgtatagatttgagattaaccgatgatgataagagcatcatcgaggaagctgcggcaatttcgaatcagacgattacccagtttgtggttgccagtgcctcagaacgtgctgcggaagtgattgagcagcaccgcagaatggtcctcaatgagcaatcatggagcctggtgatggaggcgattacccaaccgccagccccgaatgatcgactgaaacgtgcagcgaagcgtctacaaaccaggtaa

SEQ ID NO: 1547 - DNA, 471 bp, Klebsiella pneumoniae
tgctggcccgcgaagtggtcgcacagttcggcaacctgcctgatgaagaggcctggctgctctccgtccacttcgaagtcgcgaaagataacctgtaaggagcaaaacatggaacaaatcactgtagtcattggcgaccgtctgggtaaaggccaaaaagtcgccgcaggcgccgaaaaagcgggcgcacgtgctgtggtcgtccctggcgttgcggccgacatgaagcttggcgacataatgaaagcggaaaacgccaccttcggcatctccttctgcggcagcggcggcgctggcgccatcaccgcccagaccaaatacggctacaaagcaaaatatggcatgcgctctattgatgagggcgtcaccgctatcaacgaaggctgcaacgtgctgggcttcggctttatggataaagaagagctgggcgagcggctggtagaagcctggaaaaagaaatacggcgcataa

SEQ ID NO: 1548 - DNA, 189 bp, Klebsiella pneumoniae
gccatcgccgcttcacgcgcctgcaacaaggcaatggttaatgaatcatgcatagtatcccctcaacagcctcaccaaaaacttattaataacttaataattagcgttaatcctgccatgtacaaccggtttctgcacctgaaaagtaccagtcttttcctgaaaaatattcaatctattgatttataa

SEQ ID NO: 1549 - DNA, 1080 bp, Klebsiella pneumoniae
aaggggtacgcggccgtgataaaacgtaatttaccattgatgatcacccttgcggtgtttgtgctgggctacctctactgcctgacccagttccccggttttgcctcaacgcgggtgatctgcaatatcctgacggataatgccttcctcgggatcatcgccgtgggcatgaccttcgtgatcctctccggcgggatcgatctgtcggtggggtcggtgatcgcctttaccggcgtcttcctcgccaaagcgattggcttttggggaatctcgccgctggtggcctttccgctggtgctggtgatgggctgcgccttcggcgcgtttatggggctgctgattgacgccctgaagatcccggcctttatcatcaccctcgccggcatgttcttcctgcgcggcgtgagctatctggtgtcagaggagtcgattccgattaaccacccagtgtacgacaccctgtccgggctggcatggaccattcccggcggcggtcgtctcagcgccatgggactgctgatgctgctggtggtggtggccggtatttttgtcgcccatcgcacccgctttggcaaccaggtgtatgccatcggcggcaacgccacgtcggcgaatctgatggggatttcgactcgcagcgccacgatccgtatctatatgctctccaccggactggcgacgctggctgggatcgtcttttccatttatacccaggcgggctatgcgctggcgggcgtcggcgtcgagctggatgcgattgcctcggtggtgatcggcggtacgctgctaagcggtggcgtcggtaccgtgctgggaacgctgttccggggtggcgatccaggggctgattcagacctacatcaacttcgacggtaccctcagctcatggtggacgaaaatcgccatcggcattttgctgtttatctttatcgcgctgcagcgtgggctgaccgtgctgtgggaaaatcggcagaatgcggcggtgacgcgggtgagcggggcggggagtcgctaagaaatgctcctcccgcaggcgcgggaggagcgggcagggcgcttaggcgtccgggaacgctttaa

SEQ ID NO: 1550 - DNA, 321 bp, Klebsiella pneumoniae
aggggaagcgcaatgccacgaatcgtactctgttgtgccgcaggcatgtcgaccagcatgctggtgaacaaaatgaaagcagaagcccagcagcgtgcgctggcgctggaaatctatgcggtggcggtggcggaatttgaacgcgaattgccacacgccgacgtcatcctgctcgggccgcaggttaaatatgaagccggacggctaaccgcgctggccgcgccgcagggcaaggcggtggcggtgatcgatatggctgactacggcatgatgcgcggcgctgcggtgttggataaagcgctagccctgctcgaacactaa

SEQ ID NO: 1551 - DNA, 507 bp, Klebsiella pneumoniae
gtgaagggcgcgcggctgaatgcccgcccctccgcgcacagcgtgctgtttgaaaccgccgatggcggcggcgtggtttactggcagaaactgctcctctgctgcagcgcgggcggcctgcaggcggtggcggatacgatgaaccaggccggaggcgacgtgacgaatatcattgagcaagcgccgctcccggcgctggcagcgcttcgccgacgccataaaccgcgccttccggctggcggaatctttgaaaacgcggcgacgccggagagcctgctgtgccgttgcgaagatgtgcgctgcggcgacgtggctgccgccgacgactggctgcaggccaaactgacccagcgcccgctggctgtatggctggccgctgccgcagccgagagagccgctgtcccccgcccgcgcggaaacgcttattgccctcgccaggctgagcgccgagccgtaaccgctactcttcttcatcaccgcgcccggcagggacgccaagcgcaataa

SEQ ID NO: 1552 - DNA, 1032 bp, Klebsiella pneumoniae
cgactaccagcgtcagggggaataacgatgcgtaaatctgttatcgcgatcattgtcatcgtgctggtagtgctctacatgtctgtctttgtcgtaaaggaaggcgagcgcggtatcacgctgcgtttcggtaaagttctgcgcgacgacgaaaacaagccgctggtgtatgcgccaggcctgcacttcaagatcccgtttatcgaatcggtgaagatgctggatgcgcgtattcagaccatggacaaccaggctgaccgtttcgttactaaagagaagaaagacctgatcgtcgactcctatatcaagtggcgcatcagcgacttcagccgttactacctggcaaccggcggcggcgacgtctcccaggccgaggtgctgctgaagcgtaaattctctgaccgtctgcgttctgaaattggtcgtctggatgtgaaagatatcgtcaccgactcccgtggtcgcctgaccctggaagtgcgcgatgcgctgaactcgggttcggccggtacggaagatgaggttagcaccccggcggctgacgacgcgattgctaaagcggcagagcgtgtggaagccgaaaccaacggtaaagtgcaggtgatcaacccgaacagtatggcggcgctgggtatcgaagttgtcgacgtacgtatcaaacagatcaacctgccggcagaagtgtcggaagcgatttataaccgtatgcgcgcggagcgtgaagcggttgctcgtcgccaccgttcacagggtcaggaagaggcggaaaaactgcgcgcgactgcggactatgaagtcaccaagacgctggcggaagccgagcgccagggccgtatcctgcgtggtgaaggtgatgcggaatcagcgaaactgtttgccgacgcgttcagccaggatccaggcttctactcctttatccgtagcctgcgtgcctatgagaagagcttccagagcaatcaggatgtgatggtcctgagcccggacagcgatttcttccgctatatgcgttcaccggattcggcgcgtaaataa

SEQ ID NO: 1553 - DNA, 3627 bp, Klebsiella pneumoniae
aagacgacagcaatgaatattgaacaaatttttgagaaaccgctaaaacgtaatattaacggcgtggttaaagccgagcagaccgacgacgaaagcgcctggatagaactggatgagtacgtcattactcgggagctcgatggtcacctgcgtcagttctttgaagtctatgcccctgctactggaccaggcagattacagcttgccgacaaaatgggcgtctgggtttcaggcttctttggatccggtaaatcacacttcattaagatcctttcctatctgctggcgaaccgcgaagttagccacaatggcgtcacgcgtaatgcgctctccttctttgaagagaaaattgatgatgcactgctattggccgatattcggaaatcggttcagcatccgactgatgtcgttctattcaatattgactcacgtgcgaatgttgaagatggcgtggatgccatcctcaaagtctttctgaaagtttttaacgaactggctggttattgtggggacttcccgcatattgcacacctggaacgtgagctcgataagcgtggacagtttgatacctttaaagccgcctttgcggacatcaccggctctcgttgggaagatgaacgtgatgtttatctgatgataaacgatcagatggctcaggcgctgagtgttgctacaggccagagtgaagagtcttctcgccagtggatcgagcaacttgataagaacttcccactggatatcaaaaatttctgtacgtgggtgaaagagtggctcgatagtaagggcaaccgcaacatcctgtttatggtcgatgaagtcggtcagttcattggcaaagatggccaaatgatgctgaagttacaaactattacagaagatctaggtgttatttgtggggggcgcgcatgggtaattgtgacatcccaggccgacatcaatgccgcgatcggtggtatgagtagcggagatggtcgtgacttctccaagattcaggggcgtttctcaacgcgcttacaactatccagctcgaatacctcagaagttatccagaaacgtttgctggtgaaaaccgatgccgcaattccggcgctggaagctgtctggcaggaaaaaggcgatattctgcgtaaccagttggcgtttgacacgacaacgacagctacgctgcgagcctatacaaacagccgcgagttcgtggataactatccttttgtaccgtggcattatcagatcctgcaaaaggtctttgaatccattcgtactaaaggggcggctggtaagcagttggcaatgggggaacgctctttgctggatgccttccagtcagctgcagtccagatttctgccgatggtctggatagtctggtaccgttttggcgtttctactcatcgattgaaagcttcctggaacctgcagttagccgcactattattcaggcctgccagtctccgtcactgacggaatttgatggcaaattgctgaaaacgctgttcctgatccgctacgtcgatgtgctgaaaagtactctcgacaatctcgtcacgctctctattgagcgtattgatactgataaagtggaactccgtcgacagattgaagccagtctcaatcgtctgcaggctgagatgctgatctcgcgtattgatgacaaatttgtttttctcactaacgaagaaaaagagattgaaaacgaaatccgcaatattgacgtggaattcaccaccatcaataagcagctctcaacgatcattttcgaagagatcctgaaaaacaaaagatatcgctatccggccaataagcaggattttgatatcagtcgtttttgtaacggacatccgctggatggtgcgaatcttaacgatctggtggttaaggtgctcacgccactggactcgaactacgagagctataagggtgcgcattctaatagtctgctgatgacggacagtaaggactgcatcttaatttgtctgcctgatgaggctcgtacctggcaagacctgaccatgtacgcgcagaccaaagccttccttagcaagcaaagcggacagcgtccggaacaggcaactctgttggcagaaaaaggccgtgaaaatggcatgcgcgaaaaaacgctgaaggcgcagattgaaggcttgctggctcaagctgatgtctgggcgctgggcgaacggctggataagaaatcctcttcgccgttagctatcgtggatgcagcctgcggttacgttatcgagaacagtttctccaaactaaaattgctgcgtcttagtaccggagacgtaaatcgtgaaactcacgcgctgttgacagtagaaaatgatacccagctcgatctcggggatatggaagaatccaacccagaggcgatgcgtgaagtggataactggatcagtatgagtattgagactcataagccagtttacctgcgggacatcctcaccacttttggccgtcgcccatttggctggccggaagatgaggtcaaattgctggttgctcggctggcgcgcagcggaaaatacagcttcactctgcaaggcagtgaaatcgcactgaagcaggcgtgggacgcgtttaataattcacgtcgttatagcgatttgcgtttgcataaagtacgtcgccatgacgaagcgcagctgactaaagccgcgcaactgatggctgatattgctggagaaccgtttaacgagcgtgaggagcagccgctggtctctcatattcgcgaactctttggccgctggaagagcgaactgaccgtttttaaaactcgtgcagagagtggacaaaaccctggccgtaaggagatagaagaaggcctggtattgctgaacgggatccttaacgagaaagaggaatacgcggtcattgaaaaaatcaccgcagcggctgacgatcttaaagatttctcggaagactgggacgatttggtcagcttctacaagaaccaatacgccacatggcagcgcttgagtatagcgttgaatggcagtttcaaagctaaccgtaacgcgctggataaagacgaaacggcccaaaaggctttgcaggagttggaagctatctacagcaaggcacgaccttacggagagctgcaccggattattccgctgattgaaaccgttgaaaccatcaaccagcgtctggtggaagaataccgaagccatgcgctgcagcagatagataaccatatcaatgagctgaagcaaagcatgcaggagatgcacgtccctgctgacttgcagcactcgcttttacacccgatgcagcaatcgcgtaagaaagtggagcagaacggcctgatcccacagattatggaagaacaggctgaggttcgggcgctacaattcaaagcaaacgaacgactgaacggctgggttgaagaacagcgtaagaaagtgcctgaaccaaaaactgtccctcagccagggattatcgatccagtagctaagcctgaacccaagctgaaaaagaccatctacgtgaacacgcgtaaaacgatggaacgagctgcgggtgtgacaacgctggataacgccgaacaggtagacaaagcgctggaacaactccgtaaaacgctaatggatgctattaacgcaggcgaacgcgttcagcttcagtaa

SEQ ID NO: 1554 - DNA, 915 bp, Klebsiella pneumoniae
cggcccgcagcaggatcgggcgctgatcatcacctaccggcgcgacatcgatcgcgaggcgctggtggaggccacccgcgaccagtggcaggcacagggcattctgcagcaggaaccgcgcagcgaagcctggctacgcatgctgcaggggatctggccggacgtcgcgccgggcagccagctggcgttcgtggtcagcggcggcgaggggcagttctggtaccgcgccagcgccgcgcagaccgcctttaccccgctcggcccgcgccagtcggcggcgttcagcacccgctttctcgccatctggctcgatccgcgcaccacttatcccgaactgcgtcagcagttgatcggaggtacaccatgaaacgcattctgacccttggcctggcgctgctgatgctgatcctcgccggctgcagcaccgaggtcacggagtaccggcagcagcagcccgccctcgacatctttcactattttcaagggcgaaccgaggcgtgggggatggtgcaggatcgcagcggcaagcagctgcgccgcttccatgttgagatcgatggcgacgtcgtcggcgacaccctgaccctccatgagcgctttgtctatgacgacggcgagaagcagcagcgggtatggcgcattcgccgcaccggcgataaccgttatcagggcaccgccggggatatcgaaggggtggccagcggccaggcggcaggcaatgcctttcactggcgctacagcatgaacgtcgaggccagcggcagccggtggctgctgcactttgacgactggatgttcctgcaggatggcagccatttatttaacaaaaccgagatgaagaaattcggcattacggtcgccaccgtgacccttttctttacccgaaccacagcagaagagaggacagcgccatga

SEQ ID NO: 1555 - DNA, 939 bp, Klebsiella pneumoniae
tgccgcgcagctgctgagcgccttgagcgagttcgccaccctcaatcccggcgacgcgatccttatcggcacgccccactctcgcgtcacgctgcgccccggcgaccgggtacgtattctcgccgatggtttcccggcgctcgaaaacccggttgtcgcagaaggagagctggcatgaaacaggcacgcattgaatggcaaggacaggtacgcgacgtgctggtcaatgaacgcgaccaggtgcgcctggacgatggcacggtattaaaagaaggtgaattccgctggctgcagcccgccgacggcacgctgttcgcgctggggctgaattacgccgatcacgccagcgagctggaatttaaaccgccaaccgagccgttggtattcatcaaagcgccgaacacctttactggccaccagcagcagtcggtacgcccggataacgtcgaatacatgcactacgaagccgaactggtggtggtgattgggaaaaccgcgcgccgcgtcagcgaagccgaggctatggattatgtcgccggctataccgtgtgcaatgactacgcgatccgcgactatctggaaaactactaccgcccgaacctgcgggtgaaaagccgcgacaccctgacgccgatcggcccgtggatcgtcagcaaagaggcgatcccggatccgcataatctggccctgcgcacctgggtcaacggcgagctgcgccagcagggcaccaccgccgatctgatcttcagcatcccgttcctcatcgcttatttaagcgaatttatgaccctgcaaccgggcgacatgatcgccaccggcacgccgaaagggctatccgatgtggtgccgggcgacgaggtgatcgttgaagtcgagggcgtgggccgcctggtcaaccatatcatcagccagcaagcgtatgaggagacactgtcatga

SEQ ID NO: 1556 - DNA, 1224 bp, Klebsiella pneumoniae
aaaaaggcagccagtggctgccttttttacgtgggtcatccgaaaacgcgtccctcactgccagccgtagcggcggctgtagaagcccttcacggcctgggtcagcaccatatagcccgccaggatcgctaccagccatgggaagtagctcagcggcagggcctgcagctgcaggtagctagccagcggcgagaacggcagcgcgatacccaccgccatcaccaccagggtcatggcgaacagcggccaggcggcccggctctgaacgaacggaatgcgccgggtgcggatcatgtgcacaatcagcgtttgcgacagcagcccttcgataaaccagccggactggaacagggtctgcatctccacggtattggcgtggaacacccaccacatcaggccgaaggtgaggatatcgaaaatcgagctgatcggtccgaagaagaccataaagcgcccgagatcggccgggttccagcgctgcggcttgcggatctgctcatcatcgacgttatcaaacgggatcgccacctgggagacatcgtacagcaggttctgaatcaacaggtgcagcggcagcatcggcagaaacggcaggaaggcgctggccaccagcacgctgaagacgttgccgaagttggagctggcggtcattttgatgtacttgagcatgttggcgaaggtgcggcggccttcgattaccccctcctccagcaccatcaggctcttctccagcagaatgatatccgccgcctcgcgggcgatatccaccgcgccgtcgaccgagatgccgatatccgccgcgcgcagcgccggggcgtcgttgatgccgtcgcccataaagcccaccacgtgaccttcgcgtttcagcagcgtcacgatacgctctttatgcagcggcgccaggcgggcgaacagcgtggtgcgtttggccagcgccgccagttcgtcgtcgctcatggcttcgatctggctgccaatcaccacttcgccagcatccagtcccacttcatggcacaccttcgccgccaccagctcgctgtcgccggtgaggatcttcaccgtgatgccgctggccttcagcgccttcagcgccggggcggtggtctctttcggcggatcgaggaaggcgatgtaaccttcaaggatcaggtccgactcatcggcgcgctggtagtcgccttcgcgggccggcaggtatttggtcgccaccgccaccacccgtag

SEQ ID NO: 1557 - DNA, 1257 bp, Klebsiella pneumoniae
aatcacaaagccccaggagctgacggtcgccgccgcgtggacggtgacttctttcaactgcgctgcgatcatcgccgcgttttcaccgcccatttcatgcaggttcggcatgacgatgcccaggcctgccggcggggtgttcatcgcgaaataaaggcccggttcgataatcgaggcggcgaccagcgccatgactgcaacaaaggattccatcagcatcgcgccgtagccaataaagcgggcatcggtttcgttggccagcagcttcggcgtggtgccggaggcgatcagcgcgtggaagccggagaccgcgccgcaggcgatggtgataaacaggaacgggaacagcgcgcctttccacagcgggccggtaccatcaatgtactgggtcaccgccggcattttcaggtccggattgaggataacgatccccagcgccaggccgacgatcacgccgattttcaggaaggtggccagataatcgcgcggcgccagaatcagccataccggcagcagggcggaaataaacgcgtagccaatcagggtaaaggtgatggtggtgtctttaaaggtcagcgccgggccccagtacgggtcgtgggcaatcacgccgccgaaccagatagaggccaccagcagcacgataccgataaccgacacttcaccgacgcggcctgggcgcaggaagcgcatgtagatccccataaacagggcgataggcaccgtcgagcagacggtaaagacaccccacgggctttccgccagcgctttcaccacgatgagcgccagcaccgcgaggatgatgatcataatcaggaagcagccgaacagggcgatagagcccggaaccggccccatctcctgtttaatcatctcgcccagcgaggcgccgttacgccgcgaggagataaacagcaccatgaagtcctgtaccgcgcccgccagcaccacgccggccagcagccacagggtgcccggcagatagcccatctgcgcggccagtaccgggccgaccagcgggccagcgccggcgatcgcggcaaagtggtggccaaacagcacgtagcggttggttggcacatagttcaggccatcgttattaatgaccgccggcgtggagcgcgtcgggtcaagcttcatcaccttctgcgcgatgtacaggctgtaataacggtaggcgacgaggtacacagaaaccgatgcgacgacgatccacagggcactgacgtgctcaccgcggcgcagggcgacgactga

SEQ ID NO: 1558 - DNA, 255 bp, Klebsiella pneumoniae
agtgaaaaagcgaggaaagccttgcggatactggatttcaggcacaaaaaaagacgtccgttgacgtctattgatgttccgatggtgccgaaggccggactcgaaccggcacgtatttctacggttgattttgaatcaactgcgtctaccgatttcgccacttcggcactgaaggggatgcggaaacgttctggattatacctgtcggcggcggtcatgcaagcgacagcgtgtcgtcattgcgctaagtgttga

SEQ ID NO: 1559 - DNA, 1254 bp, Klebsiella pneumoniae
ataaaggaagcgagggttaccatgataacgtcaaataaaaattactttatcagctgtctgtttttcctgttcttctttataggttggggatgctgctacccttatttatccctgtggttgacggaaaccatcggtattaactacacagacgtcggtctggtttattctttcaccgccattgtcgccgtctgcgttcagccattattcggcttcatctccgataaactggtgtatcgtaagaatctgatgtggatgctggcgattattatcacgttattcgccccttactggatttatgtctttgctcccctgttaaaaataaatgtgttcctcggcgcgctggctggcggcctttatattggcatggcctacggcgccggctgcgggatttgcgaagcctacattgataaagtcagccgcgcctccggcttcgaatttggtcgggcgcggatgttcggcggcatcggcgctgcgatcggtacctttgcggcaggaaaactctacggcattgatcagaatatgattttctggttggccagcggcgcaggcgtctgcctgctggtcattgtctggaaaatgcagatcagcgcccacccgcagcagggattgctgtctggcaaagcctcgccggttaccctccgcgatgccgtctcgctgttaaaaattaaaaaattctggttcttcgccctctatgtcattggcgtcggggcggtctatgaaacctatgaccagcagttcgctatctactacagccatttttttgagagtaaagcccggggtgcagaagtcttcggttatttaaccacgggtcagattttccttgatgccatcgtgatgttctttgcgccatggtttgtgaataaaatcggcccgaaaaatgcgctgttatactgcgggctgattatgagcttgcgtattatcggctccgcgtgggctattggccccgtctccatcagtctgattaaactcctccacggttttgaaagctcggtgctacttgtcgcggcgttaaaatatattacggctaactttaatcctctgctgtcagcgaccgtttacttaattggcttccaattttcgaaaagctttagctctatttttctctcgaccggtatcggccatatgtaccagagcatgggctttaccagtagctatatcgtactcggcggtatcgctctgtgcttcacgcttatttcttttattacgctggataaagcgcgtgtcttctcttcacaaccggtgcccgcgaattaa

SEQ ID NO: 1560 - DNA, 984 bp, Klebsiella pneumoniae
atgtctctggcaccccggaaaccgggattttacattccgctacgaaaacatatttccccggactgcaagcgtgacatcctttttcgacgcggtacgcaaatccaggcgggcgacagcctcggcgcagcatgctataaacggcttatccccgcagcaaaggccaaagcagtgaaccatacccgagatattccccaaaccttctggcgagacgatcgtctgccgtggctagagctgcgcagcacctggcgcagccgccaggcctataagcgccacagccacccccagctttccgtaggggcgattatcgagggggaaacgcgctgcctgtgcgctggccaggagtacctgctgcaacccggggatctgatcgtgatcccgccgcacgcgccgcatagctgtaatccgctgcatggcaggccgcgcagctatcacatgctttacctggacgcgacatggtgccacgcgcagcgcccggatattccccctggcgccagtatcacctcgccgcagccgctgctgcgcgacagccctctctttgccagtttccagcaggttgtcgccctgatgagccgcgggagccttgaacaactgcccgcccggctggcgcaactcctgcacgcgctgccgctgtgcgccgccgcgccgcaggcgccacatcacgccagcgccctgctgtttcagtgcctggcgatggatctgccggcgtcgccgtcgctggataagctggcccacgacagcgcgcttcgtaaagagaccgttatccgcgccgtgaaacaagataccggcctgacgcctgccagtttgatcaacatggcgcgcatcgaatatgcgaaaacgcgcttacgcgccggggatcctatcgccgacgtcggctatcaggccggctttgccgatcagagccatttccataaaacctttgtcagctataccgccgccacgccgcggcagtatgcgcaaagcagatcaatatctgacaataagtaa

SEQ ID NO: 1561 - DNA, 1134 bp, Klebsiella pneumoniae
ggacgaatggctattggtcattttttatttaggggtgataagaccgcttgcggtggcaggattcttgaaggatgccccaaccatcaatttttcgataaagatatggcatgtgaaggccataaagtaacctgcggcaaacatccagggcattatcgtatctgcggtggccttgatagtgacgaaatacatggtaaaagagtagccggaacactgcacagccgtagttcctgtccctgcaaatcacgttttattccttccatcgatgacacttatgaattttctacaggggcagcgaaagccgacacagcccaatctcaagtcgtcgaatttcccgttctcccccgcccgatttatgatccccaagctgataatgtgactgacacctgcaagtcagaagataacccgctgctgaacggcgtttatatctggactgaaacgacaagtgcaggtcatgttttcgtttcagtgcatgagaataacaatatcttcctctacacctatggacgctatggacgcactgataaaagtaccttcactggggatgggattttagactttttccaagatgaagatgcgcgtaagtattaccgatacgaactttatgaaatgggagctcgcgctttccgcattgatgatgcagatcctaaaataatccgtaaattcttcgaaaatctttggaatggcggtgtaacaccaattcaaacgccaaacatgcaagatggtacaaagcgaagaggccgaaccattgataagtatgatgtcactggtagcaactgtaccactcactcagtcgaggggctcaagtttgctggctcaaaggtattcgaacacggttacacatccacgacaacacagctaccaatcgacatagaagaagattttactattccggtttcactgcaaagatatcttgaatcaaagagtgcggatttctcatcaatcctcgttgtcgaaatgactaatacattcaaacagcagtaccctaacaccgagaacaaaagccctcaatcaataggagggagtgcaaaaattcaacaatctgctgccgattccgctgctgttgctggctcaacatccccctactcaggcggtacagtaggcggttcattgggaagcacttacgatgatgaataa

SEQ ID NO: 1562 - DNA, 1350 bp, Klebsiella pneumoniae
tgctcttcggcctggggattatctggcgatttttgcacgacctcgccgtcaggctatatgcttaagcatatggaaaaactcgctgaactgaaacgcgccaaactgctggcgctgtcgctgctgctgattgcagccgccatttttatcactaccctcgcgctaccaccgtcgccctgggtcggtgcgctaaaagctatttccgaagcggcgatggtcggggcgctggccgactggtttgcggtcgtggctctgtttcgccgtattccgctgccctttgtcgcccgccatacggcgattattccgcgcaataaagaccgcatcgccgacaacctcggccgctttgtcgaggaaaagttccttgataccccgtcgctggtcgcgctgatccgccgctatcagccagccctgatgctcggcaactggttcagccagccggagaacgcccgacgggtcggccagcacctgctgcaggtgatgagcggttttctcgaactgaccgatgacgcgcgcattcaacgtctgctgcgacgcgcggtgcataaggctatcgataaggtcgacctgacgcagaccagcgccatgatgctggagggactgacccgcgacaatcgccatcaaaagctgctcgattcgctgataaaccaactgatcgccctgctgcagcgcgacagctcccgcgcctttatcgcccgcggcatcgtacactggctggagaccgaacacccgctgaaggccaaactcctacccaccgagtggctcggcgagcacagcgctgagatggtcaccgacgcggtgaataccctgctggacgaggtgactcacgaccgtacgcatcagatccgtcagacttttgaccgcgccgtgcaaaagcttatcgataacctgaaatccgacccggatatggcgcagaaggccgataacatcaaagcgtggctaaaaaatgatgagacctttaaccactatcttggcgaagtatggggcgacctgcgcggctgggtaaaaaacgatatcagcagcgacgactcacgtattaagcagcgcatcgccgaggcggggcagtggttcggtgaaaccttactccgcgacgacgcgctgcgcgaatcgcttaacgaacacctggagcaggcggcgcaccgggtggcgccggagttcgccgccttcctcacccgccatatcagcgacacagtgaagagctgggacgcccgcgatatgtcgcggcagatcgagctcaatatcggtaaagatctgcagttcatccgcatcaacggtaccctggtggggggaaccatcggcctgttgttgtggctgctctcgcagatcccctcgctgttgcatctgcatattggttag

SEQ ID NO: 1563 - DNA, 489 bp, Klebsiella pneumoniae
cgccgcccggctttgcatttaaatccacaacaagaagccccatatatgaaaaacgcaacgttctatcttctggacaatgacgccaccgtcgacggcctgagcgccgtcgagcagctggtgtgtgacattgccgcagaacgttggcgcaacggcaagcgcgtcctgatcgcctgcgaagatgaacagcaggcgattcgtctcgacgaggcgctgtggtcgcggccgccggagagctttgtgccgcataatctggcgggcgaaggcccgagaggcggcgcgccggtagagattgcctggccgcaaaagcgcaacagcagcccgcgggatattcttatcagcctgcggctaaactttgcagattttgccaccgctttcacagaagtgatagactttgtcccttacgaagacaatctgaaacaactggcgcgcgaacgctataaggcgtaccgcatggctggtttcaacctgaacacggcaacctggaaataa

SEQ ID NO: 1564 - DNA, 633 bp, Klebsiella pneumoniae
gtgctgccggctatcgcgcccactggcaaagcagctggttcgccaacgatatggggagctatttcaaggatgatatggagatcccgtggtcgcgattgcgggccttcaagtgccgatgtgaagtcctctgctgaccagtaccagttaaccgatcgggcgacaaaatatgccatcgtgttaatcgggctgacctttatggcttttttcgtgttcgagagcctgacccgtcgtcccctgcatccgatgcaatatctgctggtgggcttatcgctggtgctgttttacctggtgctgctggcgctctcagagcacattggttttaccgccgcctggctggcggccagcctgtctggcgcggtgatgaatgggatataccttcaggcagtgctcagaggatggcgtaacagcctgctgtttgtcgccgcgctactgctgctggatggcgtgatgtggtttctgttgcattctgaggatagcgcgctgctgctgggtaccggggtgctggcgctggcgctgagcgtcctgatgtttttgacccgtcgcgtggactggtatgcgttatcgctgccgaaaggcacagtgcctccgacaccggctgccgatgacgataagctgcgtctctggaaagagtga

SEQ ID NO: 1565 - DNA, 1362 bp, Klebsiella pneumoniae
cgtgctgcggctgcacctggcgagaaatctcgctcaccatcgccgactggtttggatcgcctgcccccagcccgacggagagcgcattatcgatcagcttcgcgtagtcgcgcatatcggccaccgcgctggcgacgtccggatagtttttggagagcacgccgaccaggacgtgaccttccgccgcgtcgtaaatttcacgggcgttgtctttgctgcccgccaggacgttcaggcacacgcggtcacggtaaaagtttggggtcagtttcatgcttgtttctccttattcagaacttctgcgatgcggcgagcgaccacctccagctgctgggcgtttacgctgcggacatcggcttcgataatgccttcattcgctttatagccgcggaagtagatggcgtattcaccctgcttcagcgcgttaaccagatcgccggtcttcacgccggtcgtgacttcatcaaatttaatttcggcgcgggcgatatcgcggcccgcgctgtcccacaccacccgcgcggtcacgccgttgagagtattgagctgttcgataaacggcgtcatcttgtccaccatctgctgaccgctctctttgctcgccgtcaggtagtgttcaatggcgcaggtcaggccgagaatgccctctttacccactttcatcgcccggccaatgcccatcgactggcgcttaacccactcgacgtactgcgttttgccgatcaccagcccgctggtcggcccttcaatcgctttcgcgccgctgtagataaccaggtcggcgcccatgcggtagtagcactgcagatcttcttccgccgccgcatcgacgatcagcggtacgttatgctggcgcgccacttccgcggcctgcgcgacgttgagcatgcttttctgcacgcagtggtgggatttgatgtacagaatcgccgcggtgcgcggagtgatcgccgccgccagctgctgggcagaacattcgttggcgtagcccgcttccaccagcttaccgccgcccaacgccaccatggtgccaaccggcgcgccgaagttgacgttgtggcccttcggcaacacgatttcgttattttcaatcggcgtaacgtgcaggttctccagcagccagtcgctgtctttcaccagcaccgccgctaccgactgggcaatccccgccgacgcgcaggagacaacggtcgccccttccacatccaacagtttggcgatgtactcgccggttttattcaccaggtctttcatttcaaagtactggttcataccggccatcgcggcttcaaccacttccgggcgcggcgtggaaacgcccagcgccgtcatgcggccagaagtattaatcacctgttttaa

SEQ ID NO: 1566 - DNA, 453 bp, Klebsiella pneumoniae
atcgacgcggccggccttcgcctcttccggcacctgttctttgagaccggaaacctgtttttccaccgccggcggccagacatacggaatttcatgggtacgcagcgccatatcgacggccatgccggtgcccatgttgtcgcccagcacttcgacgatcttacccaccgctttggtgcggcgggttggtcgctgggtcagctcgaccacgaccacgtagcccatccgcgcgcccattatctcttccggcgggatcaggatatcaaagctcaggcggctgtcgtccgggacgacaaagccgacgccagcgtcggtgaagtaacgaccaactatctggctggttttcggcacgaggacgcggacgatgcgcgcttcgcggcggcccttacggtccgcgcccagcggctgagccagcacctggtcgccgtgaatacaggttttcatctgttctga

SEQ ID NO: 1567 - DNA, 1113 bp, Klebsiella pneumoniae
acctcggcggcgtcagcgacacaggctgcctgggcgagaagctgctgcgcgacagatgccgacctggtgatcggcgtcggcacccgcttcagcgattttaccaccgcctcgaaatggattttccagcacccggaggtgcgtttcctgaatattaacgtcagcaacttcgacgcctggaagctggacggcattgccatgctggcggacgcccgggaagcgatgaccgctctcgacgcggcgctggcggacagcggctggcaggccggctggggcgcgcagatcgagagcgtgcagagccgtcagttaaaagagacccagcgcgtctaccaggcggtgtggcaggagaaatcctttgtgccggagatcgacgatcatctcgatcgtgaatcggtgtatcgcgagttccgccagatcaccgactccaccctgacccagagcagcgttcttggggtactgaatgaaacgctgccggccgaggcggtgatcgtcgcggcggcgggcagcctgccaggcgatctgcagcgcgtctggcgcaaccgcgcggaaaacacctaccacgtggagtacggctactcctgcatgggatacgaagtcaacgccgcgctgggcgtgaagctggcgcagccgcagagcgaagtctactccctggtcggcgatggctcgttcatgatgctgcactctgagctggtcacctccctgcaggagcgggcgaagatcaacgtcgtgctgttcgacaacatggccaacggctgcatcaacaacctgcagatggagcacgggatggacagcttcggcaccgagttccgctaccgtcagccggaaaccggccagctgcagggcggcctggtgccggtggacttcgccaccatcgccgccggctacggctgcaaaacctggcgcgtcactaccctggacgaactgcgccatgcgctggacgccgcccgtcgcgaaacggtcagcaccctgattgatattaaagtgctaccgaagaccatggtgcacaaatacggcagctggtggaacgttggggtcgcccagacggcgctctctgagcggatccgcaaggtggcgcaaatgattaatgaaaagcgcgcccaggcgcgtgattactaa

SEQ ID NO: 1568 - DNA, 492 bp, Klebsiella pneumoniae
tgccgccgggcaccgggtgacctaaacaagcgagcaatttgcatgtctaaatccgtacagagcaacagcgcggtactggtgcacttcactctgaaactggacgacggctccactgccgagtccacccgcagcaacggcaaaccggcgctgtttcgcctcggcgacacctctttgtctgaagggctggagcaacagcttctcggtttgaaagagggggagaaaaaggccttttcgctggagcctgacgccgcctttggcgtacccagcccggacctgattcagtatttctctcgccgcgagtttatcgacgctggcgagccggagatcggcgcgattatgctctttaccgcaatggatggcagcgaaatgcctggcgtgatccgcgaagtgaacggcgattccatcaccgttgacttcaaccatccgctggccgggcgcactgttcattttgatattgaagtgctggagatcgatccggcgctggaggagtaa

SEQ ID NO: 1569 - DNA, 2508 bp, Klebsiella pneumoniae
acagtgcgggctttttttttgacaagagatcaaggggtaagaaccatgcgagtgttgaagttcggcggtacatcagtggcaaatgcggaacggtttctgcgggttgccgatattctggagagtaatgccaggcaggggcaggtagcgacggtcctgtctgccccggcgaagatcactaaccacctggtagcgatgattgaaaagaccattggcggccaggatgccctccccaatattgccgacgccgaacgcatttttgccgaacttcttcagggccttgccgacgcccagcccgctttcccgcttgcccagttaaaagccttcgtggagcaggaatttgctcagattaagcatgttctgcacggcatcagcctgctgggtcagtgcccggacagcgtcaatgccgcgctgatctgccgcggcgaaaagctctccatcgccatcatggcgggtctgctggaagctcgtggacataaagtcagtgtcattaacccggtcgaaaaactgcttgccgtgggccactatctggaatccaccgtcgatatcgccgaatccacccgccgcattgccgccagccagatcccggcagaccatatgatcctgatggccgggtttaccgccggcaatgagaaaggcgagctggtggtgctggggcgtaacggctccgactactcggctgcggtactggccgcctgcctgcgcgctgactgctgcgaaatctggaccgatgtcgacggagtgtacacctgcgatccgcgtcaggtgccggatgcgcgcctgctgaaatcgatgtcttatcaggaggcgatggagctctcctactttggcgcgaaagtgctgcacccgcgcaccattgcccctatcgcccagttccaaatcccatgcctgattaaaaataccggcaacccgcaggcgccgggaacgcttatcggcgccagccgcgacgaggacgatttgccggtgaaaggcatctctaacctcaacaacatggcgatgttcaacgtctccgggccggggatgaaagggatggtcggcatggcggcccgcgtcttcgccaccatgtcccgcgccggcatctcggtggtgttgatcactcaatcttcttcggagtacagcatcagtttctgcgtgccgcagagcgactgcgcacgtgccaaacgggcgatggaagatgagttttatctggagctgaaagaggggctgctggagccgctggcgattatggagcgtctggcgatcatctccgtggtgggcgacggaatgcgtaccctgcgcggtatctcggcgaaattctttgcggcgctggcccgcgccaatatcaatatcgtggcgattgcccagggctcttccgagcgctcaatttcggtagtggtcagcaatgacgacgccaccaccggcgtgcgcgtgacccatcagatgctgttcaacaccgaccaggtgattgaagtgtttgtcatcggcgtcggcggcgtcggcggcgcgctgctagagcagatcaagcgccagcaggggtggctgaagaacaaacatatcgatctgcgcgtctgcggtgtagccaattctcaggcgctgctgaccagcgtgcatggcctgaatctggaaaactggagtgcggaactggcggaggcgaaagagccgtttaagcttggccgcctgatccgcctggtgaaagagtaccacctgctcaatccggtgatcgtcgactgtacctccagccaggcggtcgccgatcagtatgccgacttcctgcgcgaaggtttccatgtggtgacgccgaacaaaaaggccaatacctcttcgctggattactatcaccagctgcgccatgcggccagcagctcgcggcgtaagttcctctatgacactaacgttggcgcgggcctgccggtgattgagaacctgcagaacctgctcaacgccggcgatgagctgcgccatttctccgggatcctgtccggctccctgtcgtttatcttcggcaagctggacgagggggtgagtttctccgcggcgacggcgatggcccgtgagatggggtataccgagccggatccgcgcgacgatttatccggggtggatgtggcgcgtaaactgctgattctggcccgtgagaccgggcgtgaactggagctggcggacattatcgtcgagtcggcgctgccgccggacttcgacgccagcggcgatgtcgagacctttatggcccgcctgccgtcgctggacgatggttttgcctcgcgggttgctaaggcgcgcgatgaaggtaaagtcttgcgctacgtcggtaacatcgaagaggatggtacctgccgggtaaaaatagccgcggttgacggcaacgatccgctgttcaaagttaagaatggtgagaacgcgctggctttttatagccattattatcagccattgccgctggtgctgcgcggctatggcgccgggaacgacgtcacggcggccggcgtattcgccgacctgctgcgcaccctgtcctggaagttaggagtttaa

SEQ ID NO: 1570 - DNA, 3705 bp, Klebsiella pneumoniae
tttccccattttcagggcagatgttgtctgcccttttcaggacttcacatgaatacgtcaaatatcaaaaaatacgccccagtggcacgtaaacagttccgcgatgcggtcatgcaaaaactgaccacgctgggtattgaggccgataaaaagggaaacctgcaaattgctcaagcaaccgatcttggcgacagcgtgcgttatggtcagttctcgttggataaatcactggcttcacgccgtgagcgtctggtcaaacgagcagaaaagcagggctacgacgtgctggtggaacacattgcttacacctggtttaaccgcttctgcgctattcgctatatggagctgcatggctatcttgatcacggtttccgtatgctgtctcacccgacgctggaaggtggttttgaggttctggaccatgtgcctgaagtggctgatgcacttgggctggacaaagcgcgtttggtggagatgaagctggcgggcgatcgtgacgaagagctgtatcgcgaactgctgctggcccagtgtcatgcgctgcacggtgcaatgcctttcctgttcgaagcagtcaatgatgaaattgagctggtactgccggataacctgacccgtaccgactctattctgcgtgggctggtggacaccattcctgacgaagactgggaacaggtcgaagtgatcggctggctgtatcagttttatatttccgagaaaaaagatgatgtgatcggcaaggtggtgaagagcgaagatattccagccgccactcagctgtttaccccgaactggattgtgcagtacctggtgcagaactcggtgggtcgccaatggctgcaaatctacccggactccagcctgaaaggcaaaatgccgtactacattgagcctgcggagcaaacgccagaagtgcaggcgcagctggctgccatcactccatccagcattgaacctgaaagtatcaaggtgctggacccggcctgcggctccggccatatcctgaccgaagcctataacgtgctgaaagcgatttacgaagaacgcggctaccgtacccgtgatattccgcagctgattctggaaaacaatattttcggtctggacatcgacgaccgtgccgcacagctctccggttttgcaatgttgatgctggcccgacaggatgatcgccgcattctgagtccaggccgtggcgttcgtctgaatattgtttccctgcaggaaagtaagctggatattgctgaggtttggaccaagctgaacttccatcagcaggtgcaacgcggcagcatgggagatatgtttacccaagggacggcactggccaataccgacagcgcggaatataaactgctgatgcgcacgttagcgttgttcactagtgcaaaaacgctgggatcactgattcaggtaccgcaggaagatgaagcggcgttgaaagcgtttctggatggattgtatcgtctggctattgagggcgatattcagcagaaggaagcagcgacggagctgatcccatatatccagcaggcgtggatacttgcgcagcgctatgatgcagttgtggcgaacccgccgtatatgggtgggaaagggatgaatggcgagctaaaagagtttgctgaaataaacttctctaaagctaaatccgacctattttcgttgttcattgaaagaagtatttctttctgccatcaaaactctattttatcaatgatcacaccttatgtgtggatgtttattggttcattcgaggatttaaggaaagaaattttacgacgtcattcaataagcacattaatacaattagagtataatgctttcgcaccagcatgtatccctgttgcagcattcacattaacacaagattcacttagagaatataaaggcacatttataaaacttagtgatttcaaaggagtggatagccaatcccctaaggtcttggaggctgttggtagagaaaaatgttcctggaaatatatcgcttccaacagtttatttgatactctgccagggaatccattgctttactgggtaagccaagaactttccaaaacatttaactataataatggttttgaaaagcttggtgagttatgttcacctaggaaaggaatggctactggtgataataataaattcgtacgatactggaatgaagtcgactttagtcgctcaagtctaaatattgataatgagtattcttgggtgccttacaataacggtggtgaatataggaagtggtacggaaatatcgatcgatttatatattggaaagatgatggctttgccataaaaaatttcaaagatgaaaatggaaagctgcgttctcgcccacaagggttagatcttaaatttaaagaaatgttaagctggacttcattaagttcaacctatttaggagttagatattatcctaatggatttatcagcgatcaaaatggtaattttttagtacctaacaatcgtttcgagaatgatatttattttattcttggctggctttgcagttcaacagctaatagaattgtaaaaatgctcaaccctacaatgcatatattggttagtaatatttcaaatcttccaattcccatggacgaagttactatcaaagaggtttgtgatataacaaggcgttgcattgatatatctaagactgattgggataaatatgaatcttcatggggctttatacgtcctgcaataatcacttcacagattgatttgaaatctgctgttttacttgaaatcaaaaactgcaaatccatggtcaatgagctagagagactggaacagcgaaacaatgatatcttcgcattgaagtttggggtttctgatttattaggttatgagctaacttccgacgatataacattgaatgtaaaggaagtaatgttatcaactgaaattttcagttcaaaactcattacggaattgctttcatacatcgttggcactcaaatgggccgctactccctcgatcgcgaaggcttggtttatgcccatgaaggcaacaaaggtttttctgaccttgttgaagaaggtgcctacaaaaccttccctgccgatgaagacggcatactgccattaatggattccaactggttcgatgacgatgtcacagcccgtgtaaaagagtttgtgcgcacggtctggggtgaagaacatctgcaggaaaacctcgactttatcgctgaaagcctctgcttgtatgcaatcaagccgaaaaaaggcgaatcttcgctggataccatccgtcgctatctttccacccagttctggaaagatcatctaaaaatgtacaaaaaacgccctatttactggttgttcagctccggtaaagagaaagcgtttgagtgcctggtgtacctgcaccgttataatgaaggcacactgtcgcgtatgcgtaccgaatacgtggttccgctgcttgcgcgataccaaggcaatatcgatctggttaacgatcagcttaagaatgctgaatccggcgctgccactacccgtctgaaaaaagagctggatgggttgagcaaaaaattcaatgagctgcgcagttttgacgaccgcttgcgtcactatgctgatagacgtatcactattgatctggacgacggcgttaaggttaactacggcaaatttggcgatctgctggccgatgtcaaggccatcactggcagtgctccacaggaggaataa

SEQ ID NO: 1571 - DNA, 672 bp, Klebsiella pneumoniae
gctgcaaattttcaaaggtggaatatggttcgcgcaaaactgaaattccggctgcatcgtgcggtcattgttcttatctgtctcgccctgctcgtcgcgctgatgcagggcgcttcgtggttcagtcagaacagtcagaaacaacgcaatccgcagctggaagagctggcccgcacgctggcgcagcaggtggtgctgaatctcgcgccgctgatgcgcagcgagacgcctgacgagaagcgcatcaatcagctgttgacccagctaacccataacagccgcgtcctggacgccggggtatatgacgaacagggcgacctggtggcgcgctctggcgaaagcgtcgaggttcgcgaccggctggcgctggatggcaaaaaagccggcggctacttcaaccagcagattgtcgaaccggtgccaggaaaaaacggcccgctgggctacctgcgtctgaccctcgatactcataccctggcgaccgaggcgaagcaggtggataataccaccaatatcttacgcctgatgctgttactgtccctggctatcggcgtggtgctgacccgcacgctgctgcagggcaaacgcacccgctggcagcaatcgcccttcctgctcaccgccaacaagccggttgaggatgaagacgatgaaaagaaaggaaatctataa

SEQ ID NO: 1572 - DNA, 699 bp, Klebsiella pneumoniae
aatacatcttatattcctgatgacgaggtaactgctatggctttccgtgaccaacctttaggcgagctggcgctgaccatcccgcgcgcctccgccctgttccgtcaatacgatatggattactgctgcggcggcaaacagaccctggcgcgcgccgcatcgcgcaaagcgctggatgtcgcggtgattgaagccgagctggcgaaactggccgaacagcctctctcccgcgactggcgcgcggcgcccctcgcggagattatcgaccatatcatcgttcgctatcacgaccggcaccgtgaacagctgccggagctgatcctgcaggccaccaaggttgaacgcgtccatgccgataaaccgaacgtgccgaaaggactgactaagtacctgaccatgctgcatcaggagctttccagccacatgatgaaagaggaacagatcctgttcccgatgatcaaacagggaatgggcgcccaggccggggggccgatcagcgtgatggaaagcgagcatgatgaagcgggtgaactgctggaagtcattaagcacatcacccacaacgtgacgccgccgccggaagcctgtaccacctggaaggcgatgtataacggtatcaacgagatgatcgacgatctgatggaacacatcagcctggaaaataatgtgctgttcccgcgcgccctcggcggaaagtaa

SEQ ID NO: 1573 - DNA, 1125 bp, Klebsiella pneumoniae
  unsure (594): Identity of nucleotide at the above locations are unknown.
tcgatggcttatcaactcaacattaactggcccgagtttttagaaaaatactggcagaaacagccggtggtattaaaaaacgcgtttccggacttcgtcgacccgattactccggacgagctggccggattagccatggagccggaagtcgacagccggctggtcagcctgaaaaacggcaaatggcaggccagcaatggtccttttgaacatttcgacgggctgggcgaaaccggttggtccctgctggcccaggcggtaaaccactggcatatgcctgccgccgagctggtgcgtccgttccgcgtactgccggactggcgcctggacgacctgatgatctccttctccgtccccggcggcggtgtcggtccgcatatcgatcagtatgacgtctttattattcagggcatgggcagccgccgctggcgcgtgggtgacaagctgccgatgcgtcagttctgtccgcatccggcactgctgcacgtcgatccgttcccaccgatcattgatgaagatctgcagccgggcgacatcctctatattccaccgggattcccgcacgacggcataacccacgaaaccgccctgaantactccgtcggcttccgcgggccaaacggccgcgacctgatcagcagcttcgccgactatgtgctggagaacgatctcggcggcgagcactacagcgatccggaccttacctgccgcgagcatccgggccgggttgaagagtatgaactcgaacgtctgcgcaccatgatgatcgatatgattcgccagccggaagatttcaagcagtggttcggcagtttcgtcaccaccccgcgtcacgagctggatattgcgccggcagaaccaccgtatgaagaagaggaagtggtcgatgcgctgctgggtggtgaaaagctatcccgcctgagcggcctgcgcgttctgcatatcggcgacagcttcttcgtgcatagcgaacaactcgacaccaccgatgccgaagcgctggatgcgctgtgtcgctatacctcattaggccaggaagagctcggcagcggcctgcagaatccggcgttcgtgagcgaactgacgcggctgattaatcagggctactggtacttcgaagagtaa

SEQ ID NO: 1574 - DNA, 921 bp, Klebsiella pneumoniae
cttcaaattctccccacacagccgtcctattgtgaggccatcacgatagggagaaaggctatgttgaaatcaccgttattctggaaaatcaccacgttaataggctgtattgtgctgctatctttgccgttaatgatggtcagggagcttattaatgagcgagcggattatcgtagcgaagtggtggacgccattgagcaaagcaccagcggctcgcaaaaactcgccggaccgctgatcgctattcccataaccgagaccctgtcccgcatggagaaccaaaaagaggtcaactatcagcgaagctgggtgtattactggctgccggagtcgctggcggtcaccgcaaacaagaccgtgaagtcgagaagggtgggtatctcaaccggccaggtctggcataacgccttgcagattaaggcttcgtttgatcccttgcgtctggcggcgctgagaaaaacgaatatcgtcttaggccagccgcggctggtggtgagcgtcggcgatgcccgcggcattggtgccatccatgctccggaggtcaacggtaacgtattaagcgtggagccggggctggggataagcggcgatggcgcaggtattcatatgccaatgcctgcgctggcggaggacaacaagccgcttgagattgccttttcactcgatctgaacgggacgggagagttttcactggtgccgctcgggcgtaacagcgagctgcagctgaccagtaactggccgcatcccggttttctcggcagcttcctgccaacgcaacgggaagtgagtgctgccggctatcgcgcccactggcaaagcagctggttcgccaacgatatggggagctatttcaaggatgatatggagatcccgtggtcgcgattgcgggccttcaagtgccgatgtgaagtcctctgctga

SEQ ID NO: 1575 - DNA, 675 bp, Klebsiella pneumoniae
ttacaggcctatatgggtatcagaagatacaccgatgttctggcaaaacgatcatttttacatgcttattactataagcaagttcatcagcaagataatacttatccttttgaggatttttatcgtactaacagtaaaaacccacaagcagcattgatgagtatgctctcctggtggaaaagcctttcagccccgccgtctaatgaggatattcatcttgggatttacgctccctatattcgcgaaaacttgtcaaaaaataatattggctcattgactgaggataagatccatcaaatattctcttatacacatgcaacaatggaccatgtgataaaaatgagtgctgaaacatttggccaacctgccacaaagtccttaaacaaggaagaacgtgccgttttatttacaaaatggatcatgggccaaacaaatcaaaaaggcatgactattgctgaattactcaattatgtgctctacggtggaacgccttcttttatgtgggaaaggatctatcaggcagggaaagatgagcaatataaattccagcattacggtattaactccattgctgaagttgttggctgggccagacctgatgatacgcctcccagaaatggcagaaccaataaagcattgcgggcattgggctatccagttcaagtgaatatttga

SEQ ID NO: 1576 - DNA, 345 bp, Klebsiella pneumoniae
ggctaccactacactatcactatcaggaaacgagatatggttatgcgcaggttttcaccgtggttactggctatcgtcctcagcgggtgtagcgccctgcagggaacgccggaagccccgccgcccgccaccgaccatccgcaggagatccagcgctaccagactgctggcctgcagaaaatggccacggtaagcgtactgatgtacggttcgccgatggatgtcgaagcggcgctgaaggccaaagcagaagcggccaaagccgattactacgtcatcatcatgatcgatgacaccatggtacccggccagtggtattcgcaggcgatcctctatcgtcgataa

SEQ ID NO: 1577 - DNA, 228 bp, Klebsiella pneumoniae
gcgatgagctatacagaaagggtgcgcaaaccgctgttcaccgtccattatggtaaggagaaaagtatgtttcgatggggaattatttttctggtcattgcattaattgctgcggctctgggctttggtggtctggcgggtacggccgctggcgctgcgaaaatcgtctttgtcgtcgggattatcctgttcctggtgagcctgtttacaggacgcagacgtccttag

SEQ ID NO: 1578 - DNA, 1017 bp, Klebsiella pneumoniae
ttctcctctctgtccgcccagtatattattaatgccgacagcgataatcccaccacccgccaatgcactcttgctccgggagcacaaatgaatctgaacctcctgcccgacctcgctcttttcgttcagatagtcgaccagggcagcttctccgccgtcgcccgccagaacggcattaccccttcagccgttagccgcagcgtttcacggctggagcgagagatgggctgcaaactgctgcaacgtaccacccgcaagctgcgtcttagcgatgccggggaaacgatatatcagcatgcccagcagatgctggaagcggcgcgacaggcaatggattccgcaggcagtcgccaaacggtcgcccagggaaagctgacgctcagcgtcccgaaagccgtcggccgctttgtgatccacccgctgatgatggcgtttttccaccgctacccgcaggtggacgtctgcctgcggctggaagatcgccctctcgattttatcgatgacggtattgatctggcgctacgcatcaccgataccccctcccccggcctgcatggcaaaccgctgatgccaatcaggcacgttatctgcgccactgaggcctatttacagcagcacggtacgccgtacacgccgcaggatctgcgctcgcatagctgcattagccttggcgaaacgcccgccgatgcgcgctggaagttccgtcgggaaggcaaaacagaaacggtgcaaacctacgggcggtacgccgccaaccataccgccgtacgcctcgacgcggtcagacagcatttagggatcggcagcctgcctctgttcaccgcccgtgaggcgctggcgaacggcgacatcgtgcaggtgttgcccgagtgggaatttatcagcagctactcaggcgacctgtggctgctgtgggcgggagataagcatatgcccgccaggatgcgggcgatgatcgattatctcagcgagacggtgccggcgctgaacgcaggcagcacagagccagcgaaataa

SEQ ID NO: 1579 - DNA, 2181 bp, Klebsiella pneumoniae
cctccgcctctgtggataacctgttctatatatggagtgatcatgacaccgcatgtgatgaaacgtgatggctgtaaagtgccgttcaactcagagcgcattcaggaagcaattctgcgtgcagctaaagcagcgggagtcgatgacgcagactattgcgccaccgtcgcagaagtcgttagccaacaaatgcagggccgcgcccaggtcgacatcaacgagatccagaccgcggtggaaaaccagctgatgtccggcccctataagcagctggcgcgcgcctacattgagtatcgccatgaccgcgatagccagcgtgagaagcgcggccgcctcaatcaggagatccgcggcctcgtcgagcagaccaactccgcgctgctcaacgaaaacgccaacaaggacagtaaagtcatcccgacccagcgcgacctgctggccgggatcgtcgccaagcactacgcccggcagcacctgctgccccacgatgtggtgatggcccacgagcgcggcatgatccactatcatgacctcgattactcgcccttcttcccgatgttcaactgcatgctgatcgacctgaaaggcatgctgacccagggctttaagatgggcaacgcggagatcgagccgccgaagtctatctctaccgccaccgcggtgacggcgcagatcatcgcccaggtcgccagccatatttacggcggcaccaccatcaaccgcatcgatgaagtgctggcgccgttcgtcagcgaaagcttcaaaaagcatcgcaaaatcgccgaagagtggcagatcccggatgccgaaggctatgcccgcgcccgtaccgaaaaagagtgctacgacgccttccagtcgctggagtatgaggtcaacacactgcataccgccaacggccagacgccgttcgtcaccttcgggttcggccttggcaccagctgggaatcgcggctgatccagcagtcgattcttcgcaaccgcattgccggcctcggtaaaaatcgcaaaaccgcggtgttcccgaaactggtgttcgcgatccgcgacggcctgaaccataagttcggcgacccgaactacgacatcaaacagctggcgctggagtgcgccagcaagcgcatgtacccggatatcctcaactacgatcaggtggtgaaagtcaccgggtcgtttaaaacgccgatgggctgccgcagcttcctcggggtatgggaaaacgagaacggcgagcaggtgcatgatggacgcaataacctcggcgtgatcagtctcaacctgccgcgcatcgccctggaagcgaaaggcgatgaagccgccttctgggcgctgctggacgagcgcctgcagctggcgcgtaaagcgctgatgacccgtatcgcccgcctggaaggagtgaaggctcgcgtggcgccgatcctgtatatggaaggcgcctgcggcgtgcggctgaaagccgacgacgacgtctccgagatcttcaaaaacggccgcgcgtccatttctctgggctatatcggtatccatgaaaccatcaatgcgctgtacggcaaccagcatatgtacgacagcgaggcgctgcgtgagaaaggcgtggccatcgtccagcgcctgcgcgacgctgtcgatttgtggaaggaagaaaccggctacggctttagcctgtacagcacgccgagcgaaaacctgtgcgatcgcttctgccgtctcgacaccgccgagtttggcgtggtggaaggggtaaccgacaaaggttactacaccaacagcttccacctcgacgtggagaagaaggtcaacccgtacgacaagatcgatttcgaagcgccgtacccgccgctggccaacggggggttcatttgctacggcgagtacccgaatatccagcataacctcaaggcgctggaagacgtgtgggattacagctatcagcacgtgccgtactacgggaccaatacgccgatcgatgagtgctacgagtgcggttttaccggcgagttcgagtgcaccagcaagggctttacctgcccgaaatgcggtaaccacgacgccgcccgcgtttccgttacccgccgggtgtgcggttatctcggcagcccggacgcgcggccgttcaacgccggcaagcaggaagaagtgaagcgccgcgtgaagcacctgggtaatgggcagattggttaa

SEQ ID NO: 1580 - DNA, 600 bp, Klebsiella pneumoniae
ataagcgcgtacgcctccggtcactgccctccgcgtgagggcagttttgttttagctaccaggaattgtgtgatgctgacctgcgaaagcgtacgttctaccgactcgccccatttcgccatgctggacgcgctttacgcgcgcgcctttccgtggcacgagcagcgcgaaagcgaggccaaacgtcaggcgctgagccacccgcgctacgcgctggaagcatggttcgatgaaggcgtctttgtcggcctcagcggctgctggcagtttgccggctacggttatatcgaacatctggcgatcgacgacacgctgcgctcccgcggctatggtaaacagctgctggcgcagatcctgacgcgcgccccgctgaccattctggaaatcgatccgctaaccacggccatcgcccataaacggctgcgcttttatcagtcgatggggttccatgctaatccctgggcgcatcgtcatccgacctatcatcagggcattgcggatcatgagctgctggtgctcagctatccacagccgatcggtgagcggcagtatcagcagtttgcccgggatctcgggcacgaggtgatggggcgggagtag

SEQ ID NO: 1581 - DNA, 684 bp, Klebsiella pneumoniae
tccacaactcactcagcggcaagtaacgggagccggataatggaacagaataaaggtttttggtatgccgactggtcgttcccgatctttgttggcctgctctcctccggcgtcttcgccgggacccacatgtactacctgtacggcatcggcgcctttaacgaagtggcctttgtggcgatgctgaagtcggggattgataccggcgtttacggcgcggtggcggcgtttggcgccagcttccttttcgcccgcatcatcgaagggtcgctggtagggatcctcgatatcggcggcgcgatacagaccggtatcggtcttggcgtgccggcgctgctgctcggcgcgggctttgtcttcccggtggcgaatttcgccgcgtcgctggtcaccggcctggtcctcggcctggcggtgggctacatcatcattctggcgcgtaagttcaccatcaaccagagcgattccacctacggcgccgacgtgatgatgggggccggtaacgcctccggccgcttcctcggtcccttgatcatcctcagcgcaatgaccgcctcgattcctatcgggattggctcgctggttggcgcactgctgttctacatctggcagaaaccgatcaccggcggcgccatcctcggggcgatgatcctcggttccatcttcccggtggcgattagctaa

SEQ ID NO: 1582 - DNA, 279 bp, Klebsiella pneumoniae
actgacgctcaggtcttcattaacagtcagtggggctgctgctctaccataaataatccggtgcaggcactgggggacaatagcaataacctcttcctctcccggaaacttaaggctgccaaccgtcagggtatgatggtggtagatattctggtgacacatccccgatctgaccgtcagcttcgtaaaatcagtcaaccagacctgataatatctataaagttcttcgtaacgaggcttgtaatctttcataattcatattccttaaggcttaaatga

SEQ ID NO: 1583 - DNA, 579 bp, Klebsiella pneumoniae
agggcatatcaataccggactcgcccgctgggcgatcgccagcctgctaaccctcgccacctgtattggcgtggtgatggccatgaccgtatgggggctgcgcggatgggcataatctcatttatttttgcgctggcggaagacatgctgctggcggcgatccccgccgtcgggtttgcgatggtttttaatgtccctcagcgcgctctgcgctggtgcgcgctgctgggggcgattggccatggctcgcgtatgatcatgatgagcgccggttttaacattgaatgggccacctttctcgccgctctgctggtgggcagcattggcattcaatggtcgcgctggtatctggcgcatccgaagatttttaccgtcgccgccgtgatcccgatgtttcctggcatctcagcctacacggcgatgatttccgcggtaaaaatcagtcattttggttattcggaagagatgatgattttgctgctgagcaattttttaaaggcctcttcgattgtgggcgccctttcgattggcctgtcgatacccggcctgtggctgtatcgtaagcgtcctcgcgtctaa

SEQ ID NO: 1584 - DNA, 528 bp, Klebsiella pneumoniae
cgcccgcaccatcagcgtggtgcagctcaccgcggagcgggtatgacacgcccggcgcagcatctgctgatggccctcgcgttcgatgtttactggacgctggtggtgatgttgcgcgagcgcggtctgctgatctggctgatgctggccattttcgcctggctgcggttgccggcggccagtcgtccgcccgccctgctgttggccgcggcgggctgcggtctggacgcctgctgggcgctggcgggactgatcgattttcgcggcgacagcctgctgcccctgtggatggtggccctgtggctgatgttcgccgtcgtctggacccgactgacccgcaccgcgacgcttcccggctgggtgctggccacggccgccaccgtcggcggcccggtggcctacctgatcggcgctcgcctcggagccatgaccctgctggtgccgacggcgcttggcgtggccgccatggcctgcggctggctggtgctcatgctgttattccatctggggatggggaggcaaaaatga

SEQ ID NO: 1585 - DNA, 1161 bp, Klebsiella pneumoniae
cgtttaagccatgaaacaagcaattttcctgcactaaaacgggtttttacgggcgtatttatagtgataatcataagatatctggttcgtgagacgctgaaaagccagttggcgatcctattcatcctgttactgattttcttttgtcagaaattagtcaggatcctcggcgccgcggtggatggcgatatcccaaccaatctggtgctctcgctgttggggctcggcatcccggagatggcgcagcttatcctgccgttaagtctgttccttggcctgctgatgaccctcggcaagctgtacaccgaaagtgaaattacggtgatgcacgcctgcggcctgagcaaagccgtgctgatcaaggcggcgatgatcctcgcgctgttcaccggcgcggtggcggcggtcaacgttatgtgggcggggccgtggtcgtcgcgccatcaggacgaagtgctggccgaagctaaagctaaccccggtatggcggcgctggcccagggccagttccagcaggccagcgatggtaacgcggtgatgtttatcgaaagcgtcaacggcaaccgcttccatgacgtcttccttgcccagctgcgtccgaaaggcaatgcgcgcccctcggtggtagtggcggattccggcgagctgtcgcagcagaaagacggctcgcaggtggtgaccctcaacaagggcacccgctttgaaggcaccgcgatgctgcgcgacttccgcattaccgacttcaataactatcaggctattatcggccaccaggcggtgagcgccgatccggacgacaccgaacagatggatatgcgcaccttgtggaaaacccacaccgaccgcgcgcgcgccgaactgcactggcgcttcacgctggtggcgaccgtcttcattatggcgctgatggtggtgccgctcagcgtggtgaacccgcgtcagggccgtgtgctgtcgatgctgccggcgatgctgctttacctggtgttcttcctgctgcaaacgtcgattaagtcgaacggcggcaaaggcaaaatggacccggctatctggatgtgggggattaacctgctctattttgcgctggcggtgctgttaaacctgtgggacacggtgccgatgcgccgcttccgcgcccgttttaataaaggagcggcctga

SEQ ID NO: 1586 - DNA, 354 bp, Klebsiella pneumoniae
cccattatacaaaaggtacgcagtcacacccgaaggtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcttcgagttcacagcctgtgcattttggtgtacgggactatcaccctgtaccgtcggactttccagaccgttccactaacacacaagctgattcagactctgggctgctccccgttcgctcgccgctactgggggaatctcggttga

SEQ ID NO: 1587 - DNA, 222 bp, Klebsiella pneumoniae
ccggagatacaaatcatgactacccgcccctcactgaccgaagaccagttcgttgacatggcatttatcaccagtctgctgcaaatgacagataagtggatttataagctcattaaggatggagtctttcccaaacccatcaagctgggtcgaagctcccgatggttaaaaagcgaagtcgaaaactggctacaggaaagaatcgaccagtcccgtaaataa

SEQ ID NO: 1588 - DNA, 537 bp, Klebsiella pneumoniae
agtaattcacagcgggaggtcataatgcaattagatgaacaacgcctgcgttttcgcgatgccatggccagcctgtcggcggcggttaacgttgtcaccaccgcaggcgaagccggccgctgcggcattaccgccacggcggtgtgctcggtgacggatacgccgccatcggtaatggtttgtatcaacgccaacagcgcgatgaacccggtgtttcagggcaacggcaagttgtgcatcaacgtgctgaaccacgagcaggaaatcatggcccgtcatttcgccgggatgaccggggtgacgatggaagaacggtttgccctcagcggctggcagcagggcgcgctcgggcagccggtgctgaagggttcgctggccagcctcgaaggcgaaattagccaggtgcaaaccattggtacccacctggtgtatctggtggagatccgcaatattaccctgagcccgcaagggcacggcctgatttactttaaacgccgtttccacccggtgatgatggaaatggaagtggcagtctaa

SEQ ID NO: 1589 - DNA, 465 bp, Klebsiella pneumoniae
gagatgacacacgacaataaactgcaggtagaagcgatcaaacgcggcaccgtgattgaccatatcccggcgcaggtcggctttaagctgctcaccctgttcaaactgaccgaaaccgaccagcgcatcaccatcggcctgaacctgccctccggcgagatgggccgcaaggatttgattaaaatcgagaacaccttcctgaccgacgagcaggttaaccagctgtcgctgtacgccccgcaggcgacggtaaaccgcattgatgattacgaagtggtgggcaaatcccgcccgagcttgccggatcgtatcgacagcgtgctggtctgcccgaacagcaactgtatcagccacgccgaaccggtttcttccagttttgcagtgaaaaaacgcgctgatgacatcgcactcaaatgcaaatactgcgaaaaagagttttctcattatgtggtgctggccaactaa

SEQ ID NO: 1590 - DNA, 780 bp, Klebsiella pneumoniae
cgaacccgacagccatattccgcgaggtttccgaggatgagcatgaaaaacgttggcgacctgatgaaacgcctgcagaaaatgatgccggcacatattgaaccggcgtttaaaaccggcgaagagctgctggcctggcaaaaagagcaaggccggctgcgttccgaagcgctggagcgagagaatcgcgcgatgaaaatgcagcgcaccttcaaccgctcggggatccgcccgctgcatcagaactgctcctttgataactatcgcgtcgagtgcgaggggcagatgaatgcgctcgcccgggcgcgccagtacgtggaagagttcgatggcaatatcgccagctttatcttctccggtaaaccgggcactggcaaaaaccacctggcggcagccatttgcaacgagctgctgctgcgcgggaagtcggtcttaatcattaccgtggccgatattatgtcggcgatgaaagataccttcggcaaccgggaaacgagcgaagaacagttgcttaacgacctcagcatggtcgacctgctggtgatcgatgaaattggtatgcagacagagtctcgctatgaaaaggtcattatcaatcagatagttgaccggcgctcatcctccaaacgacctaccgggatgctcaccaacagcaatatggaagagatgaacaaactgctcggcgagcgggtgatggaccgtatgcggctcggcaacagcctgtgggttatcttcaattgggaaagttaccggcaccgcgttacaggcaaggagtattaa

SEQ ID NO: 1591 - DNA, 885 bp, Klebsiella pneumoniae
ggatggggacattttatggatcaagcagggattattcgcgatctccttagctggctggaaggtcacctggatcagccgctttctctggataatgtggcggcgaaggcaggttattccaagtggcatttgcagcgaatgtttaaggatgtcaccggccatgccatcggtgcctatattcgcgcgcgccgcttgtcgaaatctgctgtcgcattacgcctgaccgcccgtccaatccttgatattgcgctgcagtaccgtttcgactcccagcagaccttcacccgagcgtttaagaaacaattctcgctgacgccggcgctctaccgccgctcgccggactggagctcgttcggtatgcgcccgccgctgcgtcttggcgaatttaccctgccgaaacatgagtttatcactctgccccctactcagctgcttggcgtgacccagagctatacctgtaagctcgaggaaatctccgattttcgtaaccagatgcgggtccagttctggcgagacttcctcggcaactcaccgtcaatccccccggtgctctacgggctgcatgagccgcgtccgagcctggaaaaagacgatgagcaggaagtattctataccaccgcgctgacgccggagatggctaacggccacctgcagcatgcccatccagtgaccctggagggcggcgagtatgtcatgtttacgtatgaagggctgggtaccggtctgcaggaattcatcctgaccgtctacggcacctgcatgccgatgctgaacctgacgcgtcgcaaggggctggatattgaacgcttctaccctgaagatgaaagccgggatcaggccacgccgattcagttgcgctgcgagtatctgatcccgatccgccgttaa

SEQ ID NO: 1592 - DNA, 2082 bp, Klebsiella pneumoniae
ggcgttatgcaacagcaggataactcagccagtaacatggaaacggcctctgtgttggctcaggacctggattcattgttgaatcagcactttcgcggtcgcgtggtgcgtaaggatctgactaagcaacttaaagaaggggctaatgttccggtttacgtactggaatatctactcggtatgtactgtgcctccgatgacgatgaggttgtcgagcaggggctacagtcggttaagcgtattctttctgagaactatgttcgcccagatgaagcagaaaaagtgaaatcactgattcgcgagcgtggttcttacaaaattatcgataaggtcacggtaaagctaaaccagaagaaagacgtttacgaagcccagctttctaacctcggtattaaagatgccctggtgccgtctcagatggtgaaagacaatgagaaactgttgacgggtggtatctggtgcatgatcaccgtgaactacttttatgaagaagggcaaaaaacgtctcctttctcgctgttcacactgaagccgatccagatgccaaacatggatatggatgaggtgtttgaagctcgcaagcagtttgatcgcgaccagtggattgacgtgctgttacgttctattgggatggagcccgcgaatatcgaacaacgcaccaagtggcatctgattactcgcatgatccccttcgtggaaaacaattataacgtctgtgagcttggccctcgtgggaccggtaagagtcacgtttataaagagtgctcccctaactctctgctggtatctggcgggcaaaccacggtagcgaacttgttttacaacatggccagccggcagattggtcttgtgggtatgtgggacgtcgtcgcgtttgatgaagtggcagggatcaccttcaaagacaaagatggcgtgcagatcatgaaggactacatggcgtcaggttcgttctctcgtggtcgtgattccatcgaaggtaaagcctccatggtgtttgtcggcaacattaaccaaagcgtggacacgctagtcaaaaccagtcatctgcttgcaccgtttccggatgcgatgattgatactgcattttttgaccgcttccatgcttatattcctggttgggaaattccaaagatgcgtccggagtttttcaccaatcgctatggtttgattacggattacctcgctgaatatatgcgcgagatgcgtaaacgtagcttctccgatgcaattgataaattcttcaagctgggaaataacctcaatcagcgtgacgtgattgccgtacgccgcacggtatccggtctgttgaagctactgcacccagacggcacttacgacaaagaagatgtacgggtttgcctgatctatgcactggaggtccgccgtcgcgttaaagagcagcttaagaaactcggtggcctggagttctttgatgtgaacttcagttatatcgataacgagagcctggaagagttcttcgtgagcgtaccggagcagggcggcagtgaattgattcccgccggtatgccgaaacctggcgtagtgcatctggtcacgcaggctgattcaggcatgacgggcctctatcgtttcgaaacgcagatgactgccggtaatggcaaacatgcggtatcaggtttagggtcgaatacagcagcgaaagaagcgatccgcgtgggttttgactacttcaaaggtaacttaggtcgtatcagtactgcggctaaattctctgaacatgaatatcatcttcatgtggtggagctgcacagcacagggccgagtacaaccaccagtctggccgcgttaatcgcgttctgttccatattgctggcaaaaccggttcaggaacaaatggtcgtattgggcggcatgactttgggtggcgtgacgaatcccgttcaggatttagctgcatgcctgcaggtagcattcgatagcggtgctaaaaaggtattgctccctatggcgtctgctatggatattccgaccgtaccgactgagttgtttaccaagttccaggtaagcttttatgccgatccggtagatgctgtatataaggcattgggtgtcaactaa

SEQ ID NO: 1593 - DNA, 243 bp, Klebsiella pneumoniae
gctgtctcgcaaaatatcaccggcaccgactgccggcgcgacagcggcgggaagcctggcgtcgagggcaacgaggcgcgatgcgggaagcgcacaggcgaccggttagcgcaaaatgcgactgttatcaccaaaatgaaatttcatttcacaacaatgttgaaatataaatttcattttactacggttatagcacagcagaatcagcgacgggccggtgtgcgctggcccccttcactatga

SEQ ID NO: 1594 - DNA, 495 bp, Klebsiella pneumoniae
cataacccgcaatacttgcgcgctaaaagccccgttttcgcagtgataaactccccgccatcgcacttcgcttattcaggggacaaattaatgaaatcgctataccggctttccgtagggcttatcctcggcgtgtcatttatcacctcggcggccgctaacgaccataaaattctcggcgtgatagctatgccgcgcaatgaaaccaacgacctgacgctgacgctccccgtctgccgggtagttaaacgcattcagctcagcgccgaccacggcgatgtacaactctccggggcgacggtctactttaaggccagccgcggcgccagccacacgctgaacgtccccgccgggatcaaagagggcagcaccaccggctggatcaacatcaatagcgataacgacaacaaacgttgcgtgaagaaaatcgccttctccggccacacggtgcactcctcagatatggcatcactgaaaattatcggcgatgactaa

SEQ ID NO: 1595 - DNA, 2904 bp, Klebsiella pneumoniae
ggcgtaccgcatggctggtttcaacctgaacacggcaacctggaaataatggaaaagacatacaacccacaagatatcgaacagccgctttacgagcactgggaaaagcagggctatttcaaaccgaatggtgatgaaagccaggagagcttctgcatcatgatcccgccgccgaacgtcaccggcagtttgcatatgggtcatgccttccagcaaaccatcatggataccatgattcgctaccagcgcatgcagggcaaaaacactctgtggcaggccggtaccgaccacgcaggtatcgctacccagatggtggttgagcgtaagattgccgctgaagaagggaaaacccgccacgactacggccgcgacgcctttatcgacaaaatctggcagtggaaagcggaatccggcggcaccattacccgtcagatgcgccgtctcggcaactccgtggactgggagcgcgagcgcttcaccatggacgaggggctttccaatgccgtgaaagaagtctttgttcgcctgtacaaagaagacctgatctaccgcggcaaacgcctggttaactgggacccgaaactgcgcaccgccatttccgacctcgaagtggaaaaccgcgaatcgaaaggttccatgtggcacatccgctacccgctggccgatggcgcgaaaaccgctgacggtaaagattacctggtggtcgccaccacccgtccggaaaccctgctgggcgataccggcgtggccgttaacccggaagatccgcgctacaaagatctgattggcaaattcgtggtgctgccgctggttaaccgccgcatcccgatcgtgggcgacgagcacgccgacatggaaaaaggcaccggctgcgtgaagatcaccccggcgcacgactttaacgactacgaagtgggtcgtcgtcaccagctgccgatgatcaacatccttacctttgacggcgacatccgcgaaagcgcggaagtctacgacaccaaaggcaatgaatccgacgtctactccagcgagatcccggcggagttccagaaactggaacgcttcgcggcgcgtaaagccgttgttgcggcagttgacgccctcggcctgctggaagagatcaaaccgcacgacctgaccgtcccttacggcgatcgcggcggcgtggtgatcgagccgatgctgaccgaccagtggtacgtgcgcgcggacgtgctggccaagccagcagtcgaagccgttgaaaacggtgatattcagttcgtgccgaagcagtacgaaaatatgtacttctcctggatgcgcgatattcaggactggtgtatctcccgtcagctgtggtggggtcaccgcatcccggcatggtatgacaacgacggcaacgtctacgtaggccgtagcgaagacgaagtgcgtcaggaaaacaacctgagcgccgacgttgccctgcgtcaggatgaagacgttctcgatacctggttctcctccgcgctgtggaccttctccaccctcggctggccggaaaacaccgacgccctgcgtcagttccacccgaccagcgtgatggtgtccggcttcgacatcatcttcttctggatcgcccgcatgatcatgatgaccatgcacttcatcaaagatgaaaatggcaagccgcaggtaccgtttaagaccgtctacatgaccggtctgatccgcgatgacgaaggccagaagatgtccaagtccaagggtaacgtcattgacccgctggatatggttgacggtatcaccctgccggagctgctggaaaaacgtaccggcaacatgatgcagccgcagctggcggataaaatccgcaagcgtaccgagaaacagttcccgaacggcatcgagccgcacggcaccgacgccctgcgcttcaccctggcggcgctggcctctaccggccgcgacatcaactgggatatgaagcgtctggaaggttaccgtaacttctgtaataagctgtggaacgccagccgcttcgtgctgatgaacaccgaagatcaggattgcggcttcaacggcggcgaaatggtgctctccctggccgaccgctggatcatcgcggaattcaaccacaccgtgaaagcatatcgcgaagcgctggataacttccgcttcgatatcgccgccggcatcctgtacgagttcacctggaaccagttctgcgactggtacctggagctgaccaagccggttatgaacggtggcagcgaagcggagctgcgcgggactcgccatacgctggtgaccgtgctggaaggtctgctgcgcctggcgcatccgatcattccgttcattaccgagaccatctggcagcgcgtgaaagcgatctgcgggatcaccgccgacaccatcatgctgcagccgttcccgcagtacgatgcttctcaggtggatgacgcggcgctggccgacaccgaatggctgaagcaggcgatcgtcgccgtgcgtaacatccgtgcggaaatgaacatcgctccgggcaaaccgctggaactgctgctgcgcggctgcagcaaagaggccgagcgtcgtgtgaacgacaaccgcagcttcctgctgaacctggcgcgtctggaaagcattaccgtgctgcctgccgatgataaaggtccggtctcggtgaccaagattgtcgacggcgccgagctgctgatcccgatggcgggcctcatcaataaagaagatgagctggcgcgtctggcgaaagaagtggccaaaatcgaaggtgaaattggccgcatcgagagcaagctggctaacgaaggctttgtcgcccgcgcgccggaagcagttatcgctaaagagcgcgagaagctggaaggctacgcggaagcgaaagcgaagctgattgaacagcaggcggtgatcgccgcgctgtga

SEQ ID NO: 1596 - DNA, 261 bp, Klebsiella pneumoniae
acgacgtggcagatggcggctaagctgcgcgaacagctgccgggtataatttttcagcataaacagtccctccgcgctcgccaaagcgaacgcagcgttgccgacgggcgtagcaaaacctacctgtcaggcatgttatttttatggcagggacatcaaggacgtcactgctttacgctttccggtaaagcagtgttaaacaggcttaccggaaagaaaggttgctccatcgaggatgaggagtgggatcggggtccataa

SEQ ID NO: 1597 - DNA, 198 bp, Klebsiella pneumoniae
tactcttttaacaaaagcatttattacggcttcctttgcgagtttgcggcctactcgtcgcccaagaccgtgatccaattcgatagtgaggtctacaagctcattcagcttgttccaggcaagagaaccacaatggatatgtccatttcctttcggatggggaatattacaaaaggcatctttgggattctttcgtaa

SEQ ID NO: 1598 - DNA, 525 bp, Klebsiella pneumoniae
gtggttttcctcgatgctgacgatgatatagcagacgggttcattgaaaaacgatcgcaagcagctactgtgtctcaagccgacgtcgtgatctttaatggctggtattctggcgctaacaaccatcaaagagccgttcatacaaagcaaccctatgaagcgacgttgtcaaggcatgagtggataaggcactgtgtaacacgccgcgaatggccacattacctgtggctgcagatggtcagatcatcctatatcagacagcactcactatgcttccagcccggcagaagccataaagacattatctggacggttcatcttgcggcgaacaatggtcgattctgtacattggatattaaggactatatctatatcaacaataaggcctctatcacgcatcggccggattactacgatgttcgtgctataagctatgttgaagtgatcacggaaatcatccaggtagcggaacaagaagaaaacaaaaaaaataaaggtatttttgtaccggcatgcgctagttga

SEQ ID NO: 1599 - DNA, 1734 bp, Klebsiella pneumoniae
aaaaattataaatcagaccgatccttaactttccattttaaaaggtgtaatgaaatgtcacttattcaaaacccgatattacgcggctttaatgccgaccccagtattattcgcgtcgaggatacgtactatattgccaactcgacgtttgagtggttcccgggcgtgcgtttacatgagtcgaaagacctgaaaaactggaacctgctgccttcgccgctctccaccaccaccctgctggacatgaagggcaacccctcctccggcggcatttgggcgccggcgctctcctgggccgatgggcaattctggttggtgtataccgatgtgaaggtcaccgaaggcgcctttaaagacatgaccaactacctgaccacggcgaaggatattcggggcccgtggagcgacccgatcaagctgaacggcgtcgggtttgacgcctcgctgttccatgacgacgatggccggaaatatatcgtccagcaaacctgggatcaccgggagtaccatcaccccttcgatggcattaccttaacggagctggataccaacacgctgaagttaatgccggaaaccgcgcgcaccatctaccgcggcaccgccgtggcgctggtcgagggaccgcacctctataaactgaacggctactactatctgtttgccgcccagggtggcaccgtgtttacccaccaggaggtggtggcgcggtcgaaaaccctcgaggccgacagcttcgaaaccgagccgggcgacgtgttcttaaccaacgtcgacacgccggacagctacatccagaaacagggccatggcgcgctggtctccactccggaaggcgaatggtattacgcctcgctctgcgcccggccgtggaatcgcccgggggaatccatctacgacccacgcggctggtcaaccctcggccgggaaacctcgatccagaaagtgtactgggacgacgagggctggccgcgtattgaaggcggtcacggcgggaaaaccttcgtcgaagggccgaaagacgccatcttcaccgaaagcgcaggcgataatagccagcaggatgactttacctcgccagcgctcgatccgaactggaataccctgcgggtgccgtttacggccaaaatgggcaccaccggcgacggcaaattaaccttaatcggccagggttcgttagccaatacgcatgacctgtcgctgattgcccgccgctggcaggccttctattttgacgctgcggtgaaggtgaaattcgagcccttcagctaccagcagatggccggattaacgaattactataacgaccgccactggagcttcgtcttcctgacctggaatgaaattaacggcaaggtcatcgaagtcggcgaaaataaccgcggaaaatacacgtcgtacctgaaggataacgccatcaaggtgccggacggcgtggaatacgtctggttccggaccaaggtccgcaagcagacctacagctatgaatacagcttcgatggcgtgtcgttcaccgagatcccggtccagctggatgccgcggtgctgtccgatgactatgtgttgcagagctacggtgggttctttaccggggcgttcgtcggcctggcggcggtagactacgccgggtacggcacccaggctgagttttatcagttcgagtatcaggagctgggcgatgcgttagcggccgatgggagctatagctgggaggctggcgagacgcgggataagtaa

SEQ ID NO: 1600 - DNA, 1161 bp, Klebsiella pneumoniae
  unsure (197): Identity of nucleotide at the above locations are unknown.
tatgcaaataaagtgagtggatattctctggaggatgttttgattaagtcagcgctattggttctggaagacggaacccagtttcacggtcgggccatcggggcaaccggcacggcggttggggaagtcgttttcaatacttcaatgaccggctatcaagaaatactcactgatccttcctatttccgccaaatcgncactcttacttatcctcatattggtaatgtcggcaccaacgccgccgatgaagaatcttctcaggtacatgcgcagggtctggtcattcaggacctgccgctgattgccagcaacttccgcagtactgaaaacttctcttcttatttgaagcgccataacatcgtggcgattgccgatatcgatacccgcaagctgacgcgtctgctgcgtgagaaaggggcgcagaacggctgcatcatcgcgggcgacagcccggatgcccagctggcgctggaaaaagcgaaagcgttcccgggcctgaacggcatggacttggcgaaggaagtgaccaccgcagaaacctatagctggacgcaaggcagctggaccctggcgggcgacctgccggaagcgaaagcggaaagcgagctgccgttccacgttgtggcatatgacttcggcgcgaaacgcaacatcctgcgcatgctggttgaccgcggctgccgcctgacggtggtgccggcgaagacctccgccgcggacgtgctggcgctcaatccggacggtatcttcctctccaacggccctggcgacccggcgccgtgcgattacgctatcgaggcgattgaaaaattccttgagaccgatattccggtattcggcatctgccttggccatcagctactggcgctggcgagcggtgccaagaccattaagatgaagttcggccaccacggcggcaaccacccggtgaaagatattgataacaacgtggtgatgatcactgcccagaaccacggtttcgccgtaaatgaggcgacgctgccggccaatctgcgcgtgacccataagtcgctgttcgacggcaccctgcaggggatccatcgtaccgacaaaccggcgttcaactttccagggcaccctgaaccaaccccgggccgcacaatcccgggcccttgttcgaccctttattcaattaattga

SEQ ID NO: 1601 - DNA, 1491 bp, Klebsiella pneumoniae
gccatgaataatatgtcatttatgatttggttttccgtttatgcctgcgcgatgattaccttaggctggtacgtttcgcgcaaacagaaaaccggcgaagactttttacttggcggtcgttcgctgccgatgatcctcactctcggttcgacggtcggcaccatggtggggaccggctccagcgtcggcgccgtcggctttggctacagcaacggctgggccgggatgctttacggcctcggcggcgcggtggggatcctgctggtggcatggttattcgcaccggtacgtaaacttcgcttcatgaccatgagtgaagaaatgtcgtattacaccggcggcagtaaaattattaaaaacctcgtcgcgatacttatttttattgcctctatcggctggctgggggcgcatatattaggcggcggattatatctggcgtgggccagcggcattgatattaatgtcgcgaaaattattatcgcgctggcttttgtggtttatgtcggtatcggcggctattccgcggtggtgtggatcgataccattcaatcgatcgtgctgttcgtgggctttattttaatggcgatactggcggttcatcacgttggcggctggagccatattcagcaggccgtcgatccggcggcgcaaagcctgttcgcggtcgataaattaggcgtgctgccggcgctatcattggcgatggtgatcggcgtcggcgtgctggcgacgccttcttatcgccagcgtatttactcggcgaagaccgtctcctcggtgcgccagtcctttaccattaccggcctgctgtatctgggcttctccttcctgccggcgatcatcggtatggcggtatggaccatgaacccgcagctggagaacagcggcttcgctttcttgtttgccactcaggtgctgccgccggtgctggcgatggcgatcctgattgccggcatgtcggccaatatgtcttccggtagctctgatgccatcgccgcggtgtccattatgctgcgcgacctctacaccctggtgaccggccatatgcccgcgccggagaaagcgattcgcctgtcgcggatcttcctggttctggtgattgcgctggcgctgctgtttgccctgacctccaacgacatcatcagctacatcaccaaaatgatctcgatgattatgtccgggatgtttatctgcaccatgcttggccgtttctggacacgctttaactggcagggcgcggtcgccgcgctggccggcggcgccggggcatcggttgcggtgctggtggatagcgactggctggcgttctggggcaacccgtgtattccggcggtgctgacgagcctggtggcttcggttgtggtgacgttactgaccccggccagcaacatgagccgcgagcaggcgctggagatgattacccgcgagcgtgaaagccgcccaacgccgccgccgctgccgattggcaaacgtcatacctcacgcgggtaa

SEQ ID NO: 1602 - DNA, 519 bp, Klebsiella pneumoniae
gtgcgtgataatcactcagctatattttttaataatggtaacaatatgaaatacaagaagtttgcgatggggctgctcctgctggccggtagccagctggctcaggcggagcagattggttccgtggatacggtcttcaaatggttagggccggatcacaaaatcgtcgtcgaagcctttgacgatccggatgtgcagaacgtgacctgctatatcagccgggcgaaaaccggtggtatcaaaggcgggctggggctggcggaagatacctctgacgcggcgatttcctgccagcaggtcgggccgattgagctaacggacaaaatcaaaaacggcaaaagccagggcgacgtggtgttccagaagcgcacctcgctggtgtttaaaaaactgcaggtcgtgcgtttctatgatgcgaagcgcaatgcgctggtctatctgacctactcggataaagtggttgatggctcgccgaagaacgccatcagcgccgtgccgatcatgccatggaataaataa

SEQ ID NO: 1603 - DNA, 771 bp, Klebsiella pneumoniae
cgccactgtaaccagacgaggtggagaatgttagaacaagtatgtcagcttgcacggaatgcgggcgatgccatcatggaagtctacgatggaaaccagccgatcaacgtcgccagcaagaaagatgattctccggtcacggcggcggatatcgcagcgcataaagtcattgtcagcggcctgcaggcgctggatccggataccccgatcctctccgaggaggacccgccgtcctgggaagtgcgccagcactggcagcgctactggttggtcgacccgctggacggcaccaaagagtttattaagcgtaacggcgaattcaccgtcaatatcgcgctgattgaaaacggcaagccgacgctgggcgttgtctatgcgccggtgatgaaggtgatgtacagcgcgcaaaatggcaaagcctggaaagaagagtgcggcgtacgcaagcagatccaggtccgcgatgcccgtccgccgctggtggtgattagccgctcccatagcaacgatccggagctgcaggagtatcttgagcaacttggcgaacaccagaccacctcaatcggttcgtcgctgaaattctgcctggtggcggaaggtcaggcccagctctatccgcgcttcgggccgaccagcacctgggacaccgccgccggccatgcggtcgcggtggccgccggggcgcatgttcacgactggcaggggaaaaccctcgactacacgccgcgtgaatccttccttaaccccggcttccgggtctctatttattaa

SEQ ID NO: 1604 - DNA, 294 bp, Klebsiella pneumoniae
ttcaaatgtaatgctatactgcattacaaaattcccctttccggaggcataatggccacgctcaatgttcgactggacgataaactcaaaaaagaggcttatgccgtgctggagaaactcgatatgacaccaacggaggcggtacgcctgctgtttcaatacattgcggaaaatggccgcatgccggtgaaaagtatgaccatcagtgatggcgaagcggcgttattacgcaccgttcgcgaacggctggaaaacccacggccaggggttaaggtgagtctggatgacctatga

SEQ ID NO: 1605 - DNA, 390 bp, Klebsiella pneumoniae
gcaatgcgtaaaaaactgttagcgatgctggctgtctctgcttttgcgctcggttcagcgtcggccttcgccgacctgggcgaagacatggacactttggcagaaaacctgcaagtggtacagaagacctccgacgccggcgagctgaaagcggcgctgaataagatgcgtaccgccgcggtcgatgctcagaaagagaccccgccgaagctggaaggcaaagcggccgacagcgctgagatgaaagattaccgtcacggtctggatattctgatcggccagatcgacggtgcgctgaagctggcgaacgaaggcaaggtgaaagaggcgcaggccgccgcggaggagtttaaaaccacccgcaacacctatcataagaagtaccgctaa

SEQ ID NO: 1606 - DNA, 1302 bp, Klebsiella pneumoniae
aaaatgggtaacaacgtcgtcgtactgggcacccaatggggtgacgaaggtaaagggaagatcgtcgatctcctgactgaacgggctaaatatgttgtgcgctaccagggtggtcacaacgccggccatactctcgtaatcaacggtgaaaaaaccgttctccatcttattccatcaggcatactgcgtgaaaacgtcaccagcatcatcggtaacggcgtcgtgctgtctccggccgcgctgatgaaagagatgaagggcctggaagaccgtggtatcccggttcgcgagcgtctgctgctctctgaagcctgcccgcttatccttgactatcacgtggcgctggacgtggcgcgtgaaaaagcgcgtggcgcgaaagcgatcggcactaccggtcgcggcattggcccggcttacgaagataaagtcgctcgtcgcggtctgcgtgttggcgatctgttcgataaagcaaccttcgccgataaactgaaagaagtgatggaatatcacaacttccagctggtgaacttctacaaagcagaagcggttgactaccagaaagtgctggacgatgtgatggcgattgccgacatcctgaccagcatggtggtggacgtatccgacctgctggatcaggcgcgtcagcgcggcgacttcgtgatgttcgaaggcgcgcagggtacgctgctggatatcgaccacggtacctacccgtacgttacgtcctctaacaccaccgcaggtggcgtggcgaccggctccggcctgggcccgcgttatgtggattacgttctcggtatcattaaagcgtactcgactcgcgtcggtgcaggtccgttcccgaccgagctgtttgatgaaactggcgagttcctctgcaagcagggtaacgaattcggcgccaccaccggccgtcgtcgtcgtaccggctggctggacgcggtcgcagtccgtcgcgcggtgcagattaactccctgtccggcttctgcctgactaaactggacgtcctcgacggcctgaaagaagtgaaaatctgcgttggctaccgtatgccggatggccgcgaagtgaccaccactccgctggctgccgataactgggaaggtatcgagcctatctacgaaaccatgccgggctggtccgaaaccaccttcggcgtgaaagagcgcagcggcctgccgcaggcagccctgaactacatccagcgtattgaagagctgaccggcgtgccggtggatatcatctctaccggtccagaccgtaccgagactatgattctgcgcgatccgttcgacgcgtaa

SEQ ID NO: 1607 - DNA, 1350 bp, Klebsiella pneumoniae
ttttcctgtttctcaatttcggagttcatcatgcaaacctatttcgaccaggttgatcgcgttcgctttgccggacccaaaaccgataatccgctggcgtttcgccactataatccggatgaaatcgtgctgggaaaacgcatggcagatcatctgcgttttgccgcctgttactggcataatttctgctggaatggcgcggatatgtttggcgccggctcgtttgagcgtccctggcaggccacgggcgatgcgctggaaatggccaaacgcaaagcggacgtggcgtttgaatttttctacaagctcaacgtaccgtattactgcttccacgatgtcgacgtctcgccagaaggcgcgtcgctgaaagagtatttgcataatttcgccatcatgaccgaggtgctggcggagaaacagcagcaaaccggcgtgaaactgctgtggggcaccgccaactgctttacccacccgcgctatggcgccggggcggcgaccaaccccgacccggaggtatttgcctgggcggccacgcaggtagtgaccgccatgaacgccacccaccagctcggcggcgaaaactatgtgctgtggggcggccgcgaaggttacgaatcgctgctgaataccgatctgcgccaggagcgcgagcagattggccgcttcctgcagatggtggtggagcacaagcataagattggctttggcggcacgctgcttatcgagccgaaaccgcaggagcccaccaagcatcagtacgattacgatgtcgcgacggtgtatggtttcctgaagcagtttggtctggaaaatgagatcaaggtgaacattgaagccaaccacgccactctggcggggcactctttccaccatgaaatcgccagcgccatcgcgctgggcattttcggctccgttgatgccaaccgcggcgatgcgcagctcggctgggataccgatcagttcccgaacagtgtggaagaaaataccctggtgatgtacgagatccttaaagccgggggattcaccaccggcggcctgaactttgacgccaaagttcgtcggcagagcaccgacaaatacgacatgttttatggccatattggcgccatggacgtgatggcgctgtccctcaagctggccgcgcgcatgattgaggatggcaagctcgatcagggtctggcaaaacgctatgccggctggcagggcgagctggggcagaaaattatgagcgggcagatgtcgctggataatattgcccgatacgctgagcagcataatctgaatccgcagcctcagagcgggcgtcaggaattactcgaaaatctcgtcaatacctatatctttggttaa

SEQ ID NO: 1608 - DNA, 327 bp, Klebsiella pneumoniae
agagtaatcctgatgaccaaccgtctggagctgtccggcattatttgcaggactccacttcgtaaggtcagcccgtcaggaattcctcactgccagttcgtgcttgagcatcgttcagtgcaggaggaagccggttttcaccggcaggcatggtgtcaaatgcccgttattattagcggtcacgaaaaccaggccattactcacagtataacggtcggtagcgcagtaaccgttcgagggttcatctcttgccataaggcaaagaacggcttgagcaaaatggttctgcatgccgagcagattgaattgatagattctggagactag

SEQ ID NO: 1609 - DNA, 1116 bp, Klebsiella pneumoniae
atcaaaaccaatcaaaatttgattactattgaaaatacgaggaagagcacgatgagtaaagtacagaccatcacccgtgaatcatggatcctgaacacctttccggaatggggcagctggctgaatgaagagattgagcaggagcaggttacgcccggcaccttcgccatgtggtggctcggctgtaccggtatctggttaaaatccgaaggcggggctaacgtctgcgtcgatttctggtgcggcactggcaaacagagccacggcaatccgctgatgaaaaccggccaccagatgcagcggatggcaggtgtgaaaaaattacagccgaacctgcgcaccacaccgttcgtgctggatccgttcgccattcgccagattgacgcggtcctcgcgacccacgatcacaacgatcatattgacgtcaacgtcgccgccgccgtcatgcagaactgcccggccgatgtgccgtttatcggcccgaaaacctgcgtcgacctgtggatcggttggggcgtgccgaaagcgcgctgtatcgtcatgaaacctggcgatgtcgtgaagatcaaagacattgagatccatgcgctcgatgcgttcgatcgcaccgcgctgatcaccctcccggcggaccaaaaagccgctggcgtactgccggacggcatggaccagcgcgcggtcaactacctgtttaaaacaccgggcggcaacctgtaccacagcggcgattcccactactccaactactacgcgaagcatggcaacgagcatcggattgacgtcgccctcggctcgtatggcgagaacccgcgcgggatcaccgacaaaatgaccagcgccgatatcctgcgcatggcagagtcgctcaacgccaaagttgtgatcccgttccaccatgatatctggtcaaactttcaggccgatccgcaggagatccgcgttctgtgggagatgaaaaaggatcgtctgaagtacggcttcaagccgtttatctggcaggtcggcggcaaatttacctggccgctggataaagacaatttcgaatatcactacccgcgcggtttcgacgattgcttcaccattgagccggatctgcctttcaaatccttcctgtaa

SEQ ID NO: 1610 - DNA, 813 bp, Klebsiella pneumoniae
aaaatgaccaatatgaagttaaaatttgatttgcttctaaaatcttatcatctatctcatcgatttgtctataaggcaaaccctggtaatgctggtgatggtgtaattgcatctgcgacgtatgacttttttgaacgaaatgctcttacctatatcccttacagagatggcgagcgctacagttctgaaactgatattttaatttttggaggcggaggaaacctgatagaaggattgtattctgaaggtcatgactttatccagaataatattgggaagtttcataaagtaataataatgccgtcgacaatcagagggtatagcgatttattcatcaacaatattgataagtttgttgttttttgtcgcgaaaatatcaccttcgattatattaaatctctcaactacgaaccaaacaagaacgtattcattactgatgatatggcattttatctcgatcttaataaatacctgtcacttaaacccgtctataaaaaacaggccaactgcttcagaacggactccgaatctctaactggagactacaaagaaaacaatcatgatatttcgctcacctggaatggcgattattgggataatgaatttctggcgcgtaattctacccgttgcatgataaactttcttgaagagtataaagttgtcaataccgacaggctgcatgtggcaattttagcatctctgcttggcaaagaagtcaacttctatcctaactcatattacaaaaatgaagctgtttacaattattcactttttaatcgttatccaaaaacatgctttattacggcaagttga

SEQ ID NO: 1611 - DNA, 1479 bp, Klebsiella pneumoniae
aaaggcgccaatcaatacccatcgcggtatgggctacagcctggggcgcggctgatgcgcatcggcatgcgcctgctgctgggctattttcttatcgtcgcgatcgccgcgtggtttgtgctgtcgatctttgtccaggaagtgaagccgggcgtgcgccgggcgacagaggggaccctcaatgataccgctaccctgttggcggcgctggcgcgtgaggatctgctggcggcaaacccgcagcagggcaggctggcgcaggcctttcaccagctcaaccagcagccgctcaacgccaatattggcggaattaaaaaggtacgtaatgagtaccgcgtctatctgaccgatgcccggggcaaggtggtgtttgactccagcgggcaggcgacagggcaggactattcgcgctggaacgatgtctggctcaccctgcgcggccagtacggcgcgcgcagtacgcgcagcgatccgcatgatgaagccagctcggtgatgtatatcgccgcgccggtgatggataaggggcggattatcggcgtgctgagcgtcggtaaacccaacctggcgatgacgccggtcattaagcgcagcgagcggcggatcctctgggccggcggcgccctgctgggcattgcgctgttgattggcggcggcgtcgtctggtggatcaatttctctatcggcaagctggtgcgctatgcggactcggtgaccgctgagcgcccgctgccgctgccggaggttggcagcagcgaattgcgcaagctggcccaggctctggagagcatgcgggtaaagctcgaaggtaagaatgccatcgaaaactatgtctatgacctgacccatgaactgaaaagcccgctggcggccatccgcggcgcggcggagatcctgcgcgaagggccgccgcctgaggtggcggcgcggtttactgataatatcctcgcgcaaaacacccggatgcaactgctggtggagcggctgctccagcaggcgcgactggaaagcaggctggagataaagcagcagccggtgtcgatagatgcgctataccaacggctgacggaggagcgcaacatcgctctggcggcgaaagctatcaccctgcgctggcgggagagtgggatgctggtcaatggcgatggcgagctgctggcccaggcgctgggtaatctgctcgacaacgcgattgactttaccccccagggcggtgagatcgccctggctgcggagaagcgaaatgaagaggtgcaattgagcgttatcgacaacgggtacggtattccggactatgccctggaacgaatctttgagcgattctattcgctgccgcgcgaagacggccataagagcagcggccttgggctggcgttcgttcgtgaagtcgcgcgcctgcatcacggcgatatcaatctgcacaatcggcccgaaggcggcgtggtcgccacgctgcgacttcaccgtcccttcacatag

SEQ ID NO: 1612 - DNA, 888 bp, Klebsiella pneumoniae
aacagctacaacaactggtgggcaagggcgtcgaagtggagattcgccaggtcccgaacgatcgcaaacagctttttgcggaatgcgtgtaattccggaggacagattatggtagaggctctcttactgggtctggtggcgtttatcgcgcaatcggaatatgccttagggacgtcgctaatttcacggcctatcgtcaccgggctgctgaccgggctggtgctgggggatgtacagaccggcgtcattatgggcgcgacgctggagctggcgtttatcggctctttctccgttggcgcctcgatcccgcccgacgtggtgaccggcggtattctcggcgtggcgttcgccattacctctggcgcaggcacagaaacggcgttgctgcttggcctgcctatcgccacgctgactttgatcctgaaaaacatctatctggggatgttcattccaatgcttagccagaaggcggacgggtatgcggaacgggcggatctccgcggcattgagcggatgcatttgattgccggattcggcctgtcgctgatgcttgccgcggtggtcaccgtctcattcctggtgggcagcaacgcggtgaaatccctgctcgatacgatcccggaatttatcaaacatgggctcagcgtcgccaccggcatcatcccggccctcggcttcgcgatgctcgccaggctgctgattaacaagaaagtggcgccgtattttttcctcggttttgtgctgatggcctatttgaaaatcccggtgaccggtatcgccattctcggcgctatcgtggcggtggtcatggttaacgtcaccgcattgaattcacctcgtatcacgacagaacaaggagtcagcgatgacgacgaagatgatttctga

SEQ ID NO: 1613 - DNA, 987 bp, Klebsiella pneumoniae
cagttgtacaaggtatactcggacgattttcactgttttgagccagacatgaagctgatacgcggcatacataatctcagtcaggccccgcacgggtgcgtgctgaccattggtaatttcgacggcgtgcatcgtgggcatcaggcgctgctgcagcggttgcgcgaagagggccgccagcgcggtttaccggtcgtggtgatgatttttgaaccccagccgctggagctctttgccgctgataaagccccggcgcgattgacccgcctgcgtgaaaagctgggctatctggctgaaagcggggttgactatgtattgtgcgttcgctttgaccgccggttcgccgcgctaaccgcgcaggattttatcagtgaactgctggtgcgtcgcctgggcgtgcagttcctcgccgttggtgacgatttccgctttggcgctggtcgccagggggatttcttgttattacaaaaggcgggggcggaatatggcttcgacgtcaccagtacccaaaccttctgcgaaggcggggtgcgaatcagcagcacggcggtacgccaggcgctggccgatgacgatctcctgctggcggagacgctgctcggccatccgtttagcatctccggacgcgtcgtgcatggtgatgaactaggccgaaccataggttttccgacggcgaacttaccgctgcgtcgtcaggtttccccggttaaaggggtctatgcggtagaagtgacagggctgggtgacaaaccgatagcgggcgtcgccaatattggcacccgtccaacggttgcgggcgtgcgtcagcagctcgaagtacatctgttggacgttgtaatggacctctacggtcgccatatcaatgtaatactgcgtaaaaagatacgtaacgagcagcggtttgcgtcgctggacgagcttaaggcgcaaatcgcacgtgatgagttaacggcccgcgaattatttgggctgaccagccaggcctga

SEQ ID NO: 1614 - DNA, 1338 bp, Klebsiella pneumoniae
tgcgggtacaactgcgggtatatcccggttcgattatgtttgtacccacacagaacccttgaaaggatactcatcatggctctgagtgatgtgaaggttcgttcggctaagcctgaagcaaaagcctataaactagctgacggtgaaggcatggttttgctggttcaccctaacggttccaaatattggcgactgcgttatcgctttggcggcaaagaaaagatgctggcgttggggaaataccctgaggtttcgttggcggatgccagggcacgccgggatgaagcccgtaagctgttagctaatggtgtcgatccaagtgagaacaagaaagccgttaaggtagagcaggagcaagaggcgataacgtttgaagtggtcgccagagactggcatgccagcaatcagaaatggtctgcatcgcatagcgctcgtgttttgaaaagcctcgaagataatctcttttctgccatcggtaagcggaacattgcagaactgaaaacgcgagacctacttgtacccatcaaagccgtagagtcatcagggcgtctcgaagtcgccgcccgtttacagcagcgtactaccgcgattatgcgctttgctgtgcagagtggcttaatcgattacaaccccgcgcaagagattgctggtgcggttgctacggcgaaaagacagcatcgtgcggctctggagcttaaccgcatccctgaattactacaccgcattgatcattactctggcaggccgttaactcgactggctgttgaactcacgttgttagttttcatccgttcaagcgaactgcgttttgcccgttggtcagaagtggattttgaaacggccatgtggacgattccaggtgagcgtgaaccactggaaggtgttaaacattctcagcgtggttcaaagatgcggactcctcatcttgttcctttgtcgcggcaagccttaactattctggaaaagattaaaagcatgaatggaaatcgagagctgatctttgttggtgatcatgatccgcgtaaacccatgagtgagaacacggtgaacaaggctttgcgagttatgggctatgacaccaaaacggaagtctgtgggcatggtttcaggacgatggcttgtagctcattgattgaatcgggtttgtggtcgagagatgcggtggaaaggcagatgagccatcaggagcgtagctcggttagggctgcctacatccataaggcggagcatctgggggagagaaggctgatgttgcagtggtgggcggattttttagatgctaaccgagagaagggagtaagtccgtttgattttgcaaaactccatggctccatgtaa

SEQ ID NO: 1615 - DNA, 675 bp, Klebsiella pneumoniae
cgtcaccacaaccgaagccaccaggctcgtcagcaccgccggaatacacgggttgccccagaacgccagccagtcgctatccaccagcaccgcaaccgatgccccggcgccgccggccagcgcggcgaccgcgccctgccagttaaagcgtgtccagaaacggccaagcatggtgcagataaacatcccggacataatcatcgagatcattttggtgatgtagctgatgatgtcgttggaggtcagggcaaacagcagcgccagcgcaatcaccagaaccaggaagatccgcgacaggcgaatcgctttctccggcgcgggcatatggccggtcaccagggtgtagaggtcgcgcagcataatggacaccgcggcgatggcatcagagctaccggaagacatattggccgacatgccggcaatcaggatcgccatcgccagcaccggcggcagcacctgagtggcaaacaagaaagcgaagccgctgttctccagctgcgggttcatggtccataccgccataccgatgatcgccggcaggaaggagaagcccagatacagcaggccggtaatggtaaaggactggcgcaccgaggagacggtcttcgccgagtaaatacgctggcgataagaaggcgtcgccagcacgccgacgccgatcaccatcgccaatga

SEQ ID NO: 1616 - DNA, 603 bp, Klebsiella pneumoniae
ttgatggacaagattaagctggtggcgattttacgcggcattcaacccgctgaggcggcagatcatattgagacgctaataaatgcaggctttcgctatatcgaaatcccgctcaattcgccggactggcagcaaagtattccggcgatggtgcgtcagtttggcgagcgggcgatgattggcgcgggaacggtgctgaaggttgaacaggttgattttctcgctgaagccggggcgaaacttatcgtgacgcccaatacggccccggcggtgatccgccgcgcggtagataaggggatgctggtgtgcgccggctgcgcgacggcctccgaggcgtttagtgcgctggatgccggggcgcaatggctgaaaatctttccgtcatcagcattcggcgcggactatattcgcgcgctaaaagcggtgttgccgccggaggtgccggtgctggcggtcggcggcgtgacgccggaaaatctggcgacctggatacaggcggggtgcgccggtgccggtctgggcagcgatctttatcgcgccggacaggccgtggaacgtacccgcgagcaggcggagaggtttatctccgccagtaaaagttag

SEQ ID NO: 1617 - DNA, 402 bp, Klebsiella pneumoniae
gcgtcctgcaatatgccctccactaccttgaggtggagcgggtggtgctctgcggccactacggctgcggcggcgtgcaggcggcgctctctctgcccactctgccgctggcgcaggaatcctcggcgctggctcgccgcatcggccagctgcgccacaccctgcatcacgaaattgcgcagatcgccgatgggtgtggtgttgcggcctcctccgacgccagcgccagcgtcagcaccgacgcggagccctctcgccatgcgctggacgccctggtggaagccaacgttcgcgcccagttcgcccgtctgctggagagtgaaccggtgcagacggtgctcgccagcgggcggcccctcagcctgcacggctgcgtctacgatctggcttccggccatttaa

SEQ ID NO: 1618 - DNA, 1131 bp, Klebsiella pneumoniae
gcggcgggcaaattgcgttaccttgtcaggagaagatcaatcgaacaggaaagcagggtggggcaacgcattcccgtcacgctgggcaatatcgccccgctggcggttaaacccttccgaccaggcaagctggcgctggtatgcgaaggcggaggacagcgagggatttttactgccggggtgctggacgaatttatgcgcgccggatttaacccctttgacctgatgctgggtacttcagccggcgcgcaaaatctctccgcctacatgtgtaatcagcaaggctatgcccgcaaagttatcacccgctacaccacttcacgccagtttttcgatccgatgcgctttgtgcgcggcggcaaccttatcgatctcgactggctggtggaggccacttcgcagcaaatgccgcttgccatgaactatgccgaagcgcagttcgcgttggggaaagagctgtggctatgcgcttgccgcggtgacgattactccgccagctatttttcgccgacgccgcaaacgtggctggatctgatccgcgcctccagcgccatccccggcttttatcgcagcggcgtgttgctcgacggcgttagctacctggacggcggcgtcagcgatgcgatcccggtgcaggaggcggcccgccgcggcgcccagaccatcgtggtgatccgtaccgtcccttcgcagatgttttataccccgcagtggttcaagcggatggagcgctggctgggagagagtagtctgcaaccgctggtcaatttggtgcatcatcacgaaactacctaccgcgccatccagcagttcatcgagaaaccgccgggtaagttgcggatcttcgaaatctatccgcagcggccgctgcgcagcatggcgcttggcagccgactaccggcgctgctggaggactacaaaaccgggcgccagtgcggccgttatttcctggcaacggtgggtaaactactggccgaccagccgccgctgctgcgccacgcgccgcgtattgcccggcccgcgccggtggtggtgccgccggtgccggtggccaatgaagcgccccaggcgaccatcattcctgcgccccaggcgaatgaccccagttttgatcatgaggatctggcgtga

SEQ ID NO: 1619 - DNA, 1329 bp, Klebsiella pneumoniae
  unsure (1126): Identity of nucleotide at the above locations are unknown.
cgcaacttaaatctgattttttcgagttatcagtatgtgtattatgcttttatcgagttattcaccaacaggatgaaagtaaaagtgaaacatctgcaacgattctttagtagcgatgcttccggcggcattgtcttaattatcgccgccgcgctggcgatggtgatggccaataccagcgtgaccagtggtctgtatcactccttccttgagacgccagtacagctgcgtgtgggcgcgctggagatcaacaagaacatgctgttatggatcaatgatgctctgatggcggtgttctttatgctgattggcctggaggtcaagcgtgagctgattcaggggtcgctggcgagccgccgtcaggcggtcttcccggtgatagccgcgctgggcgggatgatcgtcccggcgctggtctacctggcctttaacgcccaggatcgtgtcgccagagaagggtgggcgatcccggcggcgacggatattgcctttgccctcggcgtgctggcgctgttaggtagccgggtcccgacggcgctgaagattttcctgatggcgctggcgattattgatgacctcggggctatcgtgattatcgcgctgttttatacccacgacctgtccatgctctcgctgggcgtggcggcggcggcgattgcggtgctggtggccctgaatctgagcggcgtgcggcgtaccgggatctatattctggttggcgcggtgctgtggacggcggtgctgaagtctggcgttcacgcgacccttgccggggtgattgtcggctttatgatcccgctcgaggaaaagcatggcaagtcgccggccaaagcgcttgagcatgttctgcacccgtgggtggcgtttatgatcctgccgctgtttgccttcgcgaacgcgggggtctcactgcagggggtcacccttgccgggctgacgtcgctcctgccgctgggcattatggctggcctgtttatcggtaagccgctggggattagcctgttctgctggctggcccctgaagctgaagtgggcttctctgccggaggcgaccacctgcaagcaaattatggcggtggggatcctgtgcgggattggctttacgatgtcgattttcatcgccacnttggcctttggcagcgtggatcccgcgttgatcaactgggccaagcttggcattctgatcggctcagtgctatcagcggtcgtcggctacctcatactgcgtcagcgcgtgacggatactcgcctcgcggtataacctttctgcaggagagcccgtcaggctctcctggacattatcagggagagaagcatgtcacatattaa

SEQ ID NO: 1620 - DNA, 483 bp, Klebsiella pneumoniae
ccaggcttaaatcaggagaatccaatgagtctgcagtctgtacggcagttttttgccgaacacgcccccgatatcgaaattattgagttaaatcagagtaccgccaccgtcgcacttgccgctgccgcacacaacgttgagccggggcaaattgccaaaacgctgtcgctcaagatcaaagataagattgtactgatcgtcgccaggggcgatgcgcggctggataataaaaagctgaaagagacctttggcgcgaaagcacgcatgctaagcagcgatgaagtggttacctggaccggtcatccggtcggcggcgtttgcccgtttggtctggaaaatccgctggcagtctactgcgacgtctctctcagacattatcaggaagtactacccgcagcgggagccatccatagcgcggttcgcattgaaccagaacgcatggcgcagctcaccgatgcaacatgggtagatgtgtgtttatag

SEQ ID NO: 1621 - DNA, 648 bp, Klebsiella pneumoniae
cgtttaacaaagggaattcgagttatgaaatttgtaaagataatgatcatcgccagtgctttttacttaacatatgctcatgcaagagagatacatcaggctgttgatgagccggcagccccttataatttgcgctgggggatgagttacgatgaggccagaaacacgcctttatattctctggaggtatcagatatcaattatgccggaaaagacccggatctgattatctcaaccctgactccccaggaagtgggggcgttgaaatatcaggagatgaagctttatttcgataagaataaagggctaaaaagtgtttttgttagcgctgatgttgattccagtcagcaggcctataaagttgatgatggccgggaagcactcgccttatataatgaggaagttaaggttcttgatcgagaatatgggccagcgacaatcaaagaagagttcattgcagaaagagggaaattctatcaaagtcttgccgcctgcattgcaaaacagcaggagtggtataataaaagattagatctgaataaaataacaaattgttcaacctggcaacgtacttataaaaaaggtcgggtaaccgttttgctatacatcgaaccgagacaagtttccaaacattatatttataaataa

SEQ ID NO: 1622 - DNA, 798 bp, Klebsiella pneumoniae
ttgttagcaaaaggtctgactatgttcctgataattttaataaaatcgcttatcatcggcggcctggtcggcgtcggcgtgggcgccggagcggcacgcatgtttcatgcccccaccacgcaggggatgggggcgtttcgaaccctgggcgagctgaattcctgtgagggcgatccggcctcccacttctcctttggccttggcttcttctttaacgcctgggcctcttccgttgcagcaggctccttcacccaggatgttgaccaccgcattatccccaactggggcgcggcggcgctgatgctgaaaaatcgtaacgtcggcgaaacgctgcacgatccgaaaaaaatggccatctcctgcggcatcatcggcatgatcgtcgtcgccttcctcaacctgaccgcctcgtccgtaccggaagcgctgcaggtgaccgccgttaaggtactggtgccggcggcaaacctgctggtgaacaccgtgatgccggtgatcttctggctggcggcgatcgatgccggtaaaaaatcaggcttctgggcgacgattttcggcggcgccgcgcagctgattatgggtaacgccgtaccgggtctggtgctggggatcctgatcggtaaaggcgtcgaagagagcggctggaaccgggtgactaaagtgatgatggtggccatcgtcgcgctgtttgtcctcagcggcttcttccgtggcttcgacatgaagatgatcgaatccttccatctgaccgtgccgaactggctggacatgatccacaactcactcagcggcaagtaa

SEQ ID NO: 1623 - DNA, 324 bp, Klebsiella pneumoniae
gtgttgaaaaaaacagcgctatcctgcgcggcgtcaccttttgctgctattccagggcgccaatgccgccagcaatcaccaccgcctcctcccgcaaccccagctccacctgccagccactcccctttctcctttccccctttccccctttcccccttgctccccacagaccccactcaaattcatctcaaatttttctcacataattctctcccacatcactcaacccaacccaacgctccccacccatccccaatatccactccccaactattccccccaaccctacccaccatcattcccatatattccagaaagttttag

SEQ ID NO: 1624 - DNA, 597 bp, Klebsiella pneumoniae
ccacaagaaaacacaccggatttactgtctggaaggcctcaacctgcgcaaaaagcgcccccgcatgcatgtcatcgtcagcaacgtccggtcctgatcggtatcgatcagtgctggagtatggatttcgtgtcggataatctgtttaacggaacacgtttccgggcgctgactgtagtggataattttagtcgggagtgtgtggcgatccatggcggaaagtcgctgaaaggtgagtatgtggtcggtgtgatggaaaggttgcgggtgctgggcaagcgtctgccggtacgtattcagacagataacggcagcgagtttattttgaaaagtctggataaatgggcgtatgagcacggtgtcacaatggacttatcccgccccggaaaaccaacggataacccgtttattgaatcatttaacggcagtctgcgggatgaatgcctgaacattcactggtttctctcgctggaagatgcgcaggacaaactcgacaactggcgcagggaatataatcatgagagaacgcattcatcattaaatgacatgactccggctgaattcatccgaagtctccggaaagacgaagatctctga

SEQ ID NO: 1625 - DNA, 2946 bp, Klebsiella pneumoniae
aaaacgccccttgccgggtggcaaggggcgggaggatcacagcgcggcgatcaccgcctgctgttcaatcagcttcgctttcgcttccgcgtagccttccagcttctcgcgctctttagcgataactgcttccggcgcgcgggcgacaaagccttcgttagccagcttgctctcgatgcggccaatttcaccttcgattttggccacttctttcgccagacgcgccagctcatcttctttattgatgaggcccgccatcgggatcagcagctcggcgccgtcgacaatcttggtcaccgagaccggacctttatcatcggcaggcagcacggtaatgctttccagacgcgccaggttcagcaggaagctgcggttgtcgttcacacgacgctcggcctctttgctgcagccgcgcagcagcagttccagcggtttgcccggagcgatgttcatttccgcacggatgttacgcacggcgacgatcgcctgcttcagccattcggtgtcggccagcgccgcgtcatccacctgagaagcatcgtactgcgggaacggctgcagcatgatggtgtcggcggtgatcccgcagatcgctttcacgcgctgccagatggtctcggtaatgaacggaatgatcggatgcgccaggcgcagcagaccttccagcacggtcaccagcgtatggcgagtcccgcgcagctccgcttcgctgccaccgttcataaccggcttggtcagctccaggtaccagtcgcagaactggttccaggtgaactcgtacaggatgccggcggcgatatcgaagcggaagttatccagcgcttcgcgatatgctttcacggtgtggttgaattccgcgatgatccagcggtcggccagggagagcaccatttcgccgccgttgaagccgcaatcctgatcttcggtgttcatcagcacgaagcggctggcgttccacagcttattacagaagttacggtaaccttccagacgcttcatatcccagttgatgtcgcggccggtagaggccagcgccgccagggtgaagcgcagggcgtcggtgccgtgcggctcgatgccgttcgggaactgtttctcggtacgcttgcggattttatccgccagctgcggctgcatcatgttgccggtacgtttttccagcagctccggcagggtgataccgtcaaccatatccagcgggtcaatgacgttacccttggacttggacatcttctggccttcgtcatcgcggatcagaccggtcatgtagacggtcttaaacggtacctgcggcttgccattttcatctttgatgaagtgcatggtcatcatgatcatgcgggcgatccagaagaagatgatgtcgaagccggacaccatcacgctggtcgggtggaactgacgcagggcgtcggtgttttccggccagccgagggtggagaaggtccacagcgcggaggagaaccaggtatcgagaacgtcttcatcctgacgcagggcaacgtcggcgctcaggttgttttcctgacgcacttcgtcttcgctacggcctacgtagacgttgccgtcgttgtcataccatgccgggatgcggtgaccccaccacagctgacgggagatacaccagtcctgaatatcgcgcatccaggagaagtacatattttcgtactgcttcggcacgaactgaatatcaccgttttcaacggcttcgactgctggcttggccagcacgtccgcgcgcacgtaccactggtcggtcagcatcggctcgatcaccacgccgccgcgatcgccgtaagggacggtcaggtcgtgcggtttgatctcttccagcaggccgagggcgtcaactgccgcaacaacggctttacgcgccgcgaagcgttccagtttctggaactccgccgggatctcgctggagtagacgtcggattcattgcctttggtgtcgtagacttccgcgctttcgcggatgtcgccgtcaaaggtaaggatgttgatcatcggcagctggtgacgacgacccacttcgtagtcgttaaagtcgtgcgccggggtgatcttcacgcagccggtgcctttttccatgtcggcgtgctcgtcgcccacgatcgggatgcggcggttaaccagcggcagcaccacgaatttgccaatcagatctttgtagcgcggatcttccgggttaacggccacgccggtatcgcccagcagggtttccggacgggtggtggcgaccaccaggtaatctttaccgtcagcggttttcgcgccatcggccagcgggtagcggatgtgccacatggaacctttcgattcgcggttttccacttcgaggtcggaaatggcggtgcgcagtttcgggtcccagttaaccaggcgtttgccgcggtagatcaggtcttctttgtacaggcgaacaaagacttctttcacggcattggaaagcccctcgtccatggtgaagcgctcgcgctcccagtccacggagttgccgagacggcgcatctgacgggtaatggtgccgccggattccgctttccactgccagattttgtcgataaaggcgtcgcggccgtagtcgtggcgggttttcccttcttcagcggcaatcttacgctcaaccaccatctgggtagcgatacctgcgtggtcggtaccggcctgccacagagtgtttttgccctgcatgcgctggtagcgaatcatggtatccatgatggtttgctggaaggcatgacccatatgcaaactgccggtgacgttcggcggcgggatcatgatgcagaagctctcctggctttcatcaccattcggtttgaaatagccctgcttttcccagtgctcgtaaagcggctgttcgatatcttgtgggttgtatgtcttttccattatttccaggttgccgtgttcaggttgaaaccagccatgcggtacgccttatag

SEQ ID NO: 1626 - DNA, 204 bp, Klebsiella pneumoniae
gatggaagaaagaccggagacttcagtttagcccggcactgttttcagggaggagatcaacacccccaccgtagtacgcggaagtatgtaatgaaacgattggcattagccctgcttttatttatttccaaagaattggttgtagcttccgttctcacgccggaagccgaccattatgacagctatctgttagtcgacacttaa

SEQ ID NO: 1627 - DNA, 549 bp, Klebsiella pneumoniae
accatgagaaagcttaacatccttattcttgcagccctgaccgcggtctctggttccgccatggcggtggggtttaccgttgaacagggtaaaaacttcactaatctgaatatggaaatgggtaaatcctcttctggcctgtacgccgaaagccactggctgaagaataccgatgatggtagccagaccggcggcgtgggcgcgggttacaacctggaagtgggcccggtgatgctcaacgctggcgcgaaagccatctacctcgggccgaaaaaaggcgataacggcgtcgcgtttccggtcggcggcggggtgaacgtggccctgaccgacagcatccacgtgtttggcgaagggtatgtcgcgccggatggtctgaacaacagcgtgaaaaactatgttgaagcgaacggcggcgtgagctggtctccgattggtccagtgacgttgaaagtgggttaccgccatgtgagcgttgacggtaaagagggtcgcccgaaccacaccctgattgatggcgcctatgtgggcggcggggtcaccttctga

SEQ ID NO: 1628 - DNA, 429 bp, Klebsiella pneumoniae
ccggagtgtttcgctatgacaccccgacgagactggcaattacagcagctgggcattacccagtggtcgctgcgccgaccgggggcgttgcagggcgaaatcgttatctcgcttcctgaacatattcgtctggtgatggtggcggaaaccccgccgtcgctgacagagccgctgattggcgacatattacgcgcgctggccgtgacgccagatcaggtcctgcagctgactccggagcgggtggcgatgctgccgcaggacagccgctgcaacagctggcggttgggcacagaggcgtcgctgccgctggcgggcgcccaggtgtccacccccgcttttgatgaactccagaccagcgcgccggctcgcagggcgctctggcaacaaatctgcgcacatgaacacgatttctaccctcagcacggctga

SEQ ID NO: 1629 - DNA, 1998 bp, Klebsiella pneumoniae
ccaataaccctcaggctgttcacggagtcgacgtcgggatcccgacccttccaggcagcagacaccaaaaaggaaatcctagctatgaatgcagcagtaaagcggctcgacgtcatctgtataggtcgggtggccgtcgacctctatgcccagcagattggttcgcggctagaagacgttgccagtttcgcgaaatatctgggcggctcctccggcaacgtggcctttggcaccgcgattcaggggctgaaatcggccatgctggcgcgcgttggcgatgaacacaacggccgtttcctgcgcgaaacgctcaaccgcgccggggtggataccgagtatctgattaccgacaaatctcgcctgaccgcgctggtgatgctggggattaaggatcaggagaccttccccctgattttctaccgcgataactgcgccgatatggccttaacgcctgacgacattagcgaggagtatattgcctcctcccgggcgctggcggtgactggcacccacctgtcgcacgccaacacccgcgccgcggtgctgaaggcgctggagtacgcccgccgtcacggcctgcgtaccgcgctggatatcgattaccgtccggtgctgtgggggctcacctcgctcggcgatggcgaaacccgtttcattgagtccggaccggtcaccagccagctgcaggaagtgctgcatctgttcgatctggtggtgggaaccgaagaagagtttcatattgccgggggcagcaccgataccctgaccgcgctgaaaaatgtgcgcaatgccaccaaagccactctcgtctgcaagcgcgggccgatgggctgcgtggtgctggaaggcgacatcccggacagctgggaccaggtgccgctgcagcagggcgtgcgcgtggaggttctcaacgtgctgggcgccggggatgcctttatgtcgggtctgctgcgcggctggctcaacgacgaaagctgggagcaggcttgccgttacgccaacgcctgcggggcgctggtggtctcccgccacggctgcgcgccggcgatgccgaccaaagtcgaactcgacgactacctgcagcgcgccgaatcggtgccgcgcccggacgtcgacgagcgcctcaaccacctgcaccgggtcaccagccgccgtcagcagtggccggagctgtgcattttcgcctttgaccatcgtaaacagctggccgatctggcgcgggagaccgggcgcgacgaagcctgcattccgcagctcaagctgctgttgttggccgcggccgaagcggcggcgcaggaggcaggtctcgatcagcgcagcggcattctggccgacggcacctacggccagcgtgcgctcaacgccattaccggcaagggctggtggatcggccgccctatcgaactgcccagctcgcgaccgctgcgtctggagcatggcaacatcggctcgcagctgatcgactggccgctggagcatgtcgtcaaatgcctggtcttctatcacccggacgacccggcggcgctgcgtgcagagcaggatgccctgctgctcgaggtctggcaggcctgtaacaagtcaggccatgaactgctgctggaggtgatcctgccggaaaatggcccggacaaagacgagcgccattaccacaccatgctggaacacttctatcagctggggatcaagccggactggtggaagctgccgccgctctccagcgccagctggcagcagatcaccgccctcatcgagcgtgaagatccgtggagccgcgggatcctgatcctcgggcttgacgcgccttccgacaaactgcgcgccggtttcgccgaggcggccgcacacccgatgatcaaaggtttcgccgtcgggcgcaccatctttggccagccgtcgcggcgctggatgcagggtgagctcagcgatgaggccctgatagaggaagtgaaacgcaactacctgacgcttattagctactggcgcgaagcccgccgctga

SEQ ID NO: 1630 - DNA, 1527 bp, Klebsiella pneumoniae
catcatttgaaggtgacatcgattatgagcgccgaggcacaccaggagatccttcgcaccgaaggacttagtaaattcttccccggcgttaaggcgctggataacgtcaactttagcctgcggcgcggcgaaatcatggccctgttgggcgaaaacggcgccggaaaatcgacgctgatcaaagcgctgaccggcgtttaccatgccgatcgcggcactatctggctggaaggccaggctatttcgcccaaaaataccgcccatgcccagcagctggggatcggcaccgtctaccaggaagtgaacctgctgcccaatatgtcggtggcggataacctgttcatcggccgtgaaccgcggcggtttggtctgctgcgacgtaaagagatggaggccagagcgacggcgctgatggcctcctacggcttttccctcgacgtgcgcgagccgctgaaccgcttttcggtggcgatgcagcagatcgtcgctatctgtcgggccatcgacctgtcggccaaggtgctgatcctcgacgagcccaccgccagcctcgatacccaggaggtggagatgctgttcaccctgatgcgccagctcagggataacggcgtcagcctgatcttcgtcacccattttctcgaccaggtctatgcggtcagcgaccgcatcaccgtgctgcgcaacggcagcttcgtcggctgccgtgagacccgcgagctgccgcagattgagctggtgaaaatgatgctgggtcgcgaactggaccacaatgccctgcagcgggcgggccgtaccctgctgagcgataaaccggtagcggcgtttgaaggctacggtaaaaaaggaaccatcgccccgttcgacctgcaggtccgcccgggtgaaattgtaggcctcgccggcctgctgggttccggacgcacggaaaccgccgaagtgatcttcggcattaaaacggcggacagcgggaaggcgtggatcaaaggcaaaccgcagaccttgcgctccccgcatcaggcgtcctgcctcgggatcggcttctgtccggaggatcgcaaaaccgacggcattatcgccgctgcctcggtgcgggaaaatatcgttctcgccctgcaggcgcagcgcggctggctgcggccgatcccccgccgggaacagaatgagatcgccgagcgcttaattcgccagctggggatccgtaccccgagcgccgagcagccgatcgagtttctctccggcggcaatcagcagaaggtgctgctctcccgctggctgctgaccaaaccgcagttcctgatcctcgatgagccgacccgcggcatcgacgtcggcgcccatgcggaaattattcgcctgattgaaaccctctgcgccgatggcctggcgctgctggttatctcttctgaactggaggagctggtgggttacgccgatcgggtcattatcctgcgcgatcgccgacaggtagcggagatcccgctcgccgagctctctgttccggcgatcatgaacgctattgcggcataa

SEQ ID NO: 1631 - DNA, 732 bp, Klebsiella pneumoniae
aaggaactgaagatggcaactcctcacattaacgcagaaatgggcgatttcgctgacgtcgttttgatgccgggcgacccgctgcgcgcgaagcacattgcagaaaccttcctcgaagacgtgcgtgaagtgaacaacgtgcgcggcatgctgggcttcaccggtacctataaaggccgcaaaatctccgtgatgggccacgggatggggatcccgtcctgctctatctacaccaaagagctgatcaccgatttcggcgtgaagaaaatcatccgcgtgggctcctgcggcgcggtgcgtgaagatgtcaaactgcgtgacgtggtgatcggcatgggcgcgtgcaccgactctaaagtgaaccgtctgcgtttcaaagaccatgattttgcggcgattgccgatttcggcatggtgcgtaatgcggtagacgcggcgaaagcgctgggcgttgacgcgcgcgtcggcaacatcttctccgcagacctgttctatacgccggacccgtccatgttcgacgtgatggaaaaatacggcattctgggcgtggaaatggaagcggcgggtatctacggcgtggcggcggagttcggcgcgaaagcgctgaccatctgcaccgtctccgaccacatccgtacccacgagcagaccactgccgctgaacgtcagacgaccttcaacgacatgatcaaaatcgcgctggaatccgtgctgctgggcgataaagagtaa

SEQ ID NO: 1632 - DNA, 837 bp, Klebsiella pneumoniae
aaaataatgaaactaattgcaaatggattaaacaaacagttttttagttcttttttacctcctccggattgcgaaattgacggtgtcgttgcagccatagcctatggtgatgataaaactgctctacttgaccattgtctaaaaaatcatcatcgcctcgatatctggatgcgatatgatcacaccgtccctgtatctccctcactcttggcgaaatttcttgctaatacaaagaataatatcttctgcaaacttgttccggatcgtcttcacagtaaagtcatctggtggaagggttatggcgcatatattggttcggctaacttaaccgatcgtgcatggcatacaaacatagaagctggtatcttcttcactgagagtgatttatatagttctaatctaattgagcaacttgaggaattcttcgatagcttagcgtctcttgactgttgcgttgatcttagtgacgatatcattaatgaacaaagactattgttgaaatcaaaactcgagttagagaaaaaagagcaagagcttatcaaaaagagaaaagtacctgaatggggcggcgtaaattttattgataacaaaaaaagcaaagataaaagaaaagagagttttcataaagaatgggaaagcacactttcaatcattcagaatatctcaagccagataaatgattacaggcctatatgggtatcagaagatacaccgatgttctggcaaaacgatcatttttacatgcttattactataagcaagttcatcagcaagataatacttatccttttgaggatttttatcgtactaacagtaaaaacccacaagcagcattga

SEQ ID NO: 1633 - DNA, 360 bp, Klebsiella pneumoniae
gtgattgccctcggccatcacatcaccggcctgatgtcgaaccataacccgctggcccatgagctgatcggcgcctccgaactggcgggcgaccgcgcatggcgtttgccgctggccgacgagttccaggatcagctggagtccaattttgccgatatggcgaacattggcggccgtcctggcggcgcgatcaccgccggctgtttcctgtcgcgcttcacccgcaagtacaactgggcgcacctcgacatcgccggtactgcctggcgttccggtaaggccaaaggcgcgaccggtcgtccggtggcgctgctgtcgcagttcctgctcaatcgtgcgggttttaacggcgaagagtga

SEQ ID NO: 1634 - DNA, 246 bp, Klebsiella pneumoniae
tccgcgccgaatgctgatgacggaaagattttcagccattgcgccccggcatccagcgcactaaacgcctcggaggccgtcgcgcagccggcgcacaccagcatccccttatctaccgcgcggcggatcaccgccggggccgtattgggcgtcacgataagtttcgccccggcttcagcgagaaaatcaacctgttcaaccttcagcaccgttcccgcgccaatcatcgcccgctcgccaaactga

SEQ ID NO: 1635 - DNA, 297 bp, Klebsiella pneumoniae
acgacagcgaaaccacggagaaacagaccgatgataccccggacacaccgccagctcgtgagcgttgaagtgatgtggcctgcacaaacactgcctcttcccctgcaacaggcggtggaagcgctgacgcagggagaaacgcccgaccagattatcgcccggatgaatttgcagggctttcaggcatggcgcgaagctacatcgccgcaaggcgaacacgacatttttcagatacgactggatgaggcacacgaggcacggttcctctgccgctacattactctgccgctgcactaa

SEQ ID NO: 1636 - DNA, 1686 bp, Klebsiella pneumoniae
aaagaggcgaagtccaacgtggctcaattcgtttataccatgcatcgtgtcggcaaagtggttccgccgaaacgtcatattttgaaaaatatctccctcagctttttccctggcgcgaaaatcggtgtgctcggtctgaacggcgccggtaaatctaccctgctgcgcatcatggccggtatcgacaccgagatcgaaggtgaagcgcgtccgcagcccggcatcaaaatcggctacctgccgcaggagccgcagctcaacccggagcacaccgtgcgcgagtccgtggaagaagcggtcgccgaagtggttaacgcgctgaaggggctggacgaagtctatgccaaatacgccgagccggatgcggacttcgataagcttgccgcacagcaaggcaagttcgaagagattatccaggcgcacgacggccacaacctgaacgtccaactggagcgcgcggccgacgccctgcgcctgccggactgggatgcgaaaatcgctaatctttccggtggtgaacgccgccgcgtcgcgctgtgccgtctgctgctggaaaaaccggatatgctgctgctcgacgaaccgaccaaccacctcgacgccgagtccgtcgcctggctggaacgcttcctgcacgacttcgaaggcaccgtggtggcgattacccacgaccgttacttccttgataacgtcgccggctggatcctcgagcttgaccgcggcgaaggtattccgtgggaaggcaactactcctcctggctggagcagaaagaccagcgtctggcgcaggaagcttctcaggaagccgcacgccgcaaatctatcgagaaagaactcgagtgggttcgccagggcgcgaaaggccgtcagtctaagggcaaagcccgcctggcgcgctttgaagagcttaacaacgttgaatatcagaaacgtaacgagactaacgaactgttcattccgcctggcccgcgtctgggcgataaagttctggaagtcagccatctgcgcaaatcctacggcgaccgcgttctgattgacgatctgagcttctcggtaccgaaaggcgctatcgtcggcatcatcggtccgaacggcgcgggtaaatccaccctcttccgcatgatgtccggccaggaacagcctgattccggcaccatcaccctgggtgaaaccgttaagctggcttccgtcgatcagttccgcgacgcgatggacaacagtaagaccgtgtgggaagaagtgtctggcggcctggatatcatgaagatcggcaacaccgagatgccgagccgcgcctacgtgggccgttttaacttcaaaggcgtcgaccagggtaaacgcgttggcgagctgtccggcggtgaacgtggtcgtctgcacctggcgaaactgctgcaggtcggcggtaacgtcctgctgctcgatgaaccaaccaacgacctggatatcgaaaccctgcgcgcgctggaaaacgccctgctggagttcccgggctgcgcgatggttatctcgcacgaccgctggttccttgaccgtattgccacccacattctggattaccaggatgaaggtaaggttgagttcttcgaaggtaactttaccgagtacgaagagtacaagaaacgcactctcggcgccgacgcgctggagccgaagcgaatcaagtacaaacgtatcgcgaaataa

SEQ ID NO: 1637 - DNA, 219 bp, Klebsiella pneumoniae
cggaacaagaagaaaacaaaaaaaataaaggtatttttgtaccggcatgcgctagttgaggctcgtcactttttggggttatatcggaaaaaggttatggataattcccacgttaaaaccagtttcaacaaaagtatatcctttatcagtttattccaaggtattagcagcctcagtgacatatttttctttatcaagctaatgcgtaaaattttttag

SEQ ID NO: 1638 - DNA, 1035 bp, Klebsiella pneumoniae
aaagaaaggaaatctataatgtccacattgcgcctcctgctctctgactcttacgacccgtggttcaacctggcggtcgaggagtgcattttccgccagatgcccgccacccagcgggtgctgttcctgtggcgcaatgccgataccgtggtcatcggccgcgcgcagaacccgtggaaggagtgtaatacccgccgcatggaggaagaccatgtgcggctggcccgtcgcagcagcggcggcggcgcggtgttccacgacctcggcaatacctgctttacctttatggcaggcaaaccggagtacgacaaaaccgtctccaccgctattgtgctggcggcgcttaattcactcggcgtaaccgccgaagcctccgggcgcaacgatctggtggtcaaaaccgacagcggcgaccgcaaagtctccggctccgcctatcgtgaaaccatggaccgcggttttcatcacggcaccctgctgctcaacgccgatttaagccgtctcgccaactacctcaacccggaccagaaaaagctgcaggctaaaggcattacctcggtgcgcggacgggtggcgaacctggttgagctgctgccgggcattacccatcagcaagtttgcgaggcgatccaggaagcattcttcagccattacggcgaacgggtggacgccgaggtgatctccccggacaacacgccggatctaccaaattttgctgagaccttcgcccgtcagagcagctgggagtggaacttcggccaggcgccggccttctctcatcttctggacgagcgctttcgctggggcggcgttgagctgcattttgacgtcgaaaaagggcatatcacccgcgcgcaggcctttaccgatagcctgaacccggcgccgctggaggccctggcggcacgcttagtcggctgtcagtatcgggcagaagtattacagcagcagtgcgaggcgctggtcggcgatttcccggagcaggaagcggaactgaaagaactgtcggcgtggattgccggcgcagtgcgctga

SEQ ID NO: 1639 - DNA, 252 bp, Klebsiella pneumoniae
acctcagggaaaagaaaacagggtatgtcgagcgacatcattattattgatgataaaccagccagcgctcaggccgctaatttatttgaaatggggcgggcgaacagcaaaaacaagggcgcccgaacggcgccccttgagagtgattacgcgtcgaacggatcgcgcagaatcatagtctcggtacggtctggaccggtagagatgatatccaccggcacgccggtcagctcttcaatacgctggatgtag

SEQ ID NO: 1640 - DNA, 555 bp, Klebsiella pneumoniae
ggaatgcctgacatgaatactgcattatcgccggtatcatcacagcctgaactttttccgctggcggttatggctcaacatgattacctgcttaccgcgacatccggattaacaccctatgctcaacggaccatccgacgcgctaccaatctgctggataaatatctgcgccagcccggtatatcctttacctcaagtactgctgcccgtgactggcttcggttacagctggcaggacaagaacgggaagtgtttatggtgctctatctcgataaccagcatcgtttactggagagtgaaacgctatttgccggttcgattaaccatgtgcaggtccatccccgtgaggtagtgaaatcagcgcttcgtttcaatgctgcggccgttgtgttggtgcataaccatccatccggtgatccggagcccagccaatgtgaccgcaacattacgggcaggcttaaagaagcactggcactggttgatgtgaacacactcgatcatctggttatcggttcagatggaattgtgtcgtttgcagagcgaggctggatatga

SEQ ID NO: 1641 - DNA, 453 bp, Klebsiella pneumoniae
ttttattatgaagcagctatagatatcatttgttatagatgcattgttaatgcacaaggttttcaaggaggaaacatgcgtattttatctctttttttggtggtgttcgctttaacaggctgctccgggacaacgattggcggtaatgaagataaattaacgccagcctatctgaaacaacatctcattgtcggaaaaaccaccaaggccgaggttcgtcagtattttggtgccccggattctggtcatacgacggtgacggcgtcgggtaaagagagctggtattattcagtagataaagggatcaacctggtcagcctcgcgggttccatgatcccggtaaccggggcatcgcaagctgccgatgcggtcgataagtccagccaaaaagattcgaactcgctgatgattttcttcgatgaaaaaggcgtggtggaaaactgggtgcgttaa

SEQ ID NO: 1642 - DNA, 606 bp, Klebsiella pneumoniae
cgcatgaatgacccgatccttgaatatcgattaaagcggttagaagaacgtatcggcgacgaccgttttttgaaaaaccaaggttccggcaatgagattggcttctggatttttgactatccggcaaagcaagagcttcaggtccgcgaataccttcactttttattcaaaaaactggataaaaagtacacctatagaacgctaaatatcttccaggtcatcatcgatatgctggaagaacgtaagctctttgaccgtatctgccagcgagagcctgaacttggcctggaaacactgaaaaagcatctggcagccccactgagccagaaaaaaatcgcggaatatattgcgcgcactgtcgatcttccggcgcagcaatttgttattctgacaggcctcggtaacgcctggccgttggttcgtggtcatgagctaatgagcgcgcttcaggacgtgatggggtttacaccactgctgatgttctatccaggcacctacagcggatatgatctttcaccactcgatggcattcactcccgtaactattaccgcgccttcagactggtacccgaaaccggaccggcggcgactttgactcctcgttaa

SEQ ID NO: 1643 - DNA, 1650 bp, Klebsiella pneumoniae
tgccgaagtgactcccggcacgctgcgcgccaccacttcaatttgcccggcgatggcgtcgatatcggccaggttggtgccggaaactttaatgccgatcgggctcttgatgccggtggagagcatgtcgatgcggttgcggatcggcggcacccacaggttcgccagtcccggcaggcgcacggttttatccagctcctcgacgatcttctccatggtcatccccggtcgccattgatcctgcggcttgagctgaatggtggtctccaccatctccagcggcgccgagtcggtggcggtttcggccttgccggttttgccgaacacccttgccacttccggcaccgtcatgatcagcttatcggttttctgcagcatatccgccgcctgcgcagcggagatccccggcagcgtggacggcatatacagcaggtcgccctcgttgatctgcggcagaaactcgccgccgacccggttaagcggccagacaaccgtcaggatcgacaggagcgcgatcagcagggtggtcttcggccagtgcaggaccttcagcagcagcgggtgataaatgcggatcaaaaagcggttcagcggattgctgctctccgccgggatcttgccgcggatccagaagcccatcaggattgggatcgccacgatcgccagcagcgccgccccggccatcgaccaggttttggtgaaggccagcggaccgaacagtttgccctcctggccttcgagggtgaaaatcgggataaacgacagggtgatgatcagcaggctgataaacagcgccgggccgacctccaccgaggcctcggtaatgattttccagcgtgtgtcgttgctgagcttctctcccgggtgctgatgttcccactcctccagccgcttatgggcgttctcaatcatcacgatggcggcatcgaccatcgcccccaccgcaatggcgatcccgcccagcgacatgatgttggcgttgagcccctggaaatgcatcatgataaaggcgaagcacaggccgagcggcagggagataatcgccaccagcgccgagcgcacgtgccacaggaacagggcgcagaccagggcgacgacgataaactcttccagcagcttgtagctgaggttgtcgatggcgcggtcgataagctggctgcggtcgtaggtggtgaccacttccaccccttccggcaggctgctttgcagcgacgccagcttctctttgaccgcggagatcacctcgcgggcgttcttgccggagcgcaagatcaccacgccgccggccacttcgccttcgccgttaagctcggcgattccgcggcgcatctccgggccgatctgcacccgcgcgacgtcgccaagatagaccggcacgccgttatccccggtcttcagtacgatatttttgaagtcgtcgagcgtctgcaggtagccgctggcgcgcaccatatattcggcttccgccagttcgacggaagagccgcccgcctcctggttagaggcgtccagcgccgatttcacctcgccgaggctgatgccgtactgggtcagcttcatcgggtcgacgacaatctggtactccttgaccacaccgcccaccgacgccacttccgagacgttaggaatggttttcagctcatattttaa

SEQ ID NO: 1644 - DNA, 1167 bp, Klebsiella pneumoniae
gcagtgggtgagctaccagcactcgctggcccactacgccggcccgtggctgtacgacgaaaacatcagttgcccaacggaagagcgctaaccgccatgctcagtctgcaaaacatcagtaaacgtttcgacggcaaaccggcgctcagcgccctgtcgctggatattcacgaaggcgaattcgtggtgctggtcggcccgtcgggctgcgggaaaagcaccctgctacgcctgctcgccgggctggagccggtcagcgaaggccaaatctggctgcataatgagaacatcaccgccgccacgccgcgcgagcgcaacttcgcgatgatcttccagaactatgccctgtttccgcatctgtcggtgcgcgacaacatcaccttcggcatgaaggtgcgcaaggaagagaaaagcagctggcagccgcgggtggacaaagtggcgcagatgctgcagctggaggcgctgctcgatcgcaaaccggcgaaactctccggcggccagcgccagcgggtggcgatggcccgggcgatcgtgcgcaatccgcggctgttcctgatggacgagccgctctccaacctcgacgcccgcctgcgcagcgaagtgcgcgacagcattatggccctccaccagcagctgaaaaccagcaccatctatgtgacccacgatcagaccgaggcgatgtcgatggccgaccgcatcgtggtgatgaacggcggccacgtgcagcaggtaggacggccagaatatctgtatgccaacccggccaacctgttcgtggccggatttatcggttcgccggcgatgaacctcctgtcgctgccctgcgccaacggtgaagtactgttgggagaacagcgccatccgctgccgccgcgccaccgggatcagacccgcgtctggctgggcgttcgcccggaacatattaccgaccgcgtggaggagggccatctgcgcctgccggccaccgttctgcaacgagaactgatgggggccgattacctgctccacgtcagcaccccgatcggcaccctgcgctttagccgccgccaccgcggcacggtgccggagaaaggcgagtcgctaccgatcggcttttcgcctgccgatgtgcatctttttcatgctgagacccagcataatttagcgccggtacatcaggcgtaa

SEQ ID NO: 1645 - DNA, 291 bp, Klebsiella pneumoniae
ttcacgggtgatggtctgtactttactcatcgtgctcttcctcgtattttcaatagtaatcaaattttgattggttttgatttatgttgtcactggattttcaagattgcaatcttgttttccatcaattttacgaagggatgcgcatcatctcttaggggttccagcatccataaaggttgtgctttgttttatctatatgatttgaaaatgtttaattatgtttcggcgctactgatcggcaatagtcacaatgaaatagaggattattgcggcgcgcgtcacatttaa

SEQ ID NO: 1646 - DNA, 357 bp, Klebsiella pneumoniae
aatgtatgcctggatcaacagcgcgcagggaatgcaagagctgaatatcaattcagcttacggggagcaaatggaatggaaaaaaatagtacaacccgccatgtcgccatcgtagaaaaatgcgtgatgacggaaatggcatggcgctatatctttagtcgtgaagataatcgccgttatcatattcatctgtttaaaaatgtcagtatgctcagggcggcggaaataccgtttccctggtcaaccattattttttctctttcgggaagtcgttcttcacgagccgagagtctgctctttgttcatgaaatggcgcggtgccggccggaagtccaaacgtttatttgtggttattaa

SEQ ID NO: 1647 - DNA, 225 bp, Klebsiella pneumoniae
cgtccttgcgaaggagccaacatgcacatgctgaagttttacctcgtcagtaccggcaacagacatttcatcacctctaacgaatccgcaaccggcgaaccattgattatgctggaagggtgtactctcagtaatactgtaaagccggagcatgtctccggctttacagtatgggggggaacagagggcgatcgctcaaatggtatgctggtttatttcatgtaa

SEQ ID NO: 1648 - DNA, 549 bp, Klebsiella pneumoniae
cgtggtggcgaaaattcagggcatggatccggtgtgggtcaacctgggcggtcccccaagtccatcgcctggcctgatcaagacgcctcggcagttcagtattcaggtttcccgcctggccggacaaaaccttccgcatcagcaaatgggacgatcctccccagcgtcgatagcgccacccgcaccctgcagctgcgcctgcaggtcaacaacccggatgaagcgctgaagccggggatgaacgcctatctgcagctgaccagtgaaagcgaaccgatgctgctgatcccctccaaagcgctgatcgacagcggcagcgagcagcgggtaatcaccatggataacgagggccgcttcgtgccgaagcgggtccaggtcttccatgaatccaatggcgtcacggccattcgcagcgggctgcaggagggcgagaaagtggtcgccagcggcctgttcctgatcgactcggaggccaatatcgccggcgcgctggagcgcatgcgcgcgcaggccccggatgccgctgcccctgccgcccacgcgcattga

SEQ ID NO: 1649 - DNA, 1263 bp, Klebsiella pneumoniae
gcgctcggcgatctcattctgttcccggcgggggatcggccgcagccagccgcgctgcgcctgcagggcgagaacgatattttcccgcaccgaggcagcggcgataatgccgtcggttttgcgatcctccggacagaagccgatcccgaggcaggacgcctgatgcggggagcgcaaggtctgcggtttgcctttgatccacgccttcccgctgtccgccgttttaatgccgaagatcacttcggcggtttccgtgcgtccggaacccagcaggccggcgaggcctacaatttcacccgggcggacctgcaggtcgaacggggcgatggttccttttttaccgtagccttcaaacgccgctaccggtttatcgctcagcagggtacggcccgcccgctgcagggcattgtggtccagttcgcgacccagcatcattttcaccagctcaatctgcggcagctcgcgggtctcacggcagccgacgaagctgccgttgcgcagcacggtgatgcggtcgctgaccgcatagacctggtcgagaaaatgggtgacgaagatcaggctgacgccgttatccctgagctggcgcatcagggtgaacagcatctccacctcctgggtatcgaggctggcggtgggctcgtcgaggatcagcaccttggccgacaggtcgatggcccgacagatagcgacgatctgctgcatcgccaccgaaaagcggttcagcggctcgcgcacgtcgagggaaaagccgtaggaggccatcagcgccgtcgctctggcctccatctctttacgtcgcagcagaccaaaccgccgcggttcacggccgatgaacaggttatccgccaccgacatattgggcagcaggttcacttcctggtagacggtgccgatccccagctgctgggcatgggcggtatttttgggcgaaatagcctggccttccagccagatagtgccgcgatcggcatggtaaacgccggtcagcgctttgatcagcgtcgattttccggcgccgttttcgcccaacagggccatgatttcgccgcgccgcaggctaaagttgacgttatccagcgccttaacgccggggaagaatttactaagtccttcggtgcgaaggatctcctggtgtgcctcggcgctcataatcgatgtcaccttcaaatgatgtcaggttaccccgggtcgcgctgggcttcccggggtttctggaacgctgctttttaccctctcccaccggggagagggatggaatga

SEQ ID NO: 1650 - DNA, 765 bp, Klebsiella pneumoniae
cggcccggcgacggtaggccccctcaacaactgaatggacgacacatggcatccctgacactgaaaaatacggcgctgatcctcggcagcatgctgattggcggcgcgcttaccgcggcgctgtatatcagactgacgccgacccactctgccgctccggcggccgagcagcagcgtaaagtgctgttctggtacgacccgatgtacccgaatactcgctttgataaaccgggtaaatcgccgtttatggatatggatctggtgccgaaatacgctgatgaggagagtgctgccgccggtgcgccgggggtgcgtatcgacccgacgcagacccagaatcttggggtgaaaaccgccgccgttacccgcgggccgctgcgctacgcccagaccttcccggccaacatcagctttaacgagtaccagtatgtgattatgcaggcgcgggcggcgggctttatcaatgaagtctatccgttgaccgtcggcgacaaagtcaagcaaggcacgccgctgctcgagctgaccatcccggactgggtggaagcgcagagcgaatatctgctattgcaggagaccgggggcaccgctacgcaggtcgaggggatcctcgagcgtctacgtctcgccggaatgccggatgacgatatccgccgcctgaaagccacgcgcaagatccagacccgctttaccctcaaagcgcccatcgaccgggtgatcaccgccttcgatctgcgcgccgggaatgaacatcgccaaagataa

SEQ ID NO: 1651 - DNA, 270 bp, Klebsiella pneumoniae
tacagcatagagttaatttacatatcaatactctatccaatcggccaagatcactctgcatattactttgaacccagaatgatttttcccattaaagcatgctttgattcaggcacttcgcggcgtttatgtgactttatggaagaaatgtactcccatactgcaagtttctctgaaactaatttgccacataagtctcttttcttacatggagccatggagttttgcaaaatcaaacggacttactcccttctctcggttagcatctaa

SEQ ID NO: 1652 - DNA, 2295 bp, Klebsiella pneumoniae
gctgtgtcagagttgttatccatcgccttatttttagcttcggtggtgctgtatgcctggaaagcgggtcgtaacacctggtggtttgccgccacgctcacggtgttaggcctgttcgtggtgctgaatatcaccctctacgccagtgactacttcaccggcgacggcatcaacgacgcggtactctacactctgaccaacagcctgaccggcgccgggatcggcaaatatatactgccgggggtcggcgtggccgtcgcactggtcgccgtctttggcgccctcggctgggtgctgcgccgccgtcggcatcatcctcatcacgtcggttacagcctggcggcgctactgctggcgctggcctccgttgatgccagcccggccttccatcagatcagcgagctggtgaaatcccagtcacgcgagggcgatccagactttgccgcgtactataaagagccgtcgaagcaaatcgacaatccgcagctgaacctggtctatatctatggcgaaagtctcgagcgcacctattttgataacgacgccttcccaaacctcacccctgagcttggcagaattaaagctgaggccattgatttcagcaataccatgcagctgccggggaccgattacactatcgccggcatggtcgcctcacagtgcggcattccgctgttcgcgccgttcgaaggtaatgcctcagcctcagtctccagcttctttccacagaatatttgccttggcgatattctgaagaactccggttacgagaattactttgtgcagggggctaacctgcgctttgccggcaaagacgtgtttcttaaatcccacggcttcgatcatctgtacggggcggaagagctaaaaactacggtggcggatcctacctaccgcaacgactggggcttctatgacgacactgtgctcgacgagacctggaaaaaattcgaagagctgtcgcagtccgggaaacgcttctcgctcttcgccctgacggtggatacccaccatcccgacggttttatctcacgcacctgcgagcgtaaacgctatgatgtggacggcaagaaaaacctctctttcagcgccgttagctgcagtcaggaacatatcgccgcgctgatagaaaagattaaagcctcaccctatttcaaaaacacggtcatcgtggtctcttccgatcacctggccatgaagaacagcgcctgggattatctcaacaagcacgatcgcagcaatctgttcttcgtcctgcgcggcgataaaccgcagcaggagaccctggcggtgaaacgcaacaccatggataacggcgcgacggtgctggatattctcggcggcgataactatatcggcctcgggcgtagcagcctctccggccagtcgctctccggtattttcatgaatatgaaagagaaagtcctggcatggaagcctgacgtgatccgcctgtggaatttccccaaagaaatgaagaatttcaccatcgactcgcaaaaaaatatgatcgctttctccggcagccatttccgcctgccgctgctgctgcgggtatctgaccagcgcgtagaaccgctgccggagagtgaatactctgcgccgctgcgcttccagctggccgatttcgcgccacgggataatttcgtgtgggtcgatcgctgctataaaatgggccagctgtggtcgcctgagctggcgctctccaccgactggtgcgtctcgcagggacagctggggggtgagcagaaggtccagcacgttgataagccgcagtggcacggcaagaccgccttcagggacacccttatcgatatggagcgctataagggcaacgtcgatacgctgaaaattgtcgacaacgatattcgctataaggccgacagcttcgtgtttaacgtcgctggcgccccggaagaggttaaacagttcagcggtatttcgcgtcccgagtcgtgggggcggtggtccaatgctcagttgggcagcgacgtgaagattgaatataaagagccgctgccggagaaatttgatctggtgatcaccgccaaagcttatggcccaaacgctaataagccgattccggtgcgagttggagaaagtgagcaagtgctcactctggataatgacgtgactaccacgacgctgcattttgacaacccaacgcgcagcaacacgctgatcatcaccccgccggacccgcaaaccactaacgagggcaatatcctcggccactccccgcgtcagttggggatcggcatggtggagatcaaagtggtgaaaagcgaaggctaa

SEQ ID NO: 1653 - DNA, 1590 bp, Klebsiella pneumoniae
accggtgcagacggtgctcgccagcgggcggcccctcagcctgcacggctgcgtctacgatctggcttccggccatttaaccaccctcgtcgaacacctctcaccgcaggagcacgccccatgaatacgtttcgtcaggactctctcgccggcatcgtcgtcttccttgtcgccctgccgctgtgcctcggcatcgcccaggccagcggcttaccgcccttcgtcggcctgctgaccggcatcatcggcggcctggtcgtcaccgccctcagcccctcccgtttcgccgtcagcggccccgccgccggactggtcaccatcgtcgtcgccgccattgaatccctgggttccttctccgtcttcctgatggcgctggtgctggccggcgtgctgcagttgctgttcggcatcctgcgggccgggcgctttatctcgctggttcccgccagcgtcatcaaaggcatgttggcggcgatcggcatcctgctgattatgcagcagatccccgtcgcactcggcacggcggaagagaccgggcttgccgatgtggttcagggcaatgccgctttctccgtcaaggcgattgccgtcgccgcgggcggtctgctggtgctctggctgtggggctcgccgcttatccgccgggtgaagagcctgcgctggatccccgggccgctgatcgccgtcctgctcggctgcgtgaccaccctgctgctgacccattttgcgccgcagcagctggccgctctgccgcgtattaccctgccggcgttcggcagcctcggcgacctgctgggcgagctggaatctccggcgtggaacgcgtggcgcaatccgtcggtgtgggtggtggcggtaaccctggcgctggtcgccagcctcgaaaccctgctcagccaggaggcgctgaaaaagctgcgtccgcaaaatccgccgccttcgccgaaccgcgaaatggtcgcccagggcgtgggcaatctgctctccggcgtgctgggggcgatgccgatcaccgcggtgatcgtccgcagctcggtgaacgtcagcaatggcgcgcaaagtaaactgtcgatctttatccacggcgtgctgctgctgatctgcggcctgtggttcagcggcctgctaaccttaatcccgctcgccagcctcgccgccgtgctgctgtataccggctataagctggcgaccccgcggctgttcatcgagcagttccgccagggggcggcgcagtacgtcccgttcctcgccaccatcggcgggattatcgcctgcggcatgctggcggggatcgggattggtcttgccacccagatggcattcagcctctggcgcagccatcgccactcgctgcagctggcgcgctacgatgaccactacgtgctgcgcatccagcagaatctgacctttatgcacaatccgcatctgctggccctgctggcgaagattccggaaaagagcgtggtgatcgtcgagcacgacagcgtcggctacctcgacccggacgtgcgggcggtgctggatgattttgccgagaacgccccgcagcgcggcatccgccttaatcagtggccgctggccagccgctga

SEQ ID NO: 1654 - DNA, 1095 bp, Klebsiella pneumoniae
aggagcggcctgatgcaggcgtttggcgtacttgaccgttatatcggtaagacgattttcaacaccatcatgatgaccctgttcatgctggtgtcgctctccggcattatcaagtgtgtcgatcagctgaaaaagtccgggcagggcagctacgatgcgctgggcgctggtctctacaccatcctcagcgtgccgaaggacatccagatcttcttcccgatggcggcgctgcttggcgcgctgctggggctggggatgctggcccagcgcagcgaactggtggtgatgcaggcatccggtttcacccggctgcaggtagcgctggcggtaatgaaaaccgcgatcccgctggtgctgctgaccatggccatcggcgagtgggtggcgccgcagggcgaacagatggcgcgcaactaccgtgcccagcagatgtacggcggctcgctgctctcaacccagcaggggctgtgggcgaaagatggccacaactttgtctatatcgaacgcgtaaaaggcaacgatgagctggggggcgtcagcatctatgctttcaacccggagcgtcgtttacagtcggtgcgctatgccgcttcggcaaaattcgatagcgaaaataaagtgtggcgtctgtcgcaggtggatgaatccgacctgaccgatccaaagcaggtgaccgggtcgcagatggtgagcggcacctggaaaaccaacctgacgccggacaaactgggcgtggttgccctggatccggatgcgctgtcgatcagcgggctgcacaactatgtgaaatacctcaagtccagcggccaggatccgggacgctaccagctcaatatgtggagcaaaatcttccagccgctgtcggtggcggtgatgatgctgatggcgctgtcgtttatctttggcccgctgcgtagcgtgccgatgggcgtgcgggtggtgacggggattagcttcggctttatcttctatgtcctcgaccagattttcggcccgctgaccctggtctacggcataccgccgatcatcggcgcgctgttgccgagcgccagcttcttcctgataagcctctggctgatgatgcgcaaggcctag

SEQ ID NO: 1655 - DNA, 597 bp, Klebsiella pneumoniae
attatgaaagattacaagcctcgttacgaagaactttatagatattatcaggtctggttgactgattttacgaagctgacggtcagatcggggatgtgtcaccagaatatctaccaccatcataccctgacggttggcagccttaagtttccgggagaggaagaggttattgctattgtcccccagtgcctgcaccggattatttatggtagagcagcagccccactgactgttaatgaagacctgagcgtcagtttatttacccaggagcatctgctggctcaccatcccatgctggaggggattttgctgtctgagtgcgtgcgtttaaaacaacgccctctggcaaataagctcatcagtttgttccgccagttcagcggtagtgagctacgtctgaagctggtctggctgtgctggtacgatttgatgctggggaattgccttgatgactggaccgacaacctcaggttcaaaaaagacaaagagatggatatctggatcaatgaccggcaggctgaaaaccctgcgctgaccagtatgatggacgagtatgtctgctttgcatggcggacgacagctgaaccactgagttag

SEQ ID NO: 1656 - DNA, 1047 bp, Klebsiella pneumoniae
caaaaccgagatgaagaaattcggcattacggtcgccaccgtgacccttttctttacccgaaccacagcagaagagaggacagcgccatgaacacgcaacctgtcattgggatcagcggatgtttaaccggctcagccgtgcgattcgacggcgggcataagcgtatgggctttgtgatggatgagctcgcgcagtgggtagcgtttaaacccgtctgcccggagatggcgattggcctgcccgttccccgcccggcgctccgcctggtgcagaccccggtcggggagatccgcatgcgcttcagccacgctccgcacgaggatgtgacggagaagatggccgatttcgccaacgcccacctggcaaccctgggcgagctgtcgggctttatcgtctgcgccaaatcgccgagctgcgggatggagcgcgtgcggttgtatgacgaaaaaggcaatcgcgggcgtaaggaaggcgtggggctgtttaccggcgccctgatggcgcgctacccgtggctgccggtggaagaggatggccggctgcacgatccgctgctgcgggagaattttgtcgagcgcgttttcgccctgcatgaactcaacgccctgcgcgcccgcggcctgacccgtcacggtctgctggcctttcacagccgctacaagctgcaactgctggctcatcaccaggcgggctaccgggagatcggcccgttcgtcgcctcgctgcatgaatgggaggatctggaagcgttcttcgaggtttaccgcgagaagctgatggcgatcctcaagcagcccgcctcgcggaaaaaccacaccaacgtgctgatgcatattcagggttatttccgcgaccagctgaacagccgccagcgcggcgagctgcgggaggtgatcctcaactatcgcgccgggctgctgccgatcctcgccccgctgacgctgcttaagcactatctggccgagtatccggatcgctacctgcaggcgcagaactattttgatccttacccgcaggatctggccctgcgcctgacggtgaactga

SEQ ID NO: 1657 - DNA, 456 bp, Klebsiella pneumoniae
ggagatagtttaatgaatacacaaaatcatcagttcgcgaagcataccgcaattactgcctcagtggtcccggacgagttacgcatcggcttctggccgcagcactttggctccatcccacaatggataacgcttgagcctcaaatctttgcctggatggatcggctgtgtgccgattaccacggtgatatctggaacttttcgacactcagtaacggcggcgcatttatggctccggagtcagagcacgatgagaagtgggcattgttcaacagcatgaacggcaatggcgcagagcttactagtgaagcagcagggatagtcgcctgcctgatggcatacagccaccaggcctggcgtaccgaatgtgacacgatgactgtgcactattatcgcttacgcgactacgcgctgaaccatccggagtgcagcgacattatgcatatcatcgactga

SEQ ID NO: 1658 - DNA, 225 bp, Klebsiella pneumoniae
ccctggcaggagagaagaatgaaaattttccaacgctacaatccgctgcaagtggcgaagtacgtgaagatcctgtttcgtggacggttgtacatcaaggacgttggcgcatttgaatttgataagggcaaaatccttatcccgaaggtcaaggacaagctgcatctgtcagtgatgtccgaagtcaatcgtcaggtgttgcgtctgcaaactgagatggcataa

SEQ ID NO: 1659 - DNA, 1500 bp, Klebsiella pneumoniae
aagcgaaaggattgtcacttaattggtaacgcttacactggcgtgccggcatggacaagaggatgtttaatgcctgattttctctcatttatcaatgaaatactctggggctcagtgatgatttatctgctactgggtgccggtatctggtttagctggcaaacccggggtattcagtttcgttacgtgcgcaaattcggccgcagtctaaaaaaaagcctgcacccgcagccgggtggtttaacgtcctttcaggcgctctgtaccagccttgccgcccgggtcggcagcggcaatcttgccggggtgacgctggcgatcgccgccggtgggcccggcgccgtattctggatgtgggtttccgccctgctcggcatggccagcagctttgctgaatgttcccttgctcagctgtataaagaacgcgatagccgcggacagtttcgcggtggccctgcctggtacatggcgcgcgggctcggcatgcgttggatgggcgtcctgttttcgatcctcctcctgctggcctatggttttatcttcaataccgtgcaggctaactccgtggcccatgccttgcgctatgcgttcgatctgccggcggcggtcagcggcggcgtgctggccgtggtcgttttgctggcgatcctccgtggtttacgcggcgtggcgcgtctgatgcaatggatcgttccgtttatggcgctgttgtggatcgccaccagcctgctcatcggcctgtggcacatcaccgccctgccgacgattttcgccaccatctttcgctgcgccttcggctggcaggaggccgccgccggcgcggtgggctacaccatcagccaggcgctgaccagcggcttccagcgcggcatgttctccaatgaagcagggatgggctcttcgcctaacgccgccgcggccgctgcctcctggccgccgcacccggcggcgcagggggtcgtgcagatgattggcgtgtttatcgatactatcgtgatctgtaccgcaagcgcgattatcgtcatgctggcgccgcggcccgacaatgaatatacgctcaacggtattcaggacttgcaacacgcgatgagcgtgctggtcggcggctggggagcgggttttatcgccctcatcgtgctgctgttcgcctttagctctatcgtagccaattacgtgtacgcggaaaataatctggtcttcctgcgcctggataagccgcgctatatctgggggctgcgaatactcaccgtcctgatggtgctgttggggaccatggttagcctgcctgtcgtctggcagagcgcggatatcatcatggcgctgatggcgatgaccaacctgacggccattctgttgctctccccgacggtgcggattatcgccagcgattatctgcgtcagcggcggctgggtatccagccgactttcgatgccactcgttacccggatattgaccaacagctggccccgggcgcctggaatgaattgccgcgcgaatag

SEQ ID NO: 1660 - DNA, 828 bp, Klebsiella pneumoniae
tcggcgaaggagagtgccatgtcgttactggctaaatcgcgaaaagagggacagatccagcatattacgccgcaaagcgccggttggcgctatatcggctttgatgtctggatgttgaaaaaagggcagaccgtgacgctggagagcggcgatcgcgagctgtgcctggtgctggtcgccgggctggcgtcggtgaaaacgcagcatgccgatttcccgaatctcggtaaacggatgtcgccgtttgaacgcaccccgccgtggtcggtctacgtcccgccgcaggataaagtcgaggtgactgccgattccgatctggagctggcggtatgcagcgcgccgggcaaaggccgcttcccggcacgcctcattcggccggaagacgtcggcgtagagcaccgtgggaaagggcgcaaccagcgccgggtgcataatattctgccggacagcgccgaggcggactgcctgctggtggtggaagtctacaccgacgagggggccaccagttcgtggccgtcgcataagcatgataccgcccagccgggcaaagagacgcagctggaagaaacctactatcaccgcttcgatccgccgcagggctttgccttccagcgggtctacaccgacgaccgcagcctggacgcctgtatggcgccctacaaccacgatgtggtgatggtgccgcgcggttaccatccggtggcagcgattgccggttacgatagctactatctgaacgtgatggccgggccggaccggaaatggctgttcacctgggaagatgaccacgcttggatcaacacgccggagtacccgcgccacgactga

SEQ ID NO: 1661 - DNA, 315 bp, Klebsiella pneumoniae
gttgccgaggaagtctcgccagaactggacccgcatctggttacgaaaatcggagatttcctcgagcttacaggtatagctctgggtcacgccaagcagctgagtagggggcagagtgataaactcatgtttcggcagggtaaattcgccaagacgcagcggcgggcgcataccgaacgagctccagtccggcgagcggcggtagagcgccggcgtcagcgagaattgtttcttaaacgctcgggtgaaggtctgctgggagtcgaaacggtactgcagcgcaatatcaaggattggacgggcggtcaggcgtaa

SEQ ID NO: 1662 - DNA, 975 bp, Klebsiella pneumoniae
ccctacgaggatacccttatgtggaagcgcttacttcttgtcacagcagtttccgcagctatgtcgtctatggcgatagctgccccgctaaccgtaggtttttcgcaggtcggttctgaatccggctggcgtgcggcggaaaccagcgtcgcgaaagaggaggccgccaagcgcggtatcaccctgaagatcgctgatggtcagcaaaaacaggaaaaccagatcaaagcagtgcgttcctttatcgctcaaggggtcgacgcgatcttcattgcgccggtggtggccaccggctgggaaccggtgctgaaagaggcgaaagaggccaagatcccggttttcctcctcgaccgttccattgatgttaaagataaagatctctacatgaccaccgtgaccgccaacaacgtgctggaaggccagctgattggcgactggctggtgaaaaccgtcgacggtaagccgtgtaacgtcgttgaactgcagggcaccgttggggccagcgtggccatcgatcttaagaaaggcttcgccgacgcgattgccaaagcgtcgaatatcaaaattatccgctcccagtccggcgacttcacccgcagtaaagggaaagaggttatggagagctttatcaaagctgagaataacggcaaaaacatctgcatggtgttcgctcataacgacgatatggccatcggcgccatccaggccattaaagaagctggcctgaagccgggcaaagatattctgaccggctccatcgacggcgtgccggatatctataaagcgatgatcgctggtgaagccaacgccagcgtcgagctgacgccaaatatggccggcccggcgttcgatgcgctggagaaatataaaaaagacggcaccctgccggagaagctgaccatcaccaaatcgacgctgtatctgccggatacggcgaaagaagagttagagaagaagaaaaatatgggctactga

SEQ ID NO: 1663 - DNA, 639 bp, Klebsiella pneumoniae
aaaaacgaggacataacgatgaccagactaaagaatgccaatatgttgctggcgctcttcttaggcttagccgcgttgaacgcctcggcagagacggaaaaaacaacggtagacagtgcgaagtcggctgccagcaatgcgggagaggcggtagataattcgattaacaaagtcggcgattttatggatgacagtaccattaccgcacgggtaaaagcggcgctgatcgaccataaagatattaactccggcgatatttcggtgaaaacggagaataaagtggtcaccctcagcggcgacgtcaccagtgctgaacagaaaagtcaggcactgagcgtagcgaaagaggtcaaaggcgtctcacacgttaacgacaagctgacggtccatcataaatcatcgagcgagacggcgacgctgaaaggctatgccggggataccgccattaccagcgaagtgaaagccaagctgctggcggatgacattgtcccttcgcgcaatgtgaaagtcgaaaccaacgccggcgcggtacatctgaccggtacggtggcttccgcggcgcaggcggagcgtgccgcagagattgcgaaagcggtctccggtgtgaaaagcgtgcgcaacgatcttagcgttaagtaa

SEQ ID NO: 1664 - DNA, 600 bp, Klebsiella pneumoniae
tctcgtcgggatttatgccgggaaagaagcgtttcgctacaaacaaataaaataatccaactgttttttcattactttattgttttaaacaacaaaagctttattacacgatttgaggacaacattatgcgactgccttacgtaatatttacattagctatgctggcttctgtatcaacagcacaggctattcccaatatgtggacgagtggttttgggatgggcgtgaccgaatatatcattaccagcccggataaggtggtgtttaatctgaactgtactggcaatccggatgcgcagaatattctgcaacacggtgttgatctcaccctgcctgatggaacatcagtaagttctcaggacgacgggacggaaataacggtcgtcatggatagcagccagtatccgttaccgtcattcctcggctggcgaaacggtgacaatgcctgggtgtcatttattgacgccctgagccaggctgcgaattttgatgtttacgtcaacgataaaaaagtcggcaccttcagtccggggctgaagaatacgcagaaagaattatctgacctcagtggctgcagaaccacccattacagcgattaa

SEQ ID NO: 1665 - DNA, 1017 bp, Klebsiella pneumoniae
aaatgcagggaacgagttatgaaaacgttaggtgagtttattgttgaaaagcagcacgagttctcccacgccaccggtgagctgactgctttgttgtcagcaataaagttgggcgccaagatcatccaccgcgatatcaacaaggccggtctggtcgatatcctgggtgccagcggtgctgaaaacgttcagggcgaggttcagcaaaaactcgatctgttcgctaatgaaaaattaaaagccgcactgcgagcacgcgatattgttgccgggatcgcctctgaagaagaagatgagattgtcgtcttcgaagggtgtgaacacgccaaatacgtggtgctgatggaccctctggatggctcctctaacatcgacgttaacgtctctgtcggtacgatcttctctatctaccgccgcgtgacgcctgtcggcacgccggtgacagaagaagacttcctgcagccgggcaacaagcaggtggccgcgggctatgtggtctacggatcgtcgacgatgctggtgtataccaccggctgcggcgttcacgccttcacctacgacccgtcccttggcgtcttctgtctatgccaggagcgcatgcgcttcccggagaagggcaatacctactccatcaacgaaggcaactacatcaaattcccgcagggcgtgaagaagtacattaagtactgtcaggaagaggacaaagcgactcagcgtccttatacctcacgctatatcggctcgctggtggcggacttccaccgcaacctgctgaaaggcggcatctatctctatccgagcaccgccagccacccggaaggcaagctgcgcctgctgtatgaatgcaacccgatggccttcctagccgaacaggcgggcggtaaggccagcgacggtaaagagcgtattctggatatcatcccggaaagcctgcatcagcgtcgctccttcttcgtcggcaacaaccacatggtagaagacgtcgagaactttattaaagcgttcccggacgcctaa

SEQ ID NO: 1666 - DNA, 945 bp, Klebsiella pneumoniae
gcaggcagggatgagccgatggcaaagggcaccacctcgacgccgcatgatgcggtgtttaaacagttcctcactcaggccgacaccgcgcgtgattttctggcgattcatttaccgcctgcgctgcgtcagcgctgcgacctcgataccttacagctggagtcggcaagctttatcgaggagagcctgcgggcctggtactccgatgtgctgtggtcactcaaaaccgcgtctggcgagggctacatttatgtggttatcgaacatcagagctcgccggatgcgcagatggccttccgcctgatgcgctacgccatcgccgcgatgcagcgccatcttgatggcggtcatacaaaactgccgctggtggtgccgatgctgttctatcacggagcgaccacgccatacccgtggtcactcaactggctggactgttttgccgatccacagctggcgagtgagctttatatctcgccctttccgctggtggatgtcacggtgatccccgacgatgagatcgttcgccaccggcgcgtggcattactcgagctgatacagaagcatattcgccagcgcgatttaatgggcattgttgagcaactgacgacgattttacttagcggggacgctaatgacagacagctaaaaacgctgtttaattatctgctgcagactggcaacgcgcgccgctttggccggtttatccacgaagtggcgcaacgggttcctcagcacagggaaagattgatgaccatcgccgaaagattacaggaagtaggccgtagaaaaggcaaacgggaaggccggcttgaaggcagacaagaaggacagcatgccgaggcgctgcgcatcgcacagaggatgctggacgacggtattgcccgcgagacggtggtgaaaatcaccggcctggccgccgacgagatcgccgcgctggcgcattga

SEQ ID NO: 1667 - DNA, 612 bp, Klebsiella pneumoniae
cgccacagtttgaacggaataaccatgaataccttacgaatcggcttagtttccatttccgatcgcgcctccagcggcgtctatcaggacaaaggcatcccggcactggaagagtggctggcacgtgccctgaccacccctttcgagctgcaaacccgtctgattccggatgagcaggccatcatcgagcaaacgctgtgcgaactggttgacgaaatggggtgccatctggtgctgaccaccggcggaaccggccctgcgcgtcgcgatgtgacgcccgacgcaacgctggcgatcgccgatcgcgagatgccgggcttcggcgagcaaatgcgccaggttagcctacactttgtgccgacggctatcctttcccggcaggtcggtgtgatccgcaagcaggcgctgatcctcaaccttcccgggcaaccgaaagcaattcaggagactctggaaggggtgaaagatgctgacggcaacgtgctggtgcacggtattttcgcaagtgtaccttattgtgtacagttgcttgaagggccttatgtggaaaccgatggccgtgtagtagaagcttttcgccccaagagcgccagacgcgaaactttatcctga

SEQ ID NO: 1668 - DNA, 1548 bp, Klebsiella pneumoniae
ttcgctctactaatccaccttccggggcgcctgccgccccggcttaaccagccaggggatgctatggaacctttcctttcccttcgacacgtcagcaaaaccttccacgccaaccgcgcgctcaatgatatcagcatcgactttatgcccggagaagtgcactgcctggccgggcagaacggttgcgggaagtcgacgttgatcaaaattatctctggcgtctatcgcccggatgagggcgcagcgatgacgctgggcggcaagacgtggcccaaactgacgccagcggcctctgtcgcccatgggatccaggtgatttatcaggatctgtcgctgtttcccaatctcagcgtgtgggagaacattgctataaaccactatcatcgcggcgtgctggtgaggcgcagcgaactgcgacgcagtgcggagcaggcgatgcgcagtattaacgtctcgctgccgctggatgccgccgtggaatcgctctccatcgctcgctgtcagctggtggctatctgccgcgcgctggcgcaggatgcccggcttatcattatggatgaacccacggcctcattgacccatcaggaagtggagggactattgcatgtggtgcgccagctgcgtgagagggggatctgcatcgtcttcgtaagccaccgtctggaagaggtcatggccgtatcggaccgcatcagcgtgctgaaggatggcaatctggtcggcaccttgccggcggcagaggtaaccacccgccggctcggttttctgatgacgggccaggaatttgactatcaggtgcgcgatctgtggcaggggcagggcagtacgccggtgctggaggtgcgcaatctcagccgcaaaggggaatatcataacgtctccctgaaggtcgaagccggagaagtggtgtcgatagtcggactgttgggcgccgggcgaacagagctgtgcctgagccttttcggcatgacccgccctgacagcggcgagatcctgataaatggccagccggtgcggttgcgtagcaatcaggacgctatccgccacggtatcggctatgtctccgaggaccgtatgtcgcgcggcctggtgatgagtcagtcgattgaaaacaacattatcagcaccgtgtttcataaagtgaaaggcgcttgcggactattgagtgatagtaaagctcagcagctggtcgcaagaatggtcaacgcgttgaccattaaggcgccggatacgcatctgccggtgaataccctctccggtggtaatgcccagcgcgtttctattgccaaatggctggcgatctctcctaagctgctgatcctcgatagcccaaccgtgggggtggatatcgcaaacaaagccgggatctatcatatcatcagcgatttggctgcccatggtatcgccgtgctgatgatttgcgacgagattgaagaggcgtggtaccagagtcatcgcatcctggtgatgaagcagggcgagttgacccatagcttcctgccggacagcagtacccagcagcagatagcggaggtggtcaatggctaa

SEQ ID NO: 1669 - DNA, 3780 bp, Klebsiella pneumoniae
attatgagtttatggaagaagataagcctcggcgtcttaatcgtgttggtgctcctgctgggcaccgtcgggttcctggtggggaccaccaccggcttgcatctggtgttcaaagcggcggatcgctgggtaccggggctggaaatcggcaaagtgaccggtggctggcgtgatttaaccctcgataatgttcgctacgaacagcccggggtggcggtcaccgccggtcagtttcacctcagcgtcaggttgcgctgcctgtgggacagcagcctgtgcgtaaacgacatcgcgctgcgcgatatttacgtcgccgtcgataccaagaagatgccgccctcagcgccggtcgaggaagaggacagcgggccgctgaatctctccactccttatccgatcaccctcagccgcgtcgcgctgcataacgtcaacgtcaaaatcgatgataccgcggtctccgtacgcgacttttccaccggcctgaactggcaggagaaaaatctgaccctaacgccgacctcgctgcaggggctgctgatcgccctgcctaaggtggcgaaagtggcgcaggagcaggtggttgagccgaaaattgacaacccgcagccgcaggaaaaaccgctcggcgagacgatgaccgacctcttctcgcagccggtgctgccggcgatgaccgatgtccatctgccgctgaacctcaatattcaggcgttccgcggcgagcagctgcgcctgaccggcgataccgatatcaccgtgtataacctgctgctgaaagtcagcagtatcgacggccagatgaagctcgacgcccttgatatcgactccgatcagggcaaggtcagcgcctcgggcagcgcgcagctgcaggataactggccggtggacattaccctcgccggaaccctgaacgtcgacccgatgaaaggggagaaggtgcagctgaaggtgggcggcgaagtgcgtaaaacgctcaaagtcggagtggacttaagcgggccggtcgtggccacgctgcgcgcggatgcgcagctggcggaggccgggctgccgctcaatatggaactgaagagtaagcagctcgcctggccgttcagcggcgagaagcagttccaggccgacgatgtccagctgaagttcagcggcaaaatgaccgactatgcgctggccttctccaccgcggtgaaaggtcaatcgctgccgtcggcgaaaatcgacctcaacgccaaaggcaatgaacggcagatcaatctcgacaagctgacggtcaatgccctggaagggaaaaccgagctgaaggcgctgctcgactggcagcaggcgatcagctggcgcggcgagctgaccctcgacggcatcaacaccgccaaagaggtgccggactggccgtcgaagcttaacggccggatcaagacccagggcagcctgtacggcggcagctggcagatgtcggtgccggagctgaaaattaccggcaacgtgaagcagaacaaagtggatgtggcgggctcgctgcagggtaacagctatctgcagtggaaaatcccgggactgcatctggcgttgggcccgaacagcgctgatatcaaaggcgagctgggggtgaaggatcttaatctcgacgccaccatcgatgcgccgcacctggataatgcgctgccggggctcggcgggacggcgaagggcttggtaaaagtgcgcggcactgtcgatgcgccgcagctgctggccgatatcaccgcccgggcgctgcgctggcaggagctgaccatcgcccaggtcaacgtcaaaggggatgtgaaatccaccgatcagattggcggtaacctggacgtgcgggtggatcgcatcagccagccgggggtcaatatcagccaggtgcagctcaatgccaaaggtacagagaaacagcatgagctgcggctgcgcgtgcagggcgatccggtttccggccagctgacgctggcaggcagcttcgatcgtcaggccgaacgctggaagggctctctgagcgatacccgcttccagacgccggtggggccggtagcgctgacgcgcagcattgcgctggactatcgcaatctggagcagaaaatcagcatcgggccacactgctggaccaacccgaacgccgagctctgcgtgcctgaaaccattgacgcgggcgccagcggacgggcgcgggtgaatctcaaccgcttcgatctggcgatgctcaagccgtttatgccggaggcgacccaggccagcggcgtgtttactggtaatgccgatgtgagctgggacaccaccaaagagggactgccgcagggcaaagtgaccctcagcgggcgcaacgtcaaggtgacccaggtcgtcaacgacgcgccgttgccggtggcgttcgatacgcttaacctcagcgccgacctgcacaacaatcgcgccgagctgggctggcttatccgcctgaccaacaatggtcaactggatgggcaggtgcaggtcaccgacccgcaggggcggcgtaacctcggcggcaacgtcaatatcagcaacttctcgctggcgatgatcaacccgattttcgctcgtggtgaaaaggcagagggaaggctcaacgcccgtctgcgtctgggcggcaatgtgaaaagtccgcagctgttcggccagatgcagctgagcggggtggatatcgacggcaactttatgccgtttgatatgcagccgagccagctggcgatgaacttcaacggcacgcgctcgaccctgcaggggacggtgaacacccgccaggggcaaatcgccctcagcggtaacgccgactggacgcagatcgataactggcgggcgcaaattgcggcgaaaggcagccgggtgcggatcacggtgccgccgatggtgcgtctcgatgtatcgccggatgtggtgtttaccgccacgccaagcctgttcaatctcgacggcaaagtggatgtgccctgggcgcggatcgtggtcaacgaggtgccggagagcgcggtcggcgtctcctctgatgaagtgatgctggataaaaacctcaagccgattaagcagcagagcgccagcatcccgatcaacagcaacctgaccattcacgtcggcaacaacgttcgtctggaagccttcggcctgaaagcgcgtctgaccggtgatttgaaagtggcgcaggacaagcaggggctgggcctcaacgggcagattaatattccggacggccgtttccacgcctatggtcaggacttgattgtccgcaaaggggagctgctgtgctccggtccgccggatcagccgttgctgaatatcgaagcgattcgtaacccggatgccaccgaagacgatgtgatcgccggcgttcgcgtcaccggctccgccgatcagccgaaagcggagatcttctctgatccggttatgtcccagcaggaagcgctgtcttatctgctgcgcggccagggtttgagtagtggtcagagcgatagcgccgcgatgacctcaatgcttattggtatgggggttgcacaaagtggtcaggttgtgggtaaaatcggcgagacgtttggcgtaagcaacttggcgttggacaccgaaggggtaggcgattcttcccaggtggtggtcagcggctatgtactgccgggtctgcaggtaaaatacggggtcggtatcttcgattccctggcgacgctgactttacgttatcgcctgatgcctaagctatatgtggaagcggtgtctggcatcgaccaggcgctcgatttgctctatcagtttgagttttag

SEQ ID NO: 1670 - DNA, 717 bp, Klebsiella pneumoniae
atgattgcactagaaatgcgcaacctcggcggtggtgaaattttacatgcctgtccgcaggagagtctggataagcccttgccctgtatcgtcttttatcatggctttacctcgtcgaagctggtctacagctactttgcggtggcgctggccgaggccggattccgggtgatcatgccggacgcgccggagcatggggcgcgctatcagggcgatgaggccgggcggatgcagcgcttctggccgattctgcagcagaatttcagggagtttcctgcgctgcgcgaggcgataatcgctgaaggatggctggaaggggagcggctggcggtggcgggcgcttcgatgggtggaatgacggcgctgggcatcatgacgcatcaccccgagctgaacagcgtcgcctgtctgatggggtcgggctattttcgttccctgtcgcaaaccctgttcccctcgcctgattttgatgtcgatagcctcaacgaatgggatgtcagccatcagctggcgtcccttgcccggcgaccgctgctgctctggcatggcgatgccgatgacgtggtgccgccggaagaaacctttcgactagaacaggcgctccggcaaggcgatcttgccgccaggctgacctgtgtctggcagaaaggcgtccgacatcgcattacgccagaggcgctggctaccacggtcgccttttttcagcagcacctttaa

SEQ ID NO: 1671 - DNA, 2775 bp, Klebsiella pneumoniae
caggtaggttttgctacgcccgtcggcaacgctgcgttcgctttggcgagcgcggagggactgtttatgctgaaaaattatacccggcagctgttcgcgcagcttagccgccatctgccacgtcgtttagtccagcgcgatccgctgccggacgcccgccatctggcgagtggccccattcctgaatcgcttggtcagcattgcctgaacgtggcggcgatggacgaccaggagatctggcgcgcctttgacagccaccctgaagggctcaatgaaggcgaagtggcggcgaaaatcctcaaacatggtgacaaccagatcccggcgcagaagccctccccgtggtgggtgcatctgtggacctgctatcgcaacccgttcaacctgctgctgaccgtgctcggcatcgtctcctattccaccgaggatctgttcgccgccggggttatcgccctgatggtggggatctcgacattgctcaatttcatccaggaggcgcgctcgaccaaagcggcggatgcgctgaaggcgatggtgagcaacaccgccaccgtgctgcgggtggtgaacgagcagggggagagccgctggctggagctgcctatcgaccagctggtgccgggcgacattatccggttgtcggcgggggatatgatcccggcggacctgcgtatcctgcaggcgcgggatctgttcgtcgcccaggcctcgctgaccggcgaatcgctgccggtggagaaagtggctcgcagccgcgatccgctgcagcaaaacccgctggagtgcgacaccctgtgctttatgggcaccaacgtggtgagcggctcggcgcaggccatcgtcttcgccaccggcggccgcacctggtttggccagctggccggccgcgtcagtgaacaggagagcgagccgaacgcctttcagaagggcatcagccgggtcagcatgctgctgattcgctttatgctagtgatggccccggtggtgctgctgatcaatggctacaccaaaggcgactggtgggaggcggcgctattcgcgctgtcggtggcggtcggcttgacgccggagatgctgccgatgattgtcacttcgacgctggcgcgcggggcggtgaagctgtcgaagcaaaaggtcatcgtgaagcacctcgacgccattcagaatttcggcgcgatggacatcctctgcactgataaaaccggcgccctgacccaggataagattgtgctggagaaccataccgacgtctccggcaaggtctgcgagcgggtactgcatgccgcctggctcaacagccactaccagaccggcctgaaaaacctgctcgacaccgcggtgctggagggcgttgagctggatgccgcccgcgggctggcggaacgctggcagaaggtggatgagatacccttcgacttcgaacgccgccgcatgtcggtggtggtgaaggaggatgacgccgcgcatcagctgatctgcaaaggggcgctgcaggagatcctcaacgtctcgacccaggtgcgctacaacggcgatatcgtaccgctggacgacaccatgctgcgccgcattcgccgggtgaccgataccctcaaccgacaggggctacgggtggtggcggtggcgaccaaatacctgccggcccgcgaaggcgactaccagcgcgccgatgagtcggacctgatccttgaaggttacatcgccttcctcgatccgccgaaagagaccaccgccccggcgctgaaggcgctgaaggccagcggcatcacggtgaagatcctcaccggcgacagcgagctggtggcggcgaaggtgtgccatgaagtgggactggatgctggcgaagtggtgattggcagccagatcgaagccatgagcgacgacgaactggcggcgctggccaaacgcaccacgctgttcgcccgcctggcgccgctgcataaagagcgtatcgtgacgctgctgaaacgcgaaggtcacgtggtgggctttatgggcgacggcatcaacgacgccccggcgctgcgcgcggcggatatcggcatctcggtcgacggcgcggtggatatcgcccgcgaggcggcggatatcattctgctggagaagagcctgatggtgctggaggagggggtaatcgaaggccgccgcaccttcgccaacatgctcaagtacatcaaaatgaccgccagctccaacttcggcaacgtcttcagcgtgctggtggccagcgccttcctgccgtttctgccgatgctgccgctgcacctgttgattcagaacctgctgtacgatgtctcccaggtggcgatcccgtttgataacgtcgatgatgagcagatccgcaagccgcagcgctggaacccggccgatctcgggcgctttatggtcttcttcggaccgatcagctcgattttcgatatcctcaccttcggcctgatgtggtgggtgttccacgccaataccgtggagatgcagaccctgttccagtccggctggtttatcgaagggctgctgtcgcaaacgctgattgtgcacatgatccgcacccggcgcattccgttcgttcagagccgggccgcctggccgctgttcgccatgaccctggtggtgatggcggtgggtatcgcgctgccgttctcgccgctggctagctacctgcagctgcaggccctgccgctgagctacttcccatggctggtagcgatcctggcgggctatatggtgctgacccaggccgtgaagggcttctacagccgccgctacggctggcagtga

SEQ ID NO: 1672 - DNA, 1725 bp, Klebsiella pneumoniae
aaaaggcaacttgcgttgcctttttgcgttttatttcgcgatacgtttgtacttgattcgcttcggctccagcgcgtcggcgccgagagtgcgtttcttgtactcttcgtactcggtaaagttaccttcgaagaactcaaccttaccttcatcctggtaatccagaatgtgggtggcaatacggtcaaggaaccagcggtcgtgcgagataaccatcgcgcagcccgggaactccagcagggcgttttccagcgcgcgcagggtttcgatatccaggtcgttggttggttcatcgagcagcaggacgttaccgccgacctgcagcagtttcgccaggtgcagacgaccacgttcaccgccggacagctcgccaacgcgtttaccctggtcgacgcctttgaagttaaaacggcccacgtaggcgcggctcggcatctcggtgttgccgatcttcatgatatccaggccgccagacacttcttcccacacggtcttactgttgtccatcgcgtcgcggaactgatcgacggaagccagcttaacggtttcacccagggtgatggtgccggaatcaggctgttcctggccggacatcatgcggaagagggtggatttacccgcgccgttcggaccgatgatgccgacgatagcgcctttcggtaccgagaagctcagatcgtcaatcagaacgcggtcgccgtaggatttgcgcagatggctgacttccagaactttatcgcccagacgcgggccaggcggaatgaacagttcgttagtctcgttacgtttctgatattcaacgttgttaagctcttcaaagcgcgccaggcgggctttgcccttagactgacggcctttcgcgccctggcgaacccactcgagttctttctcgatagatttgcggcgtgcggcttcctgagaagcttcctgcgccagacgctggtctttctgctccagccaggaggagtagttgccttcccacggaataccttcgccgcggtcaagctcgaggatccagccggcgacgttatcaaggaagtaacggtcgtgggtaatcgccaccacggtgccttcgaagtcgtgcaggaagcgttccagccaggcgacggactcggcgtcgaggtggttggtcggttcgtcgagcagcagcatatccggtttttccagcagcagacggcacagcgcgacgcggcggcgttcaccaccggaaagattagcgattttcgcatcccagtccggcaggcgcagggcgtcggccgcgcgctccagttggacgttcaggttgtggccgtcgtgcgcctggataatctcttcgaacttgccttgctgtgcggcaagcttatcgaagtccgcatccggctcggcgtatttggcatagacttcgtccagccccttcagcgcgttaaccacttcggcgaccgcttcttccacggactcgcgcacggtgtgctccgggttgagctgcggctcctgcggcaggtagccgattttgatgccgggctgcggacgcgcttcaccttcgatctcggtgtcgataccggccatgatgcgcagcagggtagatttaccggcgccgttcagaccgagcacaccgattttcgcgccagggaaaaagctgagggagatatttttcaaaatatgacgtttcggcggaaccactttgccgacacgatgcatggtataaacgaattgagccacgttggacttcgcctctttctattttga

SEQ ID NO: 1673 - DNA, 1260 bp, Klebsiella pneumoniae
tcgcttttttgcagcgcaagatgtatggagaacaagatgaaacgtgcatttatcatggtgctggactcctttgggattggcgcaacggaagacgcagaccgctttggcgacgtcggcgccgatacgctgggccacattgcagaagcctgcgccaaaggcgaggctgaccacggccgcaaaggcccgctgaatttaccgaacctgacccgtctgggtctggtgaaagcgcatgaaggctccaccggtaaaattgccgcgggtatggatggcaatgccgaagtgattggcgcctatgcctgggcgcatgaactttcttccggtaaagataccccgtccggccactgggaaatcgccggcgtgccggtgctgtttgactggggctacttcagcgaccaggaaaacagcttcccacaggagctgctggataagctggtgaaacgcgccaacctgccgggctatctcggcaactgccactcctccgggacggtgatcctcgatcagctcggcgaagagcatatgaaaaccgggaaaccgatcttctatacctccgctgactcggtgttccagatcgcctgtcacgaagagacctttggcctcgacaagctgtatgagctgtgcgaaatcgcgcgtgaagagctgaccgaaggcggctataacattggtcgcgtgattgctcgtcctttcgtgggcgacaaagccggtaacttccagcgtaccggtaaccgtcacgacctggcggtagagccgccggcgccgaccgtgctgcagaagctggtcgacgagaaaaacggccacgtggtgtccgtgggtaaaatcgccgatatctacgccaactgcggtatcactaagaaagtgaaagccaccgggctggacgcgctgttcgacgcgaccatcaaagagatgaaggaagcgggcgacgagactatcgtcttcactaacttcgtcgattttgactcctcctggggccaccgtcgtgacgtcgctggctatgcggcgggtctggagctgttcgaccgccgtctgccggagctgatggagctggttggtgaggacgacatcctgatcctcaccgccgaccacggctgcgacccgacctggactggtactgaccacacccgcgagcatatcccggtgctggtgtacggcccgaaagtgaaaccgggttcgctcggtcaccgtgaaaccttcgcggacatcggccagactattgcgaaatactttggtacgtctgacatggaatatggcaaagccatgttctga

SEQ ID NO: 1674 - DNA, 279 bp, Klebsiella pneumoniae
tatatgaaactgaaaatcatcgccatgatggctgcgcttttcttcagcgccaacgcgctggcagctatccaaatcaccgaacgtcaggcccgcaacatggacgacgtgcagagcctcggcgttatctatatcaatcacaatatggccactgagcacgaggccgaacaggcccttagccagatgagcgatgcgcagggggcgaaatactttcagcctatcctgatgcacgaacccgaaaccaacggcccgcttcgcgccagcgcggtgatataccgctaa

SEQ ID NO: 1675 - DNA, 1284 bp, Klebsiella pneumoniae
ccaatgaaactgtataacttaaaagatcataacgagcaggtcagctttgcgcaggccgtcacccagggacttggcaagcatcagggcctgttctttccgcacgatctgccggaattcagcctgactgaaattgacgacatgctggcgcaggactttgtcacccgtagcgccaaaattttatccgcctttatcggcgatgagatcccgcaggatgtcctgcagcagcgggtgcgcgcggcgtttgcgtttccggcgccggtaagcaaggttcaggaagatgtcggctgtctggagctgttccatggccctacgctggcgttcaaggatttcggcggccgctttatggcgcagatgctgacccacatcgcaggcgataagccggtcaccatcctcaccgcgacctctggcgacaccggggcggcggtggcgcatgctttctacggcctgccgaacgtcaaggtagtgatcctctatccgcgcggcaagatcagtccgctgcaggagaagctgttctgtaccctcggcggcaatattgaaaccgtggcgattgatggcgactttgatgcctgccaggcgctggtgaagcaggcgtttgacgatgaagagctgaaggcgacgctgggtctcaactcggctaactccatcaacatcagccgcctgctggcgcagatctgttactacttcgaagcggcggcgcagctgccgcaggaagcccgcaatcagctggtgatttccgtgccgagcggcaacttcggcgatctgaccgccggtctgctggccaagtcgctggggctgccgatcaagcgctttatcgccgccaccaacgccaacgacaccgttccgcgctatctgcagggcggcgagtgggcgccaaaagccacccaggcgacgctgtccaacgccatggacgtcagccagccgaacaactggccgcgcgttgaagagctgttccgccgtaaaatctggcgtctcagcgagctgggctatgccgcggtcgatgatgagaccaccaaagcagcgatgcgcgagctgaaggccatcggctacatctctgaaccgcatgcggcgattgcctggcgcgcgctgcgcgatcagctgcagccgggagagtacggcctgttcctcggcaccgcccatccggcgaagttcaaagagagcgtggaggagatcctgcaggagactctgccgctgccgaaggagctggccgaccgcgccgacctgccgctgctgtctcacaacctgccggcggatttcgccgcgctgcgtaagctgatgatgggctaa

SEQ ID NO: 1676 - DNA, 570 bp, Klebsiella pneumoniae
  unsure (66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(163),(164),(165),(166),(176),(177),(178),(179),(180),(181),(183),(185),(186),(187),(188),(192),(193),(197),(204),(206),(208),(213),(214),(217),(218),(221),(225),(226),(239),(243),(244),(246),(254),(255),(256),(268),(309),(394),(425),(426),(428),(430),(452),(478),(485): Identity of nucleotide at the above locations are unknown.
cctgacgtttggctaactgtctcgtggcgcaaacacctcgataaaccatctcatcatacgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggtatnnnnnngngnnnntggnnaagnagggggnangnaaagnngannggngggnngggggagaggtgngttnngnaaggaggnnngggggaaagaangagaaggaaagaaaagagggggggaagaaaggagagagggnaagaggaggagggggggggggaggagaggggaaagaaaagagaaaaaggggggggagagagagaggggaagagaaaagaaggagnaggggggggaaggggaaaagggaagaagagnngnangggggggaagagaggaaggagnaagaaaaggagggggagaagagaggngaaagangagggaaagggagggaggggagaaggggagggaaaaagaagagatttgggagggagaggagagaaggatggagaggagggggaca

SEQ ID NO: 1677 - DNA, 288 bp, Klebsiella pneumoniae
gcggttcattgggaagcacttacgatgatgaataagaagttctggatcagatgggtgagtattgcgctgatctgtgcagcgtattacgctaccgtgctttatttcgatctggtcttcgctcttaactttacagagacaatcagtcaaggcggagaatttaccccttctcaatgtacccggtttgttaaggagctagcgcaaaatcactctgattcggctttagcctccatcattggtttcgctgtctgcgtccctttgatcctgctcatcttcaagaaagtgaaatga

SEQ ID NO: 1678 - DNA, 696 bp, Klebsiella pneumoniae
ggtggcctctgcaccattatcgaggccactatgcataccttatcgacgctctttcccgccgtcttcccggcgctagccctgtcccactttgtcgctctgctcagtccgggccctgatttttttctgctgatcggctacgccgtgcgctaccggatccgcggcagcatcggattgtgtctcggcatcgccgcaggcaatgcgctgtatattgtgctcgccatcgtcggctgggggcttctgcgccaggcgccgctgctttttttgctcatcgagctgctgggggcgggctatttattgtggattggcagcctgctgatacgcagccgtcccgcgacgctggcgatggagagcgttcgcgcagcgcgtccggggttcggcaggcagctgctgctgctggggctggggtcatcgctgctcaaccccaaaaacgccctgttttatctggcgctgatgacttccctgctcgggccggctgtgaccctgcttcagcaaacggtgagcgggctgtggatggtcagcgtggtgttcttctgggatttactgctggtgagcgcgattgcgctgccgcagatacagcgccgcctgggcgccatcgtctggcgagtcgagcgggcggcgggggcgatcctgatgctcttcggcctggggattatctggcgatttttgcacgacctcgccgtcaggctatatgcttaa

SEQ ID NO: 1679 - DNA, 2898 bp, Klebsiella pneumoniae
cgatggatctggccgacgcgaagtcggcttagccaggagtgtgcgctggaccgcaaaaaaacagcacgggccgtcgataagcctctcttttcccgcatcatatcccttcgtaatggcgaagagggggatgcgatgcgtaaaacggaactgttggcttttttgcaaaatcagaccgattttttcgatccggataacctgagcgaggtctttaccgccagctggctggcccggcgtttcgcgatgcaaagaaataccgccagccattatctcaatcagctggtcgctcaggacgtgctggtgaaaatcaacacccggccggtctattttctgcataaaaaagccttttgccagcagttctacccgctttcccgcagtgagtatgccagcatggcggagttactcgcggagagcgaccgccagccggagcaggcggaccatttttcgttgctgaccgggcatgacggcagcctgcgtaaaccgattgagcagatgaaaaccgcgctgttttatcctaacggcgggctaccgctgcttattaccggcgacagcgggaccggcaaaagctatatggctgagctgatgcatgagttcgccatcgcccaggggctgctggcgcccgatgccccctttgtgagctttaactgcgcgcagtatgcgagtaatccggagctgctggccgccaacctctttggctacgtcaaaggcgcgtttaccggtgcgcagagcgataaagcgggggcgtttgaggcggcaaacggcgggatgctgtttctcgatgaggtccatcgcctggatgctcagggacaggagaagctgttcacctggctggatcgtaaggagatctaccgggtgggggagaccgcgcaaggcttgccgatttcgctgcggttggtgtttgccaccaccgaagatattcacagcacttttctcaccaccttcctgcgccgaattccgatcctggttagcttgcccgatcttcaacaccgtagccgcgaggagaaggaggcgctaacgctacagtttttctggcaggaggcgcgcacgcttgccgcccggctgcaactaacgccgcgactgttgcaggtcctgacgcagtatgtttatcggggcaacgtcggcgagctgaagaatgtggtgaagtacgccgtggcgtcagcctgggccaggtctccgggccgcgaaatgttgaccgtgacgctgcacgatctgccggaaaatgtcatggccgcgacgccagcgctcagcgaagcgatgggccagcaggagccgctgcttatcgagccgcagaccagcctggtctggctgctgcgcgcgcgcgacccggtacaggggctgatctatgacgttcagtgtcgggttctggcgcagtatgaagcggtgctgaataaaaaaacggtctgggaagaggcgcaaaggagcatgggggaagagattgaaaccctcttcgatcggctgatctttgataatcatgactccagtagctcgcagatgctgctgctgatcgctcatcaggttcgggaggagtattatcgcctggaaaagcgcttcaatatccagtttaacggcaactgcctctacgcgctgagccactacctgatccaccgatcccgacagccgcagtccacgataaacaatgaaaaagcccgccagctggaggacttcctggtacagaagtttccgctgctgtatcgcttttgcgaagcgatcctcggtgcgttgacgctgaagctggatattgaacctcagcgtatcgacctgctgctgttagtgctgtggttccacaagaatggcgccatcagccagcagcaggtgacccgggcgataattctcgctcacggttacgctaccgccagcagcatcgccaacgtggcgaaccgcttgctgaaaagccagctatttgagtcattcgatatgccgctggacgtgacgccggaggctatcgctaaccaggtgatggcctacatagagagccatgccctggcatcaggattgataatcctggtcgacatgggatcgctgaacgccattcaccgccattttaatcgtcgcctgagtacgccgatggcgatcatcaacaatgtctccaccggtatggcgatgtacgtcggggagcgcattttgcagggcgttatgctggaagatatcgtccgcgagatcggcgatgaccttgcgattgagcaccagctctattacccgcaaaccgataagccgcgggcgattttaaccacctgcgcgaccggtctgggcgcggcggcgaatctgtcggcgctgttaaaagccagcattcctgaagcgcttggcattgatattgtggcctgcgatgtggagacccttgccgatcccgcgagacgggagccgatgctaagccgctatgaggtgctggcgatcgtcggcaccctggatccgcatcttgccgatctaccctggatctcgctggattcgctgatctctggcgaagggagtcgtccgctgatgcgcatttttggcgaactggcgacggcggagcaggtcagcgagatcaacaacctgatcctgaaaaacttttcgctgcgccgggtgatcgagtcggtgacgatcctcgatacggctaaggtgatcaaccaggttgagcagtttttgctgcgctatgagcatctggccgggcgcgatgtacctaacgatcgtaaggtcgcgctgtatgtgcatatcagctgtctgatagagcgattaattcgtcacgcttccccagcccaatacactggagggcagtgtccggatcgcgagctggctacgctacgcgaggcctttagtgtcatagagagcgggtatagtgtcaaaattcccgttgtagagctctgctacattcacgatatcctgacgcgggaaacggaatttattcaggaagatcaagacttttaa

SEQ ID NO: 1680 - DNA, 324 bp, Klebsiella pneumoniae
  unsure (189): Identity of nucleotide at the above locations are unknown.
cgtcgctcctgccgctgggcattatggctggcctgtttatcggtaagccgctggggattagcctgttctgctggctggcccctgaagctgaagtgggcttctctgccggaggcgaccacctgcaagcaaattatggcggtggggatcctgtgcgggattggctttacgatgtcgattttcatcgccacnttggcctttggcagcgtggatcccgcgttgatcaactgggccaagcttggcattctgatcggctcagtgctatcagcggtcgtcggctacctcatactgcgtcagcgcgtgacggatactcgcctcgcggtataa

SEQ ID NO: 1681 - DNA, 777 bp, Klebsiella pneumoniae
cgtcgcccctgcccgagagaaaacgttatgcatattaattacctggaggatgacgatctcgcctttctgcctgagtgcagcgaggcgcatctggaagcctttacccgcattctgacccacggggaaaatggcaaaccccgtctctccagcacgctcctgcgcaacgagacatttttagcgatggaggggcacccggagcgttatcgccgcaactggcagctaatcgccggtgagctacagcattttggcggcgatagcatcgccaacacgctgcgccgccatggcaaattttatcgcgcgatcctgctggatgtatgtaaacgactgaaagcgaaggtcgacaaacagctgtcgacgccgcagatcgagcagcagttgctggcgcattttctgcagcacagctggaataaactgaacgcggagcaaaaagcgcagtttctcgccgcggtggagtgccggagccatgagctggacagcctgatggctcatctgctgaggcatcgcaagctaagcgaaggcgtcactttgttgctggacgaacgcttaaccgccatcctgcgcacgcatgccgcggtgagcgtcatcggtcatggcctggtgcgcggcgccgggctgggcggaccgctcggcgccgcgctgaacagcgttaaagcggtgagcggcagcgcctatcgggtcaccatccccgcggtcctgcatattgcctgtttacggcaaatgctccagccgccgtcagacaccgcggaaattggtgaaaaataccccgccagatcatag

SEQ ID NO: 1682 - DNA, 234 bp, Klebsiella pneumoniae
atcattcactgccgaagtctgaataaaaccaactttatcaatgctgttaaccagtttgatcacctgatcccgcgcaacgacggacacgggctgccgctggggttgcttctcagccgctttcttttcaagcgcgcgaatcttcaacacaggaacacacacctcctgcagcatggctccgccatgaacgaaacgagcaccacctacgaagtggaaacgctgtacccctttgggtaa

SEQ ID NO: 1683 - DNA, 1356 bp, Klebsiella pneumoniae
ggccagtgctgtttttccacgccggggagccaggttttctgcgttccccgctggtattttataaggggtttacgcttgtttgaccgttatgacgccggtgagcaggcggtactggtacacatctatttttcgcaagacaaagatatggaagatctccaggagtttgaaactctggcctcttccgccggtgtcgaagcaatgcaggtgattaccggtagccgtaaagcaccgcacccgaagtattttgttggtgaaggtaaggcagtcgaaattgcggaagccgttaaagcgaccggcgcttcggtcgtgctcttcgatcatgccctgagtccggcgcaagaacgtaacctggaacgcctgtgcgaatgccgggttatcgatcgcaccggtcttattttagatattttcgcccagcgcgcgcgcacccatgaagggaaattgcaggtcgagctggcgcagctgcgccatatggcgactcgccttgtccgcggttggacccaccttgaaagacagaagggcgggattggtttgcgtggcccgggtgaaacccagctcgaaaccgaccgccgtttattgcgtaaccgcatcatgcagatcctgtcgcggctggaaaaagtcgagaaacagcgcgagcaggggcggcggtcgcgtgcgaaagccgatattcctaccgtgtcgctggtgggctataccaacgccggaaaatcaacgctctttaaccagatcactgccgccgaggtctatgccgcgaaccagctgttcgccaccctggacccgacgctgcgccgcattgacgtccctgacgtcggcgaaacggtgctggccgataccgtcggctttattcgccatctgccgcacgatctggtagccgcgtttaaagcgacgttgcaggagacgcgtcaggcgacgctgctgctgcatgtgattgacgcggcggatgtccgcgtgcaggaaaacattgatgcggtaaatacggttctcgctgaaattgaggccgatgagatcccggcgctgctggtgatgaacaaaatcgacatgcttgacgattttgaaccgcgcatcgatcgcgacgatgaaaataaaccgattcgggtctggctttcagcccagaccggggttggcgtaccactgctttttcaggcattaacggagcgtctttccggtgaagtggcccagcatacgctgcgcttaccgccgaaagaagggcgactgagaagccgtttctatcagcttcaggcgatagaaaaagagtggatggaggatgacggcagcgtgagtctgcaggtgcgcatgccgatcgttgactggcggcgcctctgtaagcaagagccaacgcttgttgactatgtggtttaa

SEQ ID NO: 1684 - DNA, 435 bp, Klebsiella pneumoniae
cccacccgctggcgggtggcgatatccttcgggtcgaccggctggccgaacagccaggcttcaccttcgctggcgggcagcaggccggtgagcatcttcatggtggtggatttgccgcagccgttggagccgaggaagccgaagatttcaccgcgggcgatgcggaaattaacgtggtcgacggcaacaaagttgccgaagcgcatggtcaggccgcgcgcttcgatggcgatctcttcctcacggctgtcgcgcggtgggataactaccgccctatgcgcccgacgctgtgcttctggcagcagggcgataaacgcctgctccagggtctggctgccggtctgggctttgagctctgtagcgctgccggtcgccagcacctcgccggcgttcatcgccaccagccagtcaaagcgctcggcctcttccatgtag

SEQ ID NO: 1685 - DNA, 384 bp, Klebsiella pneumoniae
acagcgcgctggagtagagcaggtcgtcatccagaaagtgggcataaaattcgttgccgaggtcgtaatgggcggcaatgttctcccgcgcctgggcgcgggtgttgcggcgagtccagtggcgcaggcgggcgacaggcttacccagcagacgaaagccgcgctccagacgccccagcacctcgccgttgcgcgcaaggatctgcagcagcgccgtcagctggtggctctcccagtcgccgtccatccaggcctcggccgccgccaggctgccgccggtcagcagacgccagtacacctccggcgcgcagacccgcgcctcggcgcgcagcgcggcggcggggtcgccaaactgaaaagtctgcgccccttcgcgcacggtga

SEQ ID NO: 1686 - DNA, 1677 bp, Klebsiella pneumoniae
ccatacttatggctatcgccattgatggagggagacacgatgcactggcaaacgcacaccgtttttaatcaacccaccccgctgaataacagcaatctgtttctgtccgataccgctctgcgtgaagccgtggtccgcgaaggcgccggctgggatggcgatctgctcgccagcattggccagcagctggggacagccgaatcgctggagctgggacgcctggccaacagcaatccgccggagctgctgcgctatgacgccaccggcgcccggctggacgacgtgcgctttcatcccgcctggcacctgctgatgcaggggctgtgcgcgaaccgggtacataacctcgcctggcaggaggatgcccgcgaaggcgcgtttgtcgcccgcgccgcccgctttctgctccatgcccaggtggaggccgggacgttgtgcccgattaccatgaccttcgccgcgacgcccctgctgcagcacgccctgcccgcgccctttcgcgactggctgtcgccactgctgagcgaccgttacgatccgcaccttgcgcctggcggccagaagcgcggcctgctgatcggcatgggaatgaccgagaagcaaggggggtctgatgtgctgagcaataccactcgcgcggagaaaacggcggaagggttttaccgactggtgggacacaagtggttcttctcggtgccgcagagcgatgctcacctggtgctggctcaggctccggcggggctctcatgcttctttgtgccgcgtctgctgcccgacgggcagcgtaacggcgtgcgtcttgaacgcttaaaagagaagctcggcaaccgctccaacgcaagtagcgaagtggagttttatgatgcctgcggctggctggtgggcgacgaaggcgacggcgtgcggcagatcctcaggatgggcggcctgacccgctttgactgcgcgctgggcagccatgccctgatgcgtcgcgccttctcggtggcgctgtatcacgcgctacagcgtcaggcgtttggcaaaaacctggtcgaacagccgatgatgcgccagctgctggggcaaatggcgctccgtctggaggggcagaccgcgtttctgtttcgcctggcgcgggcctgggaccgtcgggatgatgcccgggaaagcgcctgggcgcgcctgtttacgcctgcggccaagtttgccatctgtaaggccggtatcccgtttgtcgccgaggcgatggaagtgctgggcggcatcggctattgcgaggagagcgaactaccgcggttgtatcgcgagatgccggtcaacagcatctgggaaggctccggcaatattatgtgcctcgatgtgatgcgggtgctcagcaagcagccggcggcgatggagctgctggccgcggagtgtgcggaggtgaaaggacagaaccgccatctcgaccgcgcatggcgtcagctgcagcaactgctgaaacgacccgccgaagagcaggggagagagattgcccggctggtctatcgtcttggcgcgggggcgcagatgctgcgccatgcttcgccgccgctggccgaagcctggtgccggatgatgctcgacacccgcggcggcatacgtcttgacgcgccgaccctcgacgacctgctgctgcgggctatggggcgcgggcgccaggcgcctcaggcgtag

SEQ ID NO: 1687 - DNA, 225 bp, Klebsiella pneumoniae
cgtgccatatggctagtctccagaatctatcaattcaatctgctcggcatgcagaaccattttgctcaagccgttctttgccttatggcaagagatgaaccctcgaacggttactgcgctaccgaccgttatactgtgagtaatggcctggttttcgtgaccgctaataataacgggcatttgacaccatgcctgccggtgaaaaccggcttcctcctgcactga

SEQ ID NO: 1688 - DNA, 1200 bp, Klebsiella pneumoniae
accgcggtatggaagtggtcgaattcgcctgcggggatcccgcacctgattaaaggcgaatactcctctgacgtcggcaccggcgtcgacagctactcgttgatgcagcccctgggcgtggtggcagggatcaccccgttcaacttcccggcgatggtgccgatgtggatgttcccgctggcgctggcctgcggcaacagtttcgtcctcaagccgcccgcgctggcgccgacggccgctgtgcgtctggcagagctgttaaaagaggctggtctgccggacggcgtgtttaacgtcgtgcactgcagcaatgaagatgctgagcagctgtacactgacccgcgtattgcggcggtgagcttcgtcggctcctccggcgtggcggagtatatctataagaccgccagcgcccacggcaagcgcgtgcaggcctttggcgccgcaaaaaaccacgcgattgtgatgccggatgccgatctcgacgctaccgttaacgccattatgggcggcgcttttggctccgcaggcgagcgctgcatggcgctgccggtggtggtggcggtgggagatgaaaccgccgacaaactgatcgcccgcctgaagccgctggtggaagcgctgaaagtaggcccgggctgcatgcgtggtcaggaagagaacgagatgggaccggtggtgtctgatacccaccagaaaaaagtgctcggctatattgataaaggcgaaagcgaaggggcaaaactggtggtcgatggccgcaaactgcgcgtgccgggttacgacgcgggctactatgtcggcggcaccctgttcgatcacgtcaccccggagatgaccatctggcgcgaagagatctttggcccggtgctggggattgtgcgcgcggcagactataacagcgcccttgagctggtcaacagccacgagtttggcaacggcagcgccgttttcaccagcaacggccacaccgcgcgtgaattcgtccacgacgtgcaggcggggatggttggggtgaacgtgccggtcccggtgccgatggcgttccacagcttcggcggctggaagcgctcggtgtttggcgcgttgaacgtccacgggccggacggcgtgcgcttctacacgcgtatgaagaccgccaccgtacgctggccggcagggcagcagaccgtatctgaattcagcatgccgacgttaggttaa

SEQ ID NO: 1689 - DNA, 993 bp, Klebsiella pneumoniae
atgaagagatgtggagccgtaatgcctaacagtttgacctggtgcgacctgcctgaagacgtttccctgtggcctgggttgccgctttccctgagcggcgacgaggtcatgccgctggattatcacgccgggcgcagcggctggctgctgtatggtcgcggtctggataaacgtcggctgacggcgtggcagcgtgagctgggcgccgcgttagtgatcgttgcctcctgggtggtcgaggattaccaggtgatccgtttggccggttcgctgactccccgtgcgacgcgactggcgcatgaggcggggctggacgtcgcgccattgggtaaaattccccatttgcgcaccccgggcctgctggtgatggacatggactccacggcgattcagatcgaatgcatcgatgagatcgcgaaactggccggcaccggcgagctggtctcggaagtgaccgagcgggcgatgcgtggcgagctggacttcaccgccagcctgcgccagcgcgtggcgacgctgaaagacgccgatgccagtattttactgcaggttcgcgacgcgctgccgctgatgccgggcctggcgcagctggtgctcaagctggaaacgctgggctggaaagtggcgatcgcctccggcggtttcaccttctttgccgagtatctgcgcgacaaactgcatctcgacgcggtattcgccaatgagctggagatccacgacggcaagctcaccggcaacgtgctcggcgatatcgtcgatgcgaaatataaagccaatacgttgcgcaagctggcggaaaagtatgagatcccaacggcgcaaaccgtggctatcggcgatggcgccaacgacctgccgatgattaaggcagcagggcttggcatcgcctatcacgcgaagcccaaagtgaatgaacaggcggaagtgactatccgccacgctgacctgatgggggtattctgtattctctcgggcagcatgaaccaaaagtaa

SEQ ID NO: 1690 - DNA, 276 bp, Klebsiella pneumoniae
tctcccggatggcggcgcgctgcgccttatccgggctacggctccctgtatatcaaacggttacgcaacaccgtaggcccgcgcaagcgcagcgccgccgggcaagctgtaccagactccgttcccgtcattgtgccggatggcggctacgccttatccggcctacagagccctgtatatcaaacggttactcacaccgtaggcccgcgcaagcgcagcgccgccgggcaagctgtaccagactccgttcccgtcattgtgccggatggcggctaa

SEQ ID NO: 1691 - DNA, 1428 bp, Klebsiella pneumoniae
tttgccggatggcgctgcgcttatccggcctacgaattgatgcctgtaggccggataaggcgctcgcgccgtcatccggcaatttattctctttgggaggttaccgtgtttctcgcacaagaaattattcgtaaaaaacgtgatggtcaggcattaagcgatgaagagatccgctttttcatcaacggcatccgcgacaatactatctctgaaaggcagatcgccgcgctggcgatgaccatcttcttccacgatatgtctatgccggagcgcgtttcgctgaccatggcgatgcgggattccggtaccgttctggactggaaaagcctcaaccttaacggtccgatcgtcgataaacactctaccggcggcgtcggggatgtcacttcgctgatgctggggccgatggtggccgcctgcggtggttacgtaccgatgatctccggccgcggcctcggccataccggcggtacgctggacaaactggaagcgatcccgggcttcgatatcttcccggacgacaaccgcttccgcgagattattaaagatgttggcgtggcaattatcgggcagaccagctcccttgccccggccgacaaacgtttctatgccacccgcgatattaccgcgacggtggactccatcccgctgattaccgcctcgattctggcgaagaagctggcggaagggctggatgcgctggtgatggacgtcaaagtcggcagcggcgcctttatgccgacttatgaactctctgccgcgctggccgaagcgatcgtgggtgtcgccaacggcgccggcgtgcgcaccaccgcgctgctgaccgatatgaatcaggtactggcctccagcgccggcaacgccgttgaagttcgcgaagcggtgcagttcctgaccggcgaataccgcaacccgcgcctgttcgacgtgacaatggcgctgtgtgtggaaatgctgatctccggcaagctggcggcggacgatgccgaggcgcgcgcgaagctgcaggcggtgctggataacggtaaagcggcggaagtctttggccgcatggtcgcggcgcagaaagggccgagcgactttgtcgagaattatgctaattatctgccgacggcgatgctgagcaaagcagtctatgctgataccgaaggttttatcagcgcgatggatactcgcgcgctgggcatggcagtggtttctatgggcggcggccgccgtcaggcatcggacaccattgactatagcgttggctttaccgagatggcgcgtctgggtgaccgcgtcgacggacagcgtccgctggcggtgatccatgccaaagacgagaacagctggcaggaggccgcgaaagcggtcaaagcggccattaaactggacgataaagccccggaaattacaccgacagtctatcgccgtatcactgaatag

SEQ ID NO: 1692 - DNA, 1443 bp, Klebsiella pneumoniae
ggtgccggatggccgctaagcgccccttttgccctggccacccggctcaccttctttatcagcctcgccaccatcatcgccttctttgccttcacctggatcatgatccattcggtgaaggcccactttgaagagcgcgacgttcacgatctcaggcagctcagcaccacgctggagacggtgctcaaccacgccgactatccgcaggcgcgtcggctggagatcgtgaggaatatcattgcgggttacgccaacgtttttatctgtctggacgacggccagggcaatattctatttcagtcgccagacgggccggatctcagccatatgctgagtacgccggggctggcgatgcagctccgtgacgggaatgtgatttcatggaccgacccgcagccgcgggcaatggcgcacgataatcatccactggagacccgcgcctggcggttgatcatgctgccgctgggcaagcaggcggacggtaaaccggcgtaccatctgctgatggccttatccatcgattttcacctgcactatattaatgagctgaaagcgaagctgatctccgcggcgtcgataatcagcctgctgatcatcgccatcgtgctgtttgtggtctaccaggggcataagccgatccgccagatcagtcgccagatccagaatattacctcgcgggatctcgatgtgcgccttgacccgcaggcggtgcctgtcgagctggagcggctggcgctgtcgtttaaccatatgctggagcgcatagaggatgtctttacccgccagtccaacttctccgccgatatcgcccatgaaatccgcacgccgatcaccaacctggtgacgcaaactgaaatcgccttaagccagagccgcagccagcaggagctggaagaggtgttgtattccaatctcgaagagttctcgcggatgtcgcggatggtcagcgatatgctgttcctcgctcaggcggataataaccagctgatccctgagcaacaggcgctggatctggccgatgaagtgcataaggtgtttgagtttttcgaagcgtgggcggaagagaaggcggtggcgctgcgttttgtcggtagccattgccgggtgattggcgatccgctgatgctgcggcgggcaatcagcaacctgctgtcgaacgcgattcgctatacgccggccgggcaggcggtgaccatccagttgagcgaaaacgccgggaagattcgcctggtggtggagaaccccggtacgccgattgccgccgagcatctgccgcgcctgtttgaccgtttctatcgcgtcgacccctcgcgccagcgcaaaggggagggcagcggcatcggcctggcgattgtgaaatcgattgtcggagcccaccacggcagcgtggcggcgcagtccgatctgcgctcgacgcggtttattgtggtgttgccgaaatag

SEQ ID NO: 1693 - DNA, 267 bp, Klebsiella pneumoniae
ctcatcacgtgcgatttgcgccttaagctcgtccagcgacgcaaaccgctgctcgttacgtatctttttacgcagtattacattgatatggcgaccgtagaggtccattacaacgtccaacagatgtacttcgagctgctgacgcacgcccgcaaccgttggacgggtgccaatattggcgacgcccgctatcggtttgtcacccagccctgtcacttctaccgcatagacccctttaaccggggaaacctgacgacgcagcggtaa

SEQ ID NO: 1694 - DNA, 270 bp, Klebsiella pneumoniae
gcgcccgggtgcagggaatatcgccgaagaagtagtccgcatgggtggtgccgagcgccgggatcgccagccccgcctgcgcccaggcggtggcgtgcgtcgaatgggtatgcaccaccccgccaaggtcgggataacggcgatagagcgccagatgggtggcggtatcagaggagggacgccagcgcccttccaccacgtgcccctgcagatcaaccaccgacatgtcatcgacggtcattgactcgtaggcgatgccgctgggcttaa

SEQ ID NO: 1695 - DNA, 192 bp, Klebsiella pneumoniae
ctattcattcgcacgcctatagtctgcaaaactatcgattatcgcagtaaaaaacttatcaatgagtttagtcgttgcaccgaggttttaactttccgcatcacttttcacgtacagtattttactgactccgtgtttcttaaattctattgtatgctgacagattttcccacttgcgtcgtcacgacttga

SEQ ID NO: 1696 - DNA, 291 bp, Klebsiella pneumoniae
accggcttgctgcgcccagggataggtattctgagttttactaccatccagccagaacacgacatgggcatggtagtggtggtcttctgtccattcgataacccagaagaaaccgaccaccgcttcgagttgcatcatacggttcatcagctttcggatatcccattcgagctgctggtgatcctgcaggaaatacttagcggtatgatcctggtaaaacagatctgttcggaatgcccgcaggcaagaatagcgctctaccagtttgtcgatatggttgttcagaagtga

SEQ ID NO: 1697 - DNA, 396 bp, Klebsiella pneumoniae
tatatcactcgattttcaaggagagaagcaatgacctatggacaggcgtatttgagcggctggaaagagacctttaactttagcggacgcgccagccggcagcagttctggacgttttttcttatcaatgtgctgatcgccgccgcgccagtggccgcctggagtctggccacccttgttgaccctcactacggactcctcagttttgttgtcataccctttgcggcgctgtggctgctgttgatggcgatccccctgctggctgtaggctgccggcggatgcatgatatcggccgctccgggatctggtttgtgttgggagttatcattccgtggtttgcaattatttcgctggctctgtgctgcctgcgttcagcgccggcaccgtctcgctga

SEQ ID NO: 1698 - DNA, 378 bp, Klebsiella pneumoniae
agtccagctcgccacgcatcgcccgctcggtcacttccgagaccagctcgccggtgccggccagtttcgcgatctcatcgatgcattcgatctgaatcgccgtggagtccatgtccatcaccagcaggcccggggtgcgcaaatggggaattttacccaatggcgcgacgtccagccccgcctcatgcgccagtcgcgtcgcacggggagtcagcgaaccggccaaacggatcacctggtaatcctcgaccacccaggaggcaacgatcactaacgcggcgcccagctcacgctgccacgccgtcagccgacgtttatccagaccgcgaccatacagcagccagccgctgcgcccggcgtgataatccagcggcatga

SEQ ID NO: 1699 - DNA, 555 bp, Klebsiella pneumoniae
cgaagaaatcgcttaaagaccgcatcgtgcggcgtcgaggtcatccgttttttcatggccatccgcttgcctgaaagagaaggtaagccggactctatcaccggtttttacccggttgggtttgacgacaattttctgggaagcgcctcggaaaatagcatggcggccagcccggctggccgccatcaacacggcttagtaatcaaactgccggtagtaacggcggatattgaggtcgtggccggtatggtgttcaaagtgggccgccagccggtccaccagcagggtggacaccacgcacggcgccataacccagcggaacgcgtcatcaatgccgttcagcggatagtcgcgcgggtcgataaccaccagatggtcagttattttttcggcaaaacgctcgacgcgttcgtccagcgcccggcatctcccctcgcctttcaccagaaacagcggaacctctttttccagcagctccagggtgccgtggaaaaattcagcggagctcaccgacttcgtccgcttccactgcatctcttcgagaatacacattga

SEQ ID NO: 1700 - DNA, 297 bp, Klebsiella pneumoniae
tgcaggcgtcgcaatggccgcagctgcgcgccgtccagccgatgccgaccttctggccaatcttcagccctttatcctgcgccgcgctgcccagcgccgccacccggccaatcacctcgtgaccggccaccagcgggtagctcgacatcccccattcattgtcgatcatcgacaggtccgaatggcagatcccgcagtattccacttcaacttcgacatcttccggctgcagctcaccggcatcgtattcccacagcgacagatcggcgcccgcttctttggcggcgtagcttttaa

SEQ ID NO: 1701 - DNA, 960 bp, Klebsiella pneumoniae
cgagaattccgcatgcagaaccggctgaccatcaaagatatcgcgcgcttaagcggcgtagggaaatcgacggtatcccgcgtccttaacaacgagagcggggtcagcgaacggacccgcgagcgcgtcgaagcggtgatgcagcagcacggtttctcgccctcccgttccgcccgcgccatgcgcggccagagcgataaagtggtggcgattatcgtcacccgtctcgattcgctgtcggaaaaccttgccgtgcagaccatgctgcccgccttttatgagcagggttacgatccgattatgatggagagccagttctccccggcgttggtggaggagcatctcggcatgctcgcccggcgcaatattgacggcgtggtgctgttcggttttaccggcatcgacgaagcgatgctcgccccctggcgcgacaccctggtgctgatggcccgcgacgctcccggcttcgcctcggtgtgctatgacgacgagggggccatcacgctgctgatgcagcggctctacgatcgcggacaccgccacatcagttttcttggcgtaccgcacagcgacgtcaccaccggcgaacgccgccatctggcctacctcgccttctgtaaaaagcatcgtctgacgcccaccgccgccctgccggggctgggcatgaagcagggatatgacaccgtcgccagcgtgctgacggctgaaaccagcgccctggtctgcgcgacggataccctcgccctcggtgccagcaagtacctccagcagcagggtcgcgatgcgctgcagctcgccagcgtcggcagcacgccgctgatgaagtttctccacccggaaatcttgaccgtcgatccgggctatgccgagtccggacgccgggccgcccggcagttgatcgagcagatcgccggcagcgtcgatccccgccagatcgtgattcccgccgccctcaattaa

SEQ ID NO: 1702 - DNA, 849 bp, Klebsiella pneumoniae
agggataaccgtcgggaggcaggcatgcagggcgtaccactccaatttagtgatgaaaaagaccgcgcgcgctttcgccatctcgaacagctgcccggggtggagctttaccacgcccatatatcccgctacgcctttgaaccccatacccacgaagccttcggcatcggcgtgattgagcaaggcgcggagcgctttcgctaccgcggcagtcagcatattgccgccgcaaactccattgtcaccatgaatcccgacgagctgcacaccggtgaagcggaaaccgccgacggctggcgctaccggatgatttatctggagccggaccgtctggaagccatcaccggggtgcgcgactggtggttcagcgaggtggtccgcgaggatcccctgcgttcccgacagattggtcaactgatttatggcctgtggcatagcgacgatccgctggcccagcagggactgctgctcgacctcgtcgacaccttccgccctctggcccaccatgcctctgcgcaaggtgaggccgggcatcgcttcgaccgcgtgcgcgactacctgcacgataactatatgcgccccatcaccctcgacgagctggcgcaggtggcgacgctgagcccgtaccactttcagcgccagtttaaagcccactatcacgtaacgccccatcagatgctgatggccatccgtctgtggcgcgccaaagcgttcctcacccacggcatgcccgccgccgaagtggcgatagccgtcggcctcaccgaccagtcccacctgacccgcgccttcacccagcgttacggcattacgccggtgcgctatcagaagcaggtcgccaggcgctaa

SEQ ID NO: 1703 - DNA, 1113 bp, Klebsiella pneumoniae
gtactacgccgggctggatgcacagccgcccgcggcgctggccgcgctgtaccatccggacgccacgctgagcgatccttttggtcagcatcaggggctgttcgccattcagcgctactttacccatctgctggccaacgtggagcagtgccggttcaccatcgacacgccgctttgcgacggccagcggttcgccgtgacctggaccatgcactggtcgcatccgcgcattgccggcggagaaaccctggccctgccgggctgctcggtggtggacatcgccggggagcaggttctccatcagcgcgactactacgacgccggggagatgatctacgagcatcttcccctgctgggctgggcggtgcgcggcgtgaagcggagggtgcgctcatgatgacggtgctcatcaccggcgccagctccgggatcggcgccggcctggcgaaatccttcgcggcggatggccatctggtcatcgcctgcgggcgcgatgcgtcgcgcctggcagcgctccagcagctcagccccaacatcagcgtacgcctgttcgatatgacagacagggacgcctgtcgccaggcgctgacaggctgttttgccgacctgatcattctctgcgccgggacctgcgaatacctcgaccacggacaggtggatgccgccctcgtggagcgggtgatggccaccaacttcctcgggccggtgaactgcctggcggcgctgcagacgcagctggaggctggcgatcgggtggtgctggtcagctccatggcgcactggctgcccttcccgcgcgcggaagcctatggcgcctccaaggcggcgctgacctggtttgccaatagcctgcgtctggactgggagccgaaaggggtcgccgtcacggtggtctctccgggcttcgtcgacaccccgctgacgcgcaaaaacgacttcgccatgcccggccgggtgagcgtggatcgggcggtggcggcgatccgccacggtctggcgaagggcaaaaaccacatcgccttccccaccggtttcagcctggccctgcgtctgctggccagtctgccatcgggtatccagcgcctgctgttgcgcaggatggtgcgctcatga

SEQ ID NO: 1704 - DNA, 333 bp, Klebsiella pneumoniae
atcccgcgccgcgacgcgggatacaggagcgtttgcggcagctactggaacaatcatcatctcagcggcagcgaacaattttgcgacagagaggcgtgcaacgatccgctaagcccgacggagcacgccatccttcggtatatgtcgtggggatattcgctttctgatattgcgatacagctcaaccggaatattaaaacgatccgcgcgcataagtttaacgccatgaccaagctcggagttcgctcagacattggtttattaaacgcggcggatatcctgttgcatttaccgctcaatagtacgaccagcgccgttaaacaggtagcgtaa

SEQ ID NO: 1705 - DNA, 768 bp, Klebsiella pneumoniae
tcggattcgctcatgacggaagcgcaaaggcaccaaattctgctggatctgctcgcccaaacggggtttgttaccgtggagcaggtgatgtcgcggctcgggatctcacccgctaccgcccgacgtgatatcaacaagctggatgaaagcggcaaactgaaaaaggttcgtaatggcgcggaagccattagcgaacagcgcccccgctggacgccgatgaacatccaccaggcgcaaaatctggatgaaaaagtgcgtattgcacgcgccgcttcgcaactgatcgcgccgggtgagagcatcgtcattaactgcggctccaccgcctttctgttgggtcgggaactgtgcggcaaaccggtgcagatcatcaccaactatctgccgctggctaactacctgatcgaccaggagcatgacagcgtgattatcatgggcggccagtacaaccgcagccacgccatcaccctcagcccccacggtagcgagaacagcctctatgccggacactggatgtttaccagcggcaaagggctcaccgccgaaggcctctacaaaacggatatgttgaccgccatggccgagcaaaaaatgcttaacgtggtcggcaaactggcggtgctggtcgacagcagcaagatcggcgagcgcgccgggatgctattcagccaggccggacaaatagacgtggtgatcaccggcaaacaggccgatgccgcgatcctcaaacagcttgaggatcaaggcgtcagcgtaatccgcgtttaa

SEQ ID NO: 1706 - DNA, 882 bp, Klebsiella pneumoniae
tattttacacggtatgaccacggttcggtcgttacgtatatcgtgtgcgcaggccatgaatatgattttaatattcatccaggaaatgatatggcgataaagtcgctcgccgatcgtttgcaggcaagcgaaggaacttcgacaggaagcggaggtgttatgttaccaggacaaggtaagtttggcgtcgttattagtaaaattcccgtcatgcaatcagggttaaaggtgatcttcaatgagaacctccctgattacgaactgagtttttgtcgttctcatgatgagctcacccttttacaactgcggcgggcggtgctggttgtcgcggatatctccggcgagattgcgcacccccgagccgtctgcgagcgttattactccctcatgacccagtaccgtgatattcactgggtttttatggtcagcgacagcctctatccgttggccgttgagctattaattcgtcctgaaagctcgttgatctccgagagcgagccggttaaccggctgattgaggtgatttgcgccggtagccgtgcggctgaacagattagccgtacgctgtttgccggggatgaggacagcgatttcgcaagctaccactctgcggcgatgctcactctttcagagcgtaaagttctgcgccttctggcgaaggggtggggaataaaccagatcgccgcgctgttgaaaaagagtaataagacgatcagcgcgcagaaaaacagcgcaatgcgtcgcttatctctacgcagcaacgctgaaatgtatgcctggatcaacagcgcgcagggaatgcaagagctgaatatcaattcagcttacggggagcaaatggaatggaaaaaaatagtacaacccgccatgtcgccatcgtag

SEQ ID NO: 1707 - DNA, 864 bp, Klebsiella pneumoniae
ccaattgaacgaacctaccccctcttccgtcaggagtgtcctatggccatcgcaatgcaacgtttttgtattaaccgcaaaatcgcgccagcgctcaacattgaagcgtttttccgtctggtgaaccgtctgggcctgaataaggtcgagctgcgcaacgatttacccagtggaaaagtgaccgacgatctgagccatcagcaggtgcgcgagctggcggcgcgctaccacatcgagatcctgacgattaacgcggtctacccctttaaccgtcgtagcgaagaggtgcggcagttgaccgaatcgctgctgaaagaggcccaggccatcggcgccaaatcgctggtgctctgtccgctcaacgacggcagcgaggtgccggccagcgaaaccctgggcgccctgcgcgacctggcgccgctgtttgccttctatggcatccacggcctggtggagccgctgggcttcccgcaaagctcgctgcgttctgcgcaccaggcgcagacgctgatccacgacgcccgcgtgccgtttaagctgctgatcgacaccttccatcaccatctttacccgcaggcggcggacgagttcagccaggtggaggtggcggatatcgggctggtgcacctttcaggagttgacgatagccgtccgcgcgagcagctcaccgatgccgagcgcatcatgctaaccccgaaggatcgtctcggcacctgcgagcaggttaaagcgctggaagcccgcggctatcagggggtgtacgcttttgagcccttcgcccccgagctggcgcaatggagcgaagcggatatcgagtgcgaaattgagcagagcatcgcgctcatccagcgccactgcgcctga

SEQ ID NO: 1708 - DNA, 3531 bp, Klebsiella pneumoniae
gtcacgggacggggaatggacagcaatactcaaggattcacttcatactggcgtaataccttagctgataccgagtctggaaaaggggcatttgagcgcaaagaagaagattcattcacgcaatggatgaacgttgaacagggaaggttgggtgaagatatcgtgcaatcgttcttcgagggcgaagacgagcaggttaagaccgttgaggtactactacggccacaagtttggatccgcctgttaaagcatggcaaggaacgtacggcaggcgcaccaggtataattacgcctctggtgacttccgcactgttgaaccgtgaaggctttttgttccccaaatctcctgccaccattccccgtgacctgctcgaacctctccctaagggtaccttttctattggtgaaatgccggaatatgacaagtacaaaactacgcatgattcaatcacctttggtcccggtaatgaggatgagctgcgtgatgagactgatgaacaacgagtggaacgatatgctcgttatcagcagttgtggcaaaagtaccttaaagacactgatgaacttttaaaaaatgttgctggcagatggctcgcatcacctgagcaatatgaactagctggatatggctacattattaaagccaaccagcctggaggggccagcctccatatcctgcctatgtacgatcatctgctgtcgtgcaaaaaagaggtgccattgctggcgcgctttgcctcgaaagataagtttcctgttgagcagctccttgccagtaatgccatgttcagtgagcgtctggggcattccggtgataaatttccgctggctgtggcgcagcgcgatgcccttagccattatctcactcaacagccgggcgatattcttgccgtgaacggtcctccgggaacaggaaaaactactctagtactctccatcattgctacggagtgggtgagagcggctgtaaacaaaactgaaccgccagtggtgattgcgacatcaaccaacaatcaggccgttaccaatattattgaggccttcggaaaagattttgctaccggcactgggcctatggccgggcgttggttacctgatgtaaaaagctttggtgcttacttcccttcttcaagccgaaaagccgaggcggtaaaaaaataccagacggaagatttttttaaccgtgttgaatcccttgaatatgttgaagatgcccggtgcttcttccttgaaaaggcaagggcagcttttccgagtaaggaatgtcattcacctgaacaggttgtggatctcttgcatcagcgtttggttgaaatctctgcagagcttgagcaaatcgagcctgcgtgggatgacctcaacgcaattcgtcaggagcggcatgccatcagtgacgatctcgaacagtatattcaggataagagaacgttactgctcaatagcacaaatgaaatctcgctattaacgcaaggcaaaaaacagtgggagcaatatcgagccggtgagtcgatcatgtacgctctcttctcctggcttcctgccgtgcgtactaagcgtcactatcaaatgaagctgtttttggaggctaggtttggcgaaagaatgacagcattccagggatctcagcctgatggaattgatgcctttatcgatggattgattgaacaagctcataaagagcaggctgggtatcaacagcaaattgatcttgctgaggacatttcccgacgtgaaagcgaagcagctatacgctggcacgatattactcactcactgggaaatccgggcgaaacagagttgagtctgcatgaagccgatgagcttgcagatacacagctccgtttcccggcgtttctgctggcgacgcattactgggaaggccggtggctgatggatatggctgctatcgataaccttcaaaaagaaaaaggtcttaaaggggcgaaggccattaaagcgcgctggctgcgtagaatgaaactaaccccttgtgtcgtgatgacttgctttatgcttcctcaccatatgctcatcagggagcatgttggcggcaagaagtttgatgatggctatttatataactttgccgatttgctgattgtcgatgaagcggggcaggtgttgcctgaggttgcggcagcttcttttgcactggcgaagaaagccctggtgattggtgacacagaacagattgcgcctatctggaatagcttgcccggtattgatatcggcaatatggttgaggagaacattcttccgggaggtacgcaggaagaacttactgaagcttatgccctggtgtgtgactttggaaaaagtgcttcatctggcagcgttatgaaggttgcgcagtttaattcccgctaccagtacgatccggatctggcgagagggatgtacctttatgaacaccgtcgttgcttcgataacatcattggctactgtaacaccctctgctatcacggtaagttgcagcccaaacgaggggaagaaaaagagacaatatttccagcaatgggatatttgcatattgatggtaaaggtatgcaggccaatgggggaagccgttataacgcctttgaagctgagacgatagctgcgtggcttgcggcgcacaaagaggaaatcgagcaccattatggcgaacctctacataaagtagtgggggttgttaccccattttcggcacaagtcagtaccattaaatcgtcattacgtcagctggatattaattgtagtggcgatgaaaattcgctgacagtcggtactgtccattcattgcagggggcggaaagggcgattgtgcttttctctcctgtatattcgaagcatgaagatggcagttttattgacagcgacagtagcatgctgaacgtcgccgtttcacgagctaaagacagcttcctggtctttggtgatatggatctgtttgagatccaacccggatcgtcacctcggggattgctggcgaaatacctgtttgcttccactgataatgcattgcagtttgagtttcaggagcgtcaggatttaagtacctcacaaacgcagatttcaaccctacacggggtggagcaacatgatgcgtttctgaatcaaacttttgatgcaactaatcagagtattactatcgtttccccgtggctcacctggcaaaagctggaacagacaggttttctggcgtcaatgttacaggcgcgcgcccgtggtattgatatcactgtagtaacggataaaacgtttaatacagagcatgcagattttgaaaagcgcaaagagaaacatcagcggctaaatgaagcagtggaaaggttgaatgaaatgggcatcacaacgaagctggttaaccgtgttcacagtaagattgtgattggtgatgagggactgctctgcgtcggttcctttaactggtttagcgctacgcgcgatgagaagtatcaacgatacgatacgtcgatggtataccgtggcgaaagtttaaaaagcgaaattaaaacgatatattccagcctggaacaacgtcagttgtaa

SEQ ID NO: 1709 - DNA, 948 bp, Klebsiella pneumoniae
ccaccatcgcggaaaactacgtgggcttgcccatggagcgtgtcgcctgaattaagaggagtcatcatgccgttcgttcaaaccgtgcccgtatttaagctgtatggcgaagagtgcggctggccgacgccggacctgctgcactgtgagtcgattttacagcgcagcagcctgtatcagtggcatattcgcgtccatcagcatgcggaaatggtccagcttctctatctgcatcaggggcgggcggagatcgaaattgaaggcgccaccgcggtgatgacggagtcctgcatccaggtggttcccgccctctgtattcacgggtttaatttttcacccgggacgcaagggtttgtgctctctctggcgctgccgctgctgagccggtttgaaaatcagttcggtcgccctctggatgtgcttagcgtgccgcagtgtgtgccggtgggccgttctcgcgggcgcatgcatacgctgttttcagcgcttcgcgaggagtactgcgaagagcacgatgcgcgagaaatgatgctctattcgctgctggggacgctgttggtctggctgaaccgacagtgccatcccgcgtcccccgcggaagataaagcggagcggaagcgcagcatgatgcgccacttcgcccgccttatcgagagccactaccgacagcatctcccgttggcggagtatgcgaagctgattggactgtcggttacgcacttaaattatttatgtcgtgagttttatggctgtagcgctcttggagtattgcatcagcggttgatgcttgaagcgcgacgcaatctgcagtacacccgcatgacgattacacaactctctgattatttggggtttagcgatgcagcctatttttcgcgttttttccgtcgctatagcggtatgtcacccaaagcatttagagaaacaattaaagataatgcttcataa

SEQ ID NO: 1710 - DNA, 948 bp, Klebsiella pneumoniae
acccggacgcgccggtggacgatcgctacgtctggcagcgcttcgtctatgagcatccgttgtttaacccgcaaagctggtcggcccagctgcggcgcgaagagattaacggccagcagcggagctggtactgcggggcctactggtacaacggctttcatgaggacggggtacgcagtgcgctcgacgtggtgcagggcatcgccgcggcggaggacaactgaaatgaacagctgcctctatcagggcgtcctgcgccaccgtcgcctgcagccgaaggcgcaccacttcgtctaccgcctgtttatggcctggctcgacctcgacgaactggacaggttgcctgaggcgggcatccgtcgcaaccgcctggccgccgccgcctggtacgacgccgattatccgctgggcgcgccgctgaaggcccaggtgctgaaccggctggagagcctgaccggctgccgcccggcgggccgcgtgatgctcctgacccagctgcgctacttcggcttccattttaatccggtcaatttttactactgctatgacgaagccgacaccctgcgctgggtgctggccgaagtgcgcaacacgccgtggaatgagcgtcattactacgcggtggacggccagcaggcgcgcccgctggagaaagcctttcacgtttcaccgtttaacccgatggacatggtctatcactggcgcttcaacgcgcccggcaaaacgctgcacatgcatattgaaaaccatcaggccagcaaggtgttcgacgccacgctggccctgagccgcgtgccattgacccgcgccaacctgcgcgggatgctgctgcgtctgccgctgatgaccctgaaaaccgtcctcgccatctactggcaggcgctgcggctgtggctgaagcgcgtgccgctgtataaccatcctgtcagcaggagtgaacgctcatga

SEQ ID NO: 1711 - DNA, 381 bp, Klebsiella pneumoniae
tccgctgcgcgttacagtctgcgattaagttacccttacctttctgctgcgctggctattttattgcaggcgctaccacagtttgtgctgaccattgttatagggctgattgacgggctggtacaccgcgacttacggcgattcggcgcaggccatgagtccgggtttgtttatcatcatgcaaggcgtatgatcggctccagcctcgcggcaacggggctggcgtggctggcgtggctggcgtggctggcgtggctggcgtggctggcgtggctggcggtgccagtttttctggaatcaagatatattgtaatacctggagtgatgctgagtgggctcgcgggttcagtagcgacgggagcattcaaaaagcatttgtaa

SEQ ID NO: 1712 - DNA, 867 bp, Klebsiella pneumoniae
attgccgcgcgaatagcgcggcaattgcagctatcgatcccaccatgcactttttttgttaaaattcgtcgaaattacctgcaaggactggatatgctgattctgatttcacctgctaaaacgctcgattatcaaagcccgctggcaacgactcgctatacccagcccgaactcctcgagtattctcagcagcttatcggcatcgcccgtaagctgagcgcaccgcaaatcggcaagctgatgagcattagtgacaagctggcggatctaaacgccacccgcttccacgactggcaccctgactttacgccgcaaaatgcccgccaggcgatcctcgcctttaaaggcgatgtctacactggcctccaggcagagacgctcaccgaggacgactttgacttcgcccagcagcatctgcgcatgctctccgggctgtatggcgtgctgcgcccgttagacctgatgcagccctaccgcctggagatggggatccgtctggaaaatccgcgcggcaaagatctgtaccagttctggggggataccattaccgagaagctgaatcaggcgctgcgcgaccagggcgacgatatcgtcatcaacctggcttccgatgaatattttaaatcggtgaaaacgccaaaattgcagggtcagctgatcaagccggtattcctcgatgagaagaacggcaaattcaaagtgatcagtttttatgcgaagaaagcccgcggcctgatgagtcgctacattattgaaaaccgcttaacccagccggagcagctcaaagcctttaatagcgaaggctatttctttgatgcggatgcctcagagaaaggcgaactggtgtttaaacgccacgagcagtaa

SEQ ID NO: 1713 - DNA, 702 bp, Klebsiella pneumoniae
acgggagcgcgcatgcagcagccacggatttggttagttgaggatgaacagagtatcgctgataccctggtttacatgctgcagcaggagggcttccaggtcagcgtctttggccgcggtttgcccgcgctggaggcggcggcgcatcaggcgccagatgtcgccatcctcgacgtcggcttgccggatatcagcggcttcgagctctgtcggcgtctgctgacgcgttatccggcgctgccggtgctgtttttgacggcgcgtagcgacgaggtcgataagctgctggggctggaaatcggcgctgacgattacatcgccaagccgttttcaccacgcgaagtctgcgcgcgggtgcgaaccgtgctgcggcggctgcagaagtttgccgcgccatcgccggtggtacgcgtcggcgagtttgtgctcgatgagcaggcggcggcgatcagctggttcggccagccgctgaatctgacgcgctacgaatttctgctgttgaaaaccctgcttcacgcgcccggtcgcgtcttctcccgtcagcagctgatggagctggtgtggatcgatgcctgggaaagcttcgaccgtaccgtcgatacccatatcaaaaccttgcgcgctaagctgcgggctgtgaatcctgaaaaggcgccaatcaatacccatcgcggtatgggctacagcctggggcgcggctga

SEQ ID NO: 1714 - DNA, 1215 bp, Klebsiella pneumoniae
gtagcccagcgagcggctgcgcatcggcgcggcagagcgcggcgtcagcggccctccctccactttttcgtccttcgcaagaaggacgctccgcccgccggaggaaacacgcgcaccactcagcaaagggaatcaagcgagtcgcgtatggacaaaataaagaaacgttgggcagggtattttgtcggcttactggtggtgctcgccgccgccgcatggtggctgctgcgcccgccgggactcccggcggggtttgccagcagcaacggccgaatcgaagccaccgaagttgatattgccagtaaaatcgccgggcgtatcgacaccattctggtcaaagagggtcagttcgtgcaccagggagaggtgctggcgagaatggatacccgggtactgaacgagcagcgtcttgaagccgccgcgcaaatcaaggaagcggaaagcgcggtcctggccgccagagccttgctcgatcagcgacaaagtgaaatgcgcgccagcgaagcggtagtgaagcagcgccaggcggagctggattccacggcgaaacgccatgttcgctccaacgccctctcccagcgtggcgccgtctccgcccagcagctggatgacgatcgcgcggccgcagagagcgcccgcgcggcgctggaatcggcgaaagcccaggtctccgccgcccgcgccgccatcgaagctgcccgcaccagcattattcaggcgcaaacccgcgtcgaagccgcccaggcgaccgagcggcggatcctcgccgatattgacgatagcgagctgaaagcccctcgcgacggccgcattcagtatcgcgtcgctgagccaggcgaagtcctggccgccggtggccgggtactgaacatggtcgatctcgccgatgtctatatgaccttctttctgcccaccgaacaggcaggtctgctggcgctcggcagcgaagcgcgcttggtccttgatgccgcgccggatctggtgatcccggccaatatcagctttgtcgccagcgtcgcccagttcacgccgaaaacggtcgagaccagcgacgagcgcctgaagctaatgttccgcgtcaaagcgcgtatcccgccggagctgctggcgcagcacctggagtatgtcaaaaccggcctgcccggtatggcttacgtacggctggataaacaacaaccctggcctgaagccctggcggtgaggttgccgcaatga

SEQ ID NO: 1715 - DNA, 576 bp, Klebsiella pneumoniae
aacgtgcagcgaagcgtctacaaaccaggtaaggtagagctaatggagcagcaactgacgattgagatgattgccgatgcgttcagctacgatatcactggatttgattgcggcgagaaagcgctgaatacgtttttaaaagagcacctcaagcggcagcacgatggacaaatcttaaggggttatgcgctggtctccggggataccgttcccaggttgctgggttattacaccttatcggggagttgtttcgagcgaggcatgttgccgtctaaaactcagcaaaagaaaatcccgtatcaaaatgcgccaagcgtaaccctcgggcggctggccattgataaatctgttcaggggcagggctggggagagatgttggttgcccatgcgatgcgagtggtgtggggagcgtctaaagccgttggcatctacggattgtttgttgaagcccttaatgagaaggctaaagcattctatcttcgtctggggtttatacagctcgtggatgaaaatagtaacttactgttttatccgaccaaatcgattgaacagctctttactgacgatgagtcataa

SEQ ID NO: 1716 - DNA, 1464 bp, Klebsiella pneumoniae
agtgggcagcgagaaatgctgagcgtaaggcgcgttcagcgccttcaccatcgggagtgtgttatggcaatcctctacaacatctttaccgttttctttaatcaggtgatgaccaatgccccgctgctgctgggtatcgtcacctgtctgggctatatcctgctgcgcaaaagcgtcagcgtgattattaaaggcacgatcaaaaccattatcggcttcatgctgttacaggccggctccggcatcctcaccagcacttttaaaccggtggtggcgaaaatgtcagaggtgtacggcatcaacggcgcgatctctgacacctatgcctcgatgatggcgaccatcgaccggatgggcgaggcctatagctgggtgggctacgcggtgctgctggcgctggcgctcaacatctgttacgtcctgctgcgccggataaccggcatccgcaccatcatgctgactggccatatcatgtttcagcaggcggggctgatcgccgtctcgttctttatctttggttacggaatgtggacgaccatcatctgtaccgccgtgctggtctccctgtactggggtatcacctccaacatgatgttcaagccgactcagctggtcaccgacggctgcggcttctccatcggtcaccagcagcagtttgcctcgtggattgcctacaaagtggcgccgtatctggggaaaaaagaggagagtgtggaagacctcaagctgccaggctggctcaatatcttccacgacaacatcgtttccaccgcgattgtcatgaccattttctttggcgcgatcctgctttcctttggtattgacgtcgtgcaggcgatggcggggaaaacccactggacggtctatatcctgcagaccggtttctccttcgcggtggccattttcatcattacccagggcgtgcggatgttcgtcgccgaactgtccgaagccttcaacggtatctcgcaacgcctgatccccggcgcggtgctggcgattgactgcgccgcgatctatagctttgcgccgaatgcggtggtgtggggctttatgtggggcaccatcggccagctgattgccgtcggcattctggttggcattggctcttcaattctgattattccgggctttatcccgatgttcttctccaacgcgacgattggtgtctttgccaaccacttcggcggctggcgcgcggcgctcaagatctgcctggtgatgggcatggttgaaattttcggttgcgtgtgggcggtgaagctcaccggtatgagcgcctggatgggaatggcggactggtcgattctggcgccgccgatgatgcagggcttcgcctccatcgggctggcgtttatggccgtcatcatcctgattgctctcgcttatatgttcttcgctggccgcgcgctgcgcgccgaagaagacgcggaaaaacaactggcagaggcctctgcccaataa

SEQ ID NO: 1717 - DNA, 1245 bp, Klebsiella pneumoniae
cgacaggcgctgacggatccccagcggcagatcgacgggaagcgcgtcttcaacctcggtcagcataaagcgctcgcacatttccgccacccggccggggatttcgccgtccggaatatggaacaggcgggcgtgcagctcgaggttttgccggacggtcagttcgctatagagcgagaaggcctgcgacatatagcccacccgctggcgggtggcgatatccttcgggtcgaccggctggccgaacagccaggcttcaccttcgctggcgggcagcaggccggtgagcatcttcatggtggtggatttgccgcagccgttggagccgaggaagccgaagatttcaccgcgggcgatgcggaaattaacgtggtcgacggcaacaaagttgccgaagcgcatggtcaggccgcgcgcttcgatggcgatctcttcctcacggctgtcgcgcggtgggataactaccgccctatgcgcccgacgctgtgcttctggcagcagggcgataaacgcctgctccagggtctggctgccggtctgggctttgagctctgtagcgctgccggtcgccagcacctcgccggcgttcatcgccaccagccagtcaaagcgctcggcctcttccatgtaggcggtggccaccagcacgctcatcgccggctggcgctgacgaatattgtcgataagctcccagaactgcgcccgggagaggggatcgacgccggtggtcggttcatcaaggatcagcagctgcggatcgtggatcagcgcgcagcacaggccgagcttttgcttcatcccaccggagagttttccggcggggcgatcgcgaaacggcgccagcccggtactctgcagcagctcgttgatgcgcagttcgcgctcggctttatcgtggccgaacaggcgggcgaagaagtcgacgttttcatacaccgagagagtgtgatagaggtttttccccagcccctgcggcatccacgcgattttcgggcacacctcgcggcggtgatgcacatcgcgcatatcgccgccaagcaccatcacgttcccctgctcgatggtccgcgccccggcgatcagcgaaagcaggctcgatttgccgacgccgtccgggccaatcaggccaaccatacgccgtgccgggatcgccagactgatatcgcgcagcgcgatggtggcgccaaactgctgaccaacgtgttccagcagggcgacggggggcgaggtatcctgcggcgttag

SEQ ID NO: 1718 - DNA, 240 bp, Klebsiella pneumoniae
ctgggcaagcgggaaagcgggctgggcgtcggcaaggccctgaagaagttcggcaaaaatgcgttcggcgtcggcaatattggggagggcatcctggccgccaatggtcttttcaatcatcgctaccaggtggttagtgatcttcgccggggcagacaggaccgtcgctacctgcccctgcctggcattactctccagaatatcggcaacccgcagaaaccgttccgcatttgccactga

SEQ ID NO: 1719 - DNA, 3324 bp, Klebsiella pneumoniae
atccaatggcgtcacggccattcgcagcgggctgcaggagggcgagaaagtggtcgccagcggcctgttcctgatcgactcggaggccaatatcgccggcgcgctggagcgcatgcgcgcgcaggccccggatgccgctgcccctgccgcccacgcgcattgaggaaaggaaccatgattgaatggattatccgccgctcggtggccaatcgcttcctggtgatgatgggcgcgctgtttctcagcctctgggggacctggaccatcgtccatacgccggtggacgccctgccggatctctccgacgtacaggtgatcgtcaaaaccagctacccgggacaggcgccgcagatcgtcgaaaaccaggtcacctggccgctgaccaccaccatgctgtcagtccccggcgccaaaacggtgcgcggcttctcgcagtttggcgactcctacgtatacgtgatttttgaagacggcaccgatccttactgggcgcgctcgcgggtgctggagtatctcaaccaggtacagggcaaacttcccgccggggtcagcgccgaaatgggcccggacgccaccggcgttggctgggtcttcgaatacgcgctggtcgaccgtagcggcaagcacgacctcgccgaactgcgctccctacaggactggttcttaaaatatgagctgaaaaccattcctaacgtctcggaagtggcgtcggtgggcggtgtggtcaaggagtaccagattgtcgtcgacccgatgaagctgacccagtacggcatcagcctcggcgaggtgaaatcggcgctggacgcctctaaccaggaggcgggcggctcttccgtcgaactggcggaagccgaatatatggtgcgcgccagcggctacctgcagacgctcgacgacttcaaaaatatcgtactgaagaccggggataacggcgtgccggtctatcttggcgacgtcgcgcgggtgcagatcggcccggagatgcgccgcggaatcgccgagcttaacggcgaaggcgaagtggccggcggcgtggtgatcttgcgctccggcaagaacgcccgcgaggtgatctccgcggtcaaagagaagctggcgtcgctgcaaagcagcctgccggaaggggtggaagtggtcaccacctacgaccgcagccagcttatcgaccgcgccatcgacaacctcagctacaagctgctggaagagtttatcgtcgtcgccctggtctgcgccctgttcctgtggcacgtgcgctcggcgctggtggcgattatctccctgccgctcggcctgtgcttcgcctttatcatgatgcatttccaggggctcaacgccaacatcatgtcgctgggcgggatcgccattgcggtgggggcgatggtcgatgccgccatcgtgatgattgagaacgcccataagcggctggaggagtgggaacatcagcacccgggagagaagctcagcaacgacacacgctggaaaatcattaccgaggcctcggtggaggtcggcccggcgctgtttatcagcctgctgatcatcaccctgtcgtttatcccgattttcaccctcgaaggccaggagggcaaactgttcggtccgctggccttcaccaaaacctggtcgatggccggggcggcgctgctggcgatcgtggcgatcccaatcctgatgggcttctggatccgcggcaagatcccggcggagagcagcaatccgctgaaccgctttttgatccgcatttatcacccgctgctgctgaaggtcctgcactggccgaagaccaccctgctgatcgcgctcctgtcgatcctgacggttgtctggccgcttaaccgggtcggcggcgagtttctgccgcagatcaacgagggcgacctgctgtatatgccgtccacgctgccggggatctccgctgcgcaggcggcggatatgctgcagaaaaccgataagctgatcatgacggtgccggaagtggcaagggtgttcggcaaaaccggcaaggccgaaaccgccaccgactcggcgccgctggagatggtggagaccaccattcagctcaagccgcaggatcaatggcgaccggggatgaccatggagaagatcgtcgaggagctggataaaaccgtgcgcctgccgggactggcgaacctgtgggtgccgccgatccgcaaccgcatcgacatgctctccaccggcatcaagagcccgatcggcattaaagtttccggcaccaacctggccgatatcgacgccatcgccgggcaaattgaagtggtggcgcgcagcgtgccgggagtcacttcggcattagccgagcggctggtcggcgggcgctacctcaacattgatattcatcgtgagaaggcggcccgctacgggatgaccgtcggcgacgtgcagctgttcgtctcgtccgccatcggcggggcgatggttggcgaaacagtggagggcgtcgagcgctatccgatcaacatccgctacccgcagagctatcgcgacagcccggagaccctgcgccagctgccgatcctcacgccgctgaagcaacagattgtcctcggcgacgtggctgaggtgaaagtggtcaccggaccatccatgctgaagaccgagaacgcccgcccgaccagttggatctacatcgacgcccgcgaccgcgacatggtgtcggtagtgcacgatctgcagcaggccatcggcaaggaggtgaagctgaagccgggcatcagtgtgtcctactccgggcagtttgagctgctggagcgcgccaatcagaagctgaagctgatggtgccgatgacgctaatgattatcttcgtgctgctgtatctggcgttccgccgcgtcggcgaagcgctgctgattatcaccagcgtgccgttcgcccttgtgggcgggatctggttcctctactggatggggttccatctgtcggtggccaccgggaccggctttatcgccctcgccggggtggcggcagaatttggcgtggtgatgctgatgtacctgcgccatgccatcgaggcggagccatcgctggagaatccgcagactttcagcgtcgataagctcgacgaggcgctgtaccagggggcggtgctgcgcgtgcggccgaaggcgatgaccgtggcggtgattatcgccggcctgctgccgattttatggggcaccggcgccggttcggaagtcatgagccgtatcgccgcgccgatgattggcgggatgatcaccgccccgctgctgtcgctgtttatcattccggcggcgtataagctgatgtggctgtcccggcatcggggcaagcgtagccaatag

SEQ ID NO: 1720 - DNA, 597 bp, Klebsiella pneumoniae
actgcgtggcgggaacggcggtcagctccatacttttctcccgaaggctgctatgctgaggtgatgaaaactaacactataactgccggtgccgtattacgcctgactcaggagagcgatatcgcccttctgcccgccattgaacgttctgccgcccaggcatttcgccagatcccttctctcgcctggctggcggacagcgaggtgattagcgttgcgcgccatcatgattatctggaaacggagcatagcctgctggcggtagccgccgggcaacccgttggctttattctgaccgaaccgctcgacgatgcgttatttatcgtcgaagtcgccgtccaccaggcctggcagcaacagggcatcggccggatgctgctggagcgggttatcgagagcgcacggcagatgggctacccggcggtaaccctcaccaccttccgcgaggtgccgtggaatgcgccgttttatacccgtctgggattcgccatgctcgatgagctgaccctgcccgccgggctggcggcaaaaagggaacaggagacccggcacggcctgccgcccgagtcgcgctgcgccatgcgcctggcgttgtag

SEQ ID NO: 1721 - DNA, 921 bp, Klebsiella pneumoniae
tttcagcggcgcaatatggtacaaagtaccattcaaaacttacccgttgttacccgtatgtcctggtcaatcgatattatttcctgcataaccgatcgctttgtggaactcacggcgaccgaaaaacgcatcgcgcagtttattctcgatgatatcgcggcggcggcggagctgcccatcgccgagatagcgcgtctgacgcaaaccagccaggcttcggtcacccgttttgcccgggcgctcggctgtaaagacgtccgcgagctgaagatgaagcttgcgcaatctcttgcggtcggccagcggtttatcctcgatgttccggatctcgaaggcgtccaggggatctatgagtcaatcatcagcgtactggagaccaaccggcgggcgctggatatcgaggcgctgaagcgcgcggtgagctggctgagcgatgcgcggcagatcctcgccctggggatgggcggcggttcgaccatctgcgctcaggaaattcagtatcgcctgtttcgcctcggtctgccggtagtcagccagagcgatggtctgctggtacgcatgatgagctcggcggtgacgccgcaggatgtggtgatcgtgctgtctctgggcggctatacccgggaaatcatcgagagcgcggcgattgccagccagtacggcgcgaaggttattgcgattacccccgccggaacgccgctggctgaacaggcggatctggtgctaccgctgctggtacgggaaaacgactatatctttaagcccagcacttcccgttacgcgatgctggcgatggtcgatgtgctggccaccgaactggcgatggccaacaaaacccaggcaaaaggcaaattacgccgtattaagctggcgctcgacagccaccgcggcggcgtcgatcggcagccgctgggggactaa

SEQ ID NO: 1722 - DNA, 660 bp, Klebsiella pneumoniae
tatactgggcggacagagaggagaatcactatgactgaacgggtttattacaccagcgatgctaccgacgggcgcgcccagatcatcgcctgcactgcagaagcggatggccgttacgccatcgaactggatcggacgctgtttcacccgcaagggggcggtcaaccggcggaccgcggatggattgccgggcaggtggttgagacggtggttgtgcgcggcgaaagggtgctgcatattctgtcgcaactccttcccctcggtgaagtggagatgaaaattgatgcctccgcgagacagctgcatgctcgtctgcattctgccggccacctgcttggcctggcgggcgaacagcttggctggcaaccggtgaaagcgcaccactggcccggcgaagggcggataacctttgccagcaggaatagcgccgcgctgccggacgccagtgcgctactggcgctagtaaaggcatggcaggcgcaggacttaccgcgtcaggtgacgttcgctgatggcatgcgcaaggtgggattcggcgagctgccagcctatccctgcggaggcacccacgtcgcccgtctggcggagctgggcgacattgtcattagtcagattaagatgaagaaggggcaactggtggtcagctacaccctggcgtaa

SEQ ID NO: 1723 - DNA, 738 bp, Klebsiella pneumoniae
aatggggggcgctgcgcctcgataacgcctgagagagagaaagaaaccgcaatgcgtttaacgattattttagtcggtcctgcccgggccgagaacgtcggcgctgccgccagggcgatgaaaaccatgggatttcgcgaactacggatcgtcgatagcgaagcccacctggcgccgccggcacgctgggtggcgcatggctcaggcgacatcctcgatggtatcaccacctatcccacccttgccgaggcgctgcatgacgttgatttcaccgtcgccaccaccgcccgcagccgcgcgcgttttcactattacgccacgccgcagcagctgttgccgctgctggaggagaaggcgcagtggatgaaccatactgccctggtatttggtcgtgaggacgccggattgaccaatgaggagctggcgttggctgatgtgttgaccggtgtgccgatggctgcggattatccgtcgctgaatctcggccagtcggtgatggtctactgttatcaattagcatcgctaatgcaacaaacggcgcccgccgccgctgcggcagaccatcatcagctgcaggccttacgtactcgtactctggcgttactttcgcgtttgggcgtggaggatgatgccaaactggccgactggttgtcgcaacggctgggcctgctgcagcagcgcgacacggcaatgttgcatcgtttgctgcatgatattgaaaaaaacctgccagaataa

SEQ ID NO: 1724 - DNA, 807 bp, Klebsiella pneumoniae
gatttttttagaattattgccatggtcattatggttatgatcctttctgattgtcgtcagtcgtattatattgccagaaatacggggcgcaatataatgaccttatccgaccatcagcgcgctaaatcggcgttaaacgctaacgatttaaatgcagctcagggctacctgacgggagaaaaatacaataatcgctacaggcctgttagcggtgaggaatcctggggaagtttacaatatcgggcggcgaaaatcgtcgccaacgccgcggcgaacggtcaaaaagtgcgtaatgatgcgctctatctcgcttatatctctttgtttgaagcagaagagggagtgcccgaacatcccgatattatgttgggttacatgcataaagccatggcgctactgttagcgaatccgcaattactcgataaaatcgattctaaaaatgtcagtactttacccagccagtttacccttgaacgctatgctgtatggcaatatttatacgatggcggcgagattgactggaccaaaaaagcgcctgaaggtgaaggttatacaattgctggtgaaagctatcagacctggaatatcaagttaaaaaaagctatctggaatcggggagacgcttttttaacaaatataggtaaacaacaatttattcatgacgctatagattattcgcaattcccggttattgcctgtaccgccaggcgaaaaggctggcacttaacattacctgctgactaccgggaacaaaatttccgcggcggtggacgttttgattgggcttcatgtcgcgctgttgaataa

SEQ ID NO: 1725 - DNA, 411 bp, Klebsiella pneumoniae
ctaacttttagtaagtacgtacgaaaaggtaagtgtgaaatggccgaaccgacgctgagcgagaaactgcgcaccggcaatttgtttgcggaacagtgcccgtcgcgcgatgtgcttaaacatgtcaccagccgctggggcgtgttgattctggtggcgctgcgcgagggaacccaccgtttcagcgatctgcgccgtaagatgggcggggtcagcgaaaagatgctggcgcagtcgctgcaggcgctggagcaggatggttttatcgaccgcgtctcttatccggtggtgcccccgcacgttgaatatagcctgacgccgctcggcctgcaggtgagcgagaaggtggccgccctggcggactggatcgaggttaatctgccctcggtgctggctaaccacggggagtga

SEQ ID NO: 1726 - DNA, 699 bp, Klebsiella pneumoniae
gctgaccatagtcatagcatctatcttgcatgccgattacaatcattacttgatttttgcgagcagcattccggatttttgatgacaaacaccatgaaaaaaaatgacaaacgctggattggcgatctgctgggcggttcgttgatggtccgggagagccgaaccattgctgaactgttgctttctgaaccagatgaaacggcttggcagcagcaaataatcaatgaaaacattcttcaggcgtcctctaccagtaccgcaaatcgttatgcccgaaccttaaggctgcgattgatgaccctggatcgggagtgctggaaactgattgctgatggtagtgaaagcgaacgtctacaaatgctattggttgcattgatgatccagtctccaattgttgcggagtttattgctgaagttgtaaatccggctcgtcaacagtttaaagaaaaacttggtatgaactgctggagtgaatttgtggatgagaatctgcgattgcacccggagctggctgctttctctgattcatctatccaaaagatgggcaacaatctgattaaggctctggcagaagctggttacctggatagcccacgccgccgcaatttacaaaacgttttccttctaccagatgttgcaacggccttgcatcgtttaaacaaagccgaactgctccctattctggagggtaacgcatga

SEQ ID NO: 1727 - DNA, 567 bp, Klebsiella pneumoniae
cgatcaatcagcctctgcatcctggcgcccgtagctattgctcgcgctgacgatgctggcttccgtgaagtggatggtgaaggattatcttccgctctggtaagaaggtgggcgcaggaaaaaacaacgccacccgaaggtggcgctgtcgtggttaatactggtcgcgatccaaccagttgccgttcgctatcaacgtacaaccctcaacggaacgttgatagacatacatccatgcgctgccgtaaggcgtctgaatcaggtggcgcgcatactcgccccccttggtgcgcagcgcatccagttcggccagcgtcgatgcatcaatacgataaacttcaccatgtactgtgccttcgccgggcaccgcgcctggatagtggcccaggctgtacagctgataatcgtcgacactatgagcgcccagccactgggcgttggtcatccagtggctgttgccttgtttgcgtcgtaaactgccgtaaacaaatattcgcattgctaaaactcaaactgatagagcaaatcgagcgcctggtcgatgccagacaccgcttccacatatag

SEQ ID NO: 1728 - DNA, 273 bp, Klebsiella pneumoniae
tcgagatggctggcgatgcgggtaaagttaggtatatccggaatattccataacgaggctaaccggggcgaccgtcaggccgccccggcgttatcaatgcgccagcgcggcgatctcgtcggcggccaggccggtgattttcaccaccgtctcgcgggcaataccgtcgtccagcatcctctgtgcgatgcgcagcgcctcggcatgctgtccttcttgtctgccttcaagccggccttcccgtttgccttttctacggcctacttcctgtaa

SEQ ID NO: 1729 - DNA, 276 bp, Klebsiella pneumoniae
agcagcgccaggcggagctggattccacggcgaaacgccatgttcgctccaacgccctctcccagcgtggcgccgtctccgcccagcagctggatgacgatcgcgcggccgcagagagcgcccgcgcggcgctggaatcggcgaaagcccaggtctccgccgcccgcgccgccatcgaagctgcccgcaccagcattattcaggcgcaaacccgcgtcgaagccgcccaggcgaccgagcggcggatcctcgccgatattgacgatagcgagctga

SEQ ID NO: 1730 - DNA, 1737 bp, Klebsiella pneumoniae
gcaccagccagccgcaggccatggcggccacgccaagcgccgtcggcaccagcagggtcatggctccgaggcgagcgccgatcaggtaggccaccgggccgccgacggtggcggccgtggccagcacccagccgggaagcgtcgcggtgcgggtcagtcgggtccagacgacggcgaacatcagccacagggccaccatccacaggggcagcaggctgtcgccgcgaaaatcgatcagtcccgccagcgcccagcaggcgtccagaccgcagcccgccgcggccaacagcagggcgggcggacgactggccgccggcaaccgcagccaggcgaaaatggccagcatcagccagatcagcagaccgcgctcgcgcaacatcaccaccagcgtccagtaaacatcgaacgcgagggccatcagcagatgctgcgccgggcgtgtcatacccgctccgcggtgagctgcaccacgctgatggtgcgggcgttaaatccggcttcgcagtagccgaagtagtagagccacatccggcggaaacgctcatcaaagccgagcttttcaatatcctgccaggcgtgggtaaaacgctgccgccagtgggccagggtgcgggcgtaatccgggcccatgtcgaacaggttgcgcaccacaaaatcggtatggcgggtcatcagctcgctcattgccgtgatgctgggcaaaaagccgcccgggaagatgtagcgctggataaaatcgacgcttttgctgtagtcgcgatagcgctgatcctgaatggtgatcgcctgcagggccattttaccgcccgggcgcaggcgcgcctggcaggtgcggaagaaggccgggaggtagcgctggcccaccgcctcaatcatctccaccgacaccagtttgtcgtactcgccgcgcagatcgcggtagtcgcagagcagcacctcgacgcgatcctgcagcccggcgcgggccatgcgctcggtagcccagcggtgctgctcccgggaaagggtggtggtggtgacccggcaaccgtaatggcgggcggcgtactcggccagcgccccccagccggtgccaatctccagcagatgatcgccggggttgagcgccagctggtcgcacagacgcgccatcttggcccgctgggcctgggtcagatcctgctcgtcgtcggtaaacagcgcgctggagtagagcaggtcgtcatccagaaagtgggcataaaattcgttgccgaggtcgtaatgggcggcaatgttctcccgcgcctgggcgcgggtgttgcggcgagtccagtggcgcaggcgggcgacaggcttacccagcagacgaaagccgcgctccagacgccccagcacctcgccgttgcgcgcaaggatctgcagcagcgccgtcagctggtggctctcccagtcgccgtccatccaggcctcggccgccgccaggctgccgccggtcagcagacgccagtacacctccggcgcgcagacccgcgcctcggcgcgcagcgcggcggcggggtcgccaaactgaaaagtctgcgccccttcgcgcacggtgagcgagccttcgcggaggccgctcaacagacgaaagagcagccagcgcgcgagccgcacgttgcgcggcacatctggttcaagcgcaaagacgggatcggtcatgagcgttcactcctgctgacaggatggttatacagcggcacgcgcttcagccacagccgcagcgcctgccagtag

SEQ ID NO: 1731 - DNA, 1263 bp, Klebsiella pneumoniae
atattccacagggagggcgagatgatgcacaggatttcccactggctgagccgacacgccgccgcgctgttcttcccggcggcgttaattctgtatgatttttccgcttatctcactaccgatctgatccagccggggatcctgcacgtggtgcgggatttcaatgctgatgtggcgctggctccggcctcggtgagcctgtatatggccggcggcatggcgctacagtggctgctggggccgctctctgaccggataggacggcgtccggtgctgctcaccggcgcgctgattttcaccctcgcatgcctggcgaccctgttcaccacctccatgacgcagttcctgattgcccgcttcgtgcagggcaccagcatctgctttatcgccaccgtcggctacgtcaccgtacaagaggcctttgaggaaaaaagatcgatcagactgatggcggtgatcacctccgtcgtgctggtggcgccgatcgtcggtccgctctccggcgcggcgctgatgcatttcattcactggaaagcgctgttcggcattatcgccgccatgggattggtggcctggctcggcctgctgttgaccatgccggagacggtgcgccgcggcgatgtgccgttcagccccctgggcgtgctgcgcgattttcgcaacgtctttcgcaaccgcatctttttactcggcgccgccacgctgtcgctgagctatattccgctgatgagctgggtggcggtatcgccggtgattttaatggacgccggcggactgaccaccagcgagttcgcctggagccaggtgccggtcttcagcgccgttatcatcgccaacctgtcggtggcgcgctgggtaaaagaccccacccgcccgcgctttgtcctcagcgcggtgccggtacagatgctcggcctggccatcctgatcgttggcaatctggtatggccccacgtctggctgtggtcggtgctcggcacctgcttctacgccttcggcatcgggctgattttcccgacgctgtttcgctttaccctcttttccaacgacctgccgaaaggcacggtctccgcctcgctgaatatcgtgatcctcagcgtcagcgcgttatcaattgaaggcgcgcgctggctgtggttccatggcggcagactccccttccacctgttggcggtggccgccgggattgtcgccgcctgctgcctggccggactgttacgccaccagcgcggacaagcggtgatcgaagcccggcagtcgtga

SEQ ID NO: 1732 - DNA, 1698 bp, Klebsiella pneumoniae
tcagcacggctacgaccacccacagccagcgtagccccgttgaacagatcgatttactcatcaggcgaatttacgttgctcgccgtcaccggcgacgttgctcacacagcgtccgcagatttccgcgtgttccgccaccttgccgatatcggtggtgtaatgccagcagcgcgggcatttctcaccttcagctttactcaatgcgactttcagccctttgagcagttcgctttgctgcgcatcagcggacgcgctcgcatagtctgcgacgttcgccccggaggtcaacaggacaaatcgcaattcatcgcccagcgcattgagcttagccgccagatcggcatcagcatacagcgtgactgccgcttccagcgagccgccgactttcttatccgcacgcgcctgctcgatcaccttgttgacttcgccacgcaccttcagcagctcatcccagaaatcgtcgttcatcgcttcgtcgtcggccaggccgaacagaccttcataccactcgccggtgaagacatatttctcacgctcgcccggcagatagccccagatttcatctgcggtgaaggacatgatcggcgccatccagcgcaccagcgcttccacgatatggaacagcgcggtctgacagctgcgacgcgccacgctgtccgccttggcggtgtactggcggtctttgatgatgtcgaggtagaacgagcccatctcgatggagcagaagcgcatcaggcgctgcaccacttcatggaagtcgtaggattcgtaggctttcaggatatcttcctgtgccgcctgcgcgcagccgaccgcccagcggtccagcaccaccatctcttccggtttaaccatgtctttcgccggatcgaaaccgttaaggttcgccagcaggaagcgcgcggtattacggatacgacgatagctgtccgcagcgcgtttgaggatctcgtcagagaccgccatttcgccggtgtagtcggtggaagccacccacaggcgcaggatatcggcgccgagcttgttcatcacgtcctgcgggctaacggtgttgccgatagacttggacattttgcggccctgaccgtcgacggtgaagccgtgggtcagtacctgacgatatggcgctttgcctttcatcgccgtggaaatcatcagcgaggacatgaaccagccgcgatgctggtcagaaccttccagatacatatcggcggcgtgaccggcgaattccggacgcacgtcaaccacggaagagtgggtcgacccggagtcaaaccagacgtcgagggtatccggcactttctcgtagctgtcggcgtcatcgccaagaatgtcgcgggaatcgagatcccaccacgcctggatgccgtcaacttcaacgcgttttgccacttcttccatcagttcaagggtacgcgggtgcagttcatgggtttctttatgcacgaacagcgacatcggcacgccccaggtgcgctgacgggagatacaccagtcagggcggttagcgaccatcgattcgatacgcgcctggccccagtccgggatccactgcacgcctttgatctctttcagcgactgcgcgcgcaggcctttctgatccatgctcacgaaccactgcggagtggcgcggaagatgatcggcgacttgtggcgccagcagcatggatagctgtgctgcagtttctcaacgtgtaa

SEQ ID NO: 1733 - DNA, 951 bp, Klebsiella pneumoniae
cctttctgcaggagagcccgtcaggctctcctggacattatcagggagagaagcatgtcacatattaactacaatcatctgtactacttctggcacgtgtataaagaagggtccgtcgtgggcgcggcggaggcgctgtttctgacgccgcagaccattaccgggcagatcaaagccctggaggagcgcctgcaggggaaattatttaagcgaaagggaagggggcttgagccgagcgagctgggggagctggtttttcgctatgccgacaggatgtttaccctcagccaggagatgctcgacatcgtcaactatcgcaaagagtcgaacctgctgtttgacgtcggcgtggccgatgcgctctcgaaacggctggtcagcggcgtgctggatgccgccgtcgttgagagcgagcagattcatttgcgctgttttgaatccactcatgagctgctgctggagcagctgagccagcataagctcgacatgattatctctgactgcccgatcgactcgacgcagcaggaagggctattttcggtgaagattggcgagtgcagcgtcagcttctggtgcatgaatccggcgccgacgaagccgttcccggcctgcctcgaagagcggcggctgctgatccccggccggcgatcgatgctgggacgtaagctgttgaactggattaacgtgcagggcctgaaggtggagatcctcggcgagtttgacgacgcggcgctcatgaaagccttcggcgccgcacataatgcgatatttgtcgcgccgacgctctacgcgcatgatttctaccatgatgaatcgattgtcgaaattggccgtatggatagcgtgatggaggagtatcacgctattttcgctgaacgaatgattcagcacccggcggtacagcgtatctgtaatcgcgattattcgtcgctgttcaccgaaccccgatag

SEQ ID NO: 1734 - DNA, 195 bp, Klebsiella pneumoniae
gccatcaggctgtccagctcatggctccggcactccaccgcggcgagaaactgcgctttttgctccgcgttcagtttattccagctgtgctgcagaaaatgcgccagcaactgctgctcgatctgcggcgtcgacagctgtttgtcgaccttcgctttcagtcgtttacatacatccagcaggatcgcgcgataa

SEQ ID NO: 1735 - DNA, 1434 bp, Klebsiella pneumoniae
aaaaagaggctaatgttaccagttaaggcgcgcactgaaaaacggttctctgttagacttcagttaactccttcttacattatggcattagcaatgaaagtcatctctcaagttgcacagcagcgtaagacgctggaagaagccgttaccacggcactggaactggcggcaggtaaatctgatggtgcggaagtttccgtcagcaaaaccacgggcatcggcgtcagcacccgctatggcgaagtggagaatgtagaattcaacagcgatggggcattaggcatcacggtttaccatcagaaccgcaagggcagtgcctcctccaccgatcttagcccggacgctatcgcccgcaccgtgcaggcggcgctggatatcgcccgctatacctccccggacccgtttgccggcgtagccgataaagatctgctggcctttgacgccccggatctggacctgttccacccggcggaggtctccccggacgacgccatcgaactggccgcccgcgcggagcaagcggccctgaaggccgataaacgcatcaccaacaccgaaggcggcagctttaacagccactacggcatcaaagtgttcggtaacagtcacggcatgctgcaaagttactgctcgactcgccactccctctccagctgcgtcattgcggaagatgacggcgatatggagcgcgattacgcctacaccattggccgggcgatcgaggatctgcagtccccggaatgggtcggggaagagtgcgcccgccgcaccctgtcacgcctggcgccgcgtaagctgtcgaccatgaaggcgccggtcattttcgccaacgaagtggcgaccgggttgtttggccacctggtcggagcgattgccggcggcgcggtctaccgtaaatcgaccttcctgctcgattcgctgggcaaacaaattttgccggagtggctgaccattgaagagcatccgcacctgctgaaagggctggcctccacgccgttcgacagcgaaggcgtgcgcaccgaacgtcgcgatatcgtcaaagacggcgtgctgacccagtggctgctgaccaattactcagcgcgcaagctggggatgaaaagcaccggccacgccgggggcatccacaactggcgcattaacggccgcggtctgagttttgcaaagatgcttaaagagatgggcaccggtcttgtggttaccgaactgatggggcagggtgtcagtggcgtcaccggcgactactcacgcggcgcatccggcttctgggtagaaaacggcgaaattcaatatcctgtcagtgagatcaccattgcaggaaatctgaaagaaatgtggcgtaatatcgtgaccattggcgatgatattgaaacgcgcagcaacattcagtgcggttctgtgctgctgccggagatgaaaatcgccgggcaataa

SEQ ID NO: 1736 - DNA, 753 bp, Klebsiella pneumoniae
ggagaaacaagcatgaaactgaccccaaacttttaccgtgaccgcgtgtgcctgaacgtcctggcgggcagcaaagacaacgcccgtgaaatttacgacgcggcggaaggtcacgtcctggtcggcgtgctctccaaaaactatccggacgtcgccagcgcggtggccgatatgcgcgactacgcgaagctgatcgataatgcgctctccgtcgggctgggggcaggcgatccaaaccagtcggcgatggtgagcgagatttctcgccaggtgcagccgcagcacgtcaaccaggtcttcaccggcgtggctaccagccgcgcgctgctcgggcagaacgagacggtggtcaacggcctggtctctcccaccggtacgccgggaatggttaagatctccaccggcccgctgagcagcggcgcggcggatggcattgtgccgctggaaaccgccatcgcgctgctgaaagacatgggcggcagctccatcaaatacttcccgatgggcggcctgaagcaccgcgtcgaattcgaagccgtcgctaaagcctgcgccgcgcacgatttctggctcgagccgaccggcggtatcgatctggaaaactacagcgagatcctgaaaatcgccctcgatgccggggtaagcaaaatcatcccgcatatttacagctcgattatcgataaagccagcggcaacacccgcccggccgatgttcgccagctgctggagatgaccaaacagttagttaagtag

SEQ ID NO: 1737 - DNA, 774 bp, Klebsiella pneumoniae
ccggaacaaagtgaagttaacctgctgccgcctattgtttctttttcgctgagatttgtcatcatccgccgacaaagttttacccatttcgctatggctgttatgctttcgcacgcttttatcttgatgtttatcacccaaaaaggaacaacgatggcaaccccaacttttgacactatcgaagcgcaggcaagttacggtatcggcttgcaggttggacaacagctgagcgaatccggcctgcaggggctgctgccggaagcgctggtggcgggtatcgccgatgcgctggaaggtaaccagccgcaggtgccggtggaagccgttcaccgcgcgctgcgtgaaatccacgagcgtgctgacgctgtgcgtcgcgagcgttttcaggccatggccgctgacggccaaaaataccttgatgaaaaccgcgagaaagagggtgtgaacagcaccgagtctggtctgcagttccgcgtactgacccagggcgaatgcccgatcccggcgcgtactgaccgcgttcgggtgcactacactggcaaactgatcgactgcaccgtcttcgacagctccgttgctcgcggtgaaccggctgaattcccggtgaccggcgtgatcggcggctggattgaagcgctgactctgatgccggtaggttccaaatgggaactgacgatcccgcacaacctcgcctacggtgagcgcggcgctggcgcatcgattcctccgttcagcaccctgatcttcgaagttgaactgctggacattatctaa

SEQ ID NO: 1738 - DNA, 1095 bp, Klebsiella pneumoniae
ttaatgaaaagcgcgcccaggcgcgtgattactaaaacgaacctctaccctgaatcctacagacttacggagaaaaccattatgtcgctcaaattaggtgtcatcggcgctggcgctatcggtaaagaacacatccgtcgctgcacccaggttctgcagggcgccaccgttgtggcggtgtctgatatcaatgccgacaacgcccgcgcggcggtcgcgctgccgggcgtgcaggcggaagtctacgccgacggtcacgacgtgattaacgccagcgatgtcgatgccatcctggtcacctcctgggacccgacccacgaagaatacaccctggccgccatcgccgccggtaagccggtgttctgcgaaaaaccgctggcgatgaccgcggaaggctgccgccgcatcgtcgatgccgaaatgaaggccggccgtcgtctggtgcaggttggctttatgcgcccgtacgacgaaggctatctggcgctgaaaaaagtgatcgacgatggcgatatcggcgcaccgctgatgctgcgctgcgcccaccgcaaccagtcggtcggcgagaactacaccaccgatatggcgattaccaacaccctgatccacgagctggacgtgctgcgctggctgctgaacgatgactaccgctccgtgcaggtgcgcttcccgcgctccacatcgcacacccatgcgcgcctgaaagatccgcagatcgtctcctttgaaaccaaaaaaggcactctgatcgacgtcgaggtgttcgtgaactgccagtacgggtatgacatccagtgcgaagtggtcggcgagaccgggattgcccgtctgccggagccgtctgccgtccagatgcgcaagtccgccagcctgtcgaccgccattctgaccgactggaaagaccgctttatcaaagcctacgacgtcgagctgcaggcctttatcaacgacgtcaaagccggccagctgcacggcccgtcggcctgggacggctacgcggcgtcggtggcggcggatgcctgcattaaagcgcagggaaccagcgagccggttgaagtgacgctgcctgagtgcccggcattctacaaacgttaa

SEQ ID NO: 1739 - DNA, 1047 bp, Klebsiella pneumoniae
cggagacgaagaagagtaaaggagaacagtatggagtcggtaactctatcgttacctgaagcttatgacctggcgctggaggtactcagcgccaatggatttagcgccgaccacgcggcggcgattgcccgcaatgtgaccgccggggagcgcgacggctgcgcttcccacggcctgtggcggctgttgggcattgtcgataccctgcgcaaaggtaaggtatcgcccgatgccgagccgcagatccatgaccaggcgccggggattgcgcgggcggacgccgggggcgctttttcactgctggcctacgagcgcgtgctgccgctgctgctggagaaggcgcgccacaatggcattgcggcgctggcaattaatcgctgcgttcatttttccgcgctgtttgccgatattgagccgttgaccgaggcagggctggtagggctggcctgtacgccaagccacgcctgggtcgccccggcgggcggcacacgtccgctgttcggcaccaaccccatcgccttcggctggccgcggcaggataagccgccgtttattgttgatatggcgaccagcgccgcggcgcgcggcgagatccagctgcatcagcgcgccggcaaagcgctaccggaaggctggggaatcgacagtcagggacagccaacgaccgatgccgcagaggtgctgaacggcgcgatgttgactttcggcggccataagggctcggcgctggcggcaatggttgagctgttggccgggccgcttatcggcgatatgaccagcgccgaatcgctggcgtgggataacggcgcgggcggtctcccctacggcggcgagctgattctggcgctggatccgcagcgttttctcggcgcgcaggcaccagagcagctggcgcgcgccgaaacgctgttcatgggtatgcaggaacaaggggcgcggctgccgggcgagcggcgttttgcctgccgccagcagagtgagcggcagggggtcgccatcagccgttcattgcatgatgagatttgcgccttgcgccagggtgggtaa

SEQ ID NO: 1740 - DNA, 309 bp, Klebsiella pneumoniae
ttaacgatgagtgaggtaaacggcgatgtatacgtagccgcaactgccaagggtatcggcttcgcaggtgaaaccattgtggtacagggtgacacagtgggcatggcgaggatttatttcaccagtagtcagcatcgattccatctggcggataaaacgtgtgaatacttcatccaacttcaaagattctgcgttactgaattcaccggtaatgcaggcccgatcagccagatagtgcagccggtttccctcctgtaccagacgagcaccaaagcaaggtgtcatattacaattcagtccccattttag

SEQ ID NO: 1741 - DNA, 714 bp, Klebsiella pneumoniae
atcaccccgagggcaggcggtaatgcccgaaagcggttgataacgagtccagaacggaaaaaaagcatgttacaagtataccttgttcgccacggtgaaacgcagtggaacgccgagcgacgtattcagggtcagtccgacagcccgctgaccgcccatggtgagcgccaggcctggcaggtgggcgagcgcgccagaacgctggggatcacccatatcattaccagcgatctggggcgaacccgccgcacagcagaaattatcgccgaagcctgcggctgcagcgtgatcgccgatgcgcgcctgcgcgaactggatatgggggtgctggagaagcgccatatcgactcgctcagcgaagaagaagaaggctggcgtcgccagctggtcaacggcacaccggacggtcgtattccgcagggcgaatcgatgcaggagctcagcgagcgtatgcatgcggcgctggcatcctgtctggaattacccgccggtagccggccgctgctggtgagtcatgggatcgcgctgggctgcctggtgagcacgatattagggctgcctgcgtacgctgagcgtcgtctgcggctgcgcaactgctctatttcgcgcgtcgactatcagcaaagcccgtggctggcttccggctgggtggtggaaacggcgggcgacgtctcgcatcttgacgcccccgcaatggacgagctgcagcgttaa

SEQ ID NO: 1742 - DNA, 540 bp, Klebsiella pneumoniae
tgcggcacgagcttccgtttcttgatacttaccctgataagtattattttcttctcaataatgagaggaagacccgtgactgaagacgaactgtttgcccgccgcccgctggggatgcggatggctatggtggtgcgccagtggcgcgccattattgactccgctatcaccgataccggactcacccagtccagctggacggtgctgatgcaactgcatcagctgggagacaacgtctcggtcagcgaactggcggaggtgcagggcattgaactgccgccgctaatgcgcaccctctcattactggaaaagcagggctatctggtgcgttccacatcgccatatgacaaacgcattcgcctgctgacgctgaccgctgaggggcgggctattctggaaaaactgagctgcgtgatcgagacctatcaggagcgcgtaacccagaccatcccggaggccgatctcgccaccttcagcgccacgttaaatcaaatcgcctgccgtttgcggaatatccgcgaagaagataacaagatctaa

SEQ ID NO: 1743 - DNA, 321 bp, Klebsiella pneumoniae; identical to SEQ ID NO: 1389

SEQ ID NO: 1744 - DNA, 912 bp, Klebsiella pneumoniae
aactgctggagaaaggagcccactatgagcgctgaaatctcgccgctgctggtccgcacgcccgccgctgcccgtccgctgtggctgcgcctgcgccgctcgtcgccctttacgctcacagtattaatgtgctgcctggcgctgctgtgggtcagcccgtttatctggatgctggccacttcgttcagcgccaccaccttcggcgacgatatggcgtcgctgctgccacgcctgccgctgaccctcgataacttccgcgacgcctggcagagcgccgactggctgagcctgtacgccaacacccttatcttcaccttcggcaccttcttcgtgcagctgttgaccatcaccaccgccggctacgtcttcgcctgccacgagtttcgcggcaagcagacgctgtttctcctgttcctggtgcagctgatgatcatgccggtggtgatgatggtgccgaacatgctgaccctgaaaaccttcggcctgctcaacacccttaccggggtgatgatgccctacttcacctcggcgttcggcgtgttcctgatgcgtcaggcgttcctcgccatcccgaaagagctggaagaggcggcgctgatggagggctgccgctggtggcaggtgctgttccgcgtactgctgccgatgtcctggccgtcggtgctggccttcgccaccgtcagcattacctaccactggaacgagtacctgtggccgctgatgatgctcaacgatcccgataagcaggtgctgaccgtcgggctggtctccttcgccatgggcgccgaatccggcggccagtggggcaccatcggcgccgggacgctgatggtctgcctgccgctgatgctggcgttcatcctttttcagaaacagttcctgcggagcttcggcttctccgggatcaaataa

SEQ ID NO: 1745 - DNA, 1362 bp, Klebsiella pneumoniae
cctgtcaggagggctactatgtctgctaaccatgctgcgtttaatttgatatttcgctttgtagaaaattacataagccccatagcagggcggatctcgtcgcagcgccacgtcatggctatccgtgacggatttatctcagcgatgccgtttatgatcgtcggatcgttcctgttagtgtttgcttatccaccgttctcaccggataccacctggggttttgcccgcgcctggctggatctggcgaaagagtttgaggggcgtattctgaccccctttgatatgacgatggggatcatgtcgatctacatctgcgcggcaatctcctataacctcggtaagcattacgagaaatccaatcagctcgatccctttatgtgcgcaatgctgtcgatcatggcctttttgctgattgccgcgccgaaaaccaatggcacgctgccggtggatagcctcggggggaccgggatctttaccgccattctggtggcgatctactgcgtggagatgatgcgtttcttgaaagcgcacaacattgggatccgcttgccggaccaggttccgccgatgatcaaaaactcgtttgatctgttgatcccggtgctggtggtcgtgctgacgctctatccgctgagcctgtttatccagcaccattttgacatgctgatcccgcaggccattatggccattttcaagccgctggtttcggcagccgactctctgccggcaattctgttggcggtgctgatcggccacctgctgtggtttgccgggatccacggtgcggcgatcgtgtccgggatgctgcagatgttctggctgactaacctcggtatgaaccagcaggcgctggcccagggcgcgcctctgccgcatatctttatggaggcgttctggaccttctttatcgtggtcggaggttccggggcgaccatgggactggtgttctgttatctgcgcagccgttcagcgcatttgcgctccattggtcgtttgagcgtggtgccaagcctgttcaatatcaacgagccggtgatctttgggacgcctatcgtcatgaacccagtgttctttattccgttcctgctggcgccgatggtgaacgcggtgctggcctgggctgcaatgaagctggatctgattggccgcgtcatctccgtcgtaccatggacggcgccagcgccaattggcggcgcctgggcgctgggctgggatttccgggcggcgattctggtcattgttctggcctgcgtgtcggcaatcatctacttcccattctttaaggtatatgagaaacagctgcttgctcaggaagcggaagaggccgagcgggcggagcaggagagtcaacagaccgcataa

SEQ ID NO: 1746 - DNA, 414 bp, Klebsiella pneumoniae
tccgtaaggagcaattcgatgcgtcattacgaaatcgtttttatggtccatcctgaccagagcgaacaggttccgggcatgatcgaacgttacactggtgcaattactgcagcagcaggtacgatccaccgtctggaagactggggccgccgtcagctggcttatccgatcaacaaactgcacaaagctcactacgttctgatgaacgttgaagcgccgcaggaagcgatcgatgagctggaaactaacttccgcttcaacgacgccgttatccgcagcatggtaatgcgtactaagcacgctgttaccgaagcatctccgatggttaaagcgaaagacgagcgccgtgagcgtcgcgaagatttcgccaacgaaaccgcagatgattctgaagctggggattctgaagagtaa

SEQ ID NO: 1747 - DNA, 1251 bp, Klebsiella pneumoniae
gttaaaaggagattagcgatgtcgtcatttgactatttaaaaagcgccattaagcagaaaggctgtaccctgcagcaggtggcggaagccagcggaatgaccaaggggtatcttagccagctgctgaatgccaaaatcaaaagcccgagcgcgcagaagcttgaagcgctgcatcgtttcctcgggctggagtttccccgccgacagaaaagcgtcggcgtggtgtttggtaagttttacccgctgcataccgggcatatctacctgatacagcgcgcctgtagccaggtcgatgagctgcatatcattatgggctatgacgatacccgcgaccgcgagctgtttgaagagagcgccatgtcgcaacagccgacggtgcctgaccgcctgcgctggctgctacaaacctttaaatatcagaagaatattcgcatccacgccttcaatgaagaggggatggagccctatccgcacggctgggacgtgtggagccatgggatccgcgcttttatgagcgaaaaagggatcgagccgaaccggatctatacctcggaagaggccgatgcgccgcagtaccttgagcatctggggatcgagacggtgcttatcgatcctaagcggacctttatgaatattagcggcgggcagatccgcgagaacccgttccgctactgggaatatattccgacggaagtgaaaccgttctttgtgcggacggtggcgatcctcggcggcgagtcgagcggtaaatcgacgctggtcaataagctcgccaatatcttcaataccaccagcgcctgggaatatggccgggattatgttttttcgcatctcggcggcgatgagatggcgctccagtattcggattacgataaaattgcccttgggcatgcgcagtatattgattttgcggtgaaatatgccaacaaggtggcgttcatcgataccgacttcgtcagcactcaggccttctgtctgaagtacgagggacgtgagcacccgtttgtgcaggcgctgattgatgaataccgcttcgacctggtgatcctgctggagaacaataccccgtgggtggccgatggactgcgcagtcttgggagctcggtggatcgtaaagagtttcagtcgttgctggtatcgctgctgaaagagaacgagatcgaattcgtccatgtgaaggagtcggactacgatgcccggttcctgcgctgcgtcgagctggtgaaacagctgatgggcgagcaggggtag

SEQ ID NO: 1748 - DNA, 867 bp, Klebsiella pneumoniae
acacgaaggagaagacccatgatcgctcttaccggtgccaccggccagcttggccactacgttctgcaagacctgcttaacaccgtccctgccagccagattgtggcgattgtccgcaacccggccaaagcccaggcgctcagccagcagggcgtggttgtccgccaggccgactacagcgacgaagcggcgctgaccgccgcgctgcagggcgtggataaactgctgttaatctcctccagcgaagtcggccagcgtgctgtacagcaccgcaacgtcattaacgccgccaaagccgccggagtgaaattcatcgcgtataccagcctgctgcatgccgacacttcgccgctgggtctggccacagagcatatcgaaaccgagcagatgctggccgactctggtatcgcttacgccctgctgcgtaacggctggtataccgaaaactatctggccagcgcgccgccggcgctggagcatggcgtgtttatcggcgccgccggcgagggtaaaatagcctccgccacccgcgcggattatgccgccgctgccgcccgcgttatcgccagtgagggtcatgaaggcaaaatttacgaactggcgggtgataacgcctggacgctgagcgacctggctgccgagctgagcaagcaaagcgggaaaaacgtggtctaccagaacctcagcgaagccgatttcgccgccgcgctgaaaagcgtcggcctgccggccgggcttgccgatatgctggcggattccgatgtcggcgcgtcgaaaggcggactgtttgacgacagccgtaccctgagtacgctgatcggccgcccgaccacctcccttgctgaaagcgtgaaaggcattctgtaa

SEQ ID NO: 1749 - DNA, 285 bp, Klebsiella pneumoniae
aacacatttgggagttggaccttggctaatatcaaatcagctaagaagcgcgccgttcagtctgaaaaggctcgcaagcacaacgcaagccgtcgctctatgatgcgtactttcatcaagaaagtatacgcagctatcgaagctggcgacaaagctgctgcacagaaagcatttaacgaaatgcaaccgatcgtggaccgtcaggctgctaaaggtctgatccacaaaaacaaagctgcgcgtcataaagcaaacctgactgcacagatcaacaaactggcttaa

SEQ ID NO: 1750 - DNA, 1521 bp, Klebsiella pneumoniae
cctgcgtctggactgggagccgaaaggggtcgccgtcacggtggtctctccgggcttcgtcgacaccccgctgacgcgcaaaaacgacttcgccatgcccggccgggtgagcgtggatcgggcggtggcggcgatccgccacggtctggcgaagggcaaaaaccacatcgccttccccaccggtttcagcctggccctgcgtctgctggccagtctgccatcgggtatccagcgcctgctgttgcgcaggatggtgcgctcatgaatatcgccatcatcggcagcggcatcgccgggctgacctgcgcctggcgactggccggacaccatcaggtaacgctgttcgaagcgggcgccacgccgggcggccacaccgccaccgtggatgtcgccacgccgcagggcacctgggccatcgataccggatttatcgtctacaacgatcgcacctatccgcgctttatgggcctgctcagcgagctggggatcggcggtcaaaaaacgcagatgagcttctcggtccacaacccggccagcggcctggaatacaacggccacagcctgacctcgcttttcgcccagcggcgcaatctgctgaagccggccttctggggactgctgagcgagatcgtccgcttcaaccggctggcgaaactggcgctgaccgaggcgctggatccaggcgcgacgctggagagcttcctcacccgccaccgtttcagccccttcttcgcccgccactatattctgccgatgggggcggccatctggtcgtcgtcgctgcaggagatgcgtcgcttcccgctgccgctgtttttgcgcttctttgaaaaccacggtctgctggatattcgcgatcgcccgcaatggtacgtggtgcccggcggttcccgggaatacgttcgcgccctgctcgccaggctcggcgatcgcctggatctacgcctcaacgcgccggtgcagcaggtggaccgccacccggcgggggtcaccctgcggctggcgtccggggaggcgcattttgaccaggtgatcttcgcctgccactccgcgcaggccctggcgatgctggcggcgcccaccgattccgaacgagaagtcctcggggacatcggctggcagcgtaacgaggtggtgctgcacagcgatccgcgctggctgccggagcgccagcgcgcctgggccagctggaactatcgcctgagcgacggggatcgggcccgggcctgcgtcacctacaacatgaatattctccaggggctgcccgcgggcgcgccgctgttctgcgtcaccctgaacccggacgcgccggtggacgatcgctacgtctggcagcgcttcgtctatgagcatccgttgtttaacccgcaaagctggtcggcccagctgcggcgcgaagagattaacggccagcagcggagctggtactgcggggcctactggtacaacggctttcatgaggacggggtacgcagtgcgctcgacgtggtgcagggcatcgccgcggcggaggacaactga

SEQ ID NO: 1751 - DNA, 204 bp, Klebsiella pneumoniae
cctgagtctggacaaggagatgctgcaggaggtactgaaacaaaagttctgaggccggctcagaaacgtcaggcggtgcattttctgcggggggcttaccgtatcagtgtccgacggggatgcggactgctgatgcagagcagaaccgtttaccactggcagagccggcgggatgatcgggcgataaccctgcgtatccggtaa

SEQ ID NO: 1752 - DNA, 357 bp, Klebsiella pneumoniae
agaagagctgggcgagcggctggtagaagcctggaaaaagaaatacggcgcataagtatgaaagagcaattcaccaccacggtgagggttgccggcaaaggcgaaagcaaatcacgggccttcgccgatgccctgaaccatgtgcaggctgcggtgatgaaatcatcctcgcgcatcctactgcgtattgagccacaggacgtgacggttgttcatgcgcgcgaagcggtacgaaaagaggcgtttctgttcttctttttgcgccgtgaacgacggacctacagcgtggagctggacgtcaccgtcaacgtgaccgccatcgatctcgataaagtggatttcgtcacgcaaacctga

SEQ ID NO: 1753 - DNA, 498 bp, Klebsiella pneumoniae
gcgctggctggtttatcatcaataataatgatgtcgctcgacataccctgttttcttttccctgaggtttatgtgcagttaacgagtttcaccgattacggactacgcgcgctgatttatatggcgtcgctgccggaaggacgaatgaccagtatctcggaagtgaccgaggtctatggcgtctcccgtaatcatatggttaaaataatcaatcagttaagtcgcatgggctacgtgactgccgtgcgggggaagaacgggggcattcgcctcggcaaaccagcaggacagatccgcgtcggtgacgtggtgcgtgaccttgaacccttatcgctggtcaactgcagcagcgagttttgccacattacaccagcctgtcgtctgaaacaggcactagctgaagccgcgcagagttttctcaaggaactggataactatacgctggctgatttggttgagaagaatcaaccgctttataaattattgctggtggagtga

SEQ ID NO: 1754 - DNA, 1125 bp, Klebsiella pneumoniae
cgggcggctggtccgcccgcttcgcgacccctccgattgccaagcgccgtgaaaaaccatgctctacactttctgggttatcacgccaaccccaaggaaatgaacatgagcatcattaaaagctacgccgccaaagaagcgggcgccgatctgtcgctgtgggaatacgatgccggtgagctgcagccggaagatgtcgaagttgaagtggaatactgcgggatctgccattcggacctgtcgatgatcgacaatgaatgggggatgtcgagctacccgctggtggccggtcacgaggtgattggccgggtggcggcgctgggcagcgcggcgcaggataaagggctgaagattggccagaaggtcggcatcggctggacggcgcgcagctgcggccattgcgacgcctgcatcagcggcaaccagatcaactgtctggaaggctcggtgccgaccattctcaaccgcggcggcttcgccaataagctgcgcgccgactggcagtgggtgatccccctgccggagagcatcgatctggcgtccgccggcccgatgctgtgcggcggcatcaccgtctttaaaccgctgctgacccaccacgtgaccgccaccagccgcgtcggggtgatcggcatcggcggcctcggccatatcgccattaagctactgcgggcgatgggcgcggaagtgaccgccttcagctccaacccggcgaaagagcaggaagtgctggcgatgggcgccgatcgcgtggtcaacagccgggatccggaagccttaaaagcgctggccggtcagtttgacctgatcatcaacaccgtggcggtggatctcgactggcagccgtacttccaggcgctggcttacggcggcaatttccacaccgtcggcgcggtgatgaagccgttcccggtaccggcctttaccctgatcggcggcgaccgcagcatctccggctcggcgaccggtaacccgtccgaactgcgcacgctgatgaagtttgccgggcgcagcaaagtggctccgaccaccgagctgttcccgatgtcgcagattaacgaagcgctgaagcacgttcgcgaaggcaaagcccgctaccgcgcggtgctgaaagccgacttctga

SEQ ID NO: 1755 - DNA, 1494 bp, Klebsiella pneumoniae
cctcgttatggaatattccggatatacctaactttacccgcatcgccagccatctcgactacccttaatatccttaacggcatttttgactgccttagtagcgataacaaggagacatgcgatatggcctatcagacggtgaatcctgcgaacaatcagcttattaaaacgtacccggcgcacagcgatgcggacgtggaggcagcgctgcagcaggcggatgcgctctaccattctgcctgggcaaaaggcgatattgaaccgcggctggcggtactgcataagctggcggatctgatcgatagccgggcggaggagctggcaaaaatcgccagccaggagatggggaaactcattaagcagagccgcggcgaagtgaaactttgcgcgcagatcgcccgctattacgccgataacgccaaatcgttcctggcgccggtgaagtatccctccgaactgggtgaagcctgggttgagcaccatcccattggcgtcttactggcggtggagccgtggaacttcccctattaccagctgattcgcgtcctggcgccaaacctggcggccggtaacccggttatcgccaaacacgccagcattgtgccgcactgcgcggagacctttgcccatctggtgcgtgaggccggcgctccggagggggcgtggaccaacctgtttatctcccaggatcaggtggcgaagattatcgccgacgatcgcgtgcagggcgcggcgctaacggggtcggagaaagccggcagcgtggtggcggcgcaggcggcgaagcatattaagaaatcaacgctggaactgggcggcaatgatgtgtttgtcgtgctggacgatgccgacctggagcgcgcggtgaaaatcggcgtccaggcgcggctgaacaacgccggccaggtgtgtaccgctgccaagcgctttatcctgcacgaaaatatcgcggatgcgttcctgacaaaatttagcgaggcgtttcgccaggtgaaaatcggcgatccgctggatgaaagcaccacgctggggccgctctcttccaaagatgcgctggataccctaagcaaacaggtggacgaggcggtgaaaaatggcgctaagctgcatctgggcggcaaagcggtggctcgagaaggcaatttctttgaacccaccattttgaccggtatcacccgtgataatccggcgtacttcgaagagttctttggcccggtggcgcagatctacgtggtgaaaaacgatgaggaggcaatccagctggccaatgattcccactatggtctgggcggcgcggtgttcagtcaggatatcgaacgcgccaaacggatggcctccgccattgaaaccggaatggtttatatcaactggctcaccgataccgcgccggagctgccgtttggcggcgtgaagcgttccggttacggacgggagctctccgatctcggcatcaaagagtttgtgaaccagaagctggtggtggtgcgccgctaa

SEQ ID NO: 1756 - DNA, 480 bp, Klebsiella pneumoniae
ctcggtgatggtggtctgggaagggacccgcccgctgctggtggagatccaggcgctggtcgatcactcgatgatgtccaacccgcgccgcgttgcggtggggctggaacagaaccgtctggcgatcctgctggcggtgctgcaccgtcacggcggcctacagatggccgatcaggacgtcttcgtcaatgtggtcggcggggtgaaggtcacggaaaccagcgccgacctggcgctgctgctggcgatggtctccagcctgcgcgaccgtcctctgccgcaggatctggtggtctttggcgaagtggggctggccggggaaattcgcccggtaccgagcggtcaggagcgtatctccgaagcggcgaagcacggcttccgccgcgccatcgtcccggcggccaatgtgccgaaaaaagtgccggaaggcatgcaaatctttggcgtgaaaaagctttcagacgcgctaagcgtttttga

SEQ ID NO: 1757 - DNA, 399 bp, Klebsiella pneumoniae
tcggcgtgtggaagttcgccggctattacatgctgtttttcctcgccgggctgcagagcattccggcctcgacgccgggaagcggcgctgatggagggggctacccgcacgcaggtcttttttaaggtcacgctaccgctgctgcgcccgaccctgagctttgtgatcaccaccgcgctgatctactccatcacccagatcgaccacgtggcggtgatgacccgcggcgggccggacaacgccaccaccgtgctgctctattacatccagaatctcgcctgggatacccacgacctcggtaaagcctccgccgccaccttcctgaccctggccgggctgttcgccttctcgctgattaacctgaaactgctggagaaaggagcccactatgagcgctga

SEQ ID NO: 1758 - DNA, 554 bp, Klebsiella pneumoniae
  unsure (50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(160),(161),(162),(163),(164),(165),(167),(169),(170),(171),(172),(176),(177),(181),(188),(190),(192),(197),(198),(201),(202),(205),(209),(210),(223),(227),(228),(230),(238),(239),(240),(252),(293),(378),(409),(410),(412),(414),(436),(462),(469): Identity of nucleotide at the above locations are unknown.
ctgtctcgtggcgcaaacacctcgataaaccatctcatcatacgggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggtatnnnnnngngnnnntggnnaagnagggggnangnaaagnngannggngggnngggggagaggtgngttnngnaaggaggnnngggggaaagaangagaaggaaagaaaagagggggggaagaaaggagagagggnaagaggaggagggggggggggaggagaggggaaagaaaagagaaaaaggggggggagagagagaggggaagagaaaagaaggagnaggggggggaaggggaaaagggaagaagagnngnangggggggaagagaggaaggagnaagaaaaggagggggagaagagaggngaaagangagggaaagggagggaggggagaaggggagggaaaaagaagagatttgggagggagaggagagaaggatggagaggagggggaca

SEQ ID NO: 1759 - DNA, 195 bp, Klebsiella pneumoniae
tgccggagtgggcgaccccatcttgtagtcaaccgcagtgaagaacctgaaaaaaaaatgatgtctgggcagttgaaaccgcacgtttcgcccttattacaggttcacaaccacatgttgatcgaatttttagtggagacgtttagatgggtaaaattattggtatcgacctgggtactaccaactcttgtgtag

SEQ ID NO: 1760 - DNA, 357 bp, Klebsiella pneumoniae
gtcgttctcggagattggcgtgccggtatttatggccgacgtcaagggcgacctgaccggcattgccgccgcggggcagagctcagagaaactgcaggcgcggctggagaagatcggcgtcagcgactgggagccgcacgccaacccggtggtgctctgggatatctttggcgagaagggccacccggtgcgggcgacggtctccgatctcggccccctgctgctggcgcgcctgctcaatctcaacgaggtgcagagcggcgtactgaacattattttccgcatcgcggacgaccgcggcctgctgctgctcgacttcaaagacctccgcgccatcacccagtttatcggcgataa

SEQ ID NO: 1761 - DNA, 309 bp, Klebsiella pneumoniae
agatcttccggcatactgaatatatccttggaggagatcgccatacgcaaagcccgattcaccgaacaccagatcatcgccgttctgaagtccgtcgaagccggacgcaccgtcaaagatgtgtgccgcgaagccgggatttctgaggcctcgtactacaactggaaagcgaagttcggcggtatggaagcctctgatatcaaaaagatgaaggacctcgaagatgaaaaccgccggttgaaacagatgtttgcggacctgagcctcgagtgccgcgcattgaaagacgttattgaaaaaaagctttaa

SEQ ID NO: 1762 - DNA, 240 bp, Klebsiella pneumoniae
ccgccatccggctttattcgttatctggaacttataatgtttggtaacttaggtcaggcaaaaaaatatctcggtcaggcggcaaaaatgctgattggcattccggattacgacaactacgtcacgcatatgcaaaccaaccatccggatcggccgtacatgacttatgaagaattcttccgcgaacgtcagcaggcccgctacggcggcgacggcaaaggcggcgtacgctgctgttaa

SEQ ID NO: 1763 - DNA, 285 bp, Klebsiella pneumoniae
tcgaagcccggcagtcgtgagctcttttacggagaaagccccatcatgaatgacattgaactcagccaggcgcagcgcgacctgctgcgcgacaggctcagcaagtactgcgcagagaccttcgacctcgaactggagcagtttgacgccgaatttttcgtcgactttatcgccaaagagctggggccgctgttttacaacgccggtatcgaagaggccatccgcacccatcaggcatggagcgagcgtatccaggaagagatggatttgaaaaaggtctattaa

SEQ ID NO: 1764 - DNA, 237 bp, Klebsiella pneumoniae
gccaataccggctatttgattaactggtatcttgggaaaatgcgcgcgctgctaggtgatgagcggcttgccgcgttacgtcagcactgtttttttgaaaaccaactcgccgatggccaggataacccgctgtggcgacgggtgatgctgcgtgaaggcaagttagtccgacgcacctgctgtcagcgctatcgcctgccggatgtccaacagtgcggcgactgtacgcttaaataa

SEQ ID NO: 1765 - DNA, 2502 bp, Klebsiella pneumoniae
ggtcatcgcggcgctatcgctctgaccactactcaaaccctggccgcgcagcagataagacagcgcttcctgctgggacataaccggatcagagaagatctccgctttcggctgatcggcggagccggtgacgcgaacgccggcgatcacatcgtcttcggtggcatccgggttacgaatcgcttcgatattcagcaacggctgatccggcggaccggagcacagcagctcccctttgcggacaatcaagtcctgaccataggcgtggaaacggccgtccggaatattaatctgcccgttgaggcccagcccctgcttgtcctgcgccactttcaaatcaccggtcagacgcgctttcaggccgaaggcttccagacgaacgttgttgccgacgtgaatggtcaggttgctgttgatcgggatgctggcgctctgctgcttaatcggcttgaggtttttatccagcatcacttcatcagaggagacgccgaccgcgctctccggcacctcgttgaccacgatccgcgcccagggcacatccactttgccgtcgagattgaacaggcttggcgtggcggtaaacaccacatccggcgatacatcgagacgcaccatcggcggcaccgtgatccgcacccggctgcctttcgccgcaatttgcgcccgccagttatcgatctgcgtccagtcggcgttaccgctgagggcgatttgcccctggcgggtgttcaccgtcccctgcagggtcgagcgcgtgccgttgaagttcatcgccagctggctcggctgcatatcaaacggcataaagttgccgtcgatatccaccccgctcagctgcatctggccgaacagctgcggacttttcacattgccgcccagacgcagacgggcgttgagccttccctctgccttttcaccacgagcgaaaatcgggttgatcatcgccagcgagaagttgctgatattgacgttgccgccgaggttacgccgcccctgcgggtcggtgacctgcacctgcccatccagttgaccattgttggtcaggcggataagccagcccagctcggcgcgattgttgtgcaggtcggcgctgaggttaagcgtatcgaacgccaccggcaacggcgcgtcgttgacgacctgggtcaccttgacgttgcgcccgctgagggtcactttgccctgcggcagtccctctttggtggtgtcccagctcacatcggcattaccagtaaacacgccgctggcctgggtcgcctccggcataaacggcttgagcatcgccagatcgaagcggttgagattcacccgcgcccgtccgctggcgcccgcgtcaatggtttcaggcacgcagagctcggcgttcgggttggtccagcagtgtggcccgatgctgattttctgctccagattgcgatagtccagcgcaatgctgcgcgtcagcgctaccggccccaccggcgtctggaagcgggtatcgctcagagagcccttccagcgttcggcctgacgatcgaagctgcctgccagcgtcagctggccggaaaccggatcgccctgcacgcgcagccgcagctcatgctgtttctctgtacctttggcattgagctgcacctggctgatattgacccccggctggctgatgcgatccacccgcacgtccaggttaccgccaatctgatcggtggatttcacatcccctttgacgttgacctgggcgatggtcagctcctgccagcgcagcgcccgggcggtgatatcggccagcagctgcggcgcatcgacagtgccgcgcacttttaccaagcccttcgccgtcccgccgagccccggcagcgcattatccaggtgcggcgcatcgatggtggcgtcgagattaagatccttcacccccagctcgcctttgatatcagcgctgttcgggcccaacgccagatgcagtcccgggattttccactgcagatagctgttaccctgcagcgagcccgccacatccactttgttctgcttcacgttgccggtaattttcagctccggcaccgacatctgccagctgccgccgtacaggctgccctgggtcttgatccggccgttaagcttcgacggccagtccggcacctctttggcggtgttgatgccgtcgagggtcagctcgccgcgccagctgatcgcctgctgccagtcgagcagcgccttcagctcggttttcccttccagggcattgaccgtcagcttgtcgagattgatctgccgttcattgcctttggcgttgaggtcgattttcgccgacggcagcgattgacctttcaccgcggtggagaaggccagcgcatagtcggtcattttgccgctgaacttcagctggacatcgtcggcctggaactgcttctcgccgctgaacggccaggcgagctgcttactcttcagttccatattgagcggcagcccggcctccgccagctgcgcatccgcgcgcagcgtggccacgaccggcccgcttaa

SEQ ID NO: 1766 - DNA, 615 bp, Klebsiella pneumoniae
ctccggagcgggtggcgatgctgccgcaggacagccgctgcaacagctggcggttgggcacagaggcgtcgctgccgctggcgggcgcccaggtgtccacccccgcttttgatgaactccagaccagcgcgccggctcgcagggcgctctggcaacaaatctgcgcacatgaacacgatttctaccctcagcacggctgatttaaccaaagcctggcacatcgaaaaacgcgcccacgctttcccgtggagcgaacagactctggccagtaaccagggggagcgctatcgcaactatcagctatcggtagatggcgaaatggcggctttcgccattacgcaagtggtgctggatgaggcgacgctgttcaatatcgccgtcgatcccgcgtaccagcgccgcggcctggggcgagcgctgctggagcatgtcattgatgaagtcgaaaaactcggcgtcgtcacgctgtggctggaggtgcgagcatccaacgttgccgccatcgcgctgtatgagagcgtaggcttcaatgaggcaaccatccgccgcaactactatcctacgaccgacggacgcgaagacgccattattatggctctgccaatcagtatgtaa

SEQ ID NO: 1767 - DNA, 2769 bp, Klebsiella pneumoniae
agccctggcggtgaggttgccgcaatgaaactaacgccgcaggatacctcgccccccgtcgccctgctggaacacgttggtcagcagtttggcgccaccatcgcgctgcgcgatatcagtctggcgatcccggcacggcgtatggttggcctgattggcccggacggcgtcggcaaatcgagcctgctttcgctgatcgccggggcgcggaccatcgagcaggggaacgtgatggtgcttggcggcgatatgcgcgatgtgcatcaccgccgcgaggtgtgcccgaaaatcgcgtggatgccgcaggggctggggaaaaacctctatcacactctctcggtgtatgaaaacgtcgacttcttcgcccgcctgttcggccacgataaagccgagcgcgaactgcgcatcaacgagctgctgcagagtaccgggctggcgccgtttcgcgatcgccccgccggaaaactctccggtgggatgaagcaaaagctcggcctgtgctgcgcgctgatccacgatccgcagctgctgatccttgatgaaccgaccaccggcgtcgatcccctctcccgggcgcagttctgggagcttatcgacaatattcgtcagcgccagccggcgatgagcgtgctggtggccaccgcctacatggaagaggccgagcgctttgactggctggtggcgatgaacgccggcgaggtgctggcgaccggcagcgctacagagctcaaagcccagaccggcagccagaccctggagcaggcgtttatcgccctgctgccagaagcacagcgtcgggcgcatagggcggtagttatcccaccgcgcgacagccgtgaggaagagatcgccatcgaagcgcgcggcctgaccatgcgcttcggcaactttgttgccgtcgaccacgttaatttccgcatcgcccgcggtgaaatcttcggcttcctcggctccaacggctgcggcaaatccaccaccatgaagatgctcaccggcctgctgcccgccagcgaaggtgaagcctggctgttcggccagccggtcgacccgaaggatatcgccacccgccagcgggtgggctatatgtcgcaggccttctcgctctatagcgaactgaccgtccggcaaaacctcgagctgcacgcccgcctgttccatattccggacggcgaaatccccggccgggtggcggaaatgtgcgagcgctttatgctgaccgaggttgaagacgcgcttcccgtcgatctgccgctggggatccgtcagcgcctgtcgttagcggtggcggtcatccatcgcccggagatgctgatcctcgacgagccgacctccggcgtcgacccggtggcgcgggatatgttctggcagctgatggtagacctcgcgcggcaggatcaggtgaccatttttatctccacccactttatgaatgaggcggaacgctgcgatcgtatctccctgatgcacgccggcaaagtgctggccagcgatacgccgcaggcgctggtcgagcagcgcggttcaaacagcctggaagaggcgtttatcgcctggcttaaagaggcccagccgtcctctccagtaccagaagaacccacgtctgctgtggcatcgcattccggacacacggctccacggcaggccttcagtcttcgccggctgtttagctatagccgccgcgaggcgctggagctgcgccgcgatccggtacgatcgacgctggcgctgctggggacggtgatcctgatgtttatcatggggtatgggatcagcatggacgttgaggatctgcgctttgccgtcctcgaccgcgatcaaaccctcagcagccagggctggtcgcagaatctcgctggctcacgctactttatcgaacaggcgccgctgcgcagctatgacgaactggaccgccggatgcgcgacggcgagctggcggtggcgatagagatcccgccgaactttggtcgcgatatcgcccgcggcacgccggtgcaaatcggcgtgtgggtggacggcgcgatgcccaaccgcgcggaaaccgtgcgcggctacgtacaggcgatgcatctggcctggctgcaggagatggccggccggcagagcagcccgcagcgcgatacctcgctcatctccatcgagacccgctatcgctacaatccagatgtgaagagcctgccggccatcgtcccggcggtgatcccgctgctgctgatgatgatcccggcgatgctcagcgccctgagcgtagtgcgtgagaaagagctcggatcgattatcaacttgtacgtgacgccaaccacccgcagcgaattcctgctcggcaagcagctgccttacatcgtactggggatgtttaacttcttcctgctgtgcgcgctgtcggtctttgtctttggcgtcgcgcataaggggagtttcctgacgctgaccctggcggcgctgctgtatgtcaccatcgccactggtctggggctgctgatctcaacctttatgaagagccaaatcgccgctattttcggtaccgcgattattacgctgatcccggcaacccagttttccggaatgatcgatccggtggcctcgctggaaggtcccggacgctggattgggcaaatctacccgaccagccacttcctgactatcgcccgcgggaccttttcgaaagcgctgaatattagcgatttgtggggctcattcattccgctactgattgcggtgccgctggtgctcgggttgagcgtgctgctgctgaagaaacaggagggatga

SEQ ID NO: 1768 - DNA, 903 bp, Klebsiella pneumoniae
cgacgcggcggcgctcaggtggaagagagaatggaactggatatcaatgagctactcaatttctcgccattgatgaagacctttaccttcaatgcctgggtcgtcgcaggcttcacgccgattacccgcggctccacgctggactactacattaatcgcccgcaggggatgaaaggttacatcattaatctgaccctgcgcggccaggcgcgggcgaaagcgggcgatggcttcctgctgtgccgggaaaacgatctgttgctgtttcctcccggcgtgccccatcattacggcagggacgaacacagcgagtactgggaccatctgtggatctactttatcccccgcccctactggatagactggctgaagtgggaccaaaccacccacggtatcggcaaaacaaccattaacgatcccgaccagctccagcaactgcgcgatctgttctacgaagtgatacgccaccactctgcgtccgtaccgctgtcagaagcgctggcaatgaacgcgctggagagattaattctccgctgttttcaacagcaacccattagcaaccgccatgcccacgaccctcggattaacgccatctgtgactatcttaacgcccatattgcgcaggaggtaaaaatcgagactctggcggcgatggtgtttatctccccttcacgtctggcgcaccttttcaaaaatgaactggggcaaacggtctatgcgtggcgggatacgcagcgcatcaaccgcgccaggtggcttattcagagcacttcgctcccacttaacaaaattgctttatcggtgggctacagcgatccggtctatttcacccgcttgtttcgtaaacataacggcatcccaccgggcgaatatcgcaaacgctatgcggaaatgaagggctaa

SEQ ID NO: 1769 - DNA, 2253 bp, Klebsiella pneumoniae
aaaagtctaggttacaaaggaagggttacaatgaagaaaattcttataatgacgccggacattgaggggcctgtccgtaacggcggtattggtactgctttcactgcccttgccactactttggcaaaaaaggggtatgatgttgatgtattgtatacatgtggcgactattctgaatcatctgtatcgaaatttagcgactggtcacgtatttatagtacctttggtatcaatctgctaagtaccggactgataaaagagattaatattgatgcaccgtattttagaaggaaaagttattcaatttatctctggttgaaagaaaataacatctatgacactgttatttcttgtgagtggcaggcagatctttattacactttattaagcaaaaagaatggaacggattttgaaaatacaaagttcattgtaaatactcacagttcaacgttatgggctgatgaaggtaattaccagcttccatatgatcagaaccatcttgaactctattatatggagaaaatggtggttgaaatggcggatgaagttgttagtccgtctcagtatttaattgattggatgttgagtaagcactggaatgttcctgaagaacgtcatgtaattttaaattgcgagccatttcaagggtttgtgacgagagatgatgttacagttaaaataaatgaaaagccagcttctggcgttgagcttgtatttttcggccgccttgaaacccgtaaaggacttgacatattcctgcgtgcattaagaaaactatctgatgaagataaagagagcatttctggagtaaccttcctcggaaaaaatgtcactatggggaaaactgattcatttacttatattatgaatcagactaaaaatttgggactcgcagttaatgtcatcagcgactatgatcgtaccaacgctaatgaatatataaaaagaaaaaatgtattagtcatcattccatcacttgtagaaaactcaccctatactgtttatgaatgcttgattaataacgttaatttcctcgcttcaaacgttggtggaattccagagcttattccgcaggagcatcatgcggaagttctatttattcctacacctgtcgatttatacgggaaaatccactatcgcttaaaaaatataaatataaaaccagggcttgctgaatcacaagacaatattaaagaagcttggtttgtcgcagttgaacgaaaaaacaaccgcgcattcaagaaaatcgatgaagctaacagcccgttagttagcgtgtgtataactcacttcgaacgtcaccatttgcttcagcaagcactcgcatcaataaaatctcagacgtaccaaaatattgaggtcatcttggttgatgatggaagtacgacagaagattctcatcgttatttgaatctcatcgagaatgattttaactctcgaggctggaaaattgtccgtagttctaataactatctgggtgctgcaaggaatttggctgcgcgacacgcctctggcgaatatctgatgtttatggacgatgataatgttgctaagccttttgaggtagaaacgtttgttactgcagcattaaactctggggccgatgtgttaaccacaccaagcgatcttatttttggtgaggagttcccttctccgttccgtaaaatgacgcactgctggcttccgttagggcctgatttaaatatcgccagctttagtaactgctttggcgatgctaatgcgctgatcagaaaagaggttttcgaaaaagtaggcggatttactgaagattacggtttaggtcatgaagactgggagttttttgccaaaatatcattacagggatataaattgcaaatcgtcccggaacctctattttggtatagagttgcaaactccggcatgttgttaagtggaaataagagtaaaaataactaccgcagtttccgtccttttatggatgagaatgttaaatataactatgcaatggggttgataccttcctacctcgagaagattcaagaacttgagagtgaagtgaatcgattacggagcatcaatggtggtcattctgtcagtaacgagttacaacttttaaataataaggttgatggtcttatttctcagcaaagagatggctgggcccatgaccgttttaatgctctgtatgaagcaattcatgtccaaggcgcaaaacgaggcaccagcctggttcgccgggttgcccggaaagtgaaatcaatgttaaaataa

SEQ ID NO: 1770 - DNA, 1521 bp, Klebsiella pneumoniae
attcttccaggtcaactgtgtcagaaagtgtttcacctacacaaaacaaaccggagtctgcttagaatgagtaaaaacataatgcacagtcggcatgatgaatatcataaattaacccgtggagaacgaattggttatggcatgggcgactttgcgcaaaacctggttttcggcacaattgggggttttctggctttgcatatgctgacggtaaataccatcagcacggcaacggcaggctttatttttctttttgtccgtatcattaatgtgttttgggatccgatggtcggaacctacgtggataaacgaacctcgaaagcagggaaatatcgtccgtggctgttacgagccggcgtgccgctggtgatcctgtcggcattactgttcgcgcccatccctggggtgaaaggttcggtggctttcgcctttattatttatctggcactggacctggtttattccttagtcaatattccctatggctcgctgaatgcgtcgctgacccgcgacccggaatcgatcgataagctgaccagtacccgcatgatgcttgccaacagcgccaacctgctggtctataccctgttcccgatgtttgtgcagatggcggcgccgaaagatcgcagcctgaaagacaccggcttttttggccttgagctgaatctcggcaactataccgatccgtcggcgaactacgcctggttcggcgtgtacgccatctatatgatcatcggcgcggtggccctgtttatctgctacaaatgcaccaaagaacgcgttgtcgcgaccgccgagcagaccgccaacgtcaaaactaccgaccttttccacgagctcagacataaccgtccgctggttattctcggcatgttctttatgctggcctttaccttcatgttcttcatgaacaccgttaacggcttcttcaaccagttcgtcgtcggccactccgaatggatgggcgccgtgggtctcgtcgcgtctattcccggcatcgccttcccggtgttctggccgaaactgaaaaaaatctttggtaaaaaaggcttcttccatctgttcctcgccatgttcatcgtcggcgaactgctgacctacgtctggtcccgcgaagggatgcacgacgccctgtggctggcctacatcgccacctttattaaacagtggggcttaacctccgccaccggctttatgtgggcgctggtaccggaagttatcgcgtacggcgaattaaaatcgggcaaacgcaatgccgccattatcaatgccattatgggactcttcttcaagatcggcttcaccatcggcggcgcgatcccgctgtggctgctggcggtgtatggatttaatgaaagcggcgccgtgcagagcgccagcgccatcgatgggatcattatgaccgcggtgtggatcccgattgcgctggccgctatttcgatggtgatcatgcaggtttatcccatctccgataaacatgttaccgacatcaaccgtcagctggatgagatccgcgtgtag

SEQ ID NO: 1771 - DNA, 2169 bp, Klebsiella pneumoniae
ttaacgccaggttttactatggataccaaaaaactattcaagcacataccctgggtgattctcggaatcatcggggcattttgcctctcagtcgtcgccctgcgccgcggtgagcacgtcagtgccctgtggatcgtcgtcgcatcggtttctgtgtacctcgtcgcctaccgttattacagcctgtacatcgcgcagaaggtgatgaagcttgacccgacgcgctccacgccggcggtcattaataacgatggcctgaactatgtgccaaccaaccgctacgtgctgtttggccaccactttgccgcgatcgccggcgctggcccgctggtcggcccggtactggccgcgcagatgggctatctgccgggcaccctgtggctgctggccggcgtggtgctggcgggcgcggtacaggacttcatggtgctgtttatctcctcgcggcgtaacggcgcctcgctgggcgagatgattaaacaggagatggggccggttccgggctctatcgccctgttcggctgcttcctgattatgatcatcatcctcgcggtgctggcgctcatcgtggtgaaagcgctggcggaaagcccgtggggtgtctttaccgtctgctcgacggtgcctatcgccctgtttatggggatctacatgcgcttcctgcgcccaggccgcgtcggtgaagtgtcggttatcggtatcgtgctgctggtggcctctatctggttcggcggcgtgattgcccacgacccgtactggggcccggcgctgacctttaaagacaccaccatcacctttaccctgattggctacgcgtttatttccgccctgctgccggtatggctgattctggcgccgcgcgattatctggccaccttcctgaaaatcggcgtgatcgtcggcctggcgctggggatcgttatcctcaatccggacctgaaaatgccggcggtgacccagtacattgatggtaccggcccgctgtggaaaggcgcgctgttcccgttcctgtttatcaccatcgcctgcggcgcggtctccggcttccacgcgctgatcgcctccggcaccacgccgaagctgctggccaacgaaaccgatgcccgctttattggctacggcgcgatgctgatggaatcctttgttgcagtcatggcgctggtcgccgcctcgattatcgaaccgggcctttatttcgcgatgaacaccccgccggcaggcctgggcatcgtcatgccgaacctgcatgaaatgggcggtgaaaacgcggcgatgatcgcagcgcagttgaaagaagtcaccgtccacgcggcggcgaccgtcagctcctggggctttgtgatttcacctgagcagatcctgcagacggcgaaagatatcggcgaaccttcagtcctgaaccgcgctggcggcgcgccgacgctggccgtcggtatcgcccacgtattccataaaatcatcccgatggcggatatgggcttctggtaccacttcggtatcctgtttgaagcgctgtttatcctcaccgcgctggatgcgggtacccgcgcaggccgctttatgctgcaggatctgttgggtaacttcgtgccgttcctgaaaaaaaccgactcgctggtcgccgggattatcggtaccgccggctgcgtcgggctgtggggctacctgctgtatcagggcgtggtcgacccgctgggcggcgtgaagagcctgtggccgctgttcgggatctctaaccagatgctggccgccgtggcgctggtgcttggcaccgtggtgctggtcaagatgcagcgcaccaaatatatctgggtcaccgttatcccggcggcatggctgctgctgtgcaccacctgggcgctgggcctgaagctgttcagcagcaacccgcagatggaaggcttcttctttatggctcagcagtataaagagaagattgccgccggcggcgagctgaccgcgcagcagatcgccaacatgaaccatatcgtggtcaacaactacaccaacgccggcctgagtattctgttcctggtggtggtgtatagcatcatcttctacggcatcaaaacctggctcaatgtccgcaacaataaggtgcgtaccgacaaagagactccgtatgtgccggtaccggaaggcggcgtgaagacctcgtcacatcattaa

SEQ ID NO: 1772 - DNA, 735 bp, Klebsiella pneumoniae
ctgggtgaaggcgcggatggcccgcgcgggcctgatggaggcggcataatgcaacagctgaaacagcaggtgttcgaggccaatatggatctgccgcgctacggcctggtgacctttacctggggtaacgttagcgccattgatcggcagcgtgggctggtggtgattaagcccagcggcatcgcctacgagtcaatgaccgtcgatgacatgtcggtggttgatctgcaggggcacgtggtggaagggcgctggcgtccctcctctgataccgccacccatctggcgctctatcgccgttatcccgaccttggcggggtggtgcatacccattcgacgcacgccaccgcctgggcgcaggcggggctggcgatcccggcgctcggcaccacccatgcggactacttcttcggcgatattccctgcacccgggcgcttagcgcacaggaggtggacgaggcctacgagctgaacaccgggcaggtgattatcgaaacgctgggtgaggccaatccgctgcatacgccggggatcgtcgtctatcagcacgggccatttgcctggggcaaagacgcccacgaggcggtacacaacgcggtggtgatggaagaggtggcgcgcatggcgtggattgcccgcggcattaatccgcagttgcagcccatcgatagctggctgatgaataagcattttcagcgtaagcatgggccaaacgcctactatgggcaaaagtag

SEQ ID NO: 1773 - DNA, 510 bp, Klebsiella pneumoniae
ggcacacgaggcacggttcctctgccgctacattactctgccgctgcactaatgcccgaacatgcgtcaccaggccccgtgcgtcgccccggacggctcggctggatagcattacttcccggcgtgctgatcggtttttgcctcggcgcgtggatgctggcgataacgctggagtggctgggcgaggcgtttttctggcggaacacctgcgccagtcacagtgagcaggtattgctggcgacatggcagtggtggaaaagctctgctggcgcaccgatgtggttagtagaagacctcgcgattgtcagcgatacgttgcagaaagggagcgcggcgctgattgcttctctcagtggtcaaagcgggttgttctggacggaaaccgtcacttcggtgatccgctgcgcgttacagtctgcgattaagttacccttacctttctgctgcgctggctattttattgcaggcgctaccacagtttgtgctgaccattgttatagggctgattga

SEQ ID NO: 1774 - DNA, 219 bp, Klebsiella pneumoniae
caccatggagggtgtcccgtgaaaagcgttcgctatttcacccttaacttttctggcttcacgaccgccgcctgtgaaaaacaggggtatctgcgtcttatcgccggcgaccatgtcttttataccgataaacgctattttaacgacccctcgctttttgaccgcctgacgatcaatcagcctctgcatcctggcgcccgtagctattgctcgcgctga

SEQ ID NO: 1775 - DNA, 573 bp, Klebsiella pneumoniae
ggaattatgggcaacactaagttggctaatccggcaccgctgggccttatgggcttcggcatgaccactattctgcttaacctggcgaatagcggcctgttcgcattcgatgtagctatcctggcgatgggcattttttacggcggcattgcgcaaatttttgccggcctgctggaatacaaaaaaggcaacacttttggcttaaccgcttttacctcctacggcagcttctggctgacgctggtggcgattcttctgatgccgaaaatgggcctggcagacgcgccaaacgcgcacttcctcggtatgtacctcggcctgtggggcgtctttaccctgtttatgttctttggcaccctgaaggcagcccgcatgctgcagtttgtcttcctgagcctgaccgtactgttcgcgctgctggcgattggccatttggtcgataacgaaggcattgtgaaggtagccggctgggtcggcctgatttgtggcgccagcgctatttacctggcgatgggtgaagtgctgaacgaacagttcggccgcaccgtgctgccgatcggcgaaccgcgctaa

SEQ ID NO: 1776 - DNA, 1215 bp, Klebsiella pneumoniae
cgatttgtggggctcattcattccgctactgattgcggtgccgctggtgctcgggttgagcgtgctgctgctgaagaaacaggagggatgatgcgcggattacgcaatatttataatcttggcgtcaaagagctgcgcagcctgctcggtgataaagcgatgctggcgctgatcgtgtttgcgtttaccgtgtcggtgtactcctcggccacggtgatgcccggttcgctgcacctggcgccgatcgcggttgctgatatggataaatcacagctctcctcacgcattattaacgctttttaccgtccctggtttcttgagccggagctgatcaccgctgatgagatggacgccgggctggatgccgggcgctacacgttcgccatcaacatcccgcctaacttccagcgcgatgtactggccggtcggcagccggaaatccaggtcaacgtcgacgccacgcgcatgagtcaggcctttaccggcaacggttacatccagaatattatcaccggcgaagtaaacagttttgtcgcccgctatcgggataacagcgtgctgccggtagagctggcggtaaggatgcgttttaatcctaaccttgagcaggagcgctttggcgcggtgatggcgatcatcaacaatatcaccatgctggccattgtcctcaccggttcggcgctgatccgcgagcgggaacatggcaccattgagcatctgctggtgatgccggtcacgccgtttgaaattatgctggccaagatctggtcgatgggcctggtggtgctggtggtgtccgggctgtcgctggtgctgatggtgcaggggattttgcaggtacccattgagggatcggttccactgtttatgctgggggtggcgctcagcctgttcgccacgacctcaatcggcatttttatgggcaccctcgcccgctcgatgccgcagctggggctgctgatgatcctggtcttacttccgctgcagatgctctccggcggatccacgccgcgagaaagtatgccgcagctggtacaggatattatgttgaccatgccgaccacccacttcgtcagcctggcgcaggcgatattgtatcgaggcgccagcttcgccatcgtctggccgcagttcttaaccttgctggctatcggcggagtgttctttactatcgcgttgctgcgttttcgtaagactatcggtgagatggcataa

SEQ ID NO: 1777 - DNA, 297 bp, Klebsiella pneumoniae
gagcttacgggaggatgccgtaggccggataaggcatttgtgccgccatccggcacaaaaatggctacggtatctgcggtgtcctgcccggcggcgctgcgcttgccgggcctggtgtatagggacttacgggaggatcccgtaggccggataagcgtagcgccatccggcacaaaggcgggtatggcgccggaggtgtcctccccggcggcgctgcgcttgccgggtcgggagtgggattccgcggagcgtttcgcgaaaaaacacccaccgccctcaaacaagaaggccggttaa

SEQ ID NO: 1778 - DNA, 1356 bp, Klebsiella pneumoniae
agccagacgggcaggatagtttcaggccgatataatcacgcggttagtactggactatcaaaaacacagggaatctgtatgcaaatcctcatgggacttatcggcatggtggcgctattggccattgctgtgctgctctccaataaccgaaaagccattaacctgcgcaccgtgctcggcgcctggataatccaggtgggtatcggcgcgttaatattgtatgtaccggccgggcgcgcggcgctattagcgatgtcgaatggcgtcgccagcgttattgcctacggcaatgaagggattagtttcatcttcggcgggctggtctccgataaaatgttcgaggtgtttggcggcggcggcttcgtctttgccctgcgcgtgctgccggtgatcgtcttcttctcgtcgctgattgccgtgctttactacctgggcattatgcagctggtcattcgcattctcggcggcgcgctgcgggcagtgctgaagacctcacgtaccgaatcgctgtcggccacggcgaacatctttgttggccagaccgaagcgccgctggtggtgcgtccttatatcgccaccatgactcgctcggagctgtttgcggtcatgtgcggcggcctggcctcggtggcgggctcggtactggcgggctatgcgcagatgggcgttccgctggagtaccttattgccgcgtcgtttatggcggcgccgggaggcctgctgtttgccaaaattatcgtaccggaaacggaaaaaccggacgataacccggctcatgacagccaaagcgctgacgcggataaaccggccaacgtgctggatgccgccgcctccggcgccgcgtctggtatgcaactggcgctcaacgtcggcgcgatgctgctggcgtttattgcgctgatcgccctgctgaacggcatactctccggcgtcggcggctggtttaaccatcctgagctgtcgctgcagatgatcctcggctggatcttctcacccctggcgtgggtgattggcgtgccgtggcacgaagcgacggtggcggggtcgtttatcggccagaagctgatcattaacgagttcgtggcctacatgaactttggcgaatatttaaaggcggatgccgaagtggcggcggccgggctgcaggtcatttcagatcacaccaaagccattatctctttcgcgctgtgcggctttgccaacctgtcatcgatcgccattctgattggcggactcgggggaatggcgcccaaccggcggcaggatatcgctcagcttgggctacgtgcggtagcggcggggacgctgtccaacctgatgagcgccaccatcgccggggtttttctcgccctgtaa

SEQ ID NO: 1779 - DNA, 1761 bp, Klebsiella pneumoniae
aggaaacagggatattcaggagaaaatgtgctaaaaatccgccagttatgtgtcaccagccttttgctggtcagcggggtcgccagcgcagcgaatgtgcgtttgcaggttgagggattatccggggagctggagaaaaacgttcgcgcccagctttccaccatccagagcgatgaagtcacgccggatcgtcgctttcgcgcgcgcgtcgatgacgccattcgcgaaggcctgaaagcgctgggttattacgagccgacgattgaatttgatttgcgtccgccgccgaaaaggggacgtcaggtgctgatcgccaaagtgaccccgggagaaccggtgcgcattggcggaaccgaggtgattctgcgcggcggcgcccgcaccgatagcgactacctggcgctgctgaaaacgcgcccggccatcgggacggtgctcaaccacggggattacgacggcttcaagagctcgctgacccgcgtcgccctgcgcaaaggctactttgacagcgagtttcttaagagccagctcggggtctccctcgaccgtcatcaggcgttctgggatatcgattacgacagcggcgaacgctatcgctttggccacgtcactttctctggctcgcaaatccgcgatgaatacctgcaaaacctcgtgccgtttaaagagggcgactactacacctcgcaggatctggccgagctaaaccgccgcctggcggcgaccggctggttcagttcggtggtggtggcgcctgattttgctaagtcgcggaaaaccaaggtgctgcctctgcagggcgttgtctcgcctcgcaaagagaacaccgtggaaaccggggtcggctattccacagacgtcggtccgcgggtgaaagccacgtggaaaaaaccatgggtcaactcgtatggtcacagcctgacctccagcgtcagcctctccgccccggagcagcagttcgactttacctataaagtcccactgctgaagagcccccttgaacagtattatctgatgcagggcggttttaagcgtaccgacctcaatgatacccaggctgactctaccaccctgggggtctcgcgtttctgggagatgtcgagcggctggcagcgagcgattaacctgcgctggagcctggatcactttacccaggcgaacgtcaccaacaccaccatgctgatttatcctggggtctcggtgaaccgcactcgctcccgcggcggcctgatgcctacctggggcgattcccagcgctactcggtggattactccaacaccatgtggggctcggacatcaacttcatcgtgatgcaggcccaggacgtctggatccgtaccctctatgaccgccaccgctttgtggtgcgcggcaaccttggctggatcgaagcggacaactttgacaaggtgccgccagatctgcgttttttcgccgggggcgatcgcagtattcgcggctataaatacaaatctatctcgccgaaggacgatgacggcaagctgatcggggcctcgaagctggcgaccggctcgctggagtatcagtacaacgtcagtggtaaatggtggggcgccgtgtttgtcgatagcggcgaagcggtcagcgatattcgcgagagcgatttcaaaaccggcgccggggtgggcgtgcgctggcagtcgccggtggggccgatcaagctggatatcgcccggccgatcggcgacaaagaagagcatggtttacagttttacatcggtctggggcctgaattatga

SEQ ID NO: 1780 - DNA, 1140 bp, Klebsiella pneumoniae
ccgaacaagggagcgcggaacatgccttcgatttttgagaaataccatttaaaacaggtgattaatacttctggccgcatgacggcgctgggcgtttccacgccgcgcccggaagtggttgaagccgcgatggccggtatgaaccagtactttgaaatgaaagacctggtgaataaaaccggcgagtacatcgccaaactgttggatgtggaaggggcgaccgttgtctcctgcgcgtcggcggggattgcccagtcggtagcggcggtgctggtgaaagacagcgactggctgctggagaacctgcacgttacgccgattgaaaataacgaaatcgtgttgccgaagggccacaacgtcaacttcggcgcgccggttggcaccatggtggcgttgggcggcggtaagctggtggaagcgggctacgccaacgaatgttctgcccagcagctggcggcggcgatcactccgcgcaccgcggcgattctgtacatcaaatcccaccactgcgtgcagaaaagcatgctcaacgtcgcgcaggccgcggaagtggcgcgccagcataacgtaccgctgatcgtcgatgcggcggcggaagaagatctgcagtgctactaccgcatgggcgccgacctggttatctacagcggcgcgaaagcgattgaagggccgaccagcgggctggtgatcggcaaaacgcagtacgtcgagtgggttaagcgccagtcgatgggcattggccgggcgatgaaagtgggtaaagagggcattctcggcctgacctgcgccattgaacactacctgacggcgagcaaagagagcggtcagcagatggtggacaagatgacgccgtttatcgaacagctcaatactctcaacggcgtgaccgcgcgggtggtgtgggacagcgcgggccgcgatatcgcccgcgccgaaattaaatttgatgaagtcacgaccggcgtgaagaccggcgatctggttaacgcgctgaagcagggtgaatacgccatctacttccgcggctataaagcgaatgaaggcattatcgaagccgatgtccgcagcgtaaacgcccagcagctggaggtggtcgctcgccgcatcgcagaagttctgaataaggagaaacaagcatga

SEQ ID NO: 1781 - DNA, 408 bp, Klebsiella pneumoniae
tatacaaagggggatgattgcctgtatggatgctgcccgaaataccttgcgaaacatagactggttctcggctggcaaatgagaatagaaatgaaaatcctgcttaactggtcgccattgcgccagctcttcacttacattcaggagcgctttacctttctggtgctgctctgctggccagcgattatctggttgttctgtcgggtcggcgtgtggctcaccgataacgtttatgaactgctgggaaaatcaccagcccagtccttcaccgtgtatctgcagccgtttatgacccccggcacgctgctgcgcatctccatcagctgggtggtgttgctgttcattctcttcagtatggcgatggccttcacctggggtttacgtcgctttatgaatcgccataaataa

SEQ ID NO: 1782 - DNA, 1302 bp, Klebsiella pneumoniae
cccctgtggggatatcaaaaacaaatatggagcatatacatggcgtggaatcagcccggtaataacggacaggaccgcgacccgtgggggagcagcaaacctggcggcaactctgagggaaatggcaataaaggcggtcgcgagcaggggccgccggatctggatgatatcttccgcaagttaagtaaaaaacttggcgggctcggcggcggcaagggcggactgggcggcggcaatagcgcgcaggggcctcgcggaccgatgggcgggcgtattgtcggcatcgttgccgcggcggcagtgattatctgggcggccagcggtttctataccattaaagaggccgagcgcggcgtggtcacccgttttggtaagttcagccatctggttgagcctggcctgaactggaaaccgacctttatcgataacgttcaggcggtgaacgtggagtcggtgcgcgaacttgcggcttccggcgtcatgctgacctctgacgaaaacgtggtgcgcgttgagatgaacgtgcagtaccgcgtcaccgatccggagcgctatctgtttagcgtgaccagcgcggacgacagtctgcgtcaggccaccgacagcgcgctgcgcggcgtgatcggcaaatacaccatggatcgcattttgaccgaaggtcgtaccgtgatccgtagcgatacccagcgtgagctggaagagacgattcgcccgtacaacatgggtatcactctgctggacgtcaacttccagacggcgcgtccgccggaagaggtgaaggccgcgtttgacgatgccattgccgcgcgtgagaacgagcagcagtacattcgtgaagcggaagcgtataccaacgaagtccagccgcgggcgaatggtcaggcgcagcgtatcctcgaagaggcacgcgcctataagacccagaccgttctggaagcccagggtgaagtggctcgctttgcgaagatcctgccggaatacaaagccgcgccggaaattacccgcgagcgtctgtatatcgaaaccatggaaaaagtgctgagccacacccgtaaagtgctggtcaatgacagcaaaaacggcaatctgatggttctgccgctggatcagatgctgaaaggcgccgctgcgccggcagcaaagagcgatagtagtgacgccagcgatctgctgcgcctgccgccagcatccagctcaagcagcgccagcacctcatcaacctcgagctcaaccgggggtagcattatggaccaacgccgcgctaacgcgcagcgtaacgactaccagcgtcagggggaataa

SEQ ID NO: 1783 - DNA, 648 bp, Klebsiella pneumoniae
ctatgtcttatgaaaaaactaccggaccatttatccagggaatgcatcatcgccgccattcgcgcttacgatgcaggcgttgcgcatcagtttaaaagcgcgcgtctgtatgagatcgagtttgaggggcgtcggtatccttcaaaagccatcgtcgggttagcggccacgcttgcgacaggcacggaatttaccccgacggatttcagcggagggattaaatccaaatgcgtgcgtctgttactggatcaaggatttacgatcgcgtcgcagggcgctggctatgacgaggttgcgcttttccccgatgagggacagacgactatggagttcgtggaaggggcggcgatgcaggtggtgatcaatcgctatgagcgcgaccgtcaggctcgtcaggcggcgcttcgcctgcatggctgccggtgtcaggtatgcggtctggatatggccagccgctatggcgaaatcggccagggttttatccatatccaccatctcattccgctgtccgggataaagcaggactaccgtctgaatcctgaaaccgatctgatcccggtatgtcccaattgccatgcaatgctgcaccggcgagatccgccgtttactcccgaagagctgaaggcccggctgcgccccgcagactga

SEQ ID NO: 1784 - DNA, 1125 bp, Klebsiella pneumoniae
gaggtcattatgaatattaaaggtaaacactaccgtacggtctgggtttccggggatggaaaagcggtagaaatcatcgatcagactaagttgccttttaagttcgaggtggtggcgcttacctctgcggaaatggccgctacggctattcaggagatgtgggttcgtggcgctccgcttattggtgtcgttgcagcctatggtatcgcgctgggaatgaatcacgatgccagtgacgtgggtctgcagcgttactatgaccttcttatcaaaacccgaccaacggcaattaacctcaaatgggctctcgacaggatgatagccacactgaaggatctctgtgtatcagagcgcaaggatgtggcctgggcgctggcggcagaaattgccgaggaagatgtcgcgttgtgtgaacaaattggattacatggtgcagaagtcatccgcgaaatagcccagaaaaaaccggccgggagtgtggtcaatatcctgacacattgtaacgcaggctggctggcgactgtagactggggaaccgcgctttctcccatctataaagcgcatgaaaacggaatccctgttcacgtctgggtggatgaaacgcggccacgtaatcagggcgggctcacggcatttgaactgggctcacacggtattcctcacaccctgatcgccgacaacgcgggtggccacctgatgcaacacggcgacgttgatctctgcattgtggggaccgatcgaaccacggccagaggggatgtctgtaataaaattggtacctatcttaaggcgctggcggcccatgataaccatgttcccttctacgtcgcgttaccttctcccactattgactggactatcgaggacggaaagaccattccgattgagcaacgtgacggaaaagagcagtcccatgtctatgggataaaccctcagggagagttgagctgggtcaataccgcccctgaaggaacccgttgtgggaactacgctttcgacgtcacgcgtgcccgatacattaccggcctcattactgagcggggagtctgtgctgccagtgagtcagcgctggcggataggtttgctgacctgaagagtaaatcactccaggacgagcagcattaa

SEQ ID NO: 1785 - DNA, 456 bp, Klebsiella pneumoniae
gcaatgattattggcaatatccaccatctgcagccatggctgcctgccgcgctgcgcgaggctatcgaacacgttatcgctcaggtcagcgaggcgacgccgctgggtaaacacgatatcgacggcgacaacctgttttatctgatttctgaagacaccaccgagccgcaggccgcgcgccgcgcggagtaccatgctcgctatctcgatatccagattgtgctccgcggcagcgaggggatgaccttcagcaccttgccgccaggagagctgcagaccgactggctggcggagaaagacatcgcttttcttgccgaaggccagcaggagaaaacggtgatcctcaacgaaggggactttgtggtgttttatcccggcgaagtgcataaaccgctgtgcgccgtaggcgccccggcgaaggtgcgcaaagcggtggtgaagatgctgatggcgtaa

SEQ ID NO: 1786 - DNA, 912 bp, Klebsiella pneumoniae
cggaacttctttgcacaggtaacgacgatgaaaattgcctttgatgtggatgtgattaaggacctcgggatcacccgcatggtccatcaggtagcggagtggggctacaagtacattgaacagtcgccgcacccgcagattaacccgttctacaagcacccgcgcgccagccgggagatcatggcggagtacaagcaggcgctgcgcgataccggccttgagctgtcgtcgtttatctgcgtctaccgctggtccggcccggacgaactgcgccgtcaggcggcggtgaaaaactggaaacggctggtggaaattgcggtagagatgggcgttcaggtgatcaacaccgagttctccggcgatccgaatcagcctgagatctgcgatgaaatgttctatcgctcaatggaagagctgttgccgatttttgagcgggaaggcatccgcgtggagatccaggcgcatccctgggatttctgcgaagagaacaatgaaaccgtcgatatcgtgaagtcgttccgcagcgataacgtgaagtacgtctacagcgtgccgcacacctttttctacgacaaaggcgtcggcgacgtggcgagcatgctgcgctatgccgggagcgatctctcccatgtcctgattgcggacacccgcaaccatacgaaacattgccgctatatcgttaacccgccgggcgtggatgccgtggtgcaccagcacgtaggcgtcggggaaggggatgtggatttcgacgcgctattccgcaccctgcgcgaaatgaaattcgccgagcagaccttcaaggtcggcggggagccgattgtcgccacctcgctgtttggctacccggaaaaaatgaaataccaggcagtggaaacccgtgaacttattgaacgtgaattgctgcgccgctaa

SEQ ID NO: 1787 - DNA, 1314 bp, Klebsiella pneumoniae
aattgcgttatgtcatatgcaaaccgaccgctcaaccgccaggattataaaacgctgacgctggccgccctgggcggcgcgctggagttttatgactttatcattttcgttttcttcgccgccgtcgtcggcgagctcttcttccctgcggatattcccgaatggctgcgccaggtgcaaacttttggcattttcgccgccggttacctggcgcgtccgctgggggggatcatcatggcccactttggcgatctggtggggcgcaagaaaatgttcaccctcagcatcctgctgatggcgctgccaaccctggcgatcggtctgctaccgacctatagctcggtaggtatcatcgccccgctgctattgctgctgatgcgtattctgcagggagcggcgatcggcggtgaagttccaggcgcctgggtgtttgtcgctgagcatgtcccggaaaaacgcattggtatcgcctgcggcacgctgacggccggcctgacggttggcattctgctggggtcggtggtggccacgcttatcaataccagtctgacgccgcaggggatccacgacggcggctggcggatccccttcctgctgggcggcgtatttggtctggtagcgatgtatctgcgccgctggctgcaggagacgccgatttttcttgagatgcagcagcgcaaagcgctggcgcaggagctgccggtaaaagcggtggcgctcaagcaccagaaggcggtggtgatctctatgctgctgacctggctgctgtcggctggcgtggtggtggtgatcctgatgtcgccggtctggctgcagaagcactatggttttgcgccggccattaccctgcaggccaacagcatcgccaccattatgttgtgcatcggctgtctgctcgccgggctggcggcggaccgcttcggcgccagccgcacttttatcgtcggcagcctgctgctggcggttgccagctgggcattttaccatcttgccggcgccagcccgcagcggctgtttctgctctacggtacggtggggctttgcgtcggcgtggtgggggcggtgccctatgtgatggtgcgggccttcccggcggaagtacgcttcaccggcatctctttctcctacaacctgtcgtacgcgatctttggcggcctgacgccgattgcggtcaccatgctgatgggggtgtcgccgatggcgccggcctggtatgtgctggccctgtcgctgatggggctgggattaggtatctggctgcgtcaggagctgacggcgccgacggggatgccggaaggggagctgcagcgttaa

SEQ ID NO: 1788 - DNA, 795 bp, Klebsiella pneumoniae
cccggcgttattggcatccgcgccgcgaatgtccgccgccacgatgatcccggcgatcgccgcgcagacgccgctcaggacataggccagcatcaccacgatgcgggtattgacgccggcgtttttcgccgcgcggatgttgatccctaccgcctcaataaacatgcccagcgccgttttacgggtaaacagccagaacagcagcagcgtagcggcggcgacgatcaccggcgtcggaaacagcagaaacgatccgctgccgagccacgccagggccggggaatcaaaggtgacgatctgcccggcggtgatcaactgcgccaccccgcgcccggccaccatcaggatcagcgtcgccacaaagggctggatcttaaggaccgccacgaggatgccgttccacaatccggccagcgcgcccgcggccagcgcggccaacagcaccaccggcaggctgtgcccggcgacggtcatcgaggcggccgtcgcgccggcaatcgccatcaccgcccctaccgacaggtcgatgccgccggtggcgatcaccagcgtcatgccaatcgccagcagcgccaccggcgcggcgcggttgagaatatcgatcgggctgccaaacaggcggccatcctggagcaccacctgataaaaatggggcgccaccaggctgtctaccagcagaaccagcagcagggcaataatctgcggggtgcccttcggccaggtgaagcgtcgcttctccgggccggtttgcgaaagagatcgaggcatcatgggttactccttatgccgcaatag

SEQ ID NO: 1789 - DNA, 549 bp, Klebsiella pneumoniae
gatagagttatgtcttcgcgaattttaacctcccattttagcggcctggaagagttcctccagcagcacgcggcgctgctggcaaaatcgactgacggcaccgttgccgtttttgccaataacgcgccggcattctatgcgctgacgccagcgcggctggcgcaactgctggagctggaggccaggctggcgcgccccggcagcgacatcgcgcttgacccgcagtttttcgaggagcccgccgcggcgccggttgcggtgccgatgggcaaatttgctatgtacgccggatggcagcctgacgccgattttcagcgcctggccgcgctgtggggcattgccctgagccagccagtcacgccggaagagctggccgccttcgtcgcttactggcaggcggaaggtaaagtgtttcaccacgtgcagtggcagcagaagctggcgcgtagcgtgcaaatcagccgcgccagcaacggcggacagccgaagcgcgatgtgaacagcgttagcgaacccgacagccatattccgcgaggtttccgaggatga

SEQ ID NO: 1790 - DNA, 1263 bp, Klebsiella pneumoniae
aaaaggtctattaacaccgcgtacagacgcaggagatcaataaaaccctgcatacaccatggctataatggcgactctttcagcatctcccgtgtacggggaaggaaaaccatgtcgcttatcaccgatctacccgccatttttgaccagttctcagaagctcgccagaagggctttctcaccgtcatggatcttaaagagcagaacgtaccgctggtgggcacttactgcacctttatgccccaggagatcgccatggcggcgggcgccgttgtcgtctcgctgtgctcaacctccgatgaaaccatcgaggaagcggaaaaagatctcccgcgcaacctctgcccgcttatcaaaagcagctacggcttcggcaaaaccgataaatgtccctacttctatttctctgacctggtggttggggaaaccacctgcgacggcaaaaagaaaatgtatgagtacatggccgagttcaaggcggtccacgtcatgcagttgccgaacagcgccagcgatgccgcctcgcgcgcactgtggaaaacggagatcctgcgcctgcagcaggtgattgaggcccggtttggcacgccgattagcgaggcggcgctgcgcgaagccatagtgttgaaaaatcgcgagcgccgggcgctggcccacttttatcgtctcgggcagctcaatccgccggcgctcagcggcggcgacatcctgaaagtggtgtacggcgccacttttcgtttcgacaaaaccgccctgattgatgaactgcatgccatggcggagcgcatccatcaggagtggcagcagggtaaacggctggaacctcgtccgcggatcctgatcaccggctgcccgatcggcggcgcggcggaaaaagtggtccgcgccatcgaggaaaacggcggctgggtggtcggctatgagaactgcaccggcgcgaaagcgaccgagcgctgcgtggcggaagagggcgacgtctacgacgccttaaccgataaatatctcgccatcggctgctcctgtatttcccccaacgaccagcgtctgcagctgctgagccagatggcggaggagtatcaggccgacggggtgatcgacgtcattttgcaggcctgccatacctatgccgtggaatcgctggcgattaaacgccatctgcgccaacagcacgatcttccttacatggcgattgaaaccgactattcgacagcggacctcggccagctcagcacccgcgtcgccgcctttatcgaaatgctttaa

SEQ ID NO: 1791 - DNA, 1194 bp, Klebsiella pneumoniae
gacatccctatgaagacacaggtcgcgattattggcgcgggcccctccgggctgctgctggggcagttgctgcacaacgccgggatccataccgtgatccttgagcgtcaaacgccgcagtatgtgctggggcgcatccgcgcgggaattctggaaagcggcaccgtcgatctgctacgcgaagcgggcgtggcgcagcggatggatgccgaaggcctggtgcatcatggggtggagtttctgtttgacggccagcgggtgcccgtcgcactgagcgagctaaccgacggtaagagcgtaatggtttatggccagaccgaagtcacccgcgatctgatggctgcccgggccgccagcggcgcgccgatcgtctatggcgtgagcgaggtggctatccatgacgccaaaagcgaccggccgacgatcacctacctcagcgaaggggaaacctgccgtctggagtgcgattttattgccggttgcgacggtttccacggcgtatcgcggcaaagtattccagctggcattttgcagacctacgagagcgtgtggccgtttggctggctaggcctgctggcggatacgccgccggtcaatccggagcttatttatgcgcaccatcagcgggggtttgtattgtgcagtcaacgctcactgactcgcagccgctattatctgcaggttccgctgagcgataaggttgaagcatggtcggacgagcgcttctggcaggagctgaaaagccgcttgccggaggagctggcatccaggttagtgactggtcactcacttgagaagagcattgcccccctgcgtagcttcgtcgtggagccgatgcaatatgggcggttgttcctggtaggggatgcggcgcatatcgttccgccaaccggggcgaaaggattaaatctggcggcatcggacgtgaactatctgtggcggattctgcgcgaatactaccatcgtggccgcagcgatctgctggcggcctactcgcaactggcgctggatcgggtctggaaaggggaacgctttagctggtttatgacccgcctgctgcatgattttccggatcagaacgcgttcgacgctaaaatgcaggccgccgaccgccgctactatctgggctcgcgcgccgggctgaccaccatcgcggaaaactacgtgggcttgcccatggagcgtgtcgcctga

SEQ ID NO: 1792 - DNA, 450 bp, Klebsiella pneumoniae
ggggatactatgcatgattcattaaccattgccttgttgcaggcgcgtgaagcggcgatggcctactttcgaccgatcgtcaaacgacacaatctcaccgaacagcagtggcggatcgtgcgaattctcgccgaacgtccatcgatggactttcacgatctggcctttcgcgcctgtatcctgcgccccagcctgaccggtattttgacgcgcatggagcgggatgggctggtgctgcgcttaaagccagttaacgatcagcgcaagctgtacgtctcgctgacgcctgccggaactgcgctgtacgaaagcgcccaggcggaggtggaagaaacctatcgcctgctggaggcccagttcaccacggaaaagctgcagcaactgacctcgctgctggaggagtttattgcgcttggcgtccctgccgggcgcggtgatgaagaagagtag

SEQ ID NO: 1793 - DNA, 351 bp, Klebsiella pneumoniae
attgtaactatgccatcgcgtactacaacccggtacgtctacttaatcaggaagattatgatgagagaattaaccgcatttgaaatcgaaaatgtgagcggcgcaggctggttacaggatggtctggcggccttaggcagcaaggtcggcgcagccgcatggacgatgggcactgatgccctgagcattaacctgccactgcttggcaccctcaatctggccgacctggcgccggacctgggcaaaaccttaggcgaaagcatcggctcttctatcggcggcaccatcgaaagtacgctggcaagcctgccggtgatcggcggcctgctgaacaagctactcggcaactaa

SEQ ID NO: 1794 - DNA, 864 bp, Klebsiella pneumoniae
ggagcgactatgttggcgaaatccattccgctcggcatctatgaaaaagcgctccccgccggggagtgctggctggagcggctaaagcttgcaaaagcgctgggctttgatttcgttgagatgtctctcgatgaaacggacgcccgccttgcgcggctggactggagcccggagcagcgtctggcgctggtcaaggcggtggctgaaaccggcgtccgggtgccgtcgatgtgccttagcgcccatcgccgttttccgctgggtagtgaagacgacgcggtgcggcatcaggggctggaaattatgcgtaaagctattcagctggcgcaggatgtggggattcgggtgatccagctggcaggctacgacgtctattaccagcaggcgaacgatgagacgcgccgccgctttcgtgacggcctgaaacagagcgtcgagatggccagccgagcccaggtaaccctggcgatggagatcatggactacccgctgatgaactcgatcagtaaagcgctgggctatgcccattacctgaataatccgtggttccagctttacccggatatcggcaatctgtcggcgtgggataacgacgtccagatggagctgaaggcggggagcgggcatatcgtggcggtacacgtcaaagacacaaagcccggcgtctttaaaaacgtgccgttcggcgaaggggtggtcgattttgaacgctgcttcgaaacgctcaagcagaccggctactgcggcccgtacctgattgagatgtggagcgaaaccagcgctgacccgctggcggaggtggcgaaggcgcgtgactgggtgaaggcgcggatggcccgcgcgggcctgatggaggcggcataa

SEQ ID NO: 1795 - DNA, 1383 bp, Klebsiella pneumoniae
ctgaccgctatttcccctcgggagcacaccatgtcgaatacaagctggattgaacgttacgtcatgccggcggcgctgagaatcgccgggcaaaagcacgtcctgtcggtgcgcgacggcatcattctcaatatgccgtttatgttgattggctcattcttcctgattttcgcctacctgccgatccccggctatgccgatatgatgagcagcctgtttggcgaggtctggcgcgataaaatgttgtacccggtgaaagcgacctacgacatcatggcgctgatttccagcttcggcatcgcctaccggctggcggagaagtatcgcactctcgatccgctgagcgctggagcgatgtcgctggtggccttcatgatgacgatcccgcagaacacgctgtttacgccggtacacggcgcggcggaggtgattaaaggggtgatcccggtgagcatggtcggcagccaggggctgtttgtcgccattgtcatttcgctgctgtcgacggagatttatcgtttggtcgccagccgcaatctcgttatccgcatgccggacggcgtgccgccggcagtggcgaaatcattcctcgccctgatccccggcttctgcgtgctggcggtggtgctggcgctgcgcctggcggtcgaggcctcgccgttcggcgacatcaacagtatgatcgccaccctgattggtattccgatgcaccacgtcggcggtacgctgccgggcatgattatttcagtcattttgattggtattttgtggaccctgggcctgcacggcgacgcgatcgtactggtgtttatccagccggtatggctgtcgaatatgtccgagaacctgacggccttccagaacggtcagccgatcccgcatatcattactcagcagttttacgatctgtggattgcccccggaggtaccggcgcgctgctggggctggtgatttttatgttgctgcgtagccgtagccagcagatgaagcagctggggaaaattgccgcgcccggggcattgtttaacatcagcgagccgatggtgtttggcatcccgctggtgatgaacccgtactttttcctgccgtttattttaacgccggtgctgctggtgatcgtgtcctataccgcgatggcgaccgggctggtggcgccgcccgccggaatcgcgctgccgttcaccacgccgatcttcatcagcggctatctggcgaccggagggcatatctccggcacggtgctgcaggtggtgaatttagcgatttcgctggtggtctactatccgttcttccgcgcctgggatcggctaaaggcaaaagaagagcacgcctcggcgcaaccacaagcgagcgctgcgattgctgatgccgaccgcgcataa

SEQ ID NO: 1796 - DNA, 477 bp, Klebsiella pneumoniae
ggagcggctatgaaactccatgaatcactggcgcagaatcactccattcgcctgcaggcggaagcggaaacctggcaggaggcggtgaaaatcggcgtcgatctgctggtggccgccgacgtggtggaaccgcgctactaccaggcaatcctcgacggcgtcgcgcagcacggcccctattttgtgatcgctccgggattagccatgccgcacgggcggccggaagagggcgtcaaaaaaaccggctttgcgctggtcacgctaaagaaaccgctgattttcaaccacgaagataacgacccggtcgacatcctgatcaccatggcggcggttgacgccaccacccaccaggaagtgggcatcatgcagatcgttaacctgtttgatgacgaagccaatttcgaccgtttacgcgcctgccgcagtgagcaggaagtgctggatttaatcaaaaacgccaccgcggcggctgtttaa

SEQ ID NO: 1797 - DNA, 966 bp, Klebsiella pneumoniae
gagaaatatatcatgacggataaattaacttctctgcgtcagtacaccactgtcgtcgctgacaccggagatattgcggcaatgaagctgtatcagcctcaggatgccaccactaacccttccctgattctcggcgcggctcagatccctgagtaccgtaagctgattgacgacgctgtcgcctgggctcgtagccagagcagcgatcgcgcgcagcagatcctcgatgcttccgataagctggcggtgaacatcggtctcgaaattctgaaactgatcccgggccgtatctccaccgaagtggacgcacgtctctcctatgacaccgaagcgtctatcgcgaaagccaagcgcatcatcaagctgtacaacgacgcgggcatcagcaacgatcgcattctgatcaaactggcctccacctggcagggcattcgcgccgctgaacagctggaaaaagaaggcattaactgtaacctgacgctgctgttctccttcgctcaggctcgcgcttgcgccgaagcgggcgtcttcctgatttcgccgttcgttggccgtatcctcgactggtacaaagccaacaccgacaagaaagagtacgcaccggcagaagatccgggcgtagtttccgtcagcgaaatctacgagtattacaagcagcacggctatgaaaccgtcgtgatgggcgcaagcttccgtaacgttggcgaaattctggaactggctggctgtgaccgcctgaccatcgccccggcgctgctgaaagagctgtccgaaagcgaaggcgctgttgagcgtaagctggtatataccggtgaagtgaaagcgcgtccggagcgtattaccgaatctgagttcctgtggcagcataaccaggatccgatggcggtagacaaactggcggaaggtatccgtaagtttgcgatcgaccaggaaaaactggaaaaaatgatcgacgaactgctgtaa

SEQ ID NO: 1798 - DNA, 1035 bp, Klebsiella pneumoniae
aatctgaatattcaggagaaaactatgttgggttttaatcaggacgagtacctgaccagtgctcgcgagatcatcgctgcgcgtaaacaggctgaaaccgtagccgacgatatttatgacagcggctgtagcgcattattttttgcttcggtaggtggttccctggcgccgatgatggcaattaatgaatttgccaaagaattaaccagcgtgccggtatatcttgaacaggccgcggagttaatccatcgcggacataaaaaattaaataaagatgcggttgtcgttacgttatctaaatccggcgataccaaagagtcggtcgccattgccgaatggtgcaaggcacaggggatccgcgtggtggctattactcgtcacgccgactcgccattggctgccgccgccagctggcatattccgatgtgccacaaaaatggcgtggaatatgaatatatgctgctgtactggttattcttccgcgtcatttttcgtcacggcgagtttgctgattatgcgcgatttgccagccagctcgagttactgccggaaaatctcctgcaggcgaaacgccagttcgatccccgagcggatagcattgccgcgcaataccatgactgcgactatatgatgtggattggcggcgcggaaatgtggggcgaggtctatctgttctcaatgtgtattctcgaagagatgcagtggaagcggacgaagtcggtgagctccgctgaatttttccacggcaccctggagctgctggaaaaagaggttccgctgtttctggtgaaaggcgaggggagatgccgggcgctggacgaacgcgtcgagcgttttgccgaaaaaataactgaccatctggtggttatcgacccgcgcgactatccgctgaacggcattgatgacgcgttccgctgggttatggcgccgtgcgtggtgtccaccctgctggtggaccggctggcggcccactttgaacaccataccggccacgacctcaatatccgccgttactaccggcagtttgattactaa

SEQ ID NO: 1799 - DNA, 270 bp, Klebsiella pneumoniae
gcgcgcgatatctttgatggtcagccggttctgcatgcggaattctcgtcagggatggtagaagtgagcctaatgctactcaaccaaaccgcaatgagcaaagtctggtttacgttcggtttagttgcgcgggtttatcatcgccattattgccacacaatcctcagcgagggcgctataattcgcgccgtttatattcacttaccggagatagttatggaccccgatcccactcctcatcctcgatggagcaacctttctttccggtaa

SEQ ID NO: 1800 - DNA, 390 bp, Klebsiella pneumoniae
ggaggctgtatgccgcattttatcgccgaatgtaccgacaacatccgcgaacaggctgatctgccagggctgttcgccaaagtcaacgaggcgctggccgccaccggcatcttcccgatcggtgggatccgcagccgcgcccactggctggatacctggcagatggccgacggcaggcaggattacgccttcgtgcatatgaccctgaagatcggcgccgggcgcagcctggagagccgtcaggacgtgggagatatgctgttcgcgctgatcaaatcccacttcgcgacgctaatggagagccgctatctggcgctgtcgttcgccatggaagagctcgacccgacgctgaactacaaacaaaacaacgtgcacgcgttatttaaataa

SEQ ID NO: 1801 - DNA, 738 bp, Klebsiella pneumoniae
ttcttatgtattaatctagacgtattacgcgtatttattgtgttaaaagacacgcttcgttacaaccttaacgacgatttctgtattgagaggccaaccgtgagtctatttgataaaacgcatcttgtcgcccaggcggatgcgctgcctggacgcaatacccccatgccagtagcgacgctccacgcagttaacggccactcgatgaccaacgtcccggcggggatggaagtggcgctgttcgccatgggctgcttctggggagttgagcgcctgttctggcaattgccgggggtctacagcaccgccgcaggttacactggcggctatacgcccaatccgacctatcgcgaagtatgcagcggccagaccggtcacgcggaagcggtacgcgtggtttatgatccgcaggtgattagctatgagcagttattgcaggtgttctgggaaaatcacgacccggcgcagggtatgcgacagggtaacgaccacggcacccagtaccgctcggcgatttacccgctgaccccggaacagacggaggcggcaaaggccagcctcgcgcgcttccaggcggcgatgaacgacgcgcacgatacccgtcacatcaccaccgagatcgccaccgccaaaccgttctactatgccgaggacgatcaccagcagtatctgtataaaaacccgcacggctattgcggcatcggcggcattggcgtctgcctgccgcctcaggcgtaa

SEQ ID NO: 1802 - DNA, 213 bp, Klebsiella pneumoniae
gcctgcagtatctgccagtttaccgtgccagcaaaattcactttcaggcagttgatgacctacaataaaacgcttattcgcttcaatcgtgtctttggctttactttccagcttcgttttatcctgctccaccagcgcctgttgctggaacaggaacccatgatcggcggtaacaaaaattcggctggcattaaatcggctacgcaggcgtga

SEQ ID NO: 1803 - DNA, 924 bp, Klebsiella pneumoniae
attaccggtatagtcgtgattaatttacagcgtctggatctcaatctgttgcgcaccctggatgtgctgcttagcgaaaacaacgttacccgggcggcgcagcggctgaatctgtcgcagccgtcggtcagcattcagctcgccaggctgcgggagattttcgccgatccgctgctgatgccgggcccgcgcggcatgcagcccaccgcccgcgccgatgagcttcgccagccgcttcgcgccgcattagccgcgctggagcaggcggtggcgccggtcagcccttttgatccggccacggcggcggagacctggcgggtggcggcgacggactatatggcctcggcgatcctcctgccgatgctggctgggttacgccaggcctctcccggcagtcggttggcggtattcgaactgcagccggcgcggctggagcagcaggcggccagcgatacagtagatatcttctttcatacccgcgagggcgcgccgccggggctgcatcagcgcctgctgtttcgcgaatgctacgtgctggctggccgggtggaacatccggcgctgcggcctgggcttagcctggaaacgttctgtcagctggagcacgtgatcgtctccccggacgggggcggcttcagcgcggcgaccgatatcgcgctggcgaacctcggactgatgcggcgggttgtcctttccgtgccacatttcctgtttatgctggagaccctgcgcaatagcgatctggtggcggtcctgccggagcggctggtgcgcgggcagagcgggctggtggtcgtcgagccgccgctggcggtcgccggctttgagatgctgatgctgtggcacgagcgctggcaccgcgacccggcgcatcaatggctgcgtcagttcattgtgaattcactggaggaacagacatgctga

SEQ ID NO: 1804 - DNA, 885 bp, Klebsiella pneumoniae
gactacggtatgaataaacctgacggccttcaggcctttgaacaacctcttgcgtcgcttccgtgcacacttcgccagcttattcttgaacgtatccagaacctgacccattacgagccggtgattggcatcatgggcaaaagtggtacaggtaaatcctctctttgcaacgaacttttccggggtgaggtgtccccggtgagtgatgtgaacgcctgtactcgcgacgtactgcgcttccggttgcgcagcggtcgtcacagtctggtgattgtcgatttaccgggggttggtgaaaacgggcggcgggatcaagaataccgtgccctgtaccgtcgaatcctgccggagctggacctggtgttgtgggtcattaaggccgatgatcgggcactgaccgtggacgagcagttctggcacgacgtgatgcaaccttacaggcaaaaggtactgtttgtgattaaccaggccgacaaaatcgaaccctgtcatgaatgggataccctcaccagcaaaccttcaccgcaccaacagggaaatcttaaagcaaagcaggctgcgattatggcgatgtttaaactgcatcatccggtatgtgtggtgtccgccagcactggatggggcattgaggagatggtggcagccatgatgcgctgtctgcctgaccgcgccaccagcccggtggtgacacaactgcaagagagactctgcacagagccggtaaagtcgcaggcccgtgacagtttcggtgacgctgtgggccgggttttcgatacggctgagtcatcgtcgttcctgccagcaccactgaaaacggtgattcataccgtgcgtgatgcgatggtgtcggtcgcacgggccgtctgggactggatattcttctga

SEQ ID NO: 1805 - DNA, 900 bp, Klebsiella pneumoniae
ggagcgggtatgtgccagcattccatcgccaacatcgacatcaataaagattacgacgagagtctgggtaccgaagaggtgcactaccagtcgttctcccgcatggcggccttttttggccgcgacatgcaggcgcatcgccacgaccgctatttccagatgcactaccttgataccggacagattgagctgcagcttgatgaccatcgctattcggtgcaggcgccgctgtttgtgataacgccgccctcggtaccgcacgcctttattaccgagtccgatagcgatggccatgtgttgacggtccatgaggagctgatctggccgctgctggaggtactttatcccggcacgcgggagaccttcggcctgccggggatctgcctgtcgctggcggataaacccgacgagctggcggcgctggcccactactggcagctgattcgccgggaatctaccgcccagttgccggggcgggagcataccctggcgctactggcgcaggcggtctttaccctgctgctgcgtaacgcaaagctcgacgatcacgccgccagcgggatgcgcggcgagctgaagctattccagcgctttaaccagatgatcgacagccactaccatcagcactggacggtaccggattacgccagggagctgcatctgaccgaatcgcggttgaccgacatctgccgccgcttcgccaaccgttcgccgaagcggctgatattcgaccgccagctgcgcgaggcgaagcgcctgctgctgttttccgatagcgcggtcaatgagattgcctggcagctggggtttaaagaccccgcctattttgcgcgcttttttagccgccaggtcggctgctcgcccagcagctaccgggcgcaaaaagtaccggtgtcgtaa

SEQ ID NO: 1806 - DNA, 1428 bp, Klebsiella pneumoniae
ggcttcatcatgagcaaagtaaaccagcaggacatcgataaactgatcgaactggtgggcgggcgcggtaacatcgccaccgtcagccactgtattacccgtttgcgctttgtgctgaacgacccggccatcgccagaccaaaagagattgagcagctgcgcatggtgaagggatgcttcactaacgccggccagttccaggtggtcatcggcaccgaggtgggcgattactacaaggccctgctggcgaccaccggccagacctccgccgacaaagagcaggtcaagcaggccgcgcggcaaaatatgaagtggcatgaacagttaatctcgcacttcgccgagatcttctttcccctgctgccggccctgatcagcggcggtctgatcctcggtttccgcaacgttatcggcgacctgcccatgagcaatggccagacgctggcccagatgcacccgtcgctgaaaaccatctatgacttcctgtggctgattggcgaggcgatcttcttctatctgccggtggggatctgctggtcagcggtgaagaagatgggcggcacgccgatcctcgggatcgtccttggcgtcaccctcgtctccccgcagctgatgaacgcctatctcctcggccagcaggtgccggaggtgtggaacttcggcctgtttaccattgccaaagtcggctaccaggcgcaggtgatcccggccctgctggctggcctggccttaggctttatcgagacgcgcctcaagcgcattgtgcctgactacctctacctggtgattgtcccggtctgctcgctgatcctcgcggtgttcctcgcgcacgccattatcggtccgttcggccgcctgatcggcgacggcgtggccttcgcggtacgccatctgttaaccggcagcttcgcgccgatcggcgccgcgctgttcggcttcctctacgcgccgctggtgattaccggtgtccaccagaccaccctcgctatcgatatgcagatgatccagagcatgggcggtaccccggtatggccgctgattgcgctgtcgaatattgcccaggcgtcggcggtggttggcatcatcatcgccagccgcaagcagaatgaacgtgaaatctcggtaccggcggcgatctccgcctatctcggggtcaccgagccagcgatgtacggtatcaacctgaaataccgcttcccgatgctgtgcgcaatgattggctctggcctcgccggcctgctgtgcggcctgaacggcgtgctggcgaacggcatcggcgtcggcggcctgccggggatcctctccatccagcctacctactggcaggtgtacgccatggcgatggctatcgcggtggtggtgccgattatcctcaccagcgtggtgtatcagcgcaagtaccgtcagggcaccttgcagattgtctaa

SEQ ID NO: 1807 - DNA, 882 bp, Klebsiella pneumoniae
ggggcaatcatgaacgagtatattgccgtcgattggggctccacccagctgcgggcatggcggatgcgtgatggcgaatgcatcgacaagctgaaactgccctgcggcgtcacgcgtctgaacgggcagcgcgccgaagcggtatttcagcagcagctggcgccgtggcgcggcgaccccgcgctgccggtggtgatggcgggcatgatcggcagcgatgccggttggcaaccggtgccttatctggcctgcccgctggcgctggaggcgctcaacggtcagttatatgaggtggcggaaaaagtgtggatcgtgccggggctgaaagtggcgcaggctgcagattacgacgtaatgcgcggtgaagaaacgcagctgctgggcgcctggcaactgatgcccgcggagtgttacgtgatgcccggcacccactgcaaatgggtgcaggtgcaaaacggcgtggtgcgccagttcgccacggcgatgaccggcgaactgcatcacctgctgcttaaccattcgctgctcggccagcaactgcctgcgcagttgccggatgaagccgctttcgccctcggtatggaaaaagggttaaatcagccggcgttattgtccgggctttttagcgcccgcaccgcgcgggtgttaggcgcgctggcggcgacttcggtgagcgattatctctccgggctgttgattggcgcggaggtggcgacattcagcgaacgctatcgcgccagccgcgtggtgctggttggtgagcactcgcttagcgcccgttatcagcaggcgatggcggcgcgtgggctggccgtttcctgttgctccggcgaggcggcatttctttcgggtatagcgaggatgattgatggacaagattaa

SEQ ID NO: 1808 - DNA, 354 bp, Klebsiella pneumoniae
atgtatgtcattaccgcgaacgtaaagaaaaaggggcagagcacgtcgcaaatgacaaatgataaagattatcatatgatactggttatcattatcgttgtgagaggtgaaaccatgctgcagcgagcattaggaagcggctggggagtgatgattcccggcgcgctaattgtcgctctcgggtatgccggagtgtcggctgacgtatggcgggtactggtcgcggtgggcatgctgatgtccgcggcgatgatctggcatcgtcaattgcgccattttatcctgctgccatcgtgtgtcgcgttgatcggcggaataatgctgatgattgtggatattaaactgagaggataa

SEQ ID NO: 1809 - DNA, 924 bp, Klebsiella pneumoniae
ggagaaaccatgcgcttaccaatcattcttgataccgatccgggcatcgacgatgccgccgccattgccgcggcgctgttcgcgcctgagctggatctgcagttgatgaccaccgtagcgggcaatgtctcggtggagaagacgacccgtaacgcgctgcaattgctgcatttctggaatgccgatgtaccgctggcgcagggggcgtcgatgccgctggtgcgtccgttgcgcgacgccgcctcggtgcatggcgaatccggcatggaggggtatgactttgttgagcatcaacgtcaaccgctggcgaagccggccttccaggcgatccgtgatgcgcttatgcatgctgccgagccgatcaccctggtggcgattggcccgctgaccaatatagcgctgctgctgacccagtacccggaatgcgtgtttaatattcgccggctggtgatcatgggcggctcggcgggccgcggcaacttcacgccgaatgcggaattcaatatcgctatcgacccggaagccgccgcgaaagtgttccacagcgggctggagattgtgatgtgcgggctggacgtcaccaaccgggcgctgctggcggcggattatctggcgacgctgccgacgctgaaccagaccggtaaaatgctccatgcgctgtttagccactatcgcagcggcagcatgagcagtggtctgcgcatgcacgacttgtgcgctattgcgtggctggcccgcccggaactgttcactctccagccgtgctttgtggcggtggagacgcaggggacctggaccgccggcaccacggtggtggatatcgaaggacgactgggccagccggcgaacgcccaggtggcgctggatatcgacgtcgaagggtttcagcgctgggcggcggaggtgattgccctggcgccgtga

SEQ ID NO: 1810 - DNA, 267 bp, Klebsiella pneumoniae
atcctcgccatgcccactgtgtcaccctgtaccacaatggtttcacctgcgaagccgatacccttggcagttgcggctacgtatacatcgccgtttacctcactcatcgttaactactttcacaagagcaaatatgaaaactctacctgcaacaactccgcaggcggcgacgctatgtctgtcgcctgtggcagtctggcaaatgctgcttgctcgcctgctggaacaacattatggcctgacgctaaacgacacgccgttcagtga

SEQ ID NO: 1811 - DNA, 891 bp, Klebsiella pneumoniae
caacaggccatgctccttcgggaacatggcctttttgtttttatttcattatcagataaggagttagccatgcgattagccagccgctttggccgtataaaccagatacgccgtgaccggcctctgacccacgaagagctgatgagtcatgttcccagcgtgttcgggagtgacaaacatgaatctcgttcagaccgttatacctacatcccgaccatcaccatcctcgaaagcctgcagcgtgaaggctttgagccgttctttgcctgccagacgaaggtccgggaccagagcaagcgggagcacaccaagcatatgctgcgtctgcgtcgagccgggcaacttaccgggcatcaggtaccggaaatcatcctgctcaacagccacgacggctcctcgagctaccagatgctgccgggactatttcgcggcgtctgtaccaacggcctggtctgcggccagtcattcggcgaagtgcgggtaccgcataaagggaatgttgttgagaaggtgattgaaggggcttacgaagtgctcggtgtgtttgaccgggtggaggagaagcgcgatgcaatgcagtcactggcactgccagaaccagctcgtaacgccctggcgaatgccgcgctgaagtatcgctttggtgaagaccaccagccggtcacggtatcgcagttgctgaccccacgtcgccgggaggactacagcgatgacctgtggaccgtataccagcgcgtgcaggagaacctgatgaaaggtggattgtcagggcgaaccgctcaggggaaaagcagccgcacccgtgctgttaccggtattgatggcgatgtgaagctcaatcgcgccctgtgggtaatggcagaaaacatgctcgattttttcgggcgttaa

SEQ ID NO: 1812 - DNA, 726 bp, Klebsiella pneumoniae
gtagcaaacatgcagaccccgcacattcttatcgttgaagacgagttggtaacacgcaacacgttaaaaagtattttcgaagcagaaggttacgatgtattcgaagcgaccgatggcgcggaaatgcatcagatcctgtctgaaaatgatatcaacctggtgatcatggatatcaacctgccgggtaaaaatggtcttctgctggcgcgcgagctgcgcgagcaggctgacgtcgcgctgatgttcttaaccggccgcgacaacgaagtggataagatccttggcctcgaaatcggcgctgacgactatatcactaaaccgtttaacccgcgtgaactgactatccgcgcgcgcaacctgctctcccgtaccatgaacctcggtaccgtgagcgaagagcgtcgcagcgtggaaagctacaagttcaacggctgggaactcgatatcaacagccgttccctggttagcccgaacggcgaacagtacaagctgccgcgcagtgaattccgcgcgatgctgcacttctgcgaaaacccgggcaaaattcagtctcgtgccgagctgctgaagaaaatgaccggtcgcgagctgaagccgcatgaccgtaccgttgacgtgaccattcgtcggattcgtaaacacttcgaatccactccggataccccggaaatcatcgctaccattcacggtgaaggctaccgtttctgtggcgatctgcaggaataa

SEQ ID NO: 1813 - DNA, 369 bp, Klebsiella pneumoniae
ggcgagaacatgacgatcacaggaaactttattggcgggaaaaccgttattagcagcagcaacgaaacgatgccggtgtacgacccggcgacgggcaaagcggtgcgcgaagtcacggtgtcaacagcgcaggaagtctccgaggcgattcaggttgctcgcgatgcgtttgacagttggtcccgtaccacgccgctgcgccgcgcccgcgtgctgttcaacttcaaaatgttgctggagcagcacgtggaagagctggcggggatcatcgtcagcgagcacggtaaggtgtggtcggatgcgctgggcgagctgaaccgcggtatggaagtggtcgaattcgcctgcggggatcccgcacctgattaa

SEQ ID NO: 1814 - DNA, 996 bp, Klebsiella pneumoniae
ggattgtgcatcatgggcaaacagagactgacaacggcgcaggcgctggtgaagttcctcgataaccagtacctggaagtggatggcgtagagctgaagttcgtgaaaggcattttcgcgattttcggccatggcaacgtcctggggctggggcaggcgctggagcaggacagcggcgatatgcgcgtctatcaggggcgcaacgagcaggggatggcccacgcggctaccggttttgcccgccaggccctgcgccggcagattatcgcctgcacctcctccatcggtccgggagcggccaacatgatcaccgccgccggcaccgccagcgccaaccgcatcccactgctgctgctgccgggcgatgtcttcgccacccgccagccggatccggtgctccagcagattgaacagagctacgatctcagcatcagcaccaatgacgctttccgcgcagtcagcaaatactgggaccgcattacccgcccggaacagctgatgagcgcctgcatcaacgccatgcgcgtcctgaccgaccctgcggaaaccggcgcggtaacgctgtgcctgccgcaggacgtgcagggcgaagcctgggattacccggaatccttctttgcgcgccgcgtgcaccgtctcgaccgccgcccggccagcgacgcgcagctggcggacgccgtggcggccatcaaaagcagccgtagaccgctgatcgtctgcggcggccgggtgaaatactccggcgcgggcgaaccgctgtcccgttttgccgagcgctacggggtgcccttcgccgaaaaccacgccgggaatgggaccgtggtctcgtctcatcccctgaacctcggcggcgtcagcgacacaggctgcctgggcgagaagctgctgcgcgacagatgccgacctggtgatcggcgtcggcacccgcttcagcgattttaccaccgcctcgaaatggattttccagcacccggaggtgcgtttcctgaatattaa

SEQ ID NO: 1815 - DNA, 567 bp, Klebsiella pneumoniae
ggattgcgcatgaccctacgtagcatactggccgcctcgttactgcttctcccgctgctggccacagcgcataacttcgtcgacggccagcgcgtggcgcccgttggcgtcgcggatcggggagagcttattctggataaggataagtttagctataaaaactggaatagcgcccagctggcgggaaaagtgcgcgtggtccagcacatcgccggacgctcgtcagcaaaagagaagaatgccaacctgatcgaggcgattaaagcggcgggcttcccgcacgatcgctatcagaccaccactattgtaaacactgacgacgccatcccgggcaccgggatgtttgtacgtaacagcattgaaagtaataaaaagctcttcccatggtcgcaatttatcgtcgacagcaacggcctggtgcggaaagcctggcagctggacgagaagagctcagcgatcgtggtgctggataagaacgggcgtgtgcagtgggctaaagacggcgccctcacccaacaagaggtgcagcaggtgatcgacctgctgcataaattgcttaataaatag

SEQ ID NO: 1816 - DNA, 1377 bp, Klebsiella pneumoniae
cgaatgcgcattcatattttaggaatctgtggcacgtttatgggggggctggccatgctggcgcgctccctcggtcatgaggtaacggggtcggatgctaacgtctatccgccgatgagcaccctgctggaaaaccaggggattgatttaattcagggctatgaccccagccagctggagccccggccggacctggtgatcatcggtaacgccatgactcgcggcaacccgtgcgttgaagcggtgctggaaaataatattccctatatgtccggcccgcagtggctgcacgacttcgtgctgcgcgatcgctgggtgctggccgtcgccgggacccacggcaaaaccaccactgccggcatggcgacctggatccttgaagcctgcggctataaaccggggttcgtgattggcggcgttccgggcaatttcgacgtctccgcgcgcctgggcgacagcccgttcttcgtcattgaagccgacgaatatgactgcgccttcttcgacaagcgctccaagtttgttcactactgcccgcggacgctgatcctcaacaaccttgagttcgaccacgctgacatctttgatgacctgaaggcgattcagaaacaattccaccatctggtgcgcatcgtgccgggcaaaggcaaaattatcctgccggagaacgacatcaacctgaagcaggtgatggcgatgggctgctggagcgagcaggagctggtgggcgagcagggccactggcaggcgaaaaaactgaacgccgacgcctcgcagtgggaagtcttactcgacggcgaaaaggtcggcgaagtgaagtgggcactggtcggcgagcataatatgcataacggcctgatggcgattgccgcggcgcgtcacgtcggcgtgctgccggcggatgccgcgaacgcgctgggcagctttatcaacgcccgccgtcgcctggagctgcgcggcgaagccaacggcgtcaccgtgtatgatgatttcgcccatcatccaacggcaatcctcgccacgctgcaggcgctgcgcggtaaagtaggcggtaccgcgcgcattctcgccgtgctggagccgcgctctaacaccatgaaaatgggcgtctgcaaggacgatctggcgccgtctctcggccgcgccgatgaagtgttcctcctgcagccgcagcatattccgtggcaggtggcggaagtggcggaagcctgcgtccagccggcccactggagcgccgacgtcgataccctggcggagatggtggtcaaaaccgcccacccgggcgaccatatcctggtgatgagcaacggcggcttcggcggtattcatcagaagctgctggataagctggcgcaaaaagcggccgcggctgaataa

SEQ ID NO: 1817 - DNA, 1422 bp, Klebsiella pneumoniae
ggatacagcatgacccgctaccaacatctcgctacgctgctggccgaacgcatcgaacagggcctgtatcgccacggcgaaaagctgccgtcggtgcgcagcctgagccaggagcacggcgtcagcatcagcaccgtccagcaggcctatcagctgcttgagcagcagcaaatgattgtgccgcagccgcgatcgggctatttcgtcgccccgcgcaaagcccagccgccggtgccgccgatgtcgcgtccggtccagcgcccggtggagatcacccagtgggatcaggtgctgaccatgcttgacgcccgctacgataaatcgatcatccccttcggcggcggctcgccggacgtgacgcagccaagcctgaagcccatctggcgtgaactgagccgggctatccagcacaacctcactgaggtgttgaactatgacgaactggccgggcgtcgcgagctacgggagcagatcgcccgcctgatgctcgacggcggatcggtggtaactgccgacgatctggtgctcaccagcggctgccacagcgcgctgtcgctggccctgctgtcggtgtgccagccaggggacatcatcgccgtggaatccccctgctactacggcaccatgcagatgctgcgcgggctgggattaaagacgattgagatccccaccgatccggaaaccgggatcagcatcgaggccctggagctggcgctggatcagtggccgatcaaaggggtgatcctcgtgccaaactgcaataacccgctgggctttatcatgccggacgcccgcaagcgcgcggtgctgaaccttgcccaacgctacgatatcgttattttcgaggatgatatttacggcgagctggccaccgaatacccgcgcccgcgcacgatccactcctgggatatcgacggccgggtgatgctctgcagctcctttaccaaaaccatcgcccccgggctgcgtatcggctggatcgcccccgggcgctactacgacaagctgctacagatgaagtacgccgccagcgggaccaacgtcccctccactcagctggcggcctgcaattttattcgcgaaggccactaccaccgccacgtgcggcggatgcggcagatctatcagcgcaatatcgagatctacacctgctggctgcgggaatttttcccgtgcgggatctgcgtcacccggccgaagggcggttttatgctgtgggttgagctcccggagcaggtagatatggtctgcgttgccaaacagctgtgccggctgaagatccaggtcgcgccgggctcgctgttttcggcagcgggcaagtatcgcaactgcgtcaggatcaactgcgccctgccgccgaccgagaaacataaagcggtgatggtgaagctgggagaagcggtgaaggtggcgatggagtga

SEQ ID NO: 1818 - DNA, 1044 bp, Klebsiella pneumoniae
tccagcttaatttcttttcctcatgaagggactggtatgggcaacagaatgtggatgatccgcggtgacggcggcaagctctatgacgattttcgcgataagcaaattgtaggcatcggttggtctcagctggctccattagtcaaacccggcctgtcccgggctcagttactcgccttataccaggaggcagatccattaacaaagctgggaactgcgcgttctggtgcatcgcaggtctggcgttttgtgaacgaaatccaaaagggtgattgggttattacctattcgccagccaaccgtacttatttgctaggcaaagttacttcagatttccaatatcatcctgaatgggtggaagaggggatgggaatcgctcgacaggttaaatggaatactcaagaaatcgaccgcgatagactgtctgttgctaccaaaaacacattgggttctacgctgacggttttccagcttccagaatatgcgctagaagagcttttgcaggataagaaacccactgcagatgtaattactcagaatccaattgcgatggatgaagatgaggttgtttctgatccgcttcgcgatatggaaatgctggcgtttgagggtatcaaagatcgtatcaactctcttgactgggatgagatgcaaaatcttgttgccggagttttacgcagtatgggctataaaacgcaggtctcacctgcgggagccgatcggggtaaagacatcattgcttcacctgatgggttcggttttgaaaatccgcgtatcatcgttgaagtaaagcaccgcagggaacagatgggaagccaacagatacgcagctttatcggcggtcgccataaagacgatcgcgggctttatgttagtacaggggggtttacgaaagatgctcgatatgaagccgaccgttcgacaataccactgacgctctggacacttgatgatctcgtccgtgcgcttattgagaactacgaacaagttgatatcgagactaaacttttggtgcctctgaagaaaacgttcctgcctgcctga

SEQ ID NO: 1819 - DNA, 936 bp, Klebsiella pneumoniae
aagtcattaattcactgtaaatcacttagtgatatcaaggaaggtgtcggtatggttaagctagtggggaatgacagtagcaagattaaatatcttgaaaataaattaattgagaatggttatcacttccattctagtggggttgataaagattaccgggcatatcagttaagggttttcaattaccttgtttcacagaatgtttctgagcagaacattaattctttctttgctgaggtggataatagctatacaagaggttttccatccgagagtgaacttgattggtatcgtaatgatccaagagcaagcttatggttgtcttgtgagttatatgagaaattaaaggaagaaactcctaagtacaatattgattttctatctccagaagcattacaacctgatcataatgtgagaattgaagcgatacgtcattgtatggatgaatggcctatgtattttacaacaccggctgaattcattaaggataaaagtattgagtgggctgagttacttgatcaacatgatttattcagaagtgttagatccagtaaggtcgatgtctgttcttggctaagagattacttaagggggaatacatcaataggtctgaaacgtatttgtggtaattcttccgaggaaataatgtcgtggtgctatgcaagttactttatctggagaaaaaacaacctgcattctccagattctgtcgagttgttcattagaaagtttaagagcgcctggtctacacagaagaataggaataaaaataaagaagagaaaaaacttgtgacaatgagtgtaaatatctctcagcaagctcatgatatgctgagagatatgtctatgaaagactcgatgtcaaataacgcaattatagagagtgctatccttaggttatataatagtaagaatagtaaagtacgtttcaaataa

SEQ ID NO: 1820 - DNA, 195 bp, Klebsiella pneumoniae
tttaggttaattaatataattaataggcactccctttttacaaccatccccctaatccatgcaactccctcagccatgacccttcctgaaggcctggtgtattccactggctggccctcgccagcactaaagaaactcatcctatgcaaaataatcaacgatgggagccagactggtttctacagtcacttctga

SEQ ID NO: 1821 - DNA, 1206 bp, Klebsiella pneumoniae
gttgcgctaatattcgctttttacgagttaaaggggagttctaaggcgaaaaaaagcccgggcagcaaaggcccgggccggatatcaacaaaggcggaattagcgggtcaggtcgtcgaagaacttcttcacgccgtcaaagaagcttttcgaacgcgggctgttgttttccccggtcggaccgccgaagctctcctgcagctctttcagcagctgcttctgcttctcattcagccccaccggcgtctccaccaccacgcggcacagcagatcgccctgcgcgccgccgcgaacggatttcacgccttttccacgcatgcggaacagcttgccggtctgggtttcacctggaattttcaggttcacgcggccgtcgagcgttgggacctcgatctcaccgcccagcgccgccatggtgaagttgatcggaacttcgcagtacaggttattgccttcacgctcaaagatagcatgctgcttcacctgaacctgaacgtacagatcgcctgccggcgcgccatgttcgccggcttcgccttcgcccgccaaacggatccggtcaccggtatccacgcccgccggaattttaaccgacagggttttggtcttttctacgcggccatggccatgacatttattgcacggatctttaatcagcgtaccgcgtccctggcagtgcggacaggtctgctgtaccgcaaaaaagccctgacgcatctgcacctggcctgcgccatgacaggtcggacaggtctgcggtttgctgccggccttggcgccgctgccgtggcagacgtcgcactcttccagcgtcggaatacggatctctttagtgacgccgcgcaccgcttcttccagcgtcagctccatgttgtaacggagatcggcgccgcgtgccgcgcgctgacgaccacgtccgccgccaaagatatcgccgaaaacatcgccaaagatatcgctgaagtcggcaccgccgccaaaaccgccgccgccgcccatgccgccctgttcgaaggccgcgtggccgtactgatcgtaggccgcacgcttctgggcatcagtcaggatttcatacgcttctttgatttctttaaatttggcttcagcctctttatcaccctggttgcggtccgggtgatatttcatggccaggcgcttataagcctttttgatttcacgctcttccgctgttttggaaacgcctaa

SEQ ID NO: 1822 - DNA, 2607 bp, Klebsiella pneumoniae
gaatcaataatgcaatttaaagaactggaatccgggcttcgtcagaagtttaccgacaaccgtatcgtcttctggcatgatccggaacaacgtttcactgattcgctcaatgagctggatctcgacaacgttgcgctgctggatatgcgcggcgtttctgtgctcgcaacaaaaaaacgactcgaaatcgacgagcctgagcaaaaatttttactctatttcaccagtgaggttcccgctcgcgagcaggactggttgctggatattcgcctctatagcaccgaattccacgctgattatgcggcgatcactctgaattctcttggtatcccacagctagggttgcgcgaacatatacagctgcgcaaagccttctttaccgtcaagcgaactcagatcctgaagggatgggtcaccgagcgcgaaacggaaagctcactcgataagaaaatgctagcagtggtggtcggggccagtacctttgaaaccaaagaaattttgtttgctctgattcagcagtttgtcgcggcacggcagcaagatgatagcgctctggagaacaccttcgccgtactgaagaaacttggcctggatgaggtactctgggagattcttcgtgttgagctcgggtaccagtttgaatctccgtcactggaaaacctgcttctgaaactgttctgtaccgatctctgggcacagggtgatgaagcgcatcgtgactggttgagcaaaaatgtactggttaccgctgctggacgggcgtcttcactggcctttataggggcgtggcgcaacgatcgtcgctataaagcagaatatgattattgtgcagaggatttgcagcagacgctccagccaaaagagcactacaactacagttcaccgtacgccttggcaaaatgtgaaaccttcgaggccattgaacaacttattatccgtggtctggtgacacagctgcaggaagagagcaccactctagatagagatgcttttaaagcgttggtttcagagcgcagtgcgaaatactggagccaaacccgcccagagtatctttctatctggaatgctattcgtcaggcggaacgcttgctgaatttgcgtaaccactacactgacgggtttaatttccccaatacagccgcgttctggaaggcctactgcgacgaaatttatcgcttcgatcagacatatcgtttgtttaatgaatatgccgcaccggtgcacagcaaaggggcgatgatcctgcatgaactggataaattcattgaagagttgtacagcaactggtatctggctgagctgagtcgcggctggaacaaactgctggaagcggaaaaccgtatgcaggcatggcagtttagtggcatacccctgcagcgcaatttctataaagagaatgttaaacgtcagtttgacacctctcaggtgaaacgcgtttttgtcgtgatctcggatgcactgcgctacgaagtggcggaagagctgggcaggcatattaaccatgagaagcacttcagcgcagagctgcgctcccagaccggagtgctcccaagctatacccaactgggcatggccgcactgttgcctcatgagtcgttgagctaccttcctgataattctggcgtagtttacgctgatgggatgtccacttccgggtttgaaaaacgcgccactattctggcgaaggtgaatggtgtagcgctgaaagcaaaggacttgcagaacgccaataaccaggaagtgaacgagcaaatccgcaacgcttccgtggtttatatctggcacgacactatagatgcgatgggtgataaggcggctaccgaagataaaacattcgaggcttgccgaagcgctattaccgagctaaaagatttggtctcacgcctgcgtagccgatttaatgccagccgaatttttgttaccgccgatcatgggttcctgttccagcaacaggcgctggtggagcaggataaaacgaagctggaaagtaaagccaaagacacgattgaagcgaataagcgttttattgtaggtcatcaactgcctgaaagtgaattttgctggcacggtaaactggcagatactgcaggctcaagcgatgagagtgaattcctgttacccaaaggggtacagcgtttccacttcgtaggtggtgctcgtttcgttcatggcggagccatgctgcaggaggtgtgtgttcctgtgttgaagattcgcgcgcttgaaaagaaagcggctgagaagcaaccccagcggcagcccgtgtccgtcgttgcgcgggatcaggtgatcaaactggttaacagcattgataaagttggttttattcagacttcggcagtgaatgatttaaatgagccgcgcacgctgaatatctttatcgtcgatgaaaacaaccaggtcgtctccggcacggagacagtatgcttcgacagtgataacgaagatatgggtaaacgcacccgcgatgtaaccatgaaactcatggggacggcattcaatcgtaaaaacaagtatgttcttattttggagaatgcggacagcgcaacagagtatggtcgctacccgatcacgatcgacctggcatttcaggatgacttcttttaa

SEQ ID NO: 1823 - DNA, 354 bp, Klebsiella pneumoniae
gttttagcaatgcgaatatttgtttacggcagtttacgacgcaaacaaggcaacagccactggatgaccaacgcccagtggctgggcgctcatagtgtcgacgattatcagctgtacagcctgggccactatccaggcgcggtgcccggcgaaggcacagtacatggtgaagtttatcgtattgatgcatcgacgctggccgaactggatgcgctgcgcaccaaggggggcgagtatgcgcgccacctgattcagacgccttacggcagcgcatggatgtatgtctatcaacgttccgttgagggttgtacgttgatagcgaacggcaactggttggatcgcgaccagtattaa

SEQ ID NO: 1824 - DNA, 1191 bp, Klebsiella pneumoniae
ctacggcaaatttggcgatctgctggccgatgtcaaggccatcactggcagtgctccacaggaggaataatggatcaacatcccctggttattaaagggtacaagagcatcgcggagctttcccttgtggaaagcccaccgtttatcacttttgccggagccaatggtgcgggcaagagtaacattaccgatgcattggctttttttggtgctgtggtcaagaccggagcgactcaggctattcgcgatttcggtggttttcagcagattcattgctacaaactgcgtaaggaaaatcggactacggcttcactgcaccttcaaattgagctgggagggaaaaagtttacatatgacttgacgatcaaaaccatggataaaaaaccaacaatcactgaaaagttggtcattgatggagatattcatattgatcgtaagcacccagatactcttatgattcgcctaagcgatgatgaggaaacaccagctacttatatccctaattattcgtcggatatgacagcgctaatgttgctgggcaaaagtgaactgtacgcttttttgaccaatattgttgtttttcgcatcgacccgttacgtgctaaagagcccgatagcgccaaaactgactcgacatttctggacagtcatggtcgaaacattgcttctgtgcttgctgctctcgaatcgaatagcgaatttaaagagcaaatcctggagtggatggaactcatcgttccggggatggaaaatgtatcgaccgagaaacaaaaattggatggctcaacggtattgacctttaaagaacagggaactcgtgcccgctttcctgcccatcttatctctgacggcaccatcttcacgctttgtattatgacagccatcttgagtcgagcacagcaaacgggaatgaccattattgaagagcctgaacgaggtattcacccaaaagccattggggaactggtgcaattgatgcgtgaaaatgcctctttgaatcatccgattgttattactacccatagtgaatctattgttcgcaatctggaaccagacgaactgtggtttgttagtaaaaaagaggggaaaactcagctgatgcatgcttcagatgcgggggttgataaaaaggaaatcccactggatacagcgtggctgatgaatatgtttgatggcggtttgccatggtaa

SEQ ID NO: 1825 - DNA, 1917 bp, Klebsiella pneumoniae
atgggtaaaattattggtatcgacctgggtactaccaactcttgtgtagcgattatggatggcactactgcacgcgtgctggagaacgccgaaggcgatcgcaccacgccttctatcattgcctatacccaggatggtgaaactctggttggtcagccggctaaacgtcaggcagtgacaaacccgcaaaacaccctgtttgcgattaaacgcctgattggccgccgcttccaggacgaagaagttcagcgtgacgtttctatcatgccatacaaaattgttgccgcagacaatggcgacgcatggctggatgtgaaaggcaccaaaactgcaccgccgcagatctctgctgaagtgctgaagaaaatgaagaaaacggctgaagattacctgggtgaaccggtaactgaagcggttatcaccgtaccggcttacttcaacgatgcgcagcgtcaggcaaccaaagatgccggccgtatcgccggtctggaagtcaaacgtatcatcaacgaaccaaccgcggccgcgctggcttacggtctggataaagaagtgggcaaccgtactatcgcggtttacgacctcggtggtggtactttcgatatctcgattatcgaaatcgacgaagttgatggcgaaaaaacctttgaagttctggcgaccaacggtgatacccacctgggcggcgaagacttcgatactcgtctgatcaactacctcgttgatgagttcaagaaagatcagggcattgacctgcgcaacgacccgctggccatgcagcgcctgaaagaagccgctgagaaagcgaagattgaactgtcttctgctcagcagaccgacgttaacctgccgtacatcactgcagacgcgaccggtccgaaacacatgaacatcaaagtgactcgcgcgaaactggaaagcctggtagaagacctggttaaccgttccatcgagccgctgaaagtcgctctgcaggatgccggtctgtccgtttcagatatcaacgacgtgatcctcgttggtggtcagactcgtatgccgatggtgcagaagaaagtggccgagttctttggtaaagaaccgcgtaaagacgttaacccggatgaagccgtggcgatcggtgctgccgttcagggcggtgtactgactggtgatgtgaaagacgttctgctgctcgacgtaaccccgctgtcgctgggtatcgaaaccatgggcggcgtgatgactgcgcttatcagcaaaaacaccaccatcccgaccaagcacagccaggtgttctctaccgctgaagacaaccagtctgcggtaaccatccatgtgctgcagggtgagcgtaaacgcgcgtctgataacaaatctctgggtcagttcaacctggatggtattaacccggcgccgcgcggcatgccgcagatcgaagtcaccttcgacatcgatgctgacggtatcctgcacgtctccgcgaaagacaaaaatagcggtaaagagcagaagatcaccatcaaagcgtcttccggtctgaatgaagaagaaattcagaaaatggttcgcgaagcagaagctagcgccgaatctgaccgtaagttcgaagagctggtacagacccgcaaccagggcgatcatctgctgcacagcactcgtaagcaggctgaagaagcaggatataaattgccggctgacgacaaaactgccattgagtctgcgctgaccgcgctggaatcttctctgaaaggcgaagacaaagcggatatcgaagcgaaaatgcaggcgctggcgcaggcttctcagaagctgatggaaattgctcagcagcagcacgctcagcagcaggcgggttccgctgacgctcaggcgagcaacgcgaaagacgacgatgttgtcgacgctgagttcgaagaagtgaaagataaaaaataa

SEQ ID NO: 1826 - DNA, 474 bp, Klebsiella pneumoniae
gaagcgaaaatgaattatcaccagtactaccccgtcgacatcgtcaacggccccggcacccgctgcaccctgtttgtctccggctgcgtccacgagtgccccggctgctacaacaaaagcacctggcgggtgaactccggtatgccgtttaccgctgggatggccgaccgcatcatcgccgacctcaacgacacccgcatcaaacgccaggggctttcactctccggcggcgatccgctgcatccgcagaacgtcgcggatattttaaagctggttcagcgcgtgcgcgccgaatgccccggcaaagatatctgggtctggaccggctataaactggatgagctgaatgaggcgcaaatgcaggtggtgaacctgattaacgtgctggttgacggtaagtttgtgcaggatttgaaagatccggcgcttatctggcgcggcagcagcaaccaggtcgtacatcatttgcgatag

SEQ ID NO: 1827 - DNA, 837 bp, Klebsiella pneumoniae
caaaagagaatagctatgcatgatgcacaaatccgcgtggccatcgccggcgcgggcggccggatgggacgccagttaattcaggctgcattgcagatggaaggcgtggcgctgggcgcggcgctggagcgcgaagggtcaagcctggtgggcagcgacgccggcgagctggcgggcgccggcaaagcgggcgtcgcggtgcagagcagcctggcggcggtaaaagatgatttcgacgtgttgatcgattttacccgcccggaaggcacgctgaaccatctggcgttttgccgcgagcatggcaaagggatggtcatcggcaccaccggttttgacgacgctggcaaacaggcgattcgcgatgccgcgcaggacattgccattgtcttcgccgctaactttagcgttggcgtcaatgtcctgttgaagctgctggagaaggcggcgaaggtgatgggcgactataccgacatcgaaattatcgaagcgcaccaccggcataaagtggatgcgccgtcaggcaccgcgctggcgatgggcgaagcgatcgccggggcattgaacaaagatcttaaggactgcgcggtctacagtcgtgaaggctacactggcgaacgcgtcccgggcaccatcggcttcgcgaccgttcgcgcgggggatattgtcggggagcatacggcaatgtttgccgacatcggtgagcgtattgaaatcacccataaagcgtccagccgcatgacctttgcaaatggcgccgttcgttcagcgttatggctgaaagacaagaaaaatggcctgtttgatatgcgtgatgtgctggatctgaatagtttataa

SEQ ID NO: 1828 - DNA, 696 bp, Klebsiella pneumoniae
cgcaggagaatacttgtgacgacgttaaaacctttgctggcccgcaaccgcagctgggcgctgcagaagtgtcagcatgacccggactatttcgaaaaatgggtcgacgggcagcggccccactcgctgtggatcggttgctccgacagccgcgttcccgccgaggtgctcaccggcagccagcccggcgagctctttgtccaccgcaatatcgccaacatgctcgaccccaccgacgacaacgttatgagcgtcctgcaatatgccctccactaccttgaggtggagcgggtggtgctctgcggccactacggctgcggcggcgtgcaggcggcgctctctctgcccactctgccgctggcgcaggaatcctcggcgctggctcgccgcatcggccagctgcgccacaccctgcatcacgaaattgcgcagatcgccgatgggtgtggtgttgcggcctcctccgacgccagcgccagcgtcagcaccgacgcggagccctctcgccatgcgctggacgccctggtggaagccaacgttcgcgcccagttcgcccgtctgctggagagtgaaccggtgcagacggtgctcgccagcgggcggcccctcagcctgcacggctgcgtctacgatctggcttccggccatttaaccaccctcgtcgaacacctctcaccgcaggagcacgccccatga

SEQ ID NO: 1829 - DNA, 651 bp, Klebsiella pneumoniae
ggagcaggaatggaaaggattacattagcagaaaatatcatttccacttgtcgggaaatgaatgcgtcaggtcttaatcaaggaacatcaggtaatgtgagtgccaggtataccggtggcatgttgattacgccgagtgggatcgcttattcaaagatgacgccggacatgattgtctttgtagacgataagggaatatctgaagcgggtaaaataccgtcaagtgaatggttatttcatctggcgtgttataaagccagaccagaattgaatgctgtcatacatacgcatgcggtgaattccacggcggtggcaatacataatcattcaattccggccattcattatatggtggcggtaacggggacggatcatattccctgtattccctattatacctttggcagccctgaactggccgacggtgtatctaaagggatcagagaaagtaagtccttgctgatgcagcaccacggtatgctggccatggacgtcacgctggaaaagacgttgtggctggcgggtgaaaccgagacgctggctgatttatacatcaaatgtggcggattatatcacgatgttcccgttctgtctgaagacgaaatgaccattgttcttgaaaaattcaaaacatatggtttgaaagcgtaa

SEQ ID NO: 1830 - DNA, 528 bp, Klebsiella pneumoniae
gttgttttgattatgcaccatgttgtctcagcgaccactaatcccgccaaaattcaggcaattctgcaggcttttgacgagattttcggcgaaggatcctgccacattgagtccgtcgccgtcgagagcggcgtgccggaacagcccttcggcagcgaggaaacgcgcgctggcgcacgaaatcgcgtcgccaatgcgcgccttgcccggccaaatgccgatttctgggtagctatcgaagccggtatcgacgatgacagcacctttagctgggtggtcatcgaaagcgccagccagcgcggagaagcgcgctcagccacgctgccgttgcctgacgttattcttgagcaggttcgcgctggcgaagccctcggcccggtcatgtcgcagtataccggcatcgatcagatcggtcgtaaagagggggcgattggggttttcaccggcggcagattaacccgcagcagcgtttaccaccaggcggtcgtgctggcgctaagcccgttccataacgctatttatcgctag

SEQ ID NO: 1831 - DNA, 777 bp, Klebsiella pneumoniae
caaggaaccttcatggattacccgcagattctttccccgattatcagcttcctgcactgcccgacgccgcaggcgtggattgacgaagcccgcaagccggaaaacctgccgctgctgctgaccgaccatatggtgtgcgagctgaaagcggcgcagaacgccatgctgctggtgcgtcgctacgtcgcggataaagctgacgccgacgaactgttggcctgcctgaagccgtacgaagacttcacctaccgccgggggccggagccggattttgtcaccctgcataaacggatcaacaaaagcgccatgccgcagaccgacgacccgtggggccgccagctgctggacagcatgattttattgattaaagaggaactgcatcacttctggcaggtgcgggagatgatgctggcgcgcgatatcccctatgtcaaaatcaccgccagcaactatgcccgcggcctgcggcgcgaagtgcgctcgcatgagccggtgatgctgatcgataagctgatctgcggcgcctatatcgaggcccgctcttgcgaacgctttgccgccctggcgccgtggctggacgacgatctgcaaaagttctacctgtcgctgctgcgctccgaggcgcgtcactatcaggactatctggatctggcgcagaagattgccggagaagatatcagcgagcgggtgcgccagctcggcgaggcggaagcggcgctgatcctccgtccggaggccgagttccgctttcacagcggtgtgccggtagcggcgtaa

SEQ ID NO: 1832 - DNA, 222 bp, Klebsiella pneumoniae
gacgtgttgataaaacagaatttgcctggcggcactagcgcggtggtcccacctgaccccatgccgaactcagaagtgaaacgccgtagcgccgatggtagtgtggggtctccccatgtgagagtagggaactgccaggcatcaaataaagcagaaagcccggtcgaaagaccgggctttttgttttatctgttgtttgtcggtgagcgctctccagagtag

SEQ ID NO: 1833 - DNA, 318 bp, Klebsiella pneumoniae
ggagttctgattatgaccgtacgtattctggctgtgtgtggtaacgggcaaggcagttccatgatcatgaaaatgaaagtggatcagttcctgacgcaatccaatatcgaccacacggtgaacagctgcgcggtgggtgaatacaaaagcgaactaaacggcgcggatatcatcatcgcttcaacccatatcgcgggggagattaccgtctccggcaataaacacgtggtgggggtgcgtaatatgctttcccccgcggatttcgggccaaagctgctggaggtgattaaagctcatttcccgcaggacgtgaaataa

SEQ ID NO: 1834 - DNA, 183 bp, Klebsiella pneumoniae
tgttacctgatgcttagaggcttttcctggaagcagggcatttgttacttcagcaccgtagtgcctcgtcatcacacctcagccttgattatccggatttgcctggacaatcagcctacatgcttaaaccgggacaaccgtcgcccggctaacatagccttctccgtccccccttcgcagtaa

SEQ ID NO: 1835 - DNA, 510 bp, Klebsiella pneumoniae
attcgcctgatgagtaaatcgatctgttcaacggggctacgctggctgtgggtggtcgtagccgtgctgattatcgatctgggcagcaaattcctgatcctccagaacttcgctctgggggagacggtttcgctgttcccgtcgcttaatctgcattatgcccgcaactatggcgcggcctttagctttctcgccgacagcggcggctggcagcgctggttcttttccgggatcgcgatcggtatttgcgtagtgctgacggtgctgatgtaccgttcgaaggcgacgcaaaagctgaacaatattgcctacgcgctgattatcggcggcgcgctgggcaacttgttcgatcgcctgtggcatggctttgtggtcgatatgatcgacttctacgtcggcgactggcattttgccaccttcaacctcgccgatagcgcgatctgcatcggcgcagcgctgattgtgctggaaggcttcctgccgaaaccgactgtgaaagagcaggcgtaa

SEQ ID NO: 1836 - DNA, 1074 bp, Klebsiella pneumoniae
cacactatgatgacgcctgaacaaaaatttgcccgctgggtacgggtgagtattgccgcttttctgggaatattcgcctggtttatcgttgccgatatctggatcccgctgacgccggactccaccgtcatgcgcgtggtgaccccggtttcgtcgcgggtctccggctatgtctcgcacgtctacgtgcacaacaacagccaggtgaaaaagggcgacctgctgtatgagctcgacccaacgccattcattaataaagttgaagcggcgcagatcgccctcgagcaggcgaaactgagcaaccagcagctggacgcgcaaatcgccgccgcccgcgccaacctgcgcaccgcgcagtacaccgcgcgtaacgataaggtcacgctcgatcgctaccagcgcttgagtacgatgcagaatgtctcgcagtccgacctcgataaggtgcgaaccacctggcagaccagcgagcagtcggtctcggcgctgaacgcgcagatccagaacctgctgatccagcgcggcgagcgcgacgataagcgcaacgtcaccctgcaaaaataccgcaatgcgctggaggaggcgcagctgaacctggcctggaccaaagtgcgtgcggaaactgacggcatggtcagcaacctgcagctgaacccggggatctacgccaccgcggcgacggctgtgctggcattggttaacaacaacactgacatcgtcgccgacttccgcgaaaaaagcctgcgccacaccgcggtgaataccgatgcggcggtggtctttgacgccctgccgggtcaagtcttcccggcgcacgtgaccagcagcgacgccgggattctggcgggacaggaggcggtgaacggtcagctgtcgcagcccgagcagtccacccgctgggtgcgcgacgcccagcggatgcgcattcacgtcgcgctggatcagccgctggacaaaccgctgccgaccggcgctcgcgccacggtgcagctgtacaatagcgagggacctttcgcccgcaccttcgccggcctgcagatccacctggtgagctggttgcactatgtctattaa

SEQ ID NO: 1837 - DNA, 480 bp, Klebsiella pneumoniae
ggaagcatgatgattacattattaagggtagaccatcgattacttcacggccaggtggccttttcctggacccaatatgtcggcgccgattgtattttaatcgccaacgatagcgtccctggtgatgagctgcggaaaaccaccattaagcttgccaaaccgccctcggtgaagctggtgattaaaaatataaatgattctattgaggcaataaaaagcggggttaccgataaatataatttatttattgttgtggagtcggttaatgacgcctggcgtattgccagcgccatcgacgaaataaaaagcataaatcttggcggaataaaggctaaagagggcagtaaaaatatctctaaggcgattaatttactgccgacagaaatagaacagctacaacaactggtgggcaagggcgtcgaagtggagattcgccaggtcccgaacgatcgcaaacagctttttgcggaatgcgtgtaa

SEQ ID NO: 1838 - DNA, 990 bp, Klebsiella pneumoniae
aaaccggtgatagagtccggcttaccttctctttcaggcaagcggatggccatgaaaaaacggatgacctcgacgccgcacgatgcggtctttaagcgatttcttcgtcacccggagacagcgactgatttcctcaccctctaccttcccgaagcgatccgtcagcggtgcgatttctctaccctgaggctgcaatcggcgagctttatcgatgaggatctgcgcgcctggtattcagatgtcctctggtcggtgcagaccacctgcggcacggggtatgtttacgtggtgatagagcaccagagctcaccggatagccatatggcctttcgcctgatgcgctatgcgattgccgcaatgcagcgccacctggatgccgggcacaaaacgctgccgctggtggtgccgatgcttttttatcacggtgcaaccagtccgtatcctttttccctcaactggctggatgaatttgccgacccgcagctggcgaagacgctgtatggctgtccgtttccattgatcgacgtgacggtgatgccggacgatgacatcgtgcaacatcggcgagtcgccttgctggagctgatgcaaaaacatattcgccagcgcgatctcagcggcataacggagtcgttggcggccgttgtgatgctgggatacactaaccgtcggcagttgagaatgctgtttcactatatgctgcagtacggtaatacggccgagccgggcgtgtttctccgccggctggcccgccgtctgccacagtatgaggagacattgatgtctatcgcgcaaaagcttaagcaggaaggtcggcaacaaggccgactggaaggccgggaagaagggcacctggagggcttgcaggaaggcagccgacgcgaggcgctgcgcattgccggcagtatgttacagaatggcctcgacaaagagatggtacagaagatcaccggactgtcgactgatgaactacagccgctgtgtggttaa

SEQ ID NO: 1839 - DNA, 420 bp, Klebsiella pneumoniae
acacactcgatcatctggttatcggttcagatggaattgtgtcgtttgcagagcgaggctggatatgagggcacttcaatgaaatctactgactcagagaacgattcatttctaaaatggggactgaattgtaatatgacaccttgctttggtgctcgtctggtacaggagggaaaccggctgcactatctggctgatcgggcctgcattaccggtgaattcagtaacgcagaatctttgaagttggatgaagtattcacacgttttatccgccagatggaatcgatgctgactactggtgaaataaatcctcgccatgcccactgtgtcaccctgtaccacaatggtttcacctgcgaagccgatacccttggcagttgcggctacgtatacatcgccgtttacctcactcatcgttaa

SEQ ID NO: 1840 - DNA, 1143 bp, Klebsiella pneumoniae
aaaacaccgatggcaaagcaagattactacgagattttaggcgtttccaaaacagcggaagagcgtgaaatcaaaaaggcttataagcgcctggccatgaaatatcacccggaccgcaaccagggtgataaagaggctgaagccaaatttaaagaaatcaaagaagcgtatgaaatcctgactgatgcccagaagcgtgcggcctacgatcagtacggccacgcggccttcgaacagggcggcatgggcggcggcggcggttttggcggcggtgccgacttcagcgatatctttggcgatgttttcggcgatatctttggcggcggacgtggtcgtcagcgcgcggcacgcggcgccgatctccgttacaacatggagctgacgctggaagaagcggtgcgcggcgtcactaaagagatccgtattccgacgctggaagagtgcgacgtctgccacggcagcggcgccaaggccggcagcaaaccgcagacctgtccgacctgtcatggcgcaggccaggtgcagatgcgtcagggcttttttgcggtacagcagacctgtccgcactgccagggacgcggtacgctgattaaagatccgtgcaataaatgtcatggccatggccgcgtagaaaagaccaaaaccctgtcggttaaaattccggcgggcgtggataccggtgaccggatccgtttggcgggcgaaggcgaagccggcgaacatggcgcgccggcaggcgatctgtacgttcaggttcaggtgaagcagcatgctatctttgagcgtgaaggcaataacctgtactgcgaagttccgatcaacttcaccatggcggcgctgggcggtgagatcgaggtcccaacgctcgacggccgcgtgaacctgaaaattccaggtgaaacccagaccggcaagctgttccgcatgcgtggaaaaggcgtgaaatccgttcgcggcggcgcgcagggcgatctgctgtgccgcgtggtggtggagacgccggtggggctgaatgagaagcagaagcagctgctgaaagagctgcaggagagcttcggcggtccgaccggggaaaacaacagcccgcgttcgaaaagcttctttgacggcgtgaagaagttcttcgacgacctgacccgctaa

SEQ ID NO: 1841 - DNA, 1323 bp, Klebsiella pneumoniae
tggagacagatcatgtttaaacccctcacgctagtcgcggttggcctcagccttgccctgagcggcgcggcgctggcaaaagagaaaatagacttcatgttcccggcgccggtggacggcaagctgaccatggagatgacccgcgtcattaagcaattcaacgactcgcagcaggatgttgaagtgcgcgggatcttcaccggcaactacgacaccaccaagatcaaagccgaatcggcgcagaaggccggccagccgccggcgctggtgatcatgtccgccaacttcaccaccgatctggcgctgaaggatgagatcctgccgatggatgagctgtttaaatatggcgatcaaaaggccggcgattttctgcacaaggaattctggcccgcgatgcataagaacgcccaggtgatgggcaccacctatgcgatcccgttccataactcgacgccgatcctctactacaacaagacgatgttcgatcgggccgggatcaaacagccgccgcagacttgggccgagctgctggccgatgccaaaaagctgaccgacgagagcacaggccagtgggggatcatgctgccgtcgaccaacgacgactacggcggctggatcttctcggcgctggtgcgcgccaacggcgggaaatactttaacgaagactatccgggcgaggtctattacaactcgccgaccgccatcggcgccctgcgcttctggcaggatctgatctacaaggacaaggtgatgccgtccggggtgctgaactcgaagcagatcagcgccgcgttcttctccggcaagctcgggatggcgatgctcagcaccggcgcgctgggctttatgcgcgagaacagcaaagactttgagcttggggtggcgatgctgccggccaaagagcagcgtgcggtgccgatcggcggcgccagcctggtgagctttaaaggcatcagcgaggcgcagaagaaagcggcgtatcagttcctgacctatctggtgagccccgacgtgaacggcgcgtggagccgcttcaccggctacttctcgccgcgcaaggcgtcatacgatacgccggagatgaaggcctatctgcagcaggatccgcgggcggcgatcgcccttgagcagctgaagtacgcccatccatggtactccacctgggagaccgtggcggtgcgtaaggcgatggagaaccagctggcggcggtggtcaatgatgccaaagtgacgccggaagcggcggtgcaggcggcgcagaaggaagccgacgcgctgatgaaaccttatgtggataagaccgcgctggcggaagtgaagtga

SEQ ID NO: 1842 - DNA, 768 bp, Klebsiella pneumoniae
agggggcagataacagaacctaaaacgagtacattaatgagtgaaatgatttacggcatccatgcggtgcaggcactgctggagcgcgcacctgagcgttttcaggaagtttatattctgaaaggccgtgaggataagcgcttgctgccgctgatccatgccctggaagcgcagggcgtggtgattcagctggccaaccgtcagtttcttgatgagaagagcgaaggcgctgtgcaccaggggatcattgcccgcgtgaagccggggcgtcagtatcaggagaacgatctgccggatctgctggcgcagctcgatcaaccgttcctgctgatcctcgacggcgtaaccgatccgcacaacctcggcgcctgcctgcgtagcgccgacgccgccggcgtgcatgcggtgatcgtgccaaaagatcgttccgctcagttgaatgcgacggcgaagaaagtggcctgcggcgcggcggagaacgtcccgctgatccgcgtcaccaacctggcgcgcaccatgcgtctgctgcaggaagagaacgtctggatcgtcggaactgcaggggaagccgaccatacgctgttccagagcaaaatgaccggcccgatggcgctggtgatgggcgcggaaggcgaaggcatgcgtcgtctgacccgcgaacactgtgatgaattgatcagcatcccgatggcgggcagcgtctcctcgctgaacgtctcggtggctaccggcatctgtctgtttgaagcagtacgtcagcgcagctaa

SEQ ID NO: 1843 - DNA, 939 bp, Klebsiella pneumoniae
gagtttaagatggtcaaagtatatgccccggcttccagtgccaatatgagcgtcgggtttgatgtgttgggcgcggcggtcacgccggtcgatggcacgctgcttggcgacaacgtcactgtcgaagcggcggagcaatttagcctgcagaatcttggacgcttcgccagcaaactgccgacggcgccgcaggagaacattgtttaccagtgctgggaaagcttttgccgggagatcggcaagacggtgccggtggcgatgacgctggaaaaaaacatgccgattggctccgggctgggttccagcgcctgctcggtggtcgctgcgctggtggccatgaacgagttctgcggcaagccgctgaacgagacgcgcatgctggcgctgatgggagagatggaagggcgtatctccggcagcattcactacgacaacgtggcgccgtgctatcttggcggcatgcagttgatgatcgaagagaatgggattatcagtcagcaggtgcccgggtttgatgagtggctgtgggtgctggcctatccggggattaaagtctctactgctgaagcgcgggcgattctgccggcgcagtatcgccgccaggattgtatcgcccatggtcgccacctcgcgggctttattcacgcctgctacacccgccagccgcagctggcggcaaaattgatgaaagatgtgattgccgaaccgtaccgaaccaaactgctgccgggctttagcgaagcgcgtcaggcggccatggagatgggcgcccaggcttgcggcatctccggctctggcccaacgctgttcgcgttgtgtgataaaccggataccgcacagcgcgtcgccgactggcttggcgcgcactatctgcagaatcaggaaggctttgttcatatttgccggctggacacggcgggcgcacgcgtagtgggataa

SEQ ID NO: 1844 - DNA, 195 bp, Klebsiella pneumoniae
tggaataagatggagaacggttttttcaccgttgattacgagagtatggccggcgttgtgaccaccctggtagcgcacaacatatttagcccgttcagtcaggagatcgacgatcttccctttaccttcgtcaccccattgggtgcccagtacgacgacgttgttacccatttttcaaaatcaccgtttgcttaa

SEQ ID NO: 1845 - DNA, 1299 bp, Klebsiella pneumoniae
gggggcttttttttagcgcttgcgtccgcccagcaggctgcccagcatgccgcggacgatctgattggtgacctggcgaaccgcgcttttcgctgcggtctgcacgataccgtcgcgttttccgccgcgcgggccggtgctgccgaacaggatatctttcaggccgccaagcagcccgtcgtcatcgccgttctgctggcccttcgccggcggagccgactgctgcccggtggcgacctgcaccccttgctgcagcatttcgaaagccgactcgcggtccacctcctcctcatacttaccgtacagcggcgagtggttcagcagaccattgcgctcgtcatcgctgaccggccccattcgcgagcagggggcgataaccatcgcccgctcgaccaccgacgggctgcctttctcatcgaggaaggagatcagcgcctcgccggtgcccagctcctggatcgcctgctcggtactgaaggccgggttggcgcgcatggtctgggcggcggttttcaccgccttctggtccttcggcgtaaaagcgcgcagggcatgctgcacgcggttgcccagctggccgagcacggcgtcgggaatatccgccgggttctgcgagacaaagtagacgccgacgcccttggagcggataaggcggatcacctgttcaattttatccagcagcacctgcggcgcgtcgttgaacagcagatgcgcctcatcgaagaagaacaccagcttcggtttatcgaggtcgccggcttccggcaggcgctcgtagagctcggagagcatccacagcaggctggcggcgtacagcttcggcatctggtagagcttttcggcgctaaggatattgatcacccctttaccgctggcatcgacgcgcatccagtcggcaatatccagcatcggctcgccgaagaagtgctcggcgccctgttgctccagggtcaacagcccgcgctggatggcgccgatcgaggcgctgttaatattgccgtactggttctggaaagacttggcgttatcgccgataaactgggtgatggcgcggaggtctttgaagtcgagcagcagcaggccgcggtcgtccgcgatgcggaaaataatgttcagtacgccgctctgcacctcgttgagattgagcaggcgcgccagcagcagggggccgagatcggagaccgtcgcccgcaccgggtggcccttctcgccaaagatatcccagagcaccaccgggttggcgtgcggctcccagtcgctgacgccgatcttctccagccgcgcctgcagtttctctga

SEQ ID NO: 1846 - DNA, 222 bp, Klebsiella pneumoniae
ttaacatactttgattttattacaattgctcatttactcgccaacaccaaaaacttacacttcccacatggaattaaaagcaaaaataaggataaggacgaatggctattggtcattttttatttaggggtgataagaccgcttgcggtggcaggattcttgaaggatgccccaaccatcaatttttcgataaagatatggcatgtgaaggccataaagtaa

SEQ ID NO: 1847 - DNA, 1479 bp, Klebsiella pneumoniae
atggttaacttatcggcatgtcgaaagggagtaattgctatgaaagttgactggcttttcaaaaacgtcacggtgatcgacgggagcggcgggccgcaataccgtgctgatgtggcggtgaagggcgatcgaattatggctatcgccccggcgctggacgttgcggcggagcaggtgattgatggccaggggcgggtactggcgccgggctttattgatgtgcatacccatgatgatatcaacgtgatccgcatgccggagtacttgccgaagctcagccagggggtgacgacggtgatcgtcggcaactgcgggatcagtgcggcgaccgccaccatgcggggggaagtgccggacccgatgaatctcctcggcgagcagcaacactttatctatcccaccgtggaggcttatgcccatgcggtggaggcggcgcgaccgtcgctgaatgtcggcacgttaatcggtcacaccgcgctgcgtaataaccatatggacgatctgtttcgtccggcgaacgagacggaaatcgccggcatgcgcgtacagctacgcgatgcgctgcgccagggagcattagggctcagtaccgggctggcctacgccagcgccttccagtcgaccaccgaggaggtgatggcgctggcggaagagctggcggccgggaagggcgtctataccacccatttacgttcagagtttgagccgattctcgaggcgctggacgaagccttccgtattggtcgccacggcaacgtgccggtggtggtttcgcaccacaagtgcgccggggcgaaaaactgggggcgtaccaaagagacgctggcctttttcgatgagatgcgccagcagcaggatatcgcctgcgactgttatccctactccgccagctcgtcgacgctggatatgaagcaggtgaccgacgagtttgatatcgtgattacctggtccgaagcgcagccggagcaggcggggaaaacgctgcagcagatcgccgatgagtggcaggtgagcctgcacgacgccgcggcgcggctgatgccggcgggcgctatttatcacaacatggatgagcaggacgtacggcgggtgatgcgctatccggtcaccatgattggctctgacgggctgccgaacgatccgatgccgcatccgcgcctgtggggcgccttcccgcgggtgctcggccactatagccgcgacgagcagctattcccgctgactaccgcggtacacaagatgaccgggctgtcggcggcgcgcttccagctggcggatcgcgggctggtgaaaattggctactttgccgacctggtgctgtttgacccgcagacggtgcgcgatgtcgccagtttctccgacccgaaacgaccggcggacggcattgaggcggtgatggtcaacggcgtgatgagctacggcagtgataagaaaattaccggacgggcagggcgtttcctgcgtcgtcggatggactaa

SEQ ID NO: 1848 - DNA, 1386 bp, Klebsiella pneumoniae
gttatcaacttcccttccgaggatctggcctcaacggtcagaaaagatatgttaaacagtattttagtaatactctgtctgatagccgtcagtgcgtttttttcgatatcggaaatttcactggccgcctcacgtaaaatcaaactgaaactgctggccgatgaaggcaacgtcaacgcacagcgggtgctgaagatgcaggagaacccgggcaccttctttaccgtcgtgcagattggcctcaacgccgtcgccattcttggcggtattgtgggcgacgcggctttctcaccggcgtttcatagcctgctcagcgggtatttgtcaccggagctctccgagcagctgagcttcatcatctcttttaccctggtcaccagcttgttcatcctgtttgctgacctgactccgaaacgcatcggtatgattgcgcccgaaacagtggccctgcgcatcatcaacccgatgcgcttctgcctgttagtcttccgcccgctggtgtggttgtttaacggcatggccaacatgatcttccgcatcttcaaactgccgatggtgcggaaagacgatatcacttccgatgatatctatgccgtggtcgaggccggcgcgctggccggggtgctgcgcaagcaggagcatgagctaattgagaacgtgttcgagctggagtcccgcaccgttccttcctccatgaccccacgtgaaagcgtcatttggtttgatttgcacgaagacgagcagagcctgaagaataaagtggccgaacatccgcactcgaagttcctcgtctgtaatgaagatatcgaccacattatcggttacgtcgattcaaaagatctgctgaaccgcgtgctggcgaaccagagcctggtgctgaccggcggcgtacagatccgcaacacgttgatcgtgccggacaccctgaccctgtcggaagcgctggaaagcttcaaaaccgccggggaagacttcgcggtgatcatgaatgaatacgcgctggtggtcgggatcatcactctcaacgacgtgatgaccaccctgatgggcgacctcgtcggccaggggctggaagagcagattgtcgcccgcgatgaaaactcgtggctgatcgatggcggtacgccgattgatgacgtgatgcgcgtgctggatatcgacgagttcccgcagtccgggaattacgagaccatcggcggctttatgatgtttatgctgcgtaaaatccccaaacgcaccgacgcggtgaagttctccggctataagtttgaggtcgtggatatcgataactaccgtatcgaccagctgctggtgacccgcatcgataacaagccaacggtgctggtgccgaagcaggcggaaacggcggaaagccagaacgcctga

SEQ ID NO: 1849 - DNA, 756 bp, Klebsiella pneumoniae
  unsure (740): Identity of nucleotide at the above locations are unknown.
cttcactttgttccggtcatcaggacgttagccatctatactcatgagcaggatataaatatgcggagcaggaggaaagccatgcccgggcgctttgaactgacatctagcctggcgaaaatctggcacgccccggatcattttcgcctcctggacccgctgcctccgatgcaccgccggggaattatcgctggcttcctgttggttattatcggtattctgcttccctccgatgatagccaaagcccggcgtccaccagccgtgaagcgaacctgaatctacagtcgcagtcccagccgcaagctggcggcaatcaggccgttccgctgccgccgatcactaatacgcctaccgtgagcgacgccgatcagatggcgccggtcgccccggagccgattcaggatgagcagccggatcaagcgcagacgcagcagcccgccgcctcccagccttatcaatcttcatcacagcagtccgcgccgggtattgagcagcaatggcggacctatcgcatcgagtcaggcaaaaccctggcgcagctgttccgcgatcatgggctgccggccactgacgtctacgccatggcgcaggttgaaggcgctggcaagccgctaagtactttgcagagcggacagacggtgcagattcggcaaaacgccaacggcgtggtcaccgggctcactatcgataccggcaacggccagcaggtgctgtttacccgccagtcgaacggcagctntgtgcgtgcgcgatag

SEQ ID NO: 1850 - DNA, 405 bp, Klebsiella pneumoniae
aatcaccctgttcaccgccctcggcggcggctggatggaataacccgaggagtcttgattatgaattcactgtctaaaatcgccctgttcaccctgctctctggcgcggtgttcgccgcccaggccgccaacccgcatgccggcatggcgatgcacgaggagcccgccgccgcgcaggcgcaaagcatccgcggtaaaggcgtcattaaagctattgatatggatagcaaaaaaatcaccatcgcccacgaggccatcccggcggtgaactggccgccgatgaccatgcgcttcaccatcaccccgcagacgcagctcaacaatgtgaaggatggcgacagcgtggacttcaccttcgttcagcagggcaatctgtcgctgttacaggatatccgcgcccaataa

SEQ ID NO: 1851 - DNA, 1113 bp, Klebsiella pneumoniae
atattacctgtctgctgttacagcttgtgtttattctcttctaaattattaacattattacaatttctatctatttttccgctttgcgtcatacccctgtctgactacaacgtattgaggctaattattatgcataaacgtctggtcgttaatattttttcatccttgctgttgggggctgcgcttatttccgcgccggtatatgcggcggaaaaaaccgtagtcaatatttcaaaagtggacggcatgccatggtttaaccggatgggtgaaggggtagtccaggccgggaaagagtttaacctcaacgcctcccaggtagggccgtccagcaccgatgcgccgcagcaggtgaaaattattgaggacctgattgcacgtaaagtggatgccatcactatcgtgcctaacgatgccaacgtgctggagccggtattcaaaaaagcccgtgacgccggcatcgtggtgctgaccaacgaatcgcccgggcagccgagcgccaactgggatgtggagatcatcgataacgagaagttcgctgctgaatacgtggagcatatggccaagcggatgggtggcaaaggcggctacgttatctatgtcggtagccttacggtaccgcagcacaacctgtgggccgatctgctggtgaaataccaaaaagaacattacccggacatgcatgaagtcacccgccgaatgccggtggcggaaagtgttgatgattcccgccgtaccacgctcgatctgatgaaaacttacccggatctgaaagcggtggtctcttttggttcgaatggcccgattggcgcggggcgcgcggtgaaagagaagcgtgcgaaaaataaagtcgcggtctacgggatgatgatcccctcgcaggcggcttctcttattaagagcggcgatattaccgaagggatcacctacgatccggcgacagccggctatgccctcgcggccgtcgccagcaccctgctgaacggcaaaaccattgagccgggatttgaactgaaagagctcggtaaagcggaagtcgatagcgacaagcatattatccgcttccataaagtgctgctggtaaataaagacaatattgattcgctctactaa

SEQ ID NO: 1852 - DNA, 1479 bp, Klebsiella pneumoniae
ggagacactgtcatgaaaaagattaaccattggatcaacggtaaaaacgttgccggcgcagactattttcataccaccaacccggccaccggcgaggtactggcggaagtcgcctccggcggtgaagccgaaataaaccaggcggtggcggcggcaaaagaggccttcccgaagtgggctaacctgccgatgaaagagcgcgcgcgcctgatgcgccgcctgggggatctgctcgatcagaacgtcccggagatcgcggcgatggaaaccgccgataccggcctgccgatccaccagaccaaaaacgtgttgatcccgcgcgcctcacacaatttcgaatttttcgccgaagtatgccagcagatgaacggcaagacctatccggtcgacgacaagatgctgaactacaccctcgtgcagccggttggcgtctgcgcgctggtgtcgccgtggaacgtgccgtttatgaccgccacctggaaggtggcgccgtgcctggcgctggggaataccgcggtgctgaaaatgtccgagctgtcgccgctgaccgccgatcgtctgggcgagctggcgctggaagccgggatcccggctggcgtactcaatgtggtgcagggctacggcgccaccgccggcgacgcgctggtgcgccatcatgatgtgcgcgccgtctccttcaccggcggcaccgccaccggccgcaacatcatgaaaaacgccggtctgaaaaagtactccatggagctgggcggaaaatcgccggtgctgatttttgaagatgccgatatcgagcgcgcgcttgacgccgcgctgttcaccatcttctcgatcaacggcgaacgctgcaccgccggctcgcgcatctttattcagcagagtatctaccccgagttcgttaaacgcttcgccgagcgcgccaatcgcctgcgcgtaggcgatccgaccgatccgaacacccaggtcggcgcgctgattagccagcagcactgggagaaagtgtccggctacattcgcctcggcatcgaagagggggccaccctgctggccggcggcgcggataaaccgtccgacctgccggcgcatctgaaagccggcaacttcctgcgcccgacggtgctggcggatgtcgacaaccgtatgcgcgtcgcccaggaagagatttttggcccggtcgcctgcctgctgccgttcaaagacgaagcggaagggctgcgcctggcgaacgatgtggaatacggcctggcgtcgtatatctggacccaggacgtcagcaaagtgctgcgtctggcgcgcggtattgaagccgggatggtgttcgtcaacacccagaacgtgcgcgacctgcgtcagccgttcggcggcgtgaaggcctccggcaccggccgcgaaggcggcgagtacagctttgaagtgttcgccgaaatgaaaaacgtctgcatctcgatgggcgaccatccgatcccgaaatggggagtctga

SEQ ID NO: 1853 - DNA, 681 bp, Klebsiella pneumoniae
tgtggctatgtttatggattttcatgtcattattacgcgaaaaattcggagcactctgcggcgatatcgggaaaaagaagcgaagactttcgatgtgagttggctataataccgagcacttgtttgccatacattttaaaggaaacagacatgagcttactcaacgtacctgcgggcaaagatctgccggaagacatctacgtcgtgatcgaaatcccggcgaacgcagatcctatcaaatacgaagtcgacaaagagagcggtgcactgttcgttgaccgtttcatgtccacggcaatgttctatccgtgcaactacggctacatcaaccacaccctgtccctggacggcgacccggttgacgtgctggtcccgactccgtacccgctgcagccgggctccgtgatccgctgccgtccggttggcgttctgaagatgaccgacgaatctggtgaagatgcgaaactggttgccgtaccgcacaccaagctgagcaaagaatacgatcacatcaacgatgtgaacgacctgccggaactgctgaaagcccagatcactcatttctttgagcactacaaagatctggaaaaaggcaagtgggttaaagtcgacggttgggacaacgcggaagcggcgaaagccgaaatcgttgcctctttcgagcgcgctaagcagaagtaa

SEQ ID NO: 1854 - DNA, 207 bp, Klebsiella pneumoniae
gttctatatgtagtgatttgcatcaaagatgtttgcgattttattgacccagaacaaggtaaaaaggtgagagtacggatgatgggcgctggcgataaatgtaaatttaggcgcttaaaatataagcaaaaatcgagcccgttcaggcatgaaacgggcaaatattcaggcaatcaacgtatcgttaagcagatcgaccagcagtag

SEQ ID NO: 1855 - DNA, 474 bp, Klebsiella pneumoniae
cggcggtatgtgacaatagggataactgccgcacattatgaggaacgagccatggcaaacccggaacacctggaagaacagcgtgaagagacgcgtctgattatcgaagagctgctggaagatggcagcgatccggacgcactgtacacgattgagcatcacctctctgcagacgatttcgaaaccctggagaaagtggcggttgaagcgttcaagctgggctacgaagtgaccgagcccgaagagctggaagtggaagagggtgacatggtcatctgctgcgatattctgagcgaatgcgcgctgaacgcagacctgatcgatgcccaggtggaacagctgatgacgctggcagaaaaatatgacgtcgagtatgacggttggggcacctattatgaggacccgaacggtgaagacggcgatgacgatgacgaagagtatgtcgatgaagacgacgatggtgttcgccactaa

SEQ ID NO: 1856 - DNA, 1380 bp, Klebsiella pneumoniae
acggataatgtggagcgcaacatgactacctctaccctgcaacacaatgataataaagccgttgaagtagaaaaccgggtgatcaaaaagctgttccgccgcctgattaccttcctgtttgttctctttgttttctcatttttggatcgaattaatatcggcttcgccggtctgacgatgggtaaagatctcggcctgacctccaccatgttcggcctggcggcgacgttgttctatgtcacctacgtgctgtgcgggatccccagcaatatcatgctggcgaaagtcggcgcgcgccgctggatcgccgggatcatggtggtctgggggatcgcctcgacctgcaccatgttcgccaccagcccgcatacgctgtacatcctgcgcatgctggtcggcatcgccgaggccggttttctaccggggatcctcgtctatctgacctggtggttcccggcctaccatcgcgcccgcgccaacgccctgtttatgatcgccatgccggtgaccatgatgctcggctcgatactttccggctatattctggcgctcgacggcctgtggaacctgaaaggctggcaatggctatttctgctggaaggcctgccgtcggtggtgctcggcgtcgtcacctggttcttcctcaacgacacgccggataaagccaactggctggataacgaagagaaacaggcgctgaaggcgatgatcgatcgcgaacgggaacatgcggcgatcgtcccggcttcgccgcgttccacgctgcgcgaagtactgacgccagcggtgctgatgtataccctcgcctacttctgcctgaccaataccctcagcgccattaatatctggacgccgcagatcctgcagagcttcaacaccggcagcagcaacatcatgattggcctgctggcggcgatcccgcagttctgcactattttcggcatgatctggtggagccgccgatccgaccgccgcaaagagcgcaagatgcataccatcctgccctacctgttcgccgcggcgggttggctgctggcttcggcaacgcaccacagcctgatccaactgatcggcattattatggcttcggtgggatcctttaccgcgatggccattttctggaccaccccggatcgggtgatcagcctgcagtcgcgcgcggtggcgttggcggtgatcaacgctatcggcaacgtcggctccgccgtcagcccgctgttgatcggcattttgcgcgataccaccggcagctttagctccgggctgtggtttgtcgccggattactgatcgtcggcgcgctggtgcttacccgcattccaatgagccagcgtgaggacgccgccgccgcgccgggcttagcggcgcaaaaaggccactaa

SEQ ID NO: 1857 - DNA, 471 bp, Klebsiella pneumoniae; identical to SEQ ID NO: 1445

SEQ ID NO: 1858 - DNA, 1233 bp, Klebsiella pneumoniae
aaggatagtgttatgaaataccattcagcaccgctaatcccgcacaaatccgccctcatgtccgcgccggctaatctgctggcggaagaggtctgtctacccgccgcgctgctaaaaaagtcggcgctggaaaataatatttcatggatgcagcgctacgccgacgcccgcggcgtatcgctggcgccgcatggtaaaacgacaatgacgccatggatatttcaggcgcagcagcgagcgggggcgtgggggatcggcgtgggcagcgtctggcaggctagcgcggcaatggccagcggcatccaacgcgtcctgatggtcaatcagctggtcggcaaagccaatatgcaggtggtcgcgcagctaaaagcccactatcgggcggtggattttatctgctgcgtcgatagcgaggtcaacgtgcgcgccctctccgcattcttcgcagaccagggacaaacgctggatgtgctgattgaacttggcgtgcctggcgggcgctgcggctgtcgtagcgttgatgacgcgctggcgctggcgcagcgggtaagcgacctgccggggctacggctacgcggtctggaactgtatgaaggggtgctgcacggcgacgatccgcagccgcaggtggaagcgctgttacagcaggctgcggcgcttgcctgccgcatggagccgctggttgacggcgaatttattctcaccggcgcgggcaccgtctggtatgacgtggtgtgcaacatctggctggcggcggcaaaaccgcgccgctgccgtatcgttattcgccctggctgttatatcacccacgatcgcgggatctacgatctcgcccaacaagagctgatcgcccgcgatccgattgcctgcgatctcgccggcgatctcacttcagcgctggagctgatggcgatggtgcaatcggtgccggaggcggatcgcgcggtagtgaatttcggcaagcgcgactgcgctttcgacgccgggctgccgcagccgatcgcccattatcgtaacggccaggagttagcgctgcgcgcggagtcgatcgtcagcaccggcatcatggatcagcactgtatgctgcgcctggcgccgggcagcgatgtgcaggtcggcgatatcctgctgttcggcacctcgcacccctgtctgacctttgataagtggaagacgttgctgctggtcgatgacgactacaacgtgctggacgagctcgacacgctgttttga

SEQ ID NO: 1859 - DNA, 630 bp, Klebsiella pneumoniae
aggcctggtgtattccactggctggccctcgccagcactaaagaaactcatcctatgcaaaataatcaacgatgggagccagactggtttctacagtcacttctgaacaaccatatcgacaaactggtagagcgctattcttgcctgcgggcattccgaacagatctgttttaccaggatcataccgctaagtatttcctgcaggatcaccagcagctcgaatgggatatccgaaagctgatgaaccgtatgatgcaactcgaagcggtggtcggtttcttctgggttatcgaatggacagaagaccaccactaccatgcccatgtcgtgttctggctggatggtagtaaaactcagaatacctatccctgggcgcagcaagccggtttatactggagtgatatcactgaccgggaaggctggtatcaccggtgtgagtttaaagagcattacgaggccaacatcaacattccggtacgttacagcgatccggacagtatcaccaacatccgacaggtaatggcgtatatgaccaaaattcagcaaaaacaggggatgccgttgttcggttgcaatgaggtccccgaacgaccttcgagtggacgaccacgtaagaatgtctctaagtaa

SEQ ID NO: 1860 - DNA, 201 bp, Klebsiella pneumoniae
gagcatttcgttcaaaaaagtcatacgtcgcagatgcaattacaccatcaccagcattaccagggtttgccttatagacaaatcgatgagatagatgataagattttagaagcaaatcaaattttaacttcatattggtcattttttatcctgtttaacagaagctaccgactgctatcttacactacttcaattcactaa

SEQ ID NO: 1861 - DNA, 888 bp, Klebsiella pneumoniae
attcacctcgtatcacgacagaacaaggagtcagcgatgacgacgaagatgatttctgaagagaccctgcagccgcaggcgcaggaagaaacccggattacgccgcgcgatttacgccgggtgttctggcgctctttccagatggagttctcgtggaactatgagcggcagatgaatctcgcctttgtttacgcgttgatcccggtgctgaagaagctctatccgcgcagagaggagctggccgcagcgctgaagcggcatctggtttttttcaataccacgccgcatatcgtcaccctgctgctggggatcaccacggcgatggaagagaaaaacagtcagcagaaaaacatggatgccactgcgattgataacgtcaaagcctcactgatgggaccgttagccgggctgggtgactctttcttctgggggacgctgcgcctcatcgccaccgggatcggcaccagtctggcgctgaagggcaacatcctcgggccgatcatgtttctgctggtgtttaacgtgccgcacattctggtgcgctggtgttttacccgctggggctacgtactgggcaccggggtcctgcagcggatccagaagagtggaatgatggagagcctgacctacggggcgtcgattatcggtctgatggtagtcggggcgatgaccgcttcaatgatcgatatcaccattcctctctccttcggcgccggggaggccaaaacccaggtacaggacattatcaacgacattctgccctgcatgctgccgttggtgagttttggcatcgtctactggctactgggacggaaagttaaaccgctctcaattattggcggcatggcgctggtgggcattctgggttcgtggatcggattgttttaa

SEQ ID NO: 1862 - DNA, 198 bp, Klebsiella pneumoniae
ctcaacaccgtaggcccgccggtcaagctgtaccagaccccgttcccgtcgttgtgccggatggcggctaacgccttatccggtctacagagctctgtatatcaaacggttactcaacacgtaggcccgcgcaagcgcagcgccgccgggcaagctgtaccagactccgttcccgtcgttgtgccggatggcggctaa

SEQ ID NO: 1863 - DNA, 1392 bp, Klebsiella pneumoniae
gaggtaaacgtggcgaaagctccaaaacgcgcatttgtctgtaatgaatgtggtgcggattatccgcgctggcaggggcagtgcagcgcctgccatgcctggaacaccatcaccgagatgcgcatcgccgcgtcgccgcaggtggcgagaaacgagcgtctttcaggctatgccggtaacgccggcgtgtcgaaggtgcagaagctgtcagatatcagcctggaggcgctgccgcgtttctccaccggctttaaagaatttgaccgcgtgctgggcggcggcgtggtgccgggcagcgcgatcctgattggcggcaaccccggcgcgggcaaatcgacgctgctgctgcaaaccctctgcaaactggcggaagggatgaaaaccctgtacgtcaccggggaggagtccctgcagcaggtggcgatgcgcgcccatcgtctcgggttgccaacggccaacctgaacatgctctcggaaaccagcattgagcagatctgtcagatcgccgatgaagaaaagccgcagctgatggtgatcgactccatccaggtgatgcatatggccgacgtgcagtcgtcgccgggcagcgtcgcccaggtacgggaaaccgcggcctatttgacgcgctttgctaaaactcgcggcgtggcgattgtgatggtcggccacgtcaccaaagacggctcgctggccggtccgaaggtgctggagcactgtatcgactgctcggtgctgctggacggggatgccgactcccgcttccgcacgttgcgcagccataaaaaccgctttggcgcggtgaacgagctgggcgtcttcgccatgaccgagcagggcctgcgcgaagtgagcaacccgtccgctatcttcctcagccggggagatgaaatcacctccggtagctcggtgatggtggtctgggaagggacccgcccgctgctggtggagatccaggcgctggtcgatcactcgatgatgtccaacccgcgccgcgttgcggtggggctggaacagaaccgtctggcgatcctgctggcggtgctgcaccgtcacggcggcctacagatggccgatcaggacgtcttcgtcaatgtggtcggcggggtgaaggtcacggaaaccagcgccgacctggcgctgctgctggcgatggtctccagcctgcgcgaccgtcctctgccgcaggatctggtggtctttggcgaagtggggctggccggggaaattcgcccggtaccgagcggtcaggagcgtatctccgaagcggcgaagcacggcttccgccgcgccatcgtcccggcggccaatgtgccgaaaaaagtgccggaaggcatgcaaatctttggcgtgaaaaagctttcagacgcgctaagcgtttttgacgacttataa

SEQ ID NO: 1864 - DNA, 1056 bp, Klebsiella pneumoniae
cccaactgcgtgtcggacagctggcggcgcgcgccgccgatgagcggctgggtctcaagtaccacctgctggggcccggataacacccggcgtcggcggttttgccaaggcgctgcgggacgatcccgggtgatccttgaggtggcgcgcaaagtggaacagctggcgccggaagcgttcattctcaactttactaatccggcggggatcgtcaccgaggcggtcagccgctacagcacggcgaagatcatcggcctgtgcaatgtgccgatcaacatgcagcacatgatcgtcgggatgctgggcgcccaggagtccgaagtaaaactgcgctttgccgggctcaaccatatggtttgggtgcataaggtgctacaggggcgcgaggatgtcaccggcaaggtgatcgacatgctgtgcgacggtaaggcgctgtcgatgaacaacattaaagagctgccgtggccagaggaattcctgcgcgcgctgaaggcgattccgtgcccctatcatcgctatttttggttgacgccggcgatgctggcggaagagatcgccgcggcgaaaaccaagggcacccgcgccgagcaggtgatgaaagtcgagcaggagctgtttgcgctgtacgccgacccgcagctggaagaaaaaccggagcaactgagctttcgcggcggcgcctactactcggaggtggccgtcgagcttatcaacgcgatctacaacaacctgggcgcggagatggtggtgaatacccgcaacaacggcgcgattcatggtctggatgatgatgcggtggtggaaaccaacagcattattgatgcgcaaggggcgcggccgctggcgttcggcccgctgccgccggcgatgaacggcctgacccagcaggtaaaagccttcgagcggttgacgattgaagccgcggtacacggctgtcgcgaaagcgcactgctggcgctggtgaccaacccgctggtcggtaacgtcaccgatgcccaggcgctgctggatgaagtattaaccatcaaccgtcaatggctgacgcaatttaactga

SEQ ID NO: 1865 - DNA, 804 bp, Klebsiella pneumoniae
ggatctggcgtgacgcaccgttttatcgatacccactgtcactttgattttccccccttcgcggcagatgaggtcgccagcctggcgcgtgcggcgcaggccggcgtcgggcgaattatcgttccagccatctctgctgagcgttttagccgcgtgctggcgctggcagctcagcacgaagcgctgtacgccgcgctgggtatgcatccgatcgtcatcgaagagcatactgatgagggactggcgcagctggaagccttgatggcgcagcggccgcctaaactggtggcggtgggagagattggcctcgatctttatcgcgacgatccgcagtttgatcgtcagcaggcgctgctggaagcgcagctgaggctggcgaagcgttacgatctgccggtgatcctccactccagacgcacccacgataagctggcgatgctgctgaaaaaacatgccctgccgcgtaccggagtcatccatggctttgccggcagcctgcagcaggccgagcgcttcgttcagcttggctataagatcggcgttggcggcaccattacctatccccgcgccagtaaaacccgtgaagtgatggcgcgtctgccgctttccgctctgctgctggagaccgatgcgccggatatgccgctaaatggctttcagggacagcccaatcgaccggaacaagctgcacgggtatttgaggcgctgtgtgaactgcgtccggagtcgccggcagccatagaagaagggatcatgcacaatacgctcgccttgttttcccttcccccggtctctgtatggtga

SEQ ID NO: 1866 - DNA, 777 bp, Klebsiella pneumoniae
ggagctggcgtgaactatacggttggcattgattccggctccaccgccacaaaaggcatcctgctggcggacggcgtcatcgtgcgccgcttcctctgccccaccccctttcgccccgccgacgccatccacgaggcctgggagacactgcgcgctggcctcacggagacgccttttttaaccctcaccggctatggccgccagctggtggattttgccgataagcaggtgacggagatctcttgtcacggcctcggcgcccgcctgctggcgccggacacccgcacggtgattgatatcggcggccaggacagcaaagttatccagctggacgccgggggcaacctcagcgacttcctgatgaatgacaaatgcgccgccggcaccggccgctttctggaagtcatttcacgcaccctcggcgccagcgtcgaacaactggacgccattaccgacggcgtggaaccgcacgccattaccagtatgtgcacggtgtttgccgaatcggaggtcattagcctgcggtcggccggtgtcgcgccggaggcgattctggcgggggtgattaacgccatggcccggcgcagcgcgaactttattggccgcttatcggcgcaggggccgctgctgtttaccggcggcgtcagccactgcgccgcctttgcccggatgctggaaagccatgtcggcatggcggtgacaacccatcccgacgcccagtttgccggggcgatcggcgcggcgctgatcggccagcgccagcggaggcgcggatga

SEQ ID NO: 1867 - DNA, 276 bp, Klebsiella pneumoniae
ttccagagcttgagaataaacacgatccccttcatcacaactgaatgctttcaacacatccctaacccgaccggcaaacaattttgtacgccctgcttcgaatttaccgaagaacaaccgctcaattgcagaaacgtatttcactatactcgaatgtatatttggatctgtaaccgcgtccccgaaccaattgatagcgtcaataaggcgctggtgaaggtgagtagtttctactggattgactatgggtatcaaagcagaaccgaggatgtctaa

SEQ ID NO: 1868 - DNA, 1059 bp, Klebsiella pneumoniae
tcggcgccagtcttaatgaaggagtgtttcatgtccgcttttaccccggcaagtgaagtcttgctgcgccacagtgatgatttcgagtccgcccgcgttctgtttgccggtgacctgcaggatgacctgcctgcgcgtctggataccgcggccagccgcgcccacacccaacagttccaccactggcaggtcctcaaccgccagatgggtgacaccgtccgttttagcttagtggctgaggccgctgacgtcgccgaatgcgacaccctgatctactactggccaaagaacaaaccagaggcgcagttccagctgatgaacctgctctctctgctgccggtgggaagcgacattttcgtcgtcggtgaaaaccgcagcggcgtccgcagcgcggagcagatgctggctgaatacgcgccattaaacaaagtggatagcgcccgccgctgtggcctctatcatggccgtctggaaaagcagccgaccttcgacgccgacgcattctggggcgaatacacactggataatctgacgataaaaaccctgccgggcgtcttcagccgcgacggtctggacgtcggcagccagctgctgctctccaccctcgagccgcataccaaagggaaagtgctggacgtcggctgcggcgcgggcgtgctggccgccgcgctggccagccattcgccgaaagtgcgcctcaccctgtgcgacgtcagcgccccggcggttgaagccagccgcgcgacgcttgcctccaacggcctggctggcgatgtgtttgccagcaacgtcttctccgaggtcaatggtcgcttcgacatgatcatctccaacccgccattccatgacggcctgcagaccagtttcgaagccgcccaggcgctgatccgcggcgcggttcgccatctgaacagcggcggcgagctgcgcattgtcgccaacgccttcctgccgtatccgcaggtgctggatgagacgttcggcttccatgaggtgatcgcccagaccgggcgctttaaggtctatcgcaccatcatgacccgtcaggcgaaaaaataa

SEQ ID NO: 1869 - DNA, 492 bp, Klebsiella pneumoniae
actaaaacagtggcaacagcacccgctggaaaaggtttaccccttcgtctggctgaacgtattcactataaagtccgtgagaatggccgttatcagagcaaaacggtttataccgttatggcgctgaatctggcaggcaagaaagaaactctgggtcggtatctatcagaaagtaaaggcgctaacttctggctgtctatattaagcgacctgcaaaactggggcattgaagacatcctgatcgcctgcgtgggcgggctgaccggcttcccggaggcgataaacaacatttatccgcagacagaggttcagttgtgcgtcattcaccaaatcagtaactcgattaaatacgtggcctcaaatgaccataaagcttttatggctgatctgaaaccggtatatcgcgcggggtcgaaagaagccgcagaaacggtgctggatgagctggaagcgaaatgggatcagcagtatccagtgttgctcaagtcgtga

SEQ ID NO: 1870 - DNA, 468 bp, Klebsiella pneumoniae
gctacggcagtgataagaaaattaccggacgggcagggcgtttcctgcgtcgtcggatggactaaggagttgagtatgagtatcaagcgttatggcgtagaaggtggtaccggtaccggcgggcagcacctgccgttcgcgcgggcggtggaagcgggaggctggctgtacgtttccggccagacgccgatgaaaaatggcgaagtcgtggaaggcgggattgtcgaccagtcgcgtctggcgattcagaactgcgtagatatcatgaccgaagcgggctacaccctgcccgacgtggtgcatgttaaagtgatcctcaccgatgcgcgctattttcagtcgttcaataaggtatttcgcgagttctttggcgacaacccgcctgcccgcatctgctgcgtagcggacctggtggtggattgtaaagtcgaagtggatgtgacctgttttaacgctgcgcgacaataa

SEQ ID NO: 1871 - DNA, 549 bp, Klebsiella pneumoniae
atgaaaggagttctcatgaagctatggcctgttgtcaccggcgtcgctatcgcgttaaccctggtggcctgcaaatcgcccacgccgccgaagggcgttcagccgattagcgggtttgacgccagccgttatctcgggaaatggtatgaggtcgcacgcctggagaatcgcttcgagcgaggcctggagcaggtgaccgccacctacggcgcccgcagcgacggagggatcagcgtcgtcaaccgcggttatgacccggtcaaaaaacgctggaatgagagcgacgggaaagcctatttcaccggcgcccccaccaccgcggcgctgaaggtgtcgttcttcgggccattctacggcggctataacgtgatccgcctggacgacgactaccagtacgcgctggtcagcggccccaaccgtgactatctgtggatcctgtcgcgcacccccaccattccggcggcggtgaagcaggattacctgaataccgcgcgcgagctgggctttgacgtcgatcgcctggtgtggatccgccagacgccgcgctag

SEQ ID NO: 1872 - DNA, 492 bp, Klebsiella pneumoniae
ttagagatggtctccataattaaatgtaaggttaatctaatgaaaaaattgaacttattgtctttactaccagtcatgttgttccccttacttatcgcaggtaatgctcacgcagcacgtccttatagcggattcctgcctgcggcagtgaataataagagtgggaatatattctggtgtgatgcccaccgacaggtcagaaaactgtgtacagcgacggaagtggattcaatgggatggtttattgttgttcgctcgaaaccttccagagattgtccgggtggcatatgggggtggatcactcccagtaaagatgatgtggcaacagggtataccattactccgggtaaagaattcaatctgaccatgaaggatatgtgcagtcccgatatgaaagtaacgttccgcccgaataaaaaggaccctcgttatgatgatctcgtcgggatttatgccgggaaagaagcgtttcgctacaaacaaataaaataa

SEQ ID NO: 1873 - DNA, 219 bp, Klebsiella pneumoniae
ccggttgcggttatctgcattgagatgaatactggaacagtcacttctccttttatttataacaaaagagccgtgtatgaatcgttgcctcatgagcagtatagccggttgcacatccgccagcggcctgctgcgtcaaaaagcggtcatcgtaacggcagggtaatcgttgttgggccagtatcaatagcctgtcaggagggctactatgtctgctaa

SEQ ID NO: 1874 - DNA, 462 bp, Klebsiella pneumoniae
gaggataaggtaatgcaagttattctgcttgataaagtagcaaacctgggtagcctgggtgatcaggttaacgttaaagcgggctacgctcgtaacttcctggtcccgcagggtaaagctgttcctgctaccaagaaaaacgttgaattcttcgaagcacgtcgcgctgaactggaagccaaactggctgacgttctggcagcagctgaagctcgtgctgagcagatcaacgccctggaatccgtaaccatcgcgtctaaagctggcgacgaaggtaaactgttcggttccatcggtactcgcgacatcgctgacgctgttactgcagcaggcgttaaagttgctaagagcgaagttcgcctgccgaacggcgttctgcgtaacgttggcgagcacgaagtgaacttccaggttcacagcgaagtattcgctaaagttatcatcaacgtggttgctgagtaa

SEQ ID NO: 1875 - DNA, 2028 bp, Klebsiella pneumoniae
tgtcaggaggtagtgtgtatgtctcatttattttatggcgtggcgtattacgatgaatatatgccggaagatcggctggctaaggatatcgccttaatgcgcgaaaccggcattaacgtggtgcgtattgccgagtccacctggagtacgctggagcctgaagagggccagtataatttctaccatatcgaccgggtgctggaggcgatgcatgaggccggcattgcggtcatcgtcgggacgccgacctacgcggtaccggcctggctggcggcgaaacatcccgatattctggtcaccaccgtcgcggggcagcaaaaatatggcccgcggcagatcatggatatcgtcaatccgacctttcgccgctatgccgaaaaaattatccgcacgctgatggcccatgtgcagcaccatccggcgattatcggctggcaactggataacgaaaccaagcattacgacaatattggccgctatatgcaggagggcttcgtgcgcagcctgcaggagaaatatcctgacctccggcagctgaatcgcgatttcggcctggattactggagcaaccgcattgaccgctggcaggattttccgccggtggaaaacaccatcaacgccagcctcgcctgcgccttctcccgctatcagcgtcagcaggtcaccgagtatctggcctggcaggcggccatcgttcgggaatatgcccagccgcaccagttcgtcacccacaacttcgatttcgaatggcgcggttactcttacggcgtgcagccgcgggtcgaccattttgcggcggcgcaggcgctggatatcgccggcgtcgatatctatcacccgagtcaggcacacctgaccggacgggaaatcgcctttggcggcgccatcacccgctcgcttaagccgggccagaactacttcgtgctggaaacccaggctcagggcttcgcccagtggacccccttcccgggccagctacgcctgcaggcattcagccatatcgcctccggcgccgccatggtctcctactggcactggcattcgattcataacgcctttgaaacctactggaaggggctgctcagccacgacttctcgcgcaacccaacctggcaggaagctaccaccatcggcgccgatttcgcccgcctgtcgccgcagctggcggagctgaaggccgaaaatgacgtcgcgttgctaataagtaatgaggcgatggacgctctcaatcacttccttcccggcgacgccaggggcaacatttataacgatatcttccgccgcttccacgatgcgctgtatgaccacaatatcagcctcgacatcatccacgatgtgaacgaggaaacctcgcgctaccgggtgctgatcgttcctggtctgtacgccgccgatgagggcctgctaacgcggattaacgactatatcgcccggggcggcagagcgctgatcggctttaaatcaggctttagcgatgaaaacgtcaaggtgcgcagcagcgcgcagccgggggttttgcgccagagctgcggcgtcagctacagccagttcaccctgccggaagagacgacggtaagctcttgctgcgcagagattgattgccgcaatgacaatcaggctgagctgtggatggaattgctgacgcccgatgacgggacccgcaccctgctgcgctaccagcacccggcatggggcgaatacgccgccgcaacggaggcggattacggtcagggtcgcgccctgtacgttggctttctgccgcagaagggcctgattagccagctgtttgatgtcctgacggcggatctcacgctgaactcgcgaacttccgcctatcgctatccgttagtggttaaaaagatgcgtaaccgtgccggaaataatatccacttcctgttcaattactccggcgaggcgatggatgttgtcagcgagaccctgggtaccgcgctgctgagcggggagacagtatacgtcggccagccgttgcgcctcagggcctgggaatttactatcatcgaaagctaa

SEQ ID NO: 1876 - DNA, 201 bp, Klebsiella pneumoniae
ggtaaggaggtgatccaaccgcaggttcccgtacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtagcattctgatctacgattactag

SEQ ID NO: 1877 - DNA, 1650 bp, Klebsiella pneumoniae
ccgcaatttttcgtattccacatgcgtggcccatggccgcgtttacttagaagattaattatgacgttgtctccttatctgcaagaggtggccaaacgccgcacttttgccattatttctcacccggatgccggtaagaccaccatcaccgaaaaggtgctgctgttcggacaggcgattcagaccgccggtacagtaaaaggtcgtggttccagccagcacgcgaaatccgactggatggagatggaaaagcagcgtggtatctcgatcaccacctcggtaatgcagttcccgtatcatgactgcctggtgaacctgctggataccccggggcacgaagacttctccgaagatacctaccgtaccctgacggcggtggactgctgcctgatggtgattgacgcggcaaaaggcgtcgaagatcggacccgtaagctgatggaagtcacccgtctgcgcgatacgccgatcctcacctttatgaacaaactcgaccgtgatatccgcgatccgatggagctgctggatgaagtcgagaacgagctgaaaatcggctgcgcgccgattacctggcctattggctgcggcaagctgttcaaaggcgtttatcatctttacaaagacgaaacctacctgtatcagaccggtaaaggccacaccatccaggaagtgcgtatcgtgaaggggctcaacaacccggatctcgacgcggcggtgggggaagacctggcgcagcagctgcgtgacgagctggagctggtgcagggggcgtcgaatgagttcgacaaagatctgttcctggccggggaaatcaccccggtcttcttcggaaccgcgttaggtaacttcggcgttgaccatatgctggatggcctggtggagtgggccccggcgccgatgccgcgcaacaccgacacgcgtgaagtcaccgccacggaagagaaattcaccggcttcgtgtttaaaattcaggccaacatggatccgaaacaccgcgaccgcgtggctttcatgcgggtggtgtccggcaaatatgaaaaaggcatgaagctgcgtcaggtgcgtatcggcaaggacgtagtgatttccgacgcgctgacctttatggcgggcgatcgctcgcacgttgaagaagcgtacccaggcgatatcatcggcctgcataaccacggcaccattcagattggcgatacctttacccagggcgagatgatgaagttcaccggtattccgaacttcgcgccggaactgttccgtcgtattcgcctgaaggatccgctgaagcagaaacagctgctgaaagggctggttcagctctctgaagagggcgcggtccaggtcttccgcccgatcgctaataacgatctgatcgttggcgccgtcggcgtgctgcagtttgacgtggtggtagcgcgtctgaaaagcgaatacaacgtggaagcgatttacgaatcggtcaacgtggccaccgcgcgctgggttgaatctactgacgtgaagaagttcgaagagttcaagcggaaaaatgaagttcagctggcgctggatggcggcgataacctgacctacatcgccccgacaatggtcaacctgaacctgacgcaggagcgttaccctgacgtggtgttccgcaaaacgcgcgagcactaa

SEQ ID NO: 1878 - DNA, 294 bp, Klebsiella pneumoniae
ccgttttcattgcatgtgattgatttatcatactgcttaaaaaaacgtcataaaccgcaacagccgcgctccctgcgaagccttatcggctctccgctgggcagtagggccatcattaacatctcatttacttttttgaagtgtgatgtaacgcattcagttacatcaccgattgtctatagtttgtccgcaggtgagactttaaccaacaataaccctacgaggatacccttatgtggaagcgcttacttcttgtcacagcagtttccgcagctatgtcgtctatggcgatag

SEQ ID NO: 1879 - DNA, 195 bp, Klebsiella pneumoniae
tctttatcatttgtcatttgcgacgtgctctgcccctttttctttacgttcgcggtaatgacatacattcatgaaggtgataaattaagcggattatcgatatatattaaatattttgcttattttgcaaataacctttttttgcacattgttatcagactcttcatttttggctttcatcattttgaaatttaa

SEQ ID NO: 1880 - DNA, 456 bp, Klebsiella pneumoniae
tcattatcatttagatttgtatctggaaatcgaatggcctggcgttcccttcctctcagcgatgaacttatctggcgggctcctttgccgacggctgagcatgccctggcggagagtattcgggaaaaaatcgccaccctgcgcccacacctgctcgatttcctgcgacttgacgaacccgccccacggcacgcgttaacgcttgccgaatggtcgcaacccattgccttgcgctccctgctggccacctggtccgatcatatctatcgtcatcagccgacgctgcctcgggaacagaagcctctgctctcgctctgggcgcaatggtatatcggcctgctggtgccgccgctgatgctggcgctgctcaatgaaccgcaaggcctcagcctggcgccagaacatttccatgtcgagtttcatgaaagcggccgggcgggcctgcttctggattga

SEQ ID NO: 1881 - DNA, 189 bp, Klebsiella pneumoniae
caaacatcatttgtttcaataacaaaagacaataaaaaaatacatatgtataaaaacaagtgtgatttattctgtcacttcaatacttcctttcgcctaagattgcccgtaataattccccgtgcagtactattgtttcgacataacaacatgaattatatagtaataattgatgttatcctctactga

SEQ ID NO: 1882 - DNA, 588 bp, Klebsiella pneumoniae
ctggtaacattagcctctttttttaaggagcctgagatgacaaagcagcccgaagactggctcgacgacgtgcccggtgatgacgttgaagatgaagatgatgaaatcatctgggtcagtaagagtgaaattaagcgcgacgcggaagaactgaagcgtcttggcgcggaactcgttgacctggggaaaaacgcgctggataaaattccgctggataccgacctgcgcgacgccatcgaactcgcccagcgaatcaaaaaagagggtcgccgccgccagctgcagcttatcggcaagatgctgcgcaaccgcgatgtcgatccgattcgtcaggcgctggacaagctgaaaaaccgtcacaaccagcaggttgcgctgttccacaagctggagcagatccgcgatcgactgattgacgacggggatgacgccgtcgctgaagtactgaacctgtggccagaggctgaccgtcagcagctgcgttcgctgatccgcaatgcgaagaaagagaaagaaggcaacaaaccgccgaaatcggcgcgcctgatcttccagtatctgcgtgaactggcggaaaacgaaggctaa

SEQ ID NO: 1883 - DNA, 786 bp, Klebsiella pneumoniae
aaaatattttcaaatgcgggttttgccaaagggaacatgaggatggatatcgtaggtcagctgcaggaaggaatgcgccgctttagtgcccaggagtcgcgcgtcgccacctttattctacaaaatctaagctttaccgccagcgcctctattgacgagctggcagccagcgcgggggtcagccctgccaccattacccgcttcgcccgctcagtgggctgcgatgatattcgtgatctgcgtaaacagctggcgcaggccagcgaacggcgcgccagctggcttacgccggacagcgccgccctgcccgtcgcctggcgcgacaaacttagcagccttggcgttaccctaactcgtcagctcggccataccgcggaagcggcggtggaaaagtgtaaatcgcgcctgctgagcgcccgtgcggtacactgcttcgcccttggcgcccaggacgtgacgctggccgcgctgctccagcatcagctactgccctccggcatcgcgattaatctctgtcaggatgcggcgctgatgcggctgaccgccagcaccctcaatgacgatcatctgctgctggtgctggccactgccgaggccaaccctgtgttgcaaagcgccaccttgcaggcgcgtacgcagggagtgaccattattgctctgacgccggaacagcacgcccttggcgatatggccagcgccatcctgccgctgcccgctgacccgcagcaggctcgctatgccctgctactgctggtcgatctgcttaacgatacgttgattgcctga

SEQ ID NO: 1884 - DNA, 1707 bp, Klebsiella pneumoniae
cttcttctttcggggcgcctttggcgcccctcgttgcagcaggaaagtactatgaatcatctcccccactggtggcaaaacggcgttatttatcaaatctatccgaagagttttcaggataccaccggcagcggtaccggcgacctgcgcggcgtcacctcccgcctcgactatctgcaaaagcttggggtcgacgccatctggctgacgccgttctacgtctcaccgcaggtggataacggctacgatgtggcgaactacaccgccatcgatcccccctacggcacgatggccgactttgaacccctggttgacgatgcaaaggccccgcggatccgcatcgtgctggatatggtgctgaaccacacgtcgaccgaacatgaatggttccgtcagtcgctgaataaggagagtccctaccgccagttctatatctggcgcgatggcgaaccggacgccctgccgaacaactggcgctctaaatttggcggtaacgcctggcagtggcacgccgacagcgggcagtattatctgcacctgttcgccattgagcaggcggatctcaactgggagaatccggcggtgcgcgccgagctgaaaaaggtctgcgaattctgggctgaccgcggcgtcgatggtctgcgcctcgacgtggtcaacctgatctcaaaagaccagacctttccctgcgatctggacggggatggccgccgcttctataccgacggcccgcgggtgcatgagttcctgcaggagatgagccgcgatgtcttcaccccgcgtaacctgatgaccgtcggcgagatgtcctccacctcgctggagcactgccagcagtacgccgcgctggacggccgcgagctgtcgatgacctttaacttccaccatttaaaagtcgattatcccggcggagagaaatggaccctcgcccgcccggactatgtggcgctgaaggcgctgttccgccactggcagcagggaatgcacaatcgggcgtggaacgcgctgttctggtgtaaccacgatcagccgcgcatcgtgtcgcgctttggcgacgaaggcgagtaccgggtgacggcggcgaagatgctggcgatggtgctgcacggcatgcagggcacgccctatatctaccagggcgaagagatcggcatgaccaatccgcacttcagcagcatcagcgattaccgtgacgtcgaaagccacaatatgtttatcgaacgtgcggcgcaggggcaaagcccggacgaactgctggcgatcctcgccagcaagtcgcgcgacaacagccgcacgccgatgccgtggcacgccggcgagaacggtggcttcagcgacggtgagccgtggatcggccttggcgataattaccaggagatcaacgtcgaggcggcgctggcggaccccgattcggtgttttatacctatcagcagctgattacgctgcgtaaaaccctgccgctactgacctggggtgattacgaggatctgctgccggagcatccgtcgctgtggtgctatcgtcgtcagtggcaggggcaaacgctggtagtcgccgctaacctgagccgcgagctgcaggcctggcagcccgctgaggccccgggcgagtggaagatgatcatcagcaactatgccgagaccaccccgcgcccgaccgggctgacgctgcggccgttcgaagcgatatggtggctgcagggataa

SEQ ID NO: 1885 - DNA, 213 bp, Klebsiella pneumoniae
gactcggtttccctgcggctcccctatacggttaaccttgctacagaatataagtcgctgacccattatacaaaaggtacgcagtcacacccgaaggtgctcccactgcttgtacgtacacggtttcaggttctttttcactcccctcgccggggttcttttcgcctttccctcacggtactggttcactatcggtcagtcaggagtatttag

SEQ ID NO: 1886 - DNA, 771 bp, Klebsiella pneumoniae
gcggcttcttcgccggcttccagattgcggtgtttgccttcgtggggattgagctggtgggtaccaccgccgccgaaaccaaagacccgggaaaagtccctgccgcgagcgattaactccatcccgctgcgtatcattatgttctacgtcttcgcgctgattgtgattatgtcggtgacgccgtggagctccgtggtgccgagcaagagcccgttcgttgagctgttcgtgctggttggtctgccggcggcggcgagcctgatcaacttcgtggtgctgacctccgcggcctcctcggccaacagcggcgtgttctctaccagccgtatgctgttcggtctggcgcaggatggtcaggcgccgaagatgttcgccaagctgtcgaagcgtgcggtgccggcgaagggcttaaccttctcctgcatgtgtctgctgggcggggtggtgatgctgatggtcaacccgagcgtgattgccgccttcaccatgatcaccacggtgtcggcgatcctgtttatgttcgtctggaccatcatcctttgctcttacctggcgtatcgcaaaaaccgccctcagctgcatgagaagtcaagctacaagatgccgctgggtaaagtcatgtgctgggtgtgcatggccttcttcgtctttgtgctggtgctgttgaccctggaagacgatacccgtgaagcgctgatggtcaccccgctgtggtttgtgctgctgggcgcgggctggctgtttgccggcaaaaaacggctggcgaaataa

SEQ ID NO: 1887 - DNA, 522 bp, Klebsiella pneumoniae
cacatctcttctttttatccttgcgttagccgacgcgccactgtttctggcacgtcggttgcaattaagaaagcagtggaatgcgctttcgaggtaaggatgaaacgacactatatttttgccagccatggcagctttgctaacggtttgttgaactccgtggaactgatcctcggtaaacaacccgatatacataccttgtgtgcctacgtggaagaagaggtcgatctgacgcagcaggtggaagcgctagtggcgcgtttcccggcgcaggatgagctgatcgtgattacggatatttttgccggtagcgtgaataacgagtttgttcgttttttatctcgcccacatttccatttattatccggtttaaatctgccgttaattattgacttgctgatttccgcagcggaagacgataccgaaaaattaattaccgaggcattaacaaacgccaaagagagcattcagtactgcaatcaaacgattgccagcgcgatgactatggataaagacttctga

SEQ ID NO: 1888 - DNA, 276 bp, Klebsiella pneumoniae
tcaccgccttcgatctgcgcgccgggaatgaacatcgccaaagataacgtggtggcgaaaattcagggcatggatccggtgtgggtcaacctgggcggtcccccaagtccatcgcctggcctgatcaagacgcctcggcagttcagtattcaggtttcccgcctggccggacaaaaccttccgcatcagcaaatgggacgatcctccccagcgtcgatagcgccacccgcaccctgcagctgcgcctgcaggtcaacaacccggatgaagcgctga

SEQ ID NO: 1889 - DNA, 756 bp, Klebsiella pneumoniae
aagccgacttctgatccttctctcccgccgggcggcccgctcgcccggcgttttccccgtcgcttcatcaaaccgtcatctccccgccatgcctctgtagtcattgcttcccacaatccgggcttcgataaatggctgaacgagatgcgcgtcaccatgagaaagacctggcttccctggctgatcctgtcgccttccctgctgtttttactgctgtttacctggttcccgctggggcgttcggtgtatgacagcctgtttgatacccgcatggccagcgacggcgcgcagtacgtcgggctggataacttcgcccgcctgtttgccgataacgtcttctggcagtcgctgggcaataacctgctctatatcctgctgacggtggtgcccggggtgaccctcgccctgctgctggcggtcgccctgagcgagaaccatcgcgtcaaccgctggctgcgcaccgcctttttcttcccgatgattatcccgatggtcagcgccgccgcgctgtggctgtttatctttatgcccggcctcggcctgctcgaccactatctggcaaagctgttcgggccgatgaacaacaactggctggggcgcagcaacagcgcgctgctggccctggcgctgatcggcgtgtggaagttcgccggctattacatgctgtttttcctcgccgggctgcagagcattccggcctcgacgccgggaagcggcgctgatggagggggctacccgcacgcaggtcttttttaa

SEQ ID NO: 1890 - DNA, 525 bp, Klebsiella pneumoniae
agcgattattcagtcacgcttatgagtccgtctatgaaatcgtttaaaaatagcgttgttgccgcgcttgccgttagcgcgtttaccctctctggcgcccacgccgcctcctggcaggattcccttaacagcgctgccagccagctcagcggcagtaacgcccaggccagcggcggcatgtccgtctcctcgctaaccagcctgcttaacggcagcagccaatccctgaccgccagcagcatgaataatgcggccgggatcctgtcatattgcgcgaaacagaagctggcctccgtgaccagcgccgataacgtcaaaaatcaggtgctggataaactggggcttagcacgccggaaaaacaaaaacaggacaccagctatctggatggcctgcaggggctgctcaacagcaaaaacggccagcagttggacctgaatacgctcggcaatagctcgctggcgaaacaggtaaaaaccaaagcctgcgatctggtcttaaaacagggtgttaatttcctctcctga

SEQ ID NO: 1891 - DNA, 924 bp, Klebsiella pneumoniae
atgaaaaattcgcttcatttggtacactggaagccatattccttccattttctcagagcgcactctatggccaataacccaacacagctgaccatcctgcaggatgaaatcaggcgtcgctacgatacgttaagcaaacgcctgaaacaggtcgcccgctatatccttgataacagcaatagcgtggctttcgataccgtggcctccattgcgcaacaggcggatgttcccccttccacgttgattcgttttgccaacgccttcggcttcagcggctttaacgaaatgaaacagatgttcaagcaacatttgatggaagagaccgccaactataccgagcgcgcccgtctgttccgccagaccaccagcgatgagtccagcccgccggaaacgccgacggaaatcctcaatatgttcacgatggtgaacaaccaggcgctgcagcagctggcgatgcagacctccagcgatgatctggagcgcgcggtggccctgctgggcgaggcggaaaatatttacgtcattggtctgcgccggtcgtttagcgtcgcctcttatctgacctatgcgctgcgtcacctcgatcgcaaagcctttctgatcgacggcctcggcggcatgttcaccgaacagctgagtctggtcggcccgaaagacgtggtggtggcggtgagcttctcgccgtacgcccgggaagtggtcgagctggtggagctgggcgcgcagcgcaaagcgcggcagatcgccattaccgacagccaggtcagcccgctggcggccttcagcgatgtctgctttgtggtgcgtgaagcgcaggtggatggcttccgctcgcaggttgcttccctgtgtctggcccagacgctggcggtctcgctggcgctgaacagcagccaggagtccgaggccaagcagaaggcgtga

SEQ ID NO: 1892 - DNA, 387 bp, Klebsiella pneumoniae
agaaccggttcgccagccgccgcagccgccgcgccaggccccggttccaccgcagcaacagcctgcgccgcatgcggctccgcagcctggctggcaacagccgcaacctgcgcagccgcccgtacaaccgcaacaccagccgcagcctgttgtgcagcagcctgtcgcgccgcaaccggtgacgccgaccgtcgctcagccgcagccagccgccccgcagcagcctgcgccacagcctgttgccgcgtcgcagcccgccatcgcggaaccgcagccggtagagccgcagcagcccgccgcgccgcagccgaaagagcgcaaagagacggtcatagtgatgaacgtcggcgcgcatcatgggggcccagcttaacggtgaagtgctga

SEQ ID NO: 1893 - DNA, 906 bp, Klebsiella pneumoniae
cattggacatcacttgtttacaattcaggccgaatgagcacttttaaacccttaaaaatacttgcttcgcgccgtcaggtgctgaaagccgggctggctgcgatgacgctgagcggcgtcgcctcacaggtcagcgcaaaagaacagccactgaaaacgtcaaatggacatagcaaacccgccgccaaaaaggccgggggtcgccggattgtaatgttagatccgggccacggcggcatcgataccggcgctatcggccataacggctcgaaagagaagcatgtggtgttggcgatcgctaagaacgtgcgcagcattttgcgcagcaacggcatcgacgcccgcctgacccgcaccggggatacctttatcccgctgtacgaccgcgtggagatcgcccatcagcacggcgccgatctgtttatgtcaatccacgccgatggttttaccaacccgagcgccgccggcgcctcggtgttcgccctgtcaaaccgcggcgccagtagcgccatggcgaaatacctctccgatcgcgaaaaccgcgccgatgaggtcgccggtaagaaagcgacggataaagaccatctgctgcagcaggtactgttcgatctggtgcagaccgacaccatcaaaaacagcctgacgctgggctcgcatatcctgaaaaagatcaagccggtacataagctgcacagccgcaataccgagcaggcggcgttcgtggtgctgaagtcaccatccataccgtccgtgctggtggaaacctcgtttatcaccaacccgaacgaggagaaactgctcggcaccaccgccttccggcagaaaatcgccaccgcgattgccaacggcattatcagctatttccactggttcgataaccagaaagcccattcgaagagacgttaa

SEQ ID NO: 1894 - DNA, 579 bp, Klebsiella pneumoniae
gatatgaaatcgctacgtgtaatgctctgtgcgcttccgctggcgctgaccggctgctccacgatgagcgcagtcaactggtcggcggcctatccgtggaactggtttggcgcttccaccgaggtgaccgagcagggagtgggtaaactgacggcttccacgccgctcaatgaacaggcgattagcgatgcgctgggcagcgactaccgtttacgcagcggaatgaagaccgataagggcaatatcgtccactactttgaagcgctgaaaaacaacagcgtggcgctgaccatcaatggcgacaacggtgctatcagccggattgacgtgcgtgatgcggatatcaaaaccgccagaggcgtaaaaatcggcacaccgtttagcgacctgtacagcaaagccttcggcaactgccagaaaggcagccatgacaacggggcggtcgtcgagtgtcaggccgaggggagccagcatatcagctatgccttcactggccactggagcggtccggacgagctgatgccctccgacgatacgctgaaaaactggaaggtcagcaagattatctggcgtcgctaa

SEQ ID NO: 1895 - DNA, 2085 bp, Klebsiella pneumoniae
cggaggggatccgcctgttcgccgtcgatcagcgcaaactggaagatctgcttgccgccaaactgtcactttagtctcacggagaaaaatatgtcccgaagagagcttgccaacgccatccgcgccctgagtatggacgccgtgcagaaagccaactccggccatcccggtgcgccgatggggatggctgatattgccgaagtgctgtggaacgattttctcaagcacaatccgcagaaccctgactgggtggaccgcgaccgctttatcttgtccaacggccacgcgtcgatgctgctctatagtctgctgcacctgaccggctacgatctgccgctgtctgaactgaagcagttccgtcagctgcactctaaaacgcccggccacccggagcatggctatacccctggggtggaaaccaccaccggcccgctgggccaggggctggcgaacgccgtcgggatggccatcgccgaacggacgctggcggcgcagtttaatcgccccggccatgagatcattgaccatcacacctgggtgttcatgggcgatggctgtttgatggaggggatctcccatgaggcctgttcgctggccggcacgctcggactgggcaagctgatcggtttttacgatcacaacggcatctccatcgacggcaaaaccgaaggctggttttccgatgatacggcggaacgcttccgcgcctatcactggcacgtcataggcgatatcgacggccacgatccgcaggctatcaaacaggcgataacggaagcgcaggcggtgaaagataaaccgtcactgattatctgccggaccatcatcggcttcggttcgcccaacaaagccggctcagaggagtctcacggggcggcgcttggcgaaaaagaggtagcgctggcccgccagcagcttggctggaaatatcctccgttcgagatcccgaaagagatctacgcgggctgggatgcgcgtccgcgcggggaaaaagcggagcacgcctggaacgagaaattcgccgcctaccagcagcagttcccggagctggccgctgagctgacccgacgtatgaatggcgccctgccggaagactttgccgcgaccgcccgcgactacgtggcgaaactgcaggccgagccggcgaaaatcgccagtcgcaaggcttcgcaaaacgcgctgaacgcctacggcccgcaccttccggaactgctgggcggttctgcggatcttgcgccgagtaacctgaccatctggtctggatcgacatcgattaaagaagatcctgcgggcaattatatccactacggggtgcgcgagtttggcatgaccgcggtggccaacggcattgccctgcacgggggctttattccttatacctcgaccttcctgatgtttgtggagtacgcccgcaacgccgcgcgcatggcggccctgatgaaggcccggcagatcatggtctatacccatgactcgatcggtcttggggaagacgggccgacgcaccaggcggtggaacagctggccagtctgcggctgacgcccaacttcagcacctggcgcccctgcgaccaggtggagaccgccgtcgcctggcaggcggctatcgcgcgacagggcgggccgacggcgctgatcctgtcgcgacaaaacctggcgcagatgccgcgtaccccggaacaggtgcaggatatcgcccggggtggctacgtgctgaaggatgccggcggcaagcccgacctgatcctcatcgccaccggctcggaagtggagatcaccgtcctggccgcggaaaaactgttggccaaaggggtaaatgtgcgggtcgtctcgctcccttccactgatgtgtttgacgcccaggatgaggcctggcgcgaatcggtgctgccgtcggacgtcagcgcccgggtggcggtcgaagccgggatagcggactactggtataaatatgtcggcttaaaaggcaagatcgtcggcatgaccggctatggcgaatccgccccggcagagcagttgttcccgttctttggctttacggtcgaccatatcgtcgccaccgccgaacaggtgcttaacgggtga

SEQ ID NO: 1896 - DNA, 498 bp, Klebsiella pneumoniae
tccgtatcgtcgtcaccgcccttggccgctcttccggcctgtttggcggcttgtttcaagccgctgcctgcttcttggctagctggcgaaacggccgccgacactggactcgccgatcctgacgcggcaccacccccgacgcgagaacctgcggcctttgcggccgcaccgctgccccctcctgtgcttgcgccaattccagcgctgctgacgcccgtcgcaccaccgatgccccctgcggtactgccgcctgccatgctggcgttcagtgcggaggccagtccaccacccgcggcactggcagcgcctccgccagttcctgcggcccctagtgctcctgcggccggggctgctgcccctgctgttgcaacagtagcgactgcggccgccgcaccggctgcaccggctgcggccatgcccccaattgcagagccgccgcccatcgacgtgccgctaatcatgccgccgatcagttcagggatggttttggtcaggtag

SEQ ID NO: 1897 - DNA, 1083 bp, Klebsiella pneumoniae
gcgccgtggtcgggtttatctggggtcgggcggttcatgctttttcgcgtcatctttttcctttttctggcggtgctgccttgctcgcaggcatggtcggcaccgacgcagcagcgcttcaacgactggctggtcacctgtaacaaccaaaatttctgcgtcacccgtaacgtggggctgcatcatggcctggtgatgaccctcagccgcagcgctggggcagtcactgacgccagtctgcgtatcgagctgggcggcaccggcaatccagtggcgacgctcgcgccgatagcgccgcgcctgctgctggatggtaaaccgctgcccctgaccgacaagcgctggcacattgaagataagctcattaaaaccgccgacagcgtgacgatcgatgcgtttctccagcaggttcaggagggtaaagcgctctcgctggccaatggcctgcagaccatctccctgcaggggttgaaagcggctctgttttttatcgacgatcggcaaaagcgggtaggtagcgaaacggcctgggtcggcaaaggggaagagccgccgctcagcgtaccgccggcgccggcgctgcgcgcggtggcgagcgcggaaacggcgcagtcgccgctggggcgtgaggagctcaacgatctgatggactacggtaatgagcggatgaccaacagccactgctccctcgatcccttccgccgtgaaattcgcgttactgcgctgacggatgacaaagtgctgctgatgaccagctgcgaatccggcgcctacaacaccgtctggctggcctggctggtctcccgccagcgcccctatgtcgcccgtcaggtgcggctaacgttgccatttcagccgccgggcgaggcgccgcgtgagattgagctgatcaacgccagctatgatgaccgccgccatgagctggtgaccctggataaaggccgcggggccggcgattgcgggatccaaacccgctggcgttttgacggccagcggttcagcctctcccgctacgcgcagcagccgacgtgcgacaactggcaggggccagatgcctggcccacgctgtggatcacccgttaa

SEQ ID NO: 1898 - DNA, 1038 bp, Klebsiella pneumoniae
acgatatctccagcggcaatccggatccggccagactggcctgatttaccccgctatctgggccagattgcccgcacgccccgcctgtatggcgatgcgcccatcgagccgcggcttggccaatgggccgaggcgtggtttgccagagaaatagccgttccctttgcggtgaatctcgccagcggggcgatagacgccctggagcgcctgctgtgcgctctgctgctccccggcgacggcgttgtggtggaagatccctgttttctcagcagcatcaatatggtgcgttacgccggttttaccccctgcccggtggcggtggatgccgaagggatggatcctgacggcctggaggaggcgttacgcaacggcgcacgggcggtgatcttaaccccgcgcgcgcataatcctaccggctgtagcctgacggaaacccgggcgcatgccctgcgggaggtgctagcccgctatccgcaggtactggcgattgttgatgaccattttgccctgctgtcggccacgccatggcactcccctcttcctgcaagcacccaacgctgggcgctggtgcgctcgatgtcaaaaaccctcggaccagatctacggctggcctttatcgccagcgatgccgctacttcagcggcgctgcgcctgcggcttaacgccggcagccagtgggtcagccatctgctgcaggacctgacgctggcctgcctgaccgacgaggcgtttatcgcctcgatgacggagactcgccgtcactatcgccagcagaatgagaaactggcggcggcgctggcccggcacggcttcagccatgctacgccaggggatggcctcaatttctggctgccgctgccagcggcgagccagccctacgccttacgcctggcccgcgccggctggctggtccgggagggagaggtgtttggcatccgtacgccctcccacgggctacgcctgtcgctgggccgtctgagtgacgcagagatttcccgcctggcggccgatattgcgcaggccttagacgccccctga

SEQ ID NO: 1899 - DNA, 702 bp, Klebsiella pneumoniae
ggtgagcatccgggcgggagactatatcgacattggtacgcctctttttggcggatcggttgtgccggtgacggtgaaatcactcgcatttccttcctgagggaacgacttatgaaactaaagaccacattgttcggcaatgtttatcagtttaaggatgtaaaagaggtgctggcgaaagccaacgaactgcgttcgggggatgtgctggcgggggtagcggcggagagttcgcagcagcgcgtggccgccaagcaggtgctctccgatatgacggtggccgatatccgtaataacccggtgatcccgtatgaggaggactgcgttacgcgcctgatccaggatgacgtgaacgaaaccgcctatcagcggattaaacactggaccatcagcgacctgcgggaatacgtgctcaacgacgaggtcaccagcgacgatatcgcctttgtccgcaaagggctgacctccgaggtggtggctgcggtggccaagatctgctccaacgccgatctgatctacggcggtaaaaaaatgccggtgatcaaaaaagccaataccaccatcggtctgccggggacctttagctgccgcctgcagccgaacgatacccgcgacgacgtgcagagtattgccgcgcaaatctatgaagggctctccttcggcgccgggcgacgcggtgattggcgtcaacccggtcactga

SEQ ID NO: 1900 - DNA, 474 bp, Klebsiella pneumoniae
cccatgaccccactgaaagccggtgatatcgcaccgaaatttagcttaccggaccaggacggcgaggaagtaaatttaaccgacttccagggacaacgtgtcctggtttatttttacccgaaagccatgaccccgggctgcaccgtacaggcgtgcggcttgcgcgataatatggacgacctgaaaaaagccggcgttgaagtgctgggcatcagcaccgataaaccggaaaaactctcccgtttcgccgaaaaagagctgctgaactttacgctgctgtctgatgaaaaccatcaggtttgcgagcagtttggcgtctggggcgaaaaatcctttatggggaaaacctacgacgggatccaccggattagtttcctcatcgatgccgatggcaaaatcgaacacgtctttgatgatttcaaaaccagcaatcaccacgacgtggtgctgaactggctgaaagaaaacgcctga

SEQ ID NO: 1901 - DNA, 927 bp, Klebsiella pneumoniae
ccagaaagcccattcgaagagacgttaatgaaacccgatgccgcgcaggtaaaaacttttctgctccagctccaggacaacctctgtcagcagctgagcgccgtggatggcgcgccgtttattgaagatgcctggcagcgggaaggcggtggcggcggacgcagccgggtgctgcgcgaaggccgggtgttcgagcaggcgggggtcaacttttcccacgtccatggcgacgccatgcctgcctccgccaccgcgcaccgcccggagctggccggacgcagttttgaagccatgggcgtctcgctggtggttcatccgctgaacccctacgtgcccaccagccatgccaacgtgcggttctttattgccgaaaagcctggcgccgacccggtgtggtggttcggcggcggctttgatttaaccccttactacggctttgaagaggatgccgtccactggcatcgtaccgcccgcgatctgtgtctgccgttcggcgaggaagtctatccgcgctataaaaaatggtgcgatgattacttctatctcaagcaccgccaggagcagcgcggcatcggcggtctgttctttgacgacctgaacaccccggattttgaccactgcttcgccttgatgcaggcggtcgggaacggctatgctgacgcctatttacctatcgtcgaacgccggaaagccacgccgtacggcgaacgcgagcgccactttcaactctaccgtcgcggccgctatgtcgagttcaatctggtctgggaccgcggcaccctgttcggcctgcagaccggcgggcgtacggagtcgattctgatgtcgatgccgccgctggtgcgctgggaatatgattatcagcccgagcccggcagccccgaggcggcgctgagcgagtttattcaggtgcgcgactggctgtaa

SEQ ID NO: 1902 - DNA, 576 bp, Klebsiella pneumoniae
ttgccgagcccggtgggcattctggtggtgaccgccaatatcgttaagcgcgatctgatccgcgacccggggcctgaatcgttcgatgtttgccaccgggcctgtcgacgatcgtttccggtttcttcggtttcgacgcccacccctacatacggtgaaaatatcggcgtgatggcgattacccgggtctacagcacctgggtaatcggcggcgcggcgatcattgcgattctgctctcttgcgtcggcaaactggcggcggctatccagatcatcccggtgccggtgatgggcggcgtttccctgctgctgtacggggtgatcggcgcctcggggatccgcgtactgattgaatcgaaggtggattacagtaaagcgcagaatctgatcctcacctccgtgatcctgatcatcggcgttagcggcgctaaagtgcacattggcgccgccgagctgaaagggatggcgctggcgactatcgtgggcatcgccctcagcctgattttcaagcttatcagcgtcctgcgtccggaagaggtggtcctcgacgcggcggatagcgaagagtttaaataa

SEQ ID NO: 1903 - DNA, 933 bp, Klebsiella pneumoniae
tcaaaaaagccaataccaccatcggtctgccggggacctttagctgccgcctgcagccgaacgatacccgcgacgacgtgcagagtattgccgcgcaaatctatgaagggctctccttcggcgccgggcgacgcggtgattggcgtcaacccggtcactgacgacgtggagaacctgagccgggtgctggatacggtgtacggggtgatcgacaagtttaacatcccgacccagggctgcgtgctggcgcacgtcaccacccagattgaagccatccgccgcggcgcgccgggggggcttatcttccagagcatctgcggcagtgaaaaagggcttaaagagttcggcgtcgagctggcgatgctcgatgaagcgcgggcggtgggggcggagtttaaccgcatcgccggggagaactgtctttactttgaaaccgggcagggctcggcgctttccgctggcgctaacttcggcgccgaccaggtgaccatggaagcgcgtaactatggcctggcgcggcactacgatccgttcctcgtcaacaccgtggtgggctttatcgggccggagtatctctataacgaccggcaaatcattcgcgccggactggaagaccactttatgggcaagctgagcggcatctcaatgggctgcgactgctgctataccaaccatgccgatgccgaccagaacctcaacgaaaacctgatgatcctgctggcgaccgcaggctgcaactacatcatgggcatgccgctcggcgacgacatcatgctcaactaccagaccaccgccttccacgataccgcgaccgtgcgccagctgctgggcctgcggccgtcgccggagtttgaacgctggctggaaacgatgggcattatggcaaatggtcgcctgaccaaacgggcgggcgatccgtcactgttcttctga

SEQ ID NO: 1904 - DNA, 768 bp, Klebsiella pneumoniae
ctcattcagttaaatggcatggtcatatctggcgagcggcgtacactgcccgcaaacactaaggagacagccatgaaacacgatcattttattgttcaaagtcctgcgacgcctgcgcaacagctgttgctgctgtttcatggcgtaggggataacccggtctccatggggcaaatcggcagctggttcgcgccgcagtttcctgatgcgctgatcgtcagcattggcggggtggaaccttgcggccccaacggtcggcagtggttttcgctgcagggggtgacggaagagaatcgtcagcagcgcatcgacgccattatgccgacctttattgaaattgtacgctactggcaggaaaagagcggcgtcagtccactggccaccgcgctgatcggtttctctcagggggcgattatgtcgctggagagtatcaaagcggcgccggatctggcttcgcgggtcatcgcctttaatggccgctatgcgacgctgccggagacggcaacgacggccaccaccattcacctgatccacgggggtgaagatcgggttatcgacctggcgtgggcggtgtcggccgaggaggcgttacagcaggcgggcggcgacgtgaccttagatattgtcgacgatctcgggcatgccattgacgatcgcagtatgcagttggcgatcgagcgtctgcgttataccgtgccgaagcactattttgatgaggcgctgagcggcagtacgccaaaaggggatgatatcatcgaaatgctgtaa

SEQ ID NO: 1905 - DNA, 1116 bp, Klebsiella pneumoniae
catttcgatacaattccccggattgtcgccgcttggcccttcagggaaggttttatgcttgagatgttaatgcagtggtaccgccgtcgattcagcgaccctgaggcgatagcgctgctggttattttgcttgccggtttcggcattatgttctttttcagcggcctgctggccccgttgctggtggctatcgtgctggcctatctgctggagtggccgaccgttcgtctggagcgcatcggtctgtcgcgcacctgggccacctcgctggtgctgatcctctttgtgggcatcctgctgttgctggcctttgtggtgctgccggtagcctggcagcaagggatctacctcatccgcgatatgccgggcatgctaaataagctctctgatttcgccgccacgctgccgcggcgctatccggcgttaatggatgccggcattatcgatgcgatggcggaaaatatgcgcacccggatgctgacggtgggcgactcggtggttaagtactctctggcctcgctggtggggttactcaccctggcggtctatctggtgctggtgccgctgatggtcttcttcctgctgaaggataaagagcagatgctcaacgcggtgcgccgcgttctgccgcgcaatcgcgggcttgccgggcaggtgtggaaagagatgaaccagcagatcaccaactacattcgcggcaaggtgctggagatgattgtcgtcagcgtcgccacctggataggctttattctctttggcctcaactactcgttgctgctggcggtgctggtcggcttctcggtgctgatcccctatatcggcgcgtttgtggtgaccattccggtggtgggggtggcgctgtttcagtttggcgctggcaccgagttctggagcctgtttgcggtctatctgattattcaggggctggacggtaacctgctggttccggtgctgttctcggaagcggtcaatttacacccgctggtgattatcctgtcggtggtgatctttggcggactgtggggattctggggcgtcttattcgccattccgctggccacgctgattaaagcagtggtgcatgcctggccggatggtttggcggtcgacgactaa

SEQ ID NO: 1906 - DNA, 312 bp, Klebsiella pneumoniae
atatttttcaccggcaccttaagtccggacggcagcggtccggtgttgttcagtctggccaacatggtgaaaccgggaaccttcaatccggacagcatggcggatatgatgacccctggggtgactatctttatgcaggtcccttcctacggcgatgaactgcagaacttcaagctgatgctgcagtctgcgcagtatatcgctgacgaagtgggcggcgtggtgcttgacgatcagcgtcgcatgatgacgccgcaaaaactgcgtgaataccaggatcgtattcgcgaagtgaaagacgcgaacgcctga

SEQ ID NO: 1907 - DNA, 378 bp, Klebsiella pneumoniae
aatgtcgtcaccatgaggacagatttcagggggcaatcagtcatggataaagaacgcattattcaggaattcgtaccaggcaaacaggtcacgctggcgcatctgattgcccacccgggagcggagctggcaaaaaagatcggcgtacccgaatccggcgcgatcggcattatgacgctgacgccgggagaaacggcgatgatcgccggcgatctggcgatgaaggccgccgacgtgcacatcggttttctcgaccggtttagcggcgcgctggtgatctacggctcggtcggcgcggtggaggaggcgcttctgcagaccatcggcggattaggccgcttattaaattataccttgtgcgaattaacgaaaagttaa

SEQ ID NO: 1908 - DNA, 294 bp, Klebsiella pneumoniae
gtccacaacactaaacctataagttggggaaatataatgttccagcaagaagttaccattaccgctccgaacggtctgcacacccgccctgctgctcagtttgttaaagaagctaaaggcttcacttctgagatcactgtaacctccaacggcaaaagcgccagcgccaaaagcctgttcaaactgcagactctgggcctgacccagggcaccgtagtgaccctctccgctgaaggcgaagatgagcagaaagctgttgagcatctggttaaactgatggctgaactcgagtaa

SEQ ID NO: 1909 - DNA, 303 bp, Klebsiella pneumoniae
gaggaaaacacaatggaagcattaggaatgattgaaacccggggcctggttgcactgattgaggcctccgacgccatggtcaaagcggcccgcgtcaagctggtgggagtgaaacagatcggcgggggcctggtgaccgccatggtgcgcggcgatgtcgcggcgtgcaaagccgcgacggatgccggggcggcggcggctcagcgtatcggtgagctggtctctgtacatgtcatcccgcgcccgcatggcgatctggaagaggtcttcccgattagcttcaagggcgacagcaacatctaa

SEQ ID NO: 1910 - DNA, 858 bp, Klebsiella pneumoniae
gctatgacaacagtatttatagccggctcaatctcgattagtcgcctgcatgccaaggtgcaggagagaatcaacaaaattgtgtcgtcaaacttcaatgttgtagttggtgacgcagatggtgcggactcatccattcaagagtgtcttcgtaactatcaagccaataacgtgacggtgtattgcacgggtgaaaccccacgaaataacatcgccgattggccagtacaccgggtttactcaaaagcaaaagttggaagccgagcctattttacagcaaaagacttagaaatggctcgcagcagtgattatggattaatgatttgggactgcaaaagcaccggaaccctgagcaacgtcattgaattacttcgagagagaaaaaaatccgttgtctttatcaacaaagataaggattttgtgacgatttcagatatttcggggcttgagcatcttcttacgtttatgtcgccacatgccagaactaaggcagaagaaaaaatcggtctcacatcaaaaattgccagcatttcacacgaacagttttccctcgacgtgtccgtagaggataagactgctgccatgccagacgaacaaacaggacaagatccatttaatgaaaatgctgctcaaacagaaagcatgaaactgcgatcagaactcatgtccgctcttaagcagcatatcgttaacgcccatctaagccagtcacaagctgccaaggttttcggtgtaacgcagccccgaatttccgatcttacgagaggcaaggtcgatctgtttggactagatgcactggtgaatatggcagcaacagcgggcctacacgtggaaatgcacgttcgaagaacggcatga

SEQ ID NO: 1911 - DNA, 873 bp, Klebsiella pneumoniae
ttgccagcaacggggagaacctgtcgtagtcgggtggcgctaacgcttaaccgacctacaatacacgtaggcccgcgtaagcgtatggactgcaccccgcacccaagccggagcctcgcctccggtttttttgtctctaaatcactttgcttgatatacgtcaagcaagatgggtatggcacaatccgcaaaaagcggtataatcccgcgattttttttgtggctgcccctcagaggagaaagagaatgaagattgtggaagtcaaacacccactcgtcaaacacaagctgggcctgatgcgcgagcacgacatcagcaccaaacgcttccgtgaactcgcctcagaagtgggcagcttactgacttatgaagccaccgccgatctggagactgagaaagtcactattgaaggctggaacggtccggtggaagtcgagcagatcaagggcaagaaaattaccgttgtgcctatcctgcgcgctggcctcggcatgatggaaggggtgctggagcacgtgccaagcgcgcgtatcagcgtggtcggtatctatcgcaatgaagaaaccctcgagccggtgccttacttccagaaactggtgtctaacatcgatgaacgtatggcgctggtcgttgacccgatgctggccaccggtgggtcgatgatcgccactatcgatctgctgaaaaacgccggctgcaccagcatcaaggtgctggtgctggtggcggcgccggaagggattgccgcgctggagaaagcccacccggacgttgagctgtacaccgcctctgtcgataagggactgaacgagcacgggtatatcattcccggtctcggcgatgccggcgacaagatttttggaacgaaataa

SEQ ID NO: 1912 - DNA, 1656 bp, Klebsiella pneumoniae
ggggttctgactatgcgacgttcaaccgttttcgcgcttgtcggcgcggtgctcttgctatctgcaactagtgcgatggctgccggggtcgatttggcgcagagcaacacgtctatgaacagccttctgcggctgattcagaacgcttcaaaccaatgggcaccgcgcctgcatgactacgccttgtggctcttgggatgccttgccgtcatccagttagtttggacttttgctcctttggtcatgcgcggagctgaactgggcgacatcctccatgagctggtgaaattcatcctcgtgatagggttcttctatgcgatgctcgatcacgcgaccgagtggggcggggccatcgtcaacagcttccggcaggccggggcgcacgcggcaggattgggtagtgcggagctgatgccgggggatatgttctcaactgctgtggacttttcacggcaggtgctgacggccggtgtttcgatgttcagcccaatcacatcggttgtggtggccgtatctgcattgatcgtcctgatgtgttttacgtttatagcggctctggtgttcgtgacgctggtagaggcctacgtcatcatcaatgccgccgtcttgtttatgggtttcggtggctctcaatggacacgcgaatatgcactggctcccattcgctatgccgttgcggtaggtgccaagctgttcgtcctgactctgattgtgggtctgatcatgcaggtttccgcagaatggtcagcagcctacaccaacgacgaagcgtcgttgatgaccttggtcggcctgtctttggtgtgcgcctacctgaccaaaaccatccctgaactgatcggcggcatgattagcggcacgtcgatgggcggcggctctgcaattgggggcatggccgcagccggtgcagccggtgcggcggccgcagtcgctactgttgcaacagcaggggcagcagccccggccgcaggagcactaggggccgcaggaactggcggaggcgctgccagtgccgcgggtggtggactggcctccgcactgaacgccagcatggcaggcggcagtaccgcagggggcatcggtggtgcgacgggcgtcagcagcgctggaattggcgcaagcacaggagggggcagcggtgcggccgcaaaggccgcaggttctcgcgtcgggggtggtgccgcgtcaggatcggcgagtccagtgtcggcggccgtttcgccagctagccaagaagcaggcagcggcttgaaacaagccgccaaacaggccggaagagcggccaagggcggtgacgacgatacggatcagcaggccgtcgctcagcaacggcagatgacaccaaaagaagggaccggcggcaacggcaaggctgttgcgcagggcgccgaggtggccacacgggcgcttggcgtgctgggcgctatcagcgtacccggtatggaaagctcccacgggctttcgctcgggggcaccgggtccccccctccagtccccggcggcgacagtccaacgcctgacgacggcgcagagccgactacacaagcggaatccaacattattcgtccgacatcggacacagctaggaccgaaaatgtcggcgcgctcaatgtgcccggcatggattctggcgttaactctcaatcggaggcgtaa

SEQ ID NO: 1913 - DNA, 984 bp, Klebsiella pneumoniae
agagacacgacagctctgaaaaacggttacaatggcgcgttagcaacgcgacagcgttgtggttgcatcatttcaggaggagcgatgtctcaggttcagagcggcattttgccggaacattgccgcgcggcgatttggattgaagccaatctcaaaggggacgttaacgccctgcgcgaagcgagcaaaatttttgtcgataacgtggccaccttccaggctaaattccccgacgccaaactcggtgcggtggtggcgttcggcaataacgtctggcgtcagctgagcggcggcgaaagggccgatgagttaaaagatttcccggtctatggcaaaaggctggcgccgtccacccagtatgacctgctgattcatattttatccgcccgtcatgaagttaacttctcggtggcgcaggccgcgctggccgcctttggcgacgctatcgacgtgaaagaagagatccacggcttccgctgggtggaagagcgtgacctcagcggcttcgtcgatggcaccgaaaacccggcgggggaagaaacccgccgcgaagtggcggtcattaaagacggcgtggatgcgggcggcagctacgtgttcgtccagcgctgggagcataatctcaaacagctgaaccgcatgagcgtgccggatcaggagatgatgatcggccgtactaaagacgctaacgaagagatcgatggcgatgaacgtccggtcacgtcgcacctgagccgcgtggacttaaaagaagatggcaaagggttgaaaatcgtccgtcagagcctgccgtacggcaccgccagcggcacccatggcctctatttctgcgcctactgcgcgcgcctgtataacatcgagcagcagctgctgagcatgtttggcgataccgatggtaaacgcgacgcgatgctgcgcttcaccaaaccggtgaccggcgggtattacttcgcgccgtcgctggagcgtatccaggcgctgtaa

SEQ ID NO: 1914 - DNA, 492 bp, Klebsiella pneumoniae
ttgagagcgaccatgaagcgtattgcgattgtcggcgccgtcggtgcaggaaaaaccacgttatttaatgccctgcaggggaattattccctcgccagaaaaacgcaggcgctggaatttaacgatcgtggcgacatcgatacacccggggaatatttcagccatccgcgctggtatcacgccttaattaccaccttgcaggatgtggacaccctgatttatgtccatgcggccaatgataccgaaagtcgcctgccacccgggttgctggatattggcagccgaaagcaccttatcgtggcgatcagcaaaacggatctgccggatgccaacgtcgccgcggtgcggcagctgctggacgggatggggtttcaggcgccggttttcgccctcaacggttgcgatccgcaaagcgtcgcgccgctggaaaattacttgagtgagctcagccaaaaggaggaagggccaggtgaagaaactcattaccgctaa

SEQ ID NO: 1915 - DNA, 837 bp, Klebsiella pneumoniae
gtaatgtttgctgtgtcgtccaagcgcgtgctgccgggctttaccctgagccttggcaccagcctgctgtttgtctgtctgattttgttattaccgctcagcgcgctggtgatgcagctggcgcagatgagttgggcgcagtactgggatgtgatcaccaacccgcaggtggtggccgcctataaggtgacgctgctgtcggcgtttgtggcctcgatttttaacggcgtctttggtctgctgatggcctggatcctgacccgctatcgttttccgggccgcacgctgctggatgccttaatggacctgccgtttgcgctgccgacggcggtagccggtctgaccctggcctcgctgttttcggtgaacggtatttacggggaatggctggcgaagttcgatattaaagtcacctatacctggctcggtatcgccgtggcgatggccttcaccagcatcccgtttgtggtacgcaccgtgcagccggtgctggaagagttggggcccgagtatgaggaagcggcggaaacgctgggcgccacgcgctggcagagtttccgcaaggtggtgctgccggagctgtcgccggcgctgctggcgggcattgctctgtcgtttacccgcagcctcggcgaattcggcgcggtgatttttatcgccggcaacatcgcgtggaagacggaagtgacgtcgctgatgatctttattcgtctgcaggagtttgactatccggcggcgagcgccatcgcctcggtgatcctggccgcctcactggtgctgctgttttccatcaataccctgcagagtcgctttggtcgacgcgtggtaggtcactaa

SEQ ID NO: 1916 - DNA, 894 bp, Klebsiella pneumoniae
atgaagattgcggcatttgatatcggtggcaccgcgttaaagatgggcgtgatggcccgcgacggcaggctgctggaaaccgccaggcagtcaatcaatgacagcgatggcgatcggatcttacaggcaatgctgtcgtggctggcggcccatccgtcgtgtgaaggaatagccatcagcgcgccgggctatatcgatccgcacagcggtcttatcaccatgggcggcgctatccgtcgatttgataacttcgccatgaaatcgtggctcgagacgcgaaccgggctgccggtctcggtggaaaacgacgccaactgtgtgctgctggccgagcgctggcagggcaaagcggcggagatggccaattttctggtgctcactatcggtactggcatcggtggggcgattttctgccaacaccagctgatcaacggggcgcgttttcgtgccggcgaattcggctacatgcttaccgaccgtcccggcggacgcgatcctcgtcgctattcgatgaatgagaactgcactctgcgggtgctgcgccatcgctatgcgcaacatattggcgcgccgctggatagcgtgacaggcgaactgattttcgaccgctatgacgccggcgacccggtttgtcagcgtctggtcgccgagttcttcaatggcctgggccatggcctttataacctcgtccatatcttcgatccgcagaccatttttatcggtggcggcgttgtggaacgcccaggatttctgacgctactgcgccagcatctggcctggttcggcattgccgactatctcgataccgtcagtcacggcaacgatgccggcctgattggcgcggtttaccattttaatcagctgtatcgttcgccagacgacgatcgacattag

SEQ ID NO: 1917 - DNA, 1350 bp, Klebsiella pneumoniae
atcattggtgccgatactaaagaaatcaacttctttggccagatgacgagcaatggtcgccgcagccggtgtttccaccattacgccgatctcaatggattcgtcaaatgctttaccttcgtcacgcagttcctgtttgtagatttcgatctctttcttcagcgcacgcacttcttcaacagagatgatcatcgggaacataatgcgcagcttaccgaaagcggaggcacgcaggatggcgcgaacctggtcgcgcaggatctctttacgatccatcgcaatacgcacggcacgccagccgaggaacgggttctcttctttcgggaagttcatgtacggcagctctttgtcgccgccgatatccatggtacggacgataacggcctgagagccacaggcctcagccaccgctttataagccgcaaactgttcttcttcagttggcagcgcgtcacggtccatgaacaggaattcggtacgatacagacctacgccttcggcgccgttgcgctcagcaccttcgacatcgcgaacggtaccaatgttggcgcagacttcaacctgatggccgtcgagggtaatcgccggcagatctttcagtttcgccagttcggctttttcttccgcaacctgagcctgcagactacgcagcgcttcaatttgctcgttagacgggttgatcagaacctggttgttcaccgcgtcgagaatcagatagtcgccgtttttcacctgtgccgtgatgctgccggtgcccacgatggccggcaattccagggaacgcgccatgatagaggtgtgggaggtacgaccgcccgcatcggtgatgaaacccagcacttttttcaggttcagctgtgcggtttcagacggggtcagatcggcggcgacgaggatgacttcatcctgaatcgcactcagatcgatgattgccagaccaaggatgttgcgcagcaggcgcttaccgatatcacgtacgtcagccgcacgttctttcaggtattcatcatccagctcttccagggcagtggcctgaccgtcgataacttcattggctgccgcgtcggcagtcatgtgcttatctttaatcagggctatgatttcctgctcaagctcctcatcttccagcagcataatatgcccttcgaagatggcttctttttcttcaccgaaagtttcaccagctttggttttgatgacctccagctgggcggaggccttggcgcggccgctcaggaaacgttcgacttcctgatcaaccttatcggcagaaattttcttccggtcgatgacaatttcatcttccttcagcagcaatgctttgccgaaggcgatacccggggatgctaa

SEQ ID NO: 1918 - DNA, 2268 bp, Klebsiella pneumoniae
atatgcctcgcgggagcagaggcactctgtagagcacctatgaatttattaaaatactatcaacaatatcgcgacaagtggtgggctttaccgctcgttctgcctgcgctgttattaccggtcgccagatgggcgaatacctacaccatgctcaatggtcatatggtatttttgtattatcttcccctggcgctggtgctcagcctgatgatgttttttggttgggcggcgatccctggcattattattggcctgctgttaactctggcccacggcatgatgtttgagcagtccatcggtgtactgttccatttccttatcccctgcgtgctctgctggggcggctaccgcatttttgtcccccagcgtcagcaggtctcacacggcaacgtccgactgatgccgcatcgtctgttctggcaaatgctgctcccttcggtcatttttctgattttgtcacagattgccgaatatcttggacttcatccgcgcacaacggaaatgaccggcgttacgccatttagtttacgttcattaatcacctttcaggcgctaatggtagggtgcctgaccggcatgccgctgtgttattttgtgttacgggtcattcgtaatccttttcatttacgcggctttatttctcaggttcgcttacaaattgatccaaaaataaaaaaaattgaaattatttgctgggcgacggtattaattctgctactgtggctattattgatgccgcttaatgatagcagcaccatatttagtacgaattatacgttgtcattgctgatgccggtgatgctctggggtgccatgcgttttggctatcgctttatctcactgatctggacgccggtgctgattgccgtgatccattttcattaccgttacttaccaatttacccaagctataacacccagttggcgatcacctcatcaagctatctggtattctcgtttattgtcgcctatacggcgatgttggcgacacagcagcggctgatctacgctcgcgtccggcagatggccttcctcgacccggtggttcatatgccgaacttgcgggcgctgagccgggcgctcaacggcacgagctggtcgacgctctgttttctgcgcattcctgagcttgaactgctggggcgccactatggggtacttttgcgaatccagtataagcaaatgctggcgaaccacctgagaacgctgctgcagcccaacgaagcggtatatcatcttgccggtcacgatttagtgttccgtctcaatagcgaagggcaccaggcgcgcattcacttaattgaccgctccctgcgacagttccgtttccactgggacggggtccccctgcagccgcggatcggcatgagctattgcaacgttcgctcgccggtcaagcatctgtatttactgcttggcgagttgaacaccattgccgacatgtcgttagccagcggccatccggaaaatttacagcgccgcggcgcgggccatgttcagcaggatctgaaagataaagtcgtgatgatgaaccgcattctcaaagcgctggaacatgaccattttgtcctgatggcgcagcctatccagggcattcgcggcgatcgctatcatgaagtgctggtgaggatggaaggggagtcgggtgagctaacggggccaaacgagttcttgccggtggcgcacgagtttgggctgtccacgcgggtggaccagtgggttattgagcatacgctggcctttatggacgccaaccggcgggcgctgcccggtctgcggctggcgatcaatctttctccggtgtcgctgagccgcagccagtttcctcaggaggtcgaagcgctgctgcaggcctacaacattgagccatggcagattattttcgagctgaccgagaactacgcgctcagcaatcccgagctggtctgccagactttagaacatctgcgggcgctgggctgccgggtggcgatcgatgattttggtaccggctacgccagctacgcccggttaaaaacaatgaacgtcgacattcttaaaatcgacggcagttttattcgcaatctgcttgccagcagtcttgattaccaggtcgtggactctatttgtcgtctggcgcgtatgaagaacatgcaggtggtggccgaatatgtggagtcgccggaaatacgtcaggcggtcatcacgctggggatcgattatatgcagggctatgatatcggggtaccggtacctctgacgcagttggcggaggagatgaccggctga

SEQ ID NO: 1919 - DNA, 720 bp, Klebsiella pneumoniae
gtgagctcagccaaaaggaggaagggccaggtgaagaaactcattaccgctaacgatattcgtgccgcccacgcgcgcggcgaacaggcgatgtcagtagttctgcgcgccagcattatcaccccggaagcgcgcgaagtcgccgagctgctgggattcactatcaccgaagacgatggcgccgcgccggcggcgacagcggcggacagcgacaaaacggaaagccagcggatccgcgaaaccatcctggcgcagttgccggaaggccagtttaccgaaagcctggtggcgcagctgatggaaaaggtgatgaaggagaagcagtccctggagcaggaggcgatgcagccgggatttgaggcagtgaccggcaaaggcggcatcaaagtgatcgacggcagcagcgtgaagtttggccgcttcgacggcgcccagccgcactgcgttggcttaacggacctggtgactgaccaggatggcagcagcatggccgccggatttatgcagtgggagaacgccttcttcccgtggacgctgaactacgacgaaatcgatatggtgctggagggcgagctgcatgtgcgccatcagggggaaacgctggtcgccaaagcgggggacgtcatgttcatcccgaaaggctccagcatcgaattcggtaccccgtcgacggtgcgcttcctgtacgtcgcctggccggcaaactggcaatcgctatga

SEQ ID NO: 1920 - DNA, 1410 bp, Klebsiella pneumoniae
tgccgggaagcgctgacgaaacagctcatgcacgcccggctgcatacaggcgccgcctgccagccacaaatcgacaatcccttgtccggcaatatgtcgggcgacaatttcggccatcttctcgtacaccggcttaaccaccggccagatctccccggcgtggctgcgcttgtactgctccgcctcctcaagcccgatgccgcgattcccggccagagtcagggagatatggtggccgccggtggcttcatccgccgaatacgtcaccctgccctgtttaacgatggcgatcccggtggtgccgccgccgatatccaccaccccggcgttatcgagctgcagcagatcggccaccgcggtaggctcatccagcacatgactgatctccagcccggcggactccaggacattgatcgaaatgcgcggatcggtgccgggcggaaacgaggtcgccgcatgggtgaagcggcagcccagctgctgctcgagagtcgcaagatgtcggcgcacgagggtgacggcgccgaagaagtcccagacgatgccgtcgcgcaccacatcggcccagtcaagacataccgcaaccggctggccatcgcggtcgaccaccatcgacaccacgtcgcaggtgcccaaatcgatgcccagccacagcggcgactcgctggcggcgggcgcctggttacacagggcagcggctttttgcagtctcggcgaaagccagcgttgttcgtcgtgcgccatgttcatcccttatacgattcgaaacgcatccaccagcacgcagcggcgcagacgaacgaaggtccgcgcgctggttaccccttccccggttggggtggtgatggtcatggtggtccagccctcgccgcccagcccaagcccggcgatgcacggcccgtttttgacgaagatgctggtgtcgatggcattcgccatctggttcatgttgtcgatattgcgcgagtgcatcgccgccgtatggtggcagccgccttccagttgcaccgccagggcgatggcctcttcaacgttcgccacccgcaccaccggcagcaccggcatcatcagttcagtaacagcaaacggatggctggcgggcgtttccacaaacagcaggcgggtttgcgccggcacctgcagaccaatcgccgcggcgattttgcccgcgtcgcgaccgacccagtcgcggctgaccgtgcctttgccgcgctcgtcaatatttttcagcagcagcggctggagctgttcggcctgcgccgccgtgagtttcaccgcctgctggccttccatcaggcgcatcagttcgtcggcaacgctatcgaccacgatcagcaccttctcgtcggcgcagataatgttgttatcaaacgaggcgcctttgacgatcgcctgcgcggcgcgcggtag

SEQ ID NO: 1921 - DNA, 321 bp, Klebsiella pneumoniae
tggtcgatggcgagctgcagtttgacgccgcctttgtaccggacgtcgctgcgcacaaagcgcccggcagcccgctgcagggccgggccaatgtgctggtcttcccgtcgctggaggcgggcaacatcggctacaaaatcgccccagcggctgggcggatatcgcgccatcgggccgctgatccagggcctggccgccccgcttcacgacctctcgcgaggctgtagcgtagaggaaattatcgaactggcgctggtggcgtcggtaccgcgccagacggacgcaagccggatccccgactcgtccacgctggttgaatga

SEQ ID NO: 1922 - DNA, 1110 bp, Klebsiella pneumoniae
ttttgttgttatcaatttatagcggttatgttacccggattcgccgccaataatagccctgtctgctatgctttttggttatgtacctcatcaatgtttataccgtataccggcaagcactcatgtaacaacttgttccaggaggacttatccatgaatcagttagacagcatcaagcagttcaccacggtggtcgccgacagcggagacatcgaatccatccgccactaccatccggaagacgccaccaccaacccctctctgctgctgaaggccgccggcctggcgtcctatagcggcctcatcgacgacgctatcgcctgggccaaaaaacagggtggcggccgcgaagcgcaggtggctcacgcctgcgataagctggcggtcaattttggcgcggagatcctcaaaagcattccgggacgggtctccaccgaggtggacgcccggctctccttcaaccgcgagaaaagtatcgagaaggctcgccacctggtggcgctgtatcaggagatgggcattgataagtcgcggatcctgatcaagctggcatccacctgggaggggatccgcgccgcggaggtgctggagaaagaggggatccactgcaacctgacgctgctgttttccttcgcccaggcccgggcctgcgccgaggccggggtttatctcatctccccgttcgttgggcgtatttatgactggtatcaggcgcgcaaaccgctggagccttacgtggtggaggaagatccgggggtgaaatcggtgcgcaatatctatgactatttcaaacagcataaatacaacaccatcgtgatgggcgccagcttccgccgcaccgagcagatcctggcgctggtcggttgcgaccggttgaccatcgccccgcctttattaaaagagctgcaggccagcgataccccggtggtgcgcaaactgatccctgccagccagatcctgccgcgtccggtgccgctcagtgaagcggagttccgctgggaacataatcaggatccgatggcggtcgaaaagctagcggaggggatccgcctgttcgccgtcgatcagcgcaaactggaagatctgcttgccgccaaactgtcactttag

SEQ ID NO: 1923 - DNA, 225 bp, Klebsiella pneumoniae
atttcagctcttcatgcagctgacgcagccagcggcgcagctctttacgcacctgcgcatccagcgcaccgaaaggttcatccagcagcaaaatttgcggctccaccgccagggcgcgcgccagcgccacgcgctgcttctggcccccggacagctgcgccggatagcgatccgccagatgggccagctgcaccatctccagcagtttggtcaccttggctttaa

SEQ ID NO: 1924 - DNA, 246 bp, Klebsiella pneumoniae
cctaacggccagcggtgggcgccgacgtggaactgtccaccgcggatgaccccctgcaggcggttcacttcccccataaactccagcacgaaacgggtagacggctcacgccatacgcgctccggggcatcggcctgttcgatgttgccctggctcatgaccaccacccggtcggcaacttccatcgcctcttcctggtcgtgggtgacgaacacgctggtgaatttcagctcttcatgcagctga

SEQ ID NO: 1925 - DNA, 675 bp, Klebsiella pneumoniae
aagaccatacaaaattttgtatattcagatggcgtttctagcagcttccccgacactgcaaacaacccaaaggaccgccaaagcatgcaagttcaagtcagaaagctcgaaggtagctgggacctcggctatgccctgcataagcatacgctctcaagcgtttacctcggggacgatgagtacggacatccccggtttgacaacactcggtctgagccaggggaagctctctaccaactcaagtaccgaggtgactggaatcaaatcgcaccgctggcggcgcagattcaagccacattactgccattgtttgggaaaattggcttgataattcctatgccagcatccaccacccgcgctcggcagccggtagatgaacttgcggcagaactcgggagaattaccggaattccggtattcaacaatattgtggtgaaagcacctgcaccgcaaggtgcccctcaactcaaaaacttgcacagccgcgaagaaaaagatgcggctttgcaaggtaggttcagcatcaatccgtgtatcaccaatgaaggccgttgggatgcactgttgctggatgatttgttcgatacaggcgcgactatggccgctgtttgcaatgcactgcggacgtacaacaaaataaatcgcgtctacgctgccgcaattacgtggaaataa

SEQ ID NO: 1926 - DNA, 204 bp, Klebsiella pneumoniae
aatcgcgtacattcgcataaaaacgcgtttccgaatgagttcatgagcatcaaggacggactgacaccaaaaggagggggctttgagaggccatcagctagaccagccaaatctaagtcttgtaaattgctcgattcgggtgagaacatagcctccgtttacacgcttttttcgaaactcgatcatcaagaaacaacggagtaa

SEQ ID NO: 1927 - DNA, 564 bp, Klebsiella pneumoniae
agccgcctgcaatgcctttaccgatgccgttctcgatattgcccgtcatcctgtacagcgtgcgtaatggagggagcgatgatcaatgcgctgggattgctcgaagtggagggcatggtcgcggctgtagacgctgcggatgccatgcttaaggcggccaatgtgcgcctgctcagtcatgaagtgctcgacccgggcaggttaacgctggtggtggagggcgacctggcggcctgccgcgccgcgctggatgccggggccgccgctgcccggcggaccggctgcgtgatcagccgtcgggaaattggccgcccggaagaggatacccagcggctgatcggcggttttcagccaccgccgccagcgcccatgccgcctgctgacccggcttcatcggaagccttactgacgctgctggcttcagttcgtcagggcatgacggccggcgaggtcgccgcgcattttgcctggccgctggataaggcccgccaggcgctggagcagctcttttccgcagggacgctacgaaaacgcagtagccgctatcgtctcaaaaatccataa

SEQ ID NO: 1928 - DNA, 1236 bp, Klebsiella pneumoniae
ccccgctggcaatcgccaacagcgggagggaaaaagcggaggggatgtatgcaagctgaactgcagacggcgctgttccatgcctttgatacgttgaatcttcagcaaatgaaaagcttcaacgttccgccggtgacgctgcacggcgtcggcgcgctggcggcctgcggtccgcaagcgcagtcccggggccttaggcatctgtttgtcatggttgacagttttctccatcaggcgggaatgaccgccgggctggagcgtagcctggcgatgaaagggattgctatgactctctggccctgtcccgccggcgaaccctgcgtcaccgatgtctgcgccgccgtcgcccagctgcgggacgcgcgctgcgacggcgtggtggcctttggtggtggatcggtactggatgcggcgaaggcggtggcgctgctggtcgccaatcctgagcagacgctgggggagatgacggagcacagcgagttgcgtccacgtctgccgctgatcgcggtgccgaccaccgctggcaccgggtctgaaaccaccaatgtgacggtgattatcgatgcggtgagtggacgcaaacaggtgctggcgcatgcctcgctgatgccggatgtggcgatcctcgacgccgcgctgaccgaaggcgtcccgccgcatatcacggcaatgaccgggattgatgcgctgacccacgccgtcgaggcctacagcgcccgccacgccacgccgtttaccgacagtctggcgatgggggcgatagtcatgatcggcgaggcgctgccgaaagcggtgggctgcggtcaggatctggcggcgcgggagaacatgctgctggcttcctgcatggcggggatggcgttttccagcgccgggctggggctatgccatgccatggcgcatcagccgggggcggcgctgcatattccgcacggtctggccaacgccatgctgctgccaacggtgatggagtttaaccgcatggtgcgccgggcgcgcttcagccagatcggccgggcgttaaccggcaagaaaaccgatgaccgcgaggctatcgccgccgtgcgcgagctgatcgccgaggtcggtctgacgatgcggctgacggaggctggcgcgacgtccgcgcactacgccgcctgggcgcaagcggcgcaggaggacatctgtttgcgcaccaatccacgcaccgccagccgggagcagattatcgagctgtacgcggcggcgcaataa

SEQ ID NO: 1929 - DNA, 1053 bp, Klebsiella pneumoniae
ccaggatggcagcagcatggccgccggatttatgcagtgggagaacgccttcttcccgtggacgctgaactacgacgaaatcgatatggtgctggagggcgagctgcatgtgcgccatcagggggaaacgctggtcgccaaagcgggggacgtcatgttcatcccgaaaggctccagcatcgaattcggtaccccgtcgacggtgcgcttcctgtacgtcgcctggccggcaaactggcaatcgctatgaacgatttcattaccgaagcgtggctcagagcgaatcatacgctcagcgaaggcggtgaaatccatcttcctgccgatgctcgcctgacgccctcggcgagggaactgctggaaagtcggcatctgcgggtcaaatttctcgaccgccaggggcgcctgtttgtcgaggatgacgaacagacgccgcagccggtgcatgtcctgaccagcagcgaccatccgccccaggcctgctgcgagctttgtcaccagccggtgggcaaaaagccggacaccttaactcatctgacggccgataccctggtggcgaaaaacgatccgcggctggccttccgcgcggtgctggacagcaccatcgccctgacggtgtggctgcaaattgaactggcggagccctggcagccgtggctgacggatatccgttcgcggctgggcaacatcatgcgcgccgatgcgctggaggaaccgctggcggcgcagtcgatagccggattcagcgaggtgcagctgcatcgtctgtcccatcagccgctgcgttacctgggtcacgatcacctggtgccggaggcccgccatgggcgcgatgtcgcgctgcttaatttgctgcgcggcaaagtgcgcgaggcggaggtgaccgcggcgcaggtgtttattacgccgcaatttgcggtccagcgtgccgatattctacaggcgctcaaccgcctttccagcgcggtctacgtgatgatgatcctgggcgtgacggactcgccgccggcgctcagccaactgcagcagctgggaggtgaagatgatcattga

SEQ ID NO: 1930 - DNA, 768 bp, Klebsiella pneumoniae
ggtaatcggcaaatactcttagtgagtaaatgtttgccgtggtggcaaggtgttagaacaacagagaatataatgatgcaggatttgcgtctgatattaatcattgttggcgcgatcgccataatcgctttactggtacatggtttctggaccagccgtaaagaacgttcttcgatgtttcgcgatcgcccactgaaacgtatgaagtcgcgcgacgatgagtcggaaaacgacgactttgatgataatgttgaaggcgtaggagaagtccgcgttcatccggtgactcacgccccgcacggcgcgcatggggagcatgaagcccctcgtcaggcgccgcagcaccagtaccagccgccttacgagcgccagatgcagcagcctgcgcgtcctgaagaaccggttcgccagccgccgcagccgccgcgccaggccccggttccaccgcagcaacagcctgcgccgcatgcggctccgcagcctggctggcaacagccgcaacctgcgcagccgcccgtacaaccgcaacaccagccgcagcctgttgtgcagcagcctgtcgcgccgcaaccggtgacgccgaccgtcgctcagccgcagccagccgccccgcagcagcctgcgccacagcctgttgccgcgtcgcagcccgccatcgcggaaccgcagccggtagagccgcagcagcccgccgcgccgcagccgaaagagcgcaaagagacggtcatagtgatgaacgtcggcgcgcatcatgggggcccagcttaa

SEQ ID NO: 1931 - DNA, 822 bp, Klebsiella pneumoniae
cgacccgataaaataagcgagcattcacaccggatgttaaaaaaggagcaatgcctggctatggtttcatcatccgcaccgaccccgcgcagcggcgtttattatttttcgcagggctggaaactcatcgggctgccgggcatacggcgttatgtcttcctgcctttactggttaacgtgctgctgatgggcgctgccttctggtggctgtttacccgtctcggcagctggatcccctcgctgatgagccatgtgccggactggctgcagtggctaaactacctgctgtggccggtggtagtgctctcaatcctgctggtgtttggctacttcttttcgacgatcgccaactggatagccgcgccgttcagcggcctgctggcggaacagctggaagcgcgcctgaccggcgctaccccgccggatgtcggcgtctttggcatcatgaaagatattccgcggattatgaatcgtgagtggcagaagctggcctggtatctgccgcgcgccatcgtgctgttgctgctctactttattcccggcgttgggcagacggtagccccggtactctggttcctgttcagcgcatggatgctggcgattcaatactgtgattatccctttgataatcacaaggttcccttcaaaaccatgcgcgaagcgctgcgcagtcgcaaagtgatgaatatgcagtttggggcgctcaccagcctgttcacaatgatcccggtgttaaacctggtgatccttccggtggctatctgcggcgccaccgccatgtgggtcgattgctatcgcgatagacacgccagctggaaatag

SEQ ID NO: 1932 - DNA, 375 bp, Klebsiella pneumoniae
ttgaatgtaaaaggtttatctatgctcaccatgtacggaattaaaaactgcgataccattaaaaaagcccgccgctggctggaagcgcatcagattgagtatcgcttccatgattaccgcgccgatggccttgagcgcgcgcaactggatacctttattgccgagctgggctggcaggcgctgctgaacacccgtggcaccacctggcgcaaactcgacgagtcgctgcgcaatagcatcgataatgccgacgccgctgccgcattgatgctggaaatgccggcaattatcaaacgcccattgctctgcgcgcccggtcgtcctatgctgctgggttttagtgaagcaagttatcagcagtttaacgaggtatag

SEQ ID NO: 1933 - DNA, 786 bp, Klebsiella pneumoniae
tccacagcaaataacagacgactctcagaggaatacactatgacgcgccgtgccatcggggtgagtgaaagaccgccgcttttacagacaatcccgcttagtttgcaacatctgttcgccatgtttggcgcaacggtactggtgcctattctgttccacattaacccggccaccgtcctgctgttcaacggcatcggtacgctgttgtacctctttatctgtaaaggcaaaattcccgcttatctgggatcaagcttcgcttttatctccccggtgctgctgctgttgccgctgggctacgaagtggcgctgggcggctttattatgtgcggcgtgctgttctgcctcgtctcctttattgtcaaaaaagccggtaccggctggctggatgtgatgttcccgccggcggcgatgggcgccatcgtggcggttatcggcctcgaactggcgggcgtggcggctaatatggccgggctgctgccggccgacggccagtcaccggacagtaaaaccattattatctcgatggtgaccctggcggtgacggtgttcggatccgtgctgttccgcggcttcctggcgattatcccgatcctgatcggcgtgctggtgggctatgcgctgtcgtttgtgatgggcgtggtcgataccaccccaatcgccgaggcgcactggttcgcgctgcagactttatacactccgcgctatggaggggttggctatcttcaccatattgcccgccgcgatggtggtgattgccgagcccggtgggcattctggtggtga

SEQ ID NO: 1934 - DNA, 717 bp, Klebsiella pneumoniae
aagatgaaaaagcaagctgagttgtatcgtggtaaggcgaagacagtatacagcaccgataatccggacctgctggtactggaattccgtaacgatacgtcagcaggtgatggcgcgcgcatcgagcagttcgatcgtaaaggcatggtgaacaacaaattcaaccatttcattatgagtaaactggcagaagcgggcatccctacccagatggaagcgctgctctccgataccgaatgtctggtgaaaaaactggatatggtgccggtagagtgcgtggtgcgtaaccgtgcggcaggctcgctggtaaaacgtttaggcattgaagaaggtatcgagctgaatccgccgctgttcgacctgttcctgaaaaacgatgctatgcacgatccgatggtcaacgactcctactgcgaaaccttcggctgggtgagtaaagagaatctggcgcggatgcgcgagctgacctacaaagccaacgacgtgctgaaaaaactgttcgatgacgccggtctgattctggtggactttaagctggagtttggtctgttcaaaggcgaagtggtgctgggcgacgagttttcgccggacggcagccgcctgtgggataaaaacaccctcgataaaatggacaaagaccgcttccgccagagccttggcggcctgatcgaagcctacgaagaagtggctcaccgcctgggcgttaagctcgactaa

SEQ ID NO: 1935 - DNA, 1881 bp, Klebsiella pneumoniae
cggagtctgaagatgaaagaaccaaataaaatagatggaaatcgccgcgatctcctcaaaggtctggggattgccgctgtcgtgagcctgttaccagagacgggaaacgccgcgcaaaataatgccgccccgaaagcggcatgggatattcctttcaccggcgaaatccctgacacactgcccgaaggctacaatattttactaataacctgcgatcaggaacgttatttcgagcggtatccctttccggtgccgggccgggaacgcctgatgaaaacgggtatcacttttaccaatcatcagaacacggccaacgtttgtacgccatcgcgctctgtcatgtacaccgggctccatatgccgcacacccggatgtttgataatcttggcttcccctggatgaattacgatctggacccggaattacgtaccgtgggccatatgatgcgtgaactgggttattacacggcgtataaaggtaaatggcatcttacccgggagatcgatcagccggtcgctggtaaatcggtagaagaaatggacctgggcgagatcccgacgccgcgactgcatgaaattatggaaaagtatggtttctctgattatcacggcattggcgatgtcatcgggaaaagtaagggcggctatttctttgattcagtcaccacggggcagaccattagttggctacgtaacaccggccgcccgctgaatgatgaaaataaaccctggttcgcggcagtaaacctggttaacccccacgatgtcatgtttatcgacaccgatgagcatggtgagcaggtgcagtggaaagggccaatggataaagaaaaccacaccctgctgccaacccaacccccgcacaaccaaatctatcagcaaagctggccagactatccgctgcctgcaaaccgccaccagccgctcgatgagcctggcagacctgccgcccataaagagtaccagaatgccagggcggtgatggagggacagttccccgatgaagaccggcgctggcgcaaattactggattattatttcaactgtattcgcgataatgaccagcatcttgaggcgattctcaatgaacttgataatcttcaactgacgcaaaatacgattatcgtctttaccgccgaccatggggagctcggtggctcccaccagatgcatggtaaaggttcctcggtgtataaagagcagatccatgtgccgatgatcattcgccatccggcgtatccgggaaatatccgctgcaacagtttgaccaatcatctggatttagtaccgaccctgattggtctgactggacgcgatcggtcgctgcgagagaaagtcctggagggcagaaaaggccaggatatgagcccattactggcgcatcctgagcaagcgggcttaaatgcgctgcgtccgggttcgctttattgttacggcatgatcctgtatatggatgcgcaatacacggcaaaattcagaaagctggctggagaaaaactcccgcacgatcaatttaaaaaagcaatcgcgtcactccatcctgaattttcccatcgctcagggatccgtatgatcaacgatggacactataaatttgcccgctacttttcgctcaagcagcatcatattcctgcttccctggccgagctgctggagaataatgatgttgaacttttcgatctggttaacgaccccgaagaaaatcataacctcgcccgggagccagagaaataccgggatctgttaatgacaatgaacgataaactcaatcagctcactgccgctgagattggcgaagatgatggcagctatatgcccccgtttgaaggaagccagtgggatctgacggcggcccagatgcatcaatatatgcgcgattag

SEQ ID NO: 1936 - DNA, 1410 bp, Klebsiella pneumoniae
aaaatcatgaatcaacaggacattgaacaggtagtgaaagcggtactgctgaaaatgaaagacagcagccagcctgccggcaccgttcatgatatgggcgtttttgcctcactggatgacgctgtcgcggcggcaacggtggcccagcagggattaaagcgggtggcgatgcgtcagcaggtgattcaggccattcgtgaggcgggtgaaaagtatgcccgtgaactggcggagcttgcggtgacggagaccggcatgggacgcgttgaagataagtttgccaaaaacgtggcgcaggcgcgcggcacgccgggcgtggagtgtctgactccgcaggtgctcaccggcgataatggcctgacgctgattgaaaatgcgccctggggcgtggtggcctcggtgacgccgtccaccaatccggcggcgacggtgatcaacaacgccattagcctgattgccgccggcaacagcgtggtcttcgccccccatccggcggcgaaaaaggtctcgcaaagggcaattaccctgcttaaccaggcggtagtggccgccggcggcccggccaacctgctggtgaccgtggcgaacccggatatcgacaccgcccagcggctgtttaagtaccctggcatcggcctgctggtggtgaccggcggcgaagcggtggtcgaggcggcgcgcaaacataccaacaaacgcctgatcgccgccggggctggcaacccgccggtggtggtggatgagactgccgatctaccgcgcgccgcgcaggcgatcgtcaaaggcgcctcgtttgataacaacattatctgcgccgacgagaaggtgctgatcgtggtcgatagcgttgccgacgaactgatgcgcctgatggaaggccagcaggcggtgaaactcacggcggcgcaggccgaacagctccagccgctgctgctgaaaaatattgacgagcgcggcaaaggcacggtcagccgcgactgggtcggtcgcgacgcgggcaaaatcgccgcggcgattggtctgcaggtgccggcgcaaacccgcctgctgtttgtggaaacgcccgccagccatccgtttgctgttactgaactgatgatgccggtgctgccggtggtgcgggtggcgaacgttgaagaggccatcgccctggcggtgcaactggaaggcggctgccaccatacggcggcgatgcactcgcgcaatatcgacaacatgaaccagatggcgaatgccatcgacaccagcatcttcgtcaaaaacgggccgtgcatcgccgggcttgggctgggcggcgagggctggaccaccatgaccatcaccaccccaaccggggaaggggtaaccagcgcgcggaccttcgttcgtctgcgccgctgcgtgctggtggatgcgtttcgaatcgtataa

SEQ ID NO: 1937 - DNA, 351 bp, Klebsiella pneumoniae
aaaggcatgaatgccggatggcgttgcgcttttccggcctgcacatcacacgcggagacggacatgaagctggctgtggtaaccggatatgtggtctgcaccgtacgtcatgaaggtctggcccacgacaaactgctgatggtggagatgctcaatgcccgcggcgagcccgacgggcaatgcgcggtcgccatcgacagcatcggcgcgggatgcggagagtgggtactgctggtcagcggcagctcggcgcgacaggcgcacgcacacggcgcctctccggtcgatctgtgcgtgattggtatcgtggacgaggctgcggccgatggtcaggtgctcttccataagtag

SEQ ID NO: 1938 - DNA, 456 bp, Klebsiella pneumoniae
tcgaagatgaagaatactgagtttatccccgccgattttgatgcccatggccgtctgcgcctgcctttgcttttctggtgcgtgctgttgttgcaggcccgcacgtgggtgctgtttttgatggccggcgcatcgcgccagcagggcgacgcgattcttaatctgttctatcccgatcacgagcgcttctggcttggtttactgccaggcgtgccggcggtgctggcctttctgcttagcggctatcgtcagcgcctgccgcgcctgtggcgggcgatgcgctggctgctggtgctatcgcaagtgctgctgttgctgtggcagccgatgctatggctgagcggcgaatctccctcctcgttgaccattgcgctgctggtcgcggatggctatgccctgtggtggctgttaaccagccgtcgcctgggcgcctgttttcaccagaccaccttttaa

SEQ ID NO: 1939 - DNA, 921 bp, Klebsiella pneumoniae
cataggacgaatcataatcagtgcgtgacccgctgtccagcggggggagaaaagatgggccagcaggatgatatacaatcagtgctctttcacgacaaaagccgggcgtcggaagtggatatcgtcgccgtgcagtcgcaggtagtctatggcagcgtcggcaacagcatcgcggttccggcgattaaacagcatggtctgcgcgtgctggcggtgccgacggtgctgttcagtaatacgccccattatgagacgttctatggcggcattattccggaagagtggtttgtcgggtatctgcaggcgctggaggagcgcgacgcgctgcgcgaactgcgtgcggtcaccaccggctatatgggcagcgcagtgcaaatcgaacgcctggcgcagtggctgacgcgcgtacgggcccgccatcccgggttgtgcattctggtggatccggtcatcggcgatgtcgacagcggcatctatgtcaaggctgagatcccggacgcctatcgtcagcacctgctgccgctggcgcaagggatcacccccaatctgttcgaactggagacgctgagcggccagcgctgtcgcgatcggcaggaggcggtcgccgcggcgcgaagcctgctgtcggacaccctcaaatgggtggtgatcaccagcgcgccgggagaggccgattcgacgatcaatgtgctggtggtgacggccgatgcagtggaagtggtggttcacccgcgggtggagacagacttaaaaggaaccggcgatctgttctgcgcggagctggtgagcgggttgctttccggcctggcgctgggggcagcgacgcaggctgctgcccagcgcgtgctggaggtgatgaactggactgccgcccagggttgtgacgaattgatcctaccgccgctggagcaaagcagatga

SEQ ID NO: 1940 - DNA, 210 bp, Klebsiella pneumoniae
atacctaagaagcgcatgcgctcaatcagcgggttactcttgtccgccgcttcctgcagcacgcgttcgttaaaagacaaccagctgagttctttttcgatgtatagcttttcctggcccattaccgctcacactccgttttactcacaggacgtagactattatgacgaatttttctgcatagcgatttactgtgtcacaacaatatga

SEQ ID NO: 1941 - DNA, 720 bp, Klebsiella pneumoniae
gcctatgttgaggtccatctgaacgcaccggcacagctctctttgccactgtatcttcctgacgacgaaaccttcgcgagtttctggccgggtgataatccttccctacttgccgccctccagaacgtactgcgccaggaacacagcgggtacatttatatctggtcacgtgaaggggcaggtcgtagccacctgttacacgccgcctgcgcggagctttcccagcgcggggatgcggtaggctacgtgccgctggataaacggacgtggtttgtgcccgaggtgctggaggggatggaacagctggcgctggtgtgcatcgataacatcgagtgcgtcgccggcgatgagccctgggagatggccatctttaatctctataaccggatcctggaatcaggcaaaacccggctgctgatcaccggcgatcggccgccgcggcagctgaatcttggcctgccggatctggcctcacggctggactgggggcagatctataagctgcagccgctgtcggatgaagacaaactgcaggcgctacagctgcgcgccagactgcgcggcttcgagatgccggaagatgtgtgccgcttcctgctgaagcggctggatcgcgagatgcgttcgctgtttatgaccctcgatcagctggatcatgcctcgattaccgctcagcgcaagctgacgatccccttcgtgaaagagatccttaagctttag

SEQ ID NO: 1942 - DNA, 2283 bp, Klebsiella pneumoniae
aaaatggatgagcagttaaaacagagcgccctcgacttccacgaatttccggttcccggaaaaatccaggtctcgccgaccaaacctctcgccacccagcgcgatctggcgctggcctactcgccgggcgtcgcagccccctgcctggaaatcgaaaaagatccgctggccgcctacaaatacactgcccgcggcaacctggtggcggtcgtctccaacggcaccgcggtgctggggctcggcaacatcggcgcgctggccggtaagccggtaatggagggcaaaggcgtcctgtttaagaaatttgccggtatcgatgtgtttgatatcgaagtcgatgagctggatccggacaaattcattaacgtcgtcgccgccctcgaaccaaccttcggcggtatcaacctggaagatattaaagcgccggagtgtttctacatcgagcagcagctgcgcgagcggatgaatatcccggtcttccatgacgatcagcacggcacggcgatcatcagcaccgcggcgatcctcaacggtctgcgcgtcgtcgagaagaatctttccgacgtgcggatggtggtctccggcgcgggcgcggcggcgatcgcctgtatgaatctgctggtggcgctggggatgcaaaagcacaacatcgtggtctgcgattcgaaaggcgttatctataaagaccgtgagccgaacatggcggaaaccaaagcggcctatgcggtggaagacgatggcaaacgcaccctcgatgacgtgatcgacggcgccgacattttcctcggctgctctggcccgaaagtgctgactcaggagatggtgaagaagatggcgcgggcgccgctgatcctcgccctggccaacccggagccggaaatcctgccgccgctggcgaagcaggtccgcgatgacgccatcatctgtaccggccgctccgactaccctaaccaggtcaacaacgtgctctgcttcccgttcatcttccgcggcgcgctggacgtcggcgcgacggcgatcaacgaagagatgaagctggcggcggtgcatgcgattgccgagctggcccatgccgagcagagcgaagtggtggcctccgcctacggcgatcaggatttaagctttggtccggactacatcattccgaaaccgttcgacccgcggctgatcgtcaagatagcccctgcggtggcgaaggcggcgatggattccggcgtggcaacgcgccccatcgctgattttgacgcctatatcgagaagctgagcgagttcgtctataaaaccaacctgtttatgaagcctatcttctctcaggcgcgcaaagagccgaagcgcgtggtgctggcggaaggggaggagacccgggtgctgcacgccacccaggagctggtgtctctgggactggccaaaccgattctggtggggcgcccgagcgtgattgaaatgcgcatccagaagctgggcctgcagatcaaggccggcgttgactttgagatcgtcaataatgaatccgacccgcggtttaaagagtactggagcgagtactaccagctgatgaagcgccgcggcattacccaggagcaggcgcagcgggcggtgattagcaacaccacggtgattggcgccatcatggtgcatcgcggtgaagcggatgcgatgatctgcgggactattggcgagtaccacgatcactaccgcgtggtgcagccgctgtttggctatcgcgacggcgtcagcaccgccggggcgatgaatgcgctgctgctgccgagcggcaacacctttatcgccgatacctatgtcaatcacgatccgtcgccggaagagctggcggagatcaccctgatggcggcggaaagcgtgcgacgctttggtattgaaccgcgcgtggcgttgctgtcgcactccaactttggctctgccgactgtccgtcagccagtaaaatgcgtaaaaccctggagctggtgaaggcccgcgccccggagctgatgatcgatggcgaaatgcatggcgacgccgcgctggtggaaagcatccgcaacgatcgcatgccggacagcccgctgaagggggcggccaatattctggtgatgccgaatatggaagccgcccggatcagctataacctgctgcgcgtctccagttcggaaggggtgaccgtcgggccggtgctgatgggggtggcgaagccggtgcatattctgacgccgatcgcctccgtacgccggatcgttaatatggtggcgctggcggttgttgaagcgcaaaccgaaccgctgtaa

SEQ ID NO: 1943 - DNA, 1086 bp, Klebsiella pneumoniae
aattgcgccgatttttcttgcttaccgcaaacgcgtggagacttcgcagtgaccgataaaacctctctcagctataaagatgccggcgtggatattgatgcaggcaacgctctcgtcgaccgtattaagggcgtggtgaagaaaacccgtcgcccggaagtgatggggggactgggcggattcggcgcgctgtgcgcactgccgcagaaataccgcgagccggtactggtctccggcaccgacggcgtcggtaccaagctgcgtctggcaatggatctgaagcgtcacgacaccatcggtatcgacctggtcgccatgtgcgtgaacgacctggtggttcagggcgctgagccgctgtttttcctggattattacgccaccggtaaactggacgtcgataccgcagccagcgtcatcaacggcatcgccgaaggctgcctgcagtccggttgcgcgctggtcggtggtgaaaccgcagagatgcccgggatgtaccacggcgaagattacgacgtggcgggtttctgcgtcggggtagtggaaaaatcagaaatcatcgacggcagcaaagtgaccgatggcgacgtgctggtggcgctggcgtccagcggcccgcactctaacggctattcgctggtgcgtaagatcattgaggttagcggcgttgacccacaaactaccgaccttgacggtaaaccgctggccgaccatctgctggcgccaacccgcatctatgtgaaatcggtgcttgatctgatcgccagcgttgacgtccacgctattgcccacctgaccggcggcggcttctgggaaaacattccgcgcgtgctgccggataacacccaggcgatcatcgatgagtcctcctggcagtggccatccgtcttcaactggctgcaaaccgccggtaacgtcagccagcatgaaatgtaccgtacctttaactgcggcgtagggatgattatcgccctgccggcagcggaagcggacaaagcgattgccctgctgaatgacaaaggtgaaaacgcgtggaaaatcgggtatatcaaagcctccgattccgaacagcgtgtggtcattgcatga

SEQ ID NO: 1944 - DNA, 210 bp, Klebsiella pneumoniae
gtgccgcgccttgatggcgcagctcctagcttgctgctcttggtcggcctacggccgttgggcaccaaaaaaggtagtgcgggcctgccgtcgccgacgcggctagttccgtggattacccaccggtcgcagcacctggtcgagccgttgaaaccggcaaaaagacgatcaggcaccaaaaagggaagggcagggccaaaatcgacataa

SEQ ID NO: 1945 - DNA, 345 bp, Klebsiella pneumoniae
tatgaaaaagaacccgtgaacttactcgagttcagccatcagtttaaccagatgctcaacagctttctgctcatcttcgccttcagcggagagggtcactacggtgccctgggtcaggcccagagtctgcagtttgaacaggcttttggcgctggcgcttttgccgttggaggttacagtgatctcagaagtgaagcctttagcttctttaacaaactgagcagcagggcgggtgtgcagaccgttcggagcggtaatggtaacttcttgctggaacattatatttccccaacttataggtttagtgttgtggacctaaagtctagtctaacgactcgactttag

SEQ ID NO: 1946 - DNA, 906 bp, Klebsiella pneumoniae
cacatcatggatcaaaaacagattgaagacattgtacgcagcgtaatggcgtcgatgggacaaccacagtcgcagccgcaggcccccgcagcgtcgacgccggcctgccatgccgcctgcgccagcgaagcggtggtggaaagctgcgcgctggacctgggctcagcggaagcgaaagcctggattggggtacaacatccgcatcgcgccgaagtactgactgaactgaaacgcagtaccgcggcgcgcgtttgcaccggccgcgccggcccgcgtccgcgcactcaggcgctgctgcgcttcctggccgatcactcgcgctcgaaagacacggtgctcaaagaggtgccggaagcgtgggtgaaagcgcaggggctgctggaagtgcgttccgagattagcgataagaacctctacctgacgcgtccggatatgggccgtcgcctcagtccggaagcgattgatgcgctgaaggcgcagtgcgtgatggatccggatgtgcaggtggtggtgtccgatggcctgtcaaccgatgccatcaccgccaactacgaagagatcctgccgccgctgcttgccggcctgaaacaggcgggtctgaaggtcgggacgccgttcttcgtgcgctatggccgcgtcaagattgaagatcagatcggcgagatcctcggcgcgaaggtggtgatcctgctggttggcgagcgcccggggctcggccagtcggagagcctctcctgctacgcggtgtactccccgcgggtggcgaccaccgtcgaggccgaccggacctgtatctccaatatccaccagggtggcaccccgccggtagaagccgccgcggtgatcgtggatttagccaaacgcatgctggagcagaaagcctccggcatcaacatgagccgttaa

SEQ ID NO: 1947 - DNA, 1239 bp, Klebsiella pneumoniae
aaaaccatggaaataaacgctattccccgacgccttgccttcaccgcgggcggtcagcaactcatcaactgggggatctctttttatatgcccggcacctttgccggggctatcgccgccgacaaaggatggtccttgccgcagatctatctcggcctgacgcttgcgatgctgatgatggccgctgtctccccgttcgttgccaggctgctggctcgctttggcggaagactggtggtcaccagcggtaccttactgatagccgccagctgcgccatgatggcctggcgcccttcgctggccggctggtacggcgcctggctgctgaccggcatcggcatgcggctctcactgtatgatgcgctgttcgccgcagtggtgaatctgtacggtcagcaggcgcggaaaactatctctcatatcactctcgctggcggtctggcctctgccctcttctggccgctgggcgaggcgttattaaccatcatgccctggcagaatgccctgcggatctatgcgctgtttggcctgctgagcgcatggctgagttatcaactgcctcgccagcggctcaattcagcggcgaaatcaccagcctcgccagcgacagcagagggcgaccggcgtaacggggcgcgttacgcgatctttattgcgctgatcaccttcatctctaacggtacctctacccatctgccggagtttatcagccactttggtctgccggttgccgtcggtatgctgtggggattcggccagaccggcgcccggctgggggaagtgctggccggtccccgggtcacctcactcacgctaacgcgttttactgcgctcgccatgccgctctgttttctccttggattgagcagcacgacctatgccggatgcgcagccgggtttgtgctgggctatggcgcgattaacgggctggtgacgattgtcaaagcgacgctgccgctggcgctgtttagcgcagaaagctacgccagccgcacgggtctcctgctgatccccgggcaactgatggcagctgtatcaccctttgcctacgcatggctgaaccaccggctgggcattatcggcggaatgtgggtgtccaccgggttaacgttgatcgttgccggactggcgctggcgatggtgcgcgaggcgggtaaggcgcaggatgaacgtaatgtagaatatccggcagcggccgttgaccaaccgatagccaaaaacaaccttgctgaagagtaa

SEQ ID NO: 1948 - DNA, 702 bp, Klebsiella pneumoniae
aaacgcgtggaaaatcgggtatatcaaagcctccgattccgaacagcgtgtggtcattgcatgaaaaacatcgtggtgctgatttccggtagcggcagcaatttgcaggcgatcatcgacgcctgcggccggaaacagataaacggcaccctgcgtgcggtattcagtaacaaggctgatgcgttcggccttgagcgcgcgcgcctggccggcatcccggcccatgcgctggcgcaaagtcagtttgccgaccgggaagcattcgatcgtcagctgatgcatgaaatcgacgcctacgccccggatctggtggtgctggcaggctatatgcgtatccttagcccggcgttcgtcagccactatcagggacgtctgctgaacatccatccctcgctactgccgaagtatcctggcctgcatactcatcgtcaggtgctggagaacggtgacgaggagcacggcacctcggtgcacttcgtcaccgatgagctggacggtgggccggttatcctgcaggccaaggtgccggtcttcgctggcgacagcgaggaggaaatcacggcgcgggttcaggcccaggaacatgccatttatccgctggtcatcagctggttcgtcgatggacgtctgcgcatggcaggcaaccacgcctggctggatgagcgacagcttcccccgcagggctatgccgccgacgaatga

SEQ ID NO: 1949 - DNA, 222 bp, Klebsiella pneumoniae
cgtaaagaggaagcgcgcatggaatggcttattaaacactggtggattctggtgctggtctttttggtgggggtaattatcaacgtgattaaagatctgaatcgcgttgaccacaaaaaattcctcaacaacaaacccgatctgccgccgcaccgtgattttaacgataaatgggacgacgacgacgactggccgaagcacgaccagtcgaagaaaccgtaa

SEQ ID NO: 1950 - DNA, 1542 bp, Klebsiella pneumoniae
actcgctgggatgcggccagggaacattacgccgcacaatcggtcaaactggcacacccacattacaggacagaggttatgttcaggcagttgaagaaaacgctggtggcgatcgcgatcgcgtcgctgacgctgggttcgataggtcctgcttttgctgactccgcagataccctaccggacatgggaacctccgcaggaagcacgctgtcaatcggtcaggaaatgcagatgggggattactacgtccgccaactgcgcggtagcgcgccgctgatcaacgaccctctgctggtgcaatatatcaacgggctgggtatgcgtctggtggctcacgccaactcggtgcgtaccccgttccacttctatttgattaataacgaccagatcaacgccttcgccttcttcggcggcaatgtggtcctccactccgccctgttccgctactctgataacgagagcgaactggcctctgtcatggcgcacgaaatctcccacgtgacgcagcggcatctcgcccgcgcgatggaagatcagaaacgcaatgcgccgctgacctgggtcggtgccctgggttcgattctgctggcgatggccagcccgcaggccggaatggcggccctgaccgggacgctggccggcacccagcagggtatgatcagcttcacccgccagaacgaagaagaggccgaccggattggcattcaggttctgcagcgctcgggtttcgacccgcaggctatgccgatgtttatgggtaaactgcttgacgagtcgcgctactcgacgcgaccgccggaaatgctgctcacccaccccctaccggaaagccgactggccgatgcccgtaaccgtgccaaccagatgcgcccggtggtggtacagtcctcggcggacttctatctggcgaaggcgcgtaccctcgggatgtacactaacggcgacaacaagctgggcaccgatctgctgaacgcctgggataaaggcaatatccgccaacagcatgccgcccagtatggtcgcgctctgctggcgatggaaagcaacaactttgaccaggcacgcaaaacgctgcagccgctgctcaacgccgacccgcaaaatggctggtatctcgatctggccactgatatcgacctcggacagaagaaaaccagcgacgccatcaatcgccttaaaaacgcccgcgagctgcgtactaatccggtgctgcagctgaacctggccaacgccctgctgcagggcgggcagcccggggaagcggcgaccattctgaaccggtatacctttacctataaagaggatggcaacggctgggacctgctggcccaggcggaaggcgcgctgggcaatcgcgatcaggagctggcggcgcgggctgaaagcatggcgctggtcggccagctggagcaggcgatttccctgctcagcagcgccagctcgcaggtgaaactcggtagcctgcagcaggcacgttacgatgcccgtatcgatcagctacgcgatctgcaggctcgcttccgtccctatcaaaaaatgtaa

SEQ ID NO: 1951 - DNA, 381 bp, Klebsiella pneumoniae
ttcattttttgtatgattcgcttctttttcaatcttgtctccgccctgcatggtataactaattttaagagatggatggcgaccttcatcacccttgtggcattcgtccttatccaaatccatctttttcgaacgcaggcaaccaaaagcagcagcaatagagctttttccgaaaccgttaggagctacaacgagtgtcggtttgtttggaataagctgaacatcaaaaacagagctttcgatccccttaacattcgttatggcgattttatctattctttttatcatataaaattcattccattagttaaatcatgttttaatggacgctcaccagacgtcggttcatgcagaagcacgacccggagcagtcctgattga

SEQ ID NO: 1952 - DNA, 288 bp, Klebsiella pneumoniae
attccattttgtcataggtcaataatgttagccggaaaaaccgccagcgaaatcttcgataacatccgccatctggtgcagagcggcgggttgcagcccggaaaggttctgccgccggtacgtgaactcgccagccagcttgcagtgaatcgcaacactgtcgccgccgcctataaaccgctggtgaactccgggctggccgtcagtcatgggagccacggtacagccattaaaagcgcgggacacactgcccggcgctggagggaggtgacccaacgaccccgctga

SEQ ID NO: 1953 - DNA, 624 bp, Klebsiella pneumoniae
ccgtctctttgcgctctttcggctgcggcgcggcgggctgctgcggctctaccggctgcggttccgcgatggcgggctgcgacgcggcaacaggctgtggcgcaggctgctgcggggcggctggctgcggctgagcgacggtcggcgtcaccggttgcggcgcgacaggctgctgcacaacaggctgcggctggtgttgcggttgtacgggcggctgcgcaggttgcggctgttgccagccaggctgcggagccgcatgcggcgcaggctgttgctgcggtggaaccggggcctggcgcggcggctgcggcggctggcgaaccggttcttcaggacgcgcaggctgctgcatctggcgctcgtaaggcggctggtactggtgctgcggcgcctgacgaggggcttcatgctccccatgcgcgccgtgcggggcgtgagtcaccggatgaacgcggacttctcctacgccttcaacattatcatcaaagtcgtcgttttccgactcatcgtcgcgcgacttcatacgtttcagtgggcgatcgcgaaacatcgaagaacgttctttacggctggtccagaaaccatgtaccagtaaagcgattatggcgatcgcgccaacaatga

SEQ ID NO: 1954 - DNA, 1131 bp, Klebsiella pneumoniae
tctatgtcttgcccggtcattgagctggctcagcagcttattcgccgcccttcccttagccccgatgatgcgggatgccaggcgttaatgattgaacgcctgcgtgcgatcggctttaccgttgaaccgatggatttcggcgatacgcagaatttctgggcctggcgcggccacggcgagacgctggccttcgccggccacaccgacgtagtcccggcaggcgacgccgaccgctggatcaatcccccgttcgaaccgaccatccgcgacgggatgctgtttggccgcggagcggcggatatgaaaggctcgctggcggcgatggtggttgccgcagagcgttttgtcgcgcagtacccgaaccacaggggccgactggcgtttttgatcacctctgatgaagaggccagcgccaaaaacggcaccgtcaaagtggtggagacgctgatggcgcgtaacgagcgtctggactattgtctggtcggcgaaccttccagtaccgaagtggtcggcgatgtggtgaaaaacggccgccgcggctcgctgacctgcaacctgactattcacggcgtgcaggggcatgtcgcctatccgcaccttgccgataaccctgtccaccgcgcggcgccgatgctggcggaactggtcaatatcgagtgggataaaggcaatgagttcttcccgccgaccagcatgcagatcgccaacgtgcagtccggcaccggcagcaataacgtgatccccggcgatatgttcgtccagttcaacttccgcttcagtacggagctgacagacgagatgatcaaatcccgggtgatcgccctgctggaaaaataccagctgcgttacagcgtggagtggtggctctccggccagccgttcctcaccggacggggcaagctggtggatgcggtcgtcaacgcgattgagcactataatgagatcaaaccgcagctgttaaccaacggcggcacctcagacggacggtttatcgcgcgcatgggggcgcaggtggttgagctgggccccgtaaatgcaacgattcacaaaattaatgaatgtgtgaacgccgccgacctgcagctgctggcgcggatgtatcaacgcgtcatggaacagctggtcgcctga

SEQ ID NO: 1955 - DNA, 1218 bp, Klebsiella pneumoniae
gttccctgttgcttccttaataccgacaatatttttaatttccgccagacggccaacggtttccggcagcatatcgcaaccggtacgggacggcacattatacagaatttgcggcaggtcagtatgttcggcgatagctttaaagtgctggaacaggccttcctgggtcggacggttataataaggagtgaccgtcaggcagccaacaacaccgctatcgttaaaacgtttggtcaggctaatcgcctctgcggttgcattggctcccgttccagcgataaccggaatacgcccgtcggccagctccagcgtcatcatcaccacgtcgccatgctcttcatggctcagcgttgcggattcaccggtagtccctaccgaaacgatcgccgaggttccgttggcgacatggtaatcaatcagttttttcaggcttgtccggcagacattaccgttttcatccatcggcgtgacaagcgctacaatacttcccgtgaacatgggccatcctcagagcagaagtgcgacaagattctcaatgttacgtttggagctgtaataaaagcaagagacccgacgccatcagggatgttgtatggcggttttttttatgctttcctaatgttacctcacctttttaaaggaagaacaggtttgacagcctcattacaacactatctggttattaccgccctgggggctgaccgtcccggcatcgtgaatacgatcactcgccacgtcagcagctgcggttgtaatatcgaagacagccggctggccatgctcggtgatgagtttacgtttatcatgctgctttccgggtcgtggaatgcgattaacctgatcgaatcaactctgccgctgaaaggcgcggagctggagctgttgatcgtgatgaaacgcaccactgcgcgcccgccgcaggccatgccaaacaccgtttgggtccaggttgaggtgccggactcaccgcatatcatcgagcgctttactgccctgtgcgatacatggaatatgaatattgcggagctggtgtcccgcacgcagccgggagacggcgattccgcacagctttttatccagataactgcccacagtcctgcgacgcaaaatgcagcaaatatcgaacaagcgttcaaagccctatgtacagaactgaacgcacaaggcagtattaacatcgttaattattcacagcatgatgaacaggatggagtttaa

SEQ ID NO: 1956 - DNA, 1155 bp, Klebsiella pneumoniae
agagtatgttgcaatggcgtctggccaatcagaaagaacgcgcgcaacaggagggaaatcatgagcattgagattgccaatattaagaaatcgtttggtcgcacccaggtgctgaatgatatctcgttggatatcccttccggacaaatggttgcgctgctggggccctcgggctccggaaaaaccaccctgctgcgaattatcgccggtctggagcatcagaccagcggtcatatccgcttccacggtaccgacgtcagccggatgcacgctcgcgaccgtaaagtgggcttcgttttccagcactatgcgctgttccgccatatgacggtgttcgataacatcgcctttggcctgaccgtgctgccgcgccgcgaacgccccaatgcggcggcgattaaagccaaggtgaccaaactgctggagatggtgcagctggcccatctggcggatcgctatccggcgcagctgtccgggggccagaagcagcgcgtggcgctggcgcgcgccctggcggtggagccgcaaattttgctgctggatgaacctttcggtgcgctggatgcgcaggtgcgtaaagagctgcgccgctggctgcgtcagctgcatgaagagctgaaattcaccagcgtgttcgtcacccacgaccaggaagaggcgatggaagttgccgaccgggtggtggtcatgagccagggcaacatcgaacaggccgatgccccggagcgcgtatggcgtgagccgtctacccgtttcgtgctggagtttatgggggaagtgaaccgcctgcagggggtcatccgcggtggacagttccacgtcggcgcccaccgctggccgttaggctataccccggcataccaggggccagtggacctgttcctgcgcccatgggaagtggacatcagtcggcggaccagcctggattcgccgctgccggtgcaggtcctggaggccagtccgaaagggcactacacccaattagtcgttcagcctctggggtggtatgacgaaccgctgagtgtggtgttaacgggcgatgaggcgccgtcccgcggcgaacggctgttcgtcgggctgcaaaacgcgcggttgtacaacggtaccgagcgtatcgagccgcgcggcgagcttgctctggcggagtcggcctga

SEQ ID NO: 1957 - DNA, 312 bp, Klebsiella pneumoniae
tcaaactcctgcagacgaataaagatcatcagcgacgtcacttccgtcttccacgcgatgttgccggcgataaaaatcaccgcgccgaattcgccgaggctgcgggtaaacgacagagcaatgcccgccagcagcgccggcgacagctccggcagcaccaccttgcggaaactctgccagcgcgtggcgcccagcgtttccgccgcttcctcatactcgggccccaactcttccagcaccggctgcacggtgcgtaccacaaacgggatgctggtgaaggccatcgccacggcgataccgagccaggtatag

SEQ ID NO: 1958 - DNA, 297 bp, Klebsiella pneumoniae
tgttttcactgccgcacttttacatctgcatcaattgaccccatctcgttcctgtgccttaatacccccatcgcccatcttcgggtatacttcaaggatccttttgtgagtcaggcacccagtatgcgtaaacgacatcgatttaaccgtcgcatgacccgtatcgtactgcttatcagctttctcttcttctttggacgctttgtctactcctccatcggcgcctggtaccatcatcaggataaaaaagcgtcgcaggagtcatcgctcaccgtcgagccctccccccgcgagtaa

SEQ ID NO: 1959 - DNA, 240 bp, Klebsiella pneumoniae
tgcgtctgctgggagaataacgtggataaagcgcagctggtcgagatagccaataccgaaatgccgttcggtaaatacaagggacgtcgcttaatcgatgtcccggaagagtatttattgtggttcgcgcgtaaggatcaattccctgccgggcatcttggcgagctgatggcgttgaccctactgattaaaactgaggggctgagcgatctggtccagcccctgaagaaagcgcgttag

SEQ ID NO: 1960 - DNA, 357 bp, Klebsiella pneumoniae
tgttaccgatggcgactggctttattttttggatcattatgcaagcgaaaaatacaggcggtatcgttatttttcgcaggtgacagcgtgccctgctattctcttaaaaatttcatcattgatttggtgaatgtattttcattaaaaatttataatatgaataatgcctgccatatggctataagcgcaggcataaattatcaagggcgtagtgatccacgtttactcttcagcaaggttgtttttggctatcggttggtcaacggccgctgccggatattctacattacgttcatcctgcgccttacccgcctcgcgcaccatcgccagcgccagtccggcaacgatcaacgttaa

SEQ ID NO: 1961 - DNA, 795 bp, Klebsiella pneumoniae
gccgtgcgtcgtgcgtttctgctaaccccgcaggaaggttcggttatttttgacgatcagatccgcgggcctatcgagtttcagcaacccaggaactgggacgatctgatcattcgccgtaccgatggttccccgacctataacttctgcgtggtggtagatgactgggatatggcgatcactcacgtgatccgcggcgaagatcatatcaacaacacgccgcgccagatcaacatcctcaaagcgctgaatgcgccggtgccggtttatgcgcacgtgtcgatgatcaacggcgatgacggtaaaaaactttccaagcgccacggcgcagtgagcgtgatgcagtatcgcgacgacggctacctgccggaagcgctactcaactatctggtgcgcctgggctggtctcatggcgatcaggagattttcactcgcgaagagatgattgagttcttctcgctgggcgcggtgagcaaatccgccagtgcctttaacaccgataaactgctgtggttaaaccatcactatatcaataccctgccggcggagtatgtggcaacgcatctgcagtggcatatcgagcaggaaaatatcgacactcgcaacggcccgcagctggctgagctggtgaaactgctgggcgagcgttgcaagacgctgaaagagatggcccagagctgccgctacttctatgaagagttcgctgaattcgatgccgacgccgcgaaaaaacatctgcgttcagtggcgcgtcagccgctggaagtggttcgccgattagctgccggcgattag

SEQ ID NO: 1962 - DNA, 291 bp, Klebsiella pneumoniae
ctcacgccccgcacggcgcgcatggggagcatgaagcccctcgtcaggcgccgcagcaccagtaccagccgccttacgagcgccagatgcagcagcctgcgcgtcctgaagaaccggttcgccagccgccgcagccgccgcgccaggccccggttccaccgcagcaacagcctgcgccgcatgcggctccgcagcctggctggcaacagccgcaacctgcgcagccgcccgtacaaccgcaacaccagccgcagcctgttgtgcagcagcctgtcgcgccgcaaccggtga

SEQ ID NO: 1963 - DNA, 210 bp, Klebsiella pneumoniae
ctgcgcaaccgccgttttgctagcgacacgtttcgccgtcagcaccccgttggcccctatattctcgatttcgcctgctgcgcaatacggctggcgattggactggacggcggccaacacgatgacgccgcacccgctggctacagagcgagggatggcgtgttttacgcttctggaataatgagtttgaagagcatggtgatgcggtga

SEQ ID NO: 1964 - DNA, 972 bp, Klebsiella pneumoniae
cggactcgccgccggcgctcagccaactgcagcagctgggaggtgaagatgatcattgaccagtgtcgcaaactggcgctgcgcgcccccgccagggtggtgttcccggatgcgctggacgtccgcgtgttgaaggcggcgcattatctgcagcagcagggcctggcgcatccgatcctcgtcgccagccccttcgcgctgcggcagttcgcccttggcgaacgtctgccgctgaccggggtgcaggtcatcgatccgcacagcaacctggcgatgcgcgaggcgtttgccgccgcctggcaggcgcgcgccggcgataaagcgcccgctgacgcggtcgacaagctggccgacccgctgatgttcgccgcggcgatggtcagcgccgggcaggccgaggtgtgtatcgccggaaatctctcgtcaaccgccagcgtgctgcgcgctggtctgcgccttatcggcctgcagccgggatgtaaaacgctctcttcgctgtttctgatgctgccgcagtatgccggccagccgctggggtttgccgactgcagcgtggtgccgcagccgaccgcggcgcagctggcggatatcgcgattgccagcgccgagacctggcaagcgatcgctggcgaagcgccgcgggtggcaatgctgtccttctcgacacacggcagcgcccggcatccctgtgtggctaacgtccagcaggccacggagatcgtgcgtcagcgggcgccgcagctgatggtcgatggcgagctgcagtttgacgccgcctttgtaccggacgtcgctgcgcacaaagcgcccggcagcccgctgcagggccgggccaatgtgctggtcttcccgtcgctggaggcgggcaacatcggctacaaaatcgccccagcggctgggcggatatcgcgccatcgggccgctgatccagggcctggccgccccgcttcacgacctctcgcgaggctgtag

SEQ ID NO: 1965 - DNA, 447 bp, Klebsiella pneumoniae
ggcatttcgcgacgcgccgatgggggagatagccctggaggcggtcaatcagtcctgctggcaaacgcagccagcgctaccggaggcgatgtaccagctattgtccggggcgcattaccgaacttccccgctcgatctgcggcgcatgatggatgctccgggccaggctttccgctgcgctcgcgccggcggcgcggtagcgggcgctctgtggctggtggccgaggggggactttctcgcgaactgagccgggcggtatgggcgggttttcgccggccacgcgggaatctggtcgcccagtcgctggcggcgcacggcggcagtcccctggcggcgacgctgcgcgggctgcgggtcagtcggatcgctgtccatccctcccgccagcgggaaggcctggggcggaagatgatcgccgatatcgccgccgatgccgctggctatga

SEQ ID NO: 1966 - DNA, 1242 bp, Klebsiella pneumoniae
cgtatcgcgcgccgccatcagcgcatcgtgcccctttccggcatgatcctccagctccatatcgaagcctgccgaactgccgaggccgctgatcgccggcgggctgctggcgataacccgcgcttcgttaatctgattaaacgctttggtggcgcgttcaataatggcaaaggaggtgccggtttgcgggtcgcgctggtcccagtctttgagacgaacgaacatacgggccacgttctgcccattgccgccggggccggagccaacggtagcgaacaccgactcgacgttctgcttctcgttattgaggaagtaatcttccgccttctgcaccaccttcagcgtctgctgctgggtgctgccgctcggcaactggaccgaggtggtgaacatcccgcgatcctccagcggcaggaacgaggtcggcaaatgcagaaacaggaacaccatcccgccgagcaggaggacgtagatcagcatccagcgcagcgagcggtgcaggattttgccgacgaaggtttcgtagcggctggcgctgcggttgaaggtgcggttgaaccagccgaagaagcctgttctttcatgggattcacctggcttaaccggcttaagcagcgtggcgcaaagggcaggggtgaggatcatggccaccagcaccgagaggaccatcgccgcgacgatagtgatagagaactggcgatagatggcgccggtggtgccgccgaagaaggccatcggcacaaataccgccgacagcaccatcgcgatccctaccagcgcgccctgaatttgtcccatcgatttacgggtcgcctcgcgtggcgacaggccctcctcgctcatgatgcgctcgacgttctccaccaccacgatggcgtcatccaccagcaggccgatcgccaacaccatcgcgaacatcgtcagggtgttaatgctgtagccacaggcatacagcaccgcgaaagtgcccatcagcaccaccggcacggcgatggttgggatcagggtggcgcggaagttctgcaggaacagatacatcacgaggaagaccagcaggattgcctccagcagggttttcaccacgtcggtgatggaagccttcacgaaggaggtggtctcgtaggcgaccttatattccagaccgtgggggaaaaactgcgccagctcattgaggcgattgatcacgcgctccgcggtggccatttcgttggcgccggaagccagcttgatcccgaggcctga

SEQ ID NO: 1967 - DNA, 246 bp, Klebsiella pneumoniae
acgtcggcgcgcatcatgggggcccagcttaacggtgaagtgctgatcaacagtatccagcaggccggctttaagtttggtgaaatgaatatttttcaccggcaccttaagtccggacggcagcggtccggtgttgttcagtctggccaacatggtgaaaccgggaaccttcaatccggacagcatggcggatatgatgacccctggggtgactatctttatgcaggtcccttcctacggcgatga

SEQ ID NO: 1968 - DNA, 438 bp, Klebsiella pneumoniae
tcgccgaggcggacaaatcgctcacaacaaggagcaccagagatgcatcaccctgacctggcactgaaagcagtcattgaagcctgcgatcgcgctatctcgcaggaagattacgataccctgatgagttattacgcagaagacgccgcgctggtcgtcaaaccgggcatggtggtcagagggaaagagaatatccgcaaagcctttatcgccattgccgactatttccagcaccgactggtggtgactcaggggaaaatggaggttattgaaggcggcggcaatgcgctggtgattatggagacccggctggatatcccgacggcggacgggatatcccaggtcacgcgacgcgccacctatgtctttcagaagcagggcgaacgctggctgtgcaccgtcgataactcctacggcaccgacctgcttgatgattaa

SEQ ID NO: 1969 - DNA, 1053 bp, Klebsiella pneumoniae
gatcgtaagctaactcacccgcgccgcgcttgcgcggcgcttttttttacgtgggcgattccagatctttcacgccaatatctcccgcccgccggacggtgctactgttcatccatcgctcaatccactggacggatgaacatgaaaaagccgacctccacgccccatgacgccgtgtttaagacctacctctcccatcccgataccgctcgtgatttcctgcaactgtatctgcccgagacgctgcttaaagtgtgcgatctgcgtacgctgcatctcgagtccggacattttgtcgaagacgatctgcgtcccttttacgccgacattttgtattccctcaaaaccacggcgggcgacggttatatttatgcgcttatcgaacaccagagcacgcccgaccggcatatggcctttcgtctgatgcgctacgccatcgccgccatgcagcgccatctcgatgccggccacgatcgcctgccgctggtgatccctgttctcttctaccacggtctggtgagcccctatccgttctctctgcgctggctcgatgaattcatcgctccggagctggccggccacctttatcacggggcgtttccactggcggacataaccgtcattccggatgacgagattgccacccaccagcgcatggcaacgctggagttactgcaaaaacatattcgacaacgcgatctggcgcagctcctcgacaagctgagcgaattattattgactgggctggcgacggaatcgcaggtacaagccctgatgcactatctggtacaggcaggcaacacgcgcgagccgattaaattcattcgcgagctggcgttacgtacgccgcagcataaggagacgttgatgacgattgcggaatatctggaacaacaggggctggagcggggcctggcgcaaggccgtcaggaaggacggaaagaagaggcgcagcgcatcgctgtcgctatgctgcacagcggccttccgcgcgacctggtcgcccggttgaccgggctgacggagcaggagctgactcccctggcggactaa

SEQ ID NO: 1970 - DNA, 204 bp, Klebsiella pneumoniae
tggaactggctgtgcgcgtcagcgattgatgaccctgcgtcgctgccgttcttcctcttccatctgaaggatggccattctcacacgctctaccaataccacctgattcttgctgccgaaaagtggcatgcgattaagcatacccatgccgccgtagaaatgcgcagcggcaggcagagccaatcggttcacccgatgcagtag

SEQ ID NO: 1971 - DNA, 1599 bp, Klebsiella pneumoniae
ctgatctccagcccggcggactccaggacattgatcgaaatgcgcggatcggtgccgggcggaaacgaggtcgccgcatgggtgaagcggcagcccagctgctgctcgagagtcgcaagatgtcggcgcacgagggtgacggcgccgaagaagtcccagacgatgccgtcgcgcaccacatcggcccagtcaagacataccgcaaccggctggccatcgcggtcgaccaccatcgacaccacgtcgcaggtgcccaaatcgatgcccagccacagcggcgactcgctggcggcgggcgcctggttacacagggcagcggctttttgcagtctcggcgaaagccagcgttgttcgtcgtgcgccatgttcatcccttatacgattcgaaacgcatccaccagcacgcagcggcgcagacgaacgaaggtccgcgcgctggttaccccttccccggttggggtggtgatggtcatggtggtccagccctcgccgcccagcccaagcccggcgatgcacggcccgtttttgacgaagatgctggtgtcgatggcattcgccatctggttcatgttgtcgatattgcgcgagtgcatcgccgccgtatggtggcagccgccttccagttgcaccgccagggcgatggcctcttcaacgttcgccacccgcaccaccggcagcaccggcatcatcagttcagtaacagcaaacggatggctggcgggcgtttccacaaacagcaggcgggtttgcgccggcacctgcagaccaatcgccgcggcgattttgcccgcgtcgcgaccgacccagtcgcggctgaccgtgcctttgccgcgctcgtcaatatttttcagcagcagcggctggagctgttcggcctgcgccgccgtgagtttcaccgcctgctggccttccatcaggcgcatcagttcgtcggcaacgctatcgaccacgatcagcaccttctcgtcggcgcagataatgttgttatcaaacgaggcgcctttgacgatcgcctgcgcggcgcgcggtagatcggcagtctcatccaccaccaccggcgggttgccagccccggcggcgatcaggcgtttgttggtatgtttgcgcgccgcctcgaccaccgcttcgccgccggtcaccaccagcaggccgatgccagggtacttaaacagccgctgggcggtgtcgatatccgggttcgccacggtcaccagcaggttggccgggccgccggcggccactaccgcctggttaagcagggtaattgccctttgcgagacctttttcgccgccggatggggggcgaagaccacgctgttgccggcggcaatcaggctaatggcgttgttgatcaccgtcgccgccggattggtggacggcgtcaccgaggccaccacgccccagggcgcattttcaatcagcgtcaggccattatcgccggtgagcacctgcggagtcagacactccacgcccggcgtgccgcgcgcctgcgccacgtttttggcaaacttatcttcaacgcgtcccatgccggtctccgtcaccgcaagctccgccagttcacgggcatacttttcacccgcctcacgaatggcctga

SEQ ID NO: 1972 - DNA, 1248 bp, Klebsiella pneumoniae
cagggagtaagggctatgggaattaacgaaatcatcatgtacatcatgatgttctttatgctgattgccgccgtggacaggatcctgtcgcagttcggcggctcggcgcgctttctcggcaaactggggaaaagcattgagggatccggcggtcagtttgaagaagggtttatggcgatgggcgcgctgggcctggcgatggtcgggatgaccgccctggcgccagtgctggctcatctgcttggtccggtgattattccgctgtatgagatgctcggcgccaacccgtcgatgttcgccggcacgctgctggcgtgcgacatgggcggtttcttcctcgctaaagaactcgcgggcggcgacgtggcggcctggatgtactcaggcctgatcctcggctctatgatgggtccgaccattgtgttctccattccggtggcgctcggcattatcgaaccaaccgatcgccgctggctggcgctcggcgtgctggcgggcattgtcaccattcccatcggctgtatcgccggcggtctggtggcgatgtattccggggtggagatcaacggccagccggtagagtttaccttcgcgctgatcctgatgaatatgatcccggtgatcatcgtcgccgtgctggtggcgctggggctgaagtttattccggaaaaaatgatcaacggcttccagatcttcgccaaattcctcgtggcgctgatcaccatcggcctggcggcggcggtgatcaagttcctgctcggctgggagttgatcccggggctcgatccgatctttatggcgcctggcgaccagcccggcgaggtgatgcgcgccatcgaagtcattggctctatctcctgcgtgctgctcggcgcttatccgatggtgctcctgctgacccgctggtttgaaaagccgctgatgcgcgttggtaatctgctaaaaatcaacaatatggctgccggcggcatggtcgctaccctggcgaacaatatcccgatgttcggcatgatgaagcagatggatacccgcgggaaagtgatcaactgcgccttctcggtgtcagcggcgttcgccctcggcgaccatctcggttttgcggcggccaatatgaacgccatgatctttccgatgattgtcggcaagctggtcggcggcgttaccgctattggcgtggcgatgctgctggtgccaaaagatgaaaacgtaccggcgcctgccaacaacgaagcggaggcgcactcgtga

SEQ ID NO: 1973 - DNA, 1185 bp, Klebsiella pneumoniae
caaagaatgagcgctaattttaataccgtagcaaaacccggcggcaatcgatgcaatctggcctgtcggtattgtttctatctggaaaacgaggttccgcgtccagggtatgccaccatggacgacctcacgctggaagcgtacattcacaacaccatttcatcgaccccctcgcaaaacgtcgagttttgctggcagggcggtgagcctaccttatgcgggctggatttttttgcaaaggtggtcgagctccagcagcgttaccgtggtaacaaaatcatcgccaacagcctgcaaaccaacggcatcttgctgaacgataaatgggctcgttttttgcgtcgtcatggatttctggtcggattatccattgatggccctgcgtcactccacgacacctggcgtacgacgggctgcggaaaacccacctgggaaaaagttgtgcaggccatacgctgcctgcagcagcatgacgttccggtgaatgccatggtggtggtcagccgccagtctgcaagccaggggaaaagtctctatcgctgcctgagccgcgagctaaaccttcaccatctccagtttattcctctcgttgactcccctgctccctggttagttacccctgagggctggggcaaatttttgtgcagtgttttcgacgactggctggaaaacgatgttggcagggtgtttatccagtactttgataatctgctcggcgtatgggccggccagcccgccacgctctgcaccatgcagcctgtctgtgggcagagtttactggtggagcaaaatggcgatgtctacagctgcgatcactttgtctcagcggaatataagctgggtaatctgaagcaagatgctatggcagcgatggcgagctcgccatttcagcaacagttcgggaagcaaaagggccaactctctgcccgctgtcagggctgccactggcgctttgcctgccatggaggatgccctaaacaccgttttaccatccatgacgacgaagcacagaattacctgtgcagcggctatttaacctttttcggccatatcacgccctatatgaacgtcatgagaaggcttttattaaattgccagccgcccgcgctcattatgagtcttatcccggagatacggcaaaatatattacaattaacggagtctgaagatgaaagaaccaaataa

SEQ ID NO: 1974 - DNA, 1110 bp, Klebsiella pneumoniae
ccgaggacgaggccaagagcctcagcgaccgcgcctatgaccgtcagcccatcggcaacgaccggcgcggcttctttgtccgttttggtgtcagcaaacagaattacgactctaccccgcatgaccaatggtatgaacggcgggatggcggtgtgttgctgccggtggagctgttggacgccaagcagggcagtggaaaggggcgtcaacgtgagcaagtatgacttgactcacgcccggcacgacccggtgcattgtctggcacccggtctgttccgtagcctcaaacgtggcgaacgcaagcgtagcaagctggacgttgtatatgactacggcaacggcaagcgtatcgagttcagtgggccggaaccgctgggggccgacgatctccgcattctgcaaggactggtagcaatggctggaccttctggccttgtgctttctcccgatcctcagacagaagccggtcggcagctgcggctatttctcgaacccaagtgggaagccgtccagcaggatgcgatggtggtcaagggtagctatcggtcgctggcccgtgaggttggctatgcagatatcgacaatactaggcctgtacgcgattgcattgagaggctctggaaagtctctatcattgcgcaaaatggaaggaggcggcagggcttccgtttgctgtccgagtactcaagtgatgagcaggacggcaaattgtatgtggcattgaaccctcttattgctcgcgcaatcatgggtgggcagcacatccgcatagacatggccgaagttaggaagctacagaccgaccccgcccgcctgattcatcaacgactatgcggctggattgacctcggtaagtcggggcgggtagagctggacacgctatgcggctatgtttggccggatgaacagacgaaccccaataccatcaaaaaacgccgccagaaggcacgcaaggcgctggccgagcttactgccgtgggttggaagctggacgagtatgctaagggcaaatgggaaatcgggcgacccaaggcatccgactttaacgctgctcccccctgtttaacggcaccccaccccctgtttaacagtacccaaccccctgtttaa

SEQ ID NO: 1975 - DNA, 348 bp, Klebsiella pneumoniae
ctctcaatcggaggcgtaatcatgatgaacgatgtattttttggcctgatgatgctcggcggcttttttgttctcggtattggtatgtgggcgctcggccaatggctccgacgcaaaggctttggcccgcagctcgatgcactggataagcagtacacggcactactgcatcgggtgaaccgattggctctgcctgccgctgcgcatttctacggcggcatgggtatgcttaatcgcatgccacttttcggcagcaagaatcaggtggtattggtagagcgtgtgagaatggccatccttcagatggaagaggaagaacggcagcgacgcagggtcatcaatcgctga

SEQ ID NO: 1976 - DNA, 231 bp, Klebsiella pneumoniae
gcgacggtcggcgtcaccggttgcggcgcgacaggctgctgcacaacaggctgcggctggtgttgcggttgtacgggcggctgcgcaggttgcggctgttgccagccaggctgcggagccgcatgcggcgcaggctgttgctgcggtggaaccggggcctggcgcggcggctgcggcggctggcgaaccggttcttcaggacgcgcaggctgctgcatctggcgctcgtaa

SEQ ID NO: 1977 - DNA, 1446 bp, Klebsiella pneumoniae
aaacgtaccggcgcctgccaacaacgaagcggaggcgcactcgtgaacacgcgccagctgttgagcgtcggtattgatatcggcaccaccaccacgcaggtgatcttctcgcgcctcgagctggtgaaccgcgcggcggtttcccaggtgccgcgttatgaattcatcaaacgcgacattagctggcaaagcccggtcttctttacgccggttgataaacagggagaactgaaagaggccgagcttgaggcgctgattctggctcagtaccgggccgcagggatcgctccacaagcggtggattccggggcgatcatcatcactggcgaaagcgcgaaaacccgcaatgcccgcccggcggtgatggcgctctcgcagtcgctgggcgattttgtcgtcgccagcgccgggccgcatctggagtcggtcattgccggacacggcgccggggcgcagaccctgtcccggcagcggatgtgccgggtgctcaatatcgatattggcggcggtacctcgaactatgccctgtttgacgccggaaacgtcagcgccaccgcctgcctcaacgtcggcggccgcctgctggaaaccgacgctcaggggcgcgtggtccacgcgcacccgccggggcagcggattgtcgatgcgctgtttggcgccggcactaacgtcctggcgctgaccgccgggcagctggcgcaggtggcgcgccggatggcggcgctgatcgtcgaggtgatcgagggcaccctctcaccgctggcgcaggggctgatgcaaaccgaagtactgcctgcgggtgttcagccggaggtgattaccctttccggcggagtgggggagtgctaccgccatcagcccgccgatcctttctgtttttccgatatcgggccgctgctggccacggccctgcacgagcatccgcgcctgcgtgagatgaacgtgcagttcccggcgcaaaccgtgcgcgccacggtgattggcgccggggcgcatacgctgtccctgtccgggagcaccatctggctggagggggttccattgccgctgcgcaatctgccggtggctatcccgcaggatgccgccgatctgccgaacgcctggctccaggcgctgacgcagctcgatctggcccccgaggcggacgcttacgtgctggcgcttcccgcttcacttccggtgcgctacgccaccttactgaccgtaattgacgccctgctggcgtttgtcgcccgctttcccaatccccgtccgctgctgctggtggccgagcaggattttggcaaagcgctgggcatgctgctgcggccacagcttccacaccttccgctggcggtcatcgatgaggtgagcatccgggcgggagactatatcgacattggtacgcctctttttggcggatcggttgtgccggtgacggtgaaatcactcgcatttccttcctga

SEQ ID NO: 1978 - DNA, 987 bp, Klebsiella pneumoniae
ctatccggcggcgagcgccatcgcctcggtgatcctggccgcctcactggtgctgctgttttccatcaataccctgcagagtcgctttggtcgacgcgtggtaggtcactaatggcggaagttactcaattgaaaagctacgacgcgccccgtatcaactggggaaaatggtttctgattggcgtcgggatgctggtctccgccttcatccttgtggtgccgatgctctacatctttatccaggccttcagcaaaggactgatgccggtgctggaaaacctggcgaacccggacatgctgcatgccatctggctgacggtgatgattgcgttgattaccgtaccggtgaacctggtgttcggtaccttgctggcctggctggtgacacgttttacctttccggggcgccagctgctgctgacgttgctggatatcccgttcgccgtctcgccggtggtggccggtctggtgtatctgctgttttacggctctaacggtccgctgggcggctggcttgacgcgcataatctgcaaatcatgttcgcctggccgggcatggtgctggcgaccatctttgttacctgtccgtttgtggtgcgtgagctggtgccggtgatgatgagtcagggcagtcatgaagatgaggccgcggtgctgctgggcgcgtccggctggcagatgttccgccgggtgacgttgcccaatattcgctgggcgctgctgtacggcgtggtgctgaccaacgcccgcgccatcggcgaatttggcgcggtgtcggtggtttccggctcgatccgcggcgaaacgctgtcgctgccgctgcaaattgaactactagagcaggattacaacaccgtcggctcgtttaccgccgccgccctgctgacgttaatggctattctgaccctgtttttaaagagtatgttgcaatggcgtctggccaatcagaaagaacgcgcgcaacaggagggaaatcatgagcattga

SEQ ID NO: 1979 - DNA, 3168 bp, Klebsiella pneumoniae
agtggcacaggctgtgcaataacaagaaaatgtgcatatgaggtttttattctgatggcgaatttctttatcgatcgccccatttttgcatgggtgctggcaatcctgttatgcctgacgggcgcccttgccattttgtcgctgccggttgaacagtatcccgacctcgccccgccgaatgtgcggatcaccgccaactatcccggcgcttccgcgcaaaccctggagaataccgtcactcaggttatcgaacagaatatgaccggcctcgataacctgatgtatatgtcctcccagagcagcgccaccggccaggcgacgatcaccctcagctttaccgccggtaccgacccggatgaagccgtgcagcaagttcagaaccagctacagtcggcgatgcgtaagctgccgcaggcggtgcaaaaccagggggtgacggtgcgcaagaccggtgataccaatatcctgacgctcgccttcgtctccactgacggcagtatggataaacaagatatcgccgactacgtcgccagtaacatccaggacccgctcagccgcgtcaacggcgtaggggatatcgacgcctacggttcgcaatactcaatgcgcatctggctcgacccggcgaagctcaacagctaccagatgaccaccaaggatgttaccgacgccatcagttcgcagaacgcccagattgccgtcggccagcttggcgggacgccttcggtcgataagcaagcgctgaacgccaccatcaactcgcaatctctgctgcaaaccccggagcagttccgcaatatcactctgcgcgtcaatcaggatggttcagaggtgacgctgggcgatgtcgccaccgtcgagatgggggcggagaagtacgactatcttagccgctacaaccgccagccggcctcaggcctcgggatcaagctggcttccggcgccaacgaaatggccaccgcggagcgcgtgatcaatcgcctcaatgagctggcgcagtttttcccccacggtctggaatataaggtcgcctacgagaccacctccttcgtgaaggcttccatcaccgacgtggtgaaaaccctgctggaggcaatcctgctggtcttcctcgtgatgtatctgttcctgcagaacttccgcgccaccctgatcccaaccatcgccgtgccggtggtgctgatgggcactttcgcggtgctgtatgcctgtggctacagcattaacaccctgacgatgttcgcgatggtgttggcgatcggcctgctggtggatgacgccatcgtggtggtggagaacgtcgagcgcatcatgagcgaggagggcctgtcgccacgcgaggcgacccgtaaatcgatgggacaaattcagggcgcgctggtagggatcgcgatggtgctgtcggcggtatttgtgccgatggccttcttcggcggcaccaccggcgccatctatcgccagttctctatcactatcgtcgcggcgatggtcctctcggtgctggtggccatgatcctcacccctgccctttgcgccacgctgcttaagccggttaagccaggtgaatcccatgaaagaacaggcttcttcggctggttcaaccgcaccttcaaccgcagcgccagccgctacgaaaccttcgtcggcaaaatcctgcaccgctcgctgcgctggatgctgatctacgtcctcctgctcggcgggatggtgttcctgtttctgcatttgccgacctcgttcctgccgctggaggatcgcgggatgttcaccacctcggtccagttgccgagcggcagcacccagcagcagacgctgaaggtggtgcagaaggcggaagattacttcctcaataacgagaagcagaacgtcgagtcggtgttcgctaccgttggctccggccccggcggcaatgggcagaacgtggcccgtatgttcgttcgtctcaaagactgggaccagcgcgacccgcaaaccggcacctcctttgccattattgaacgcgccaccaaagcgtttaatcagattaacgaagcgcgggttatcgccagcagcccgccggcgatcagcggcctcggcagttcggcaggcttcgatatggagctggaggatcatgccggaaaggggcacgatgcgctgatggcggcgcgcgatacgctacttgagctggccgggaaaaatccgctgttgacccgcgtccggcataacgggctcgatgacagtccgcagctgcaggtcgatatcgatcagcgtaaagcgcaggcgctgggcgtctccattgacgacatcaacgatacgctgcaaaccgcgtgggggtcgagctacgtcaacgactttatggatcgcggccgggtaaagaaagtctacgtccaggcggcggcgaaataccggatgctgcctgacgatatcaatctttggtacgtgcgcaacagcagcggcacgatggtgccattctcggccttcgccacctcgcgctgggagaccggctcgccgcggctggagcgctacaatggctactcagcggtggagatcgtcggtgaggcggcgccgggtatcagtaccggtaccgcgatggacatgatggagaagctggccgcgcagttacccacaggctttggcctcgaatggaccgccatgtcctaccaggaacgcctctctggcgctcaggcgccggccctgtacgcgatttctctgctggtggtgttcctgtgcctcgcggcgctgtacgagagctggtcggtgccgttctcggtgatgctggtggtgccgctgggggtgattggcgccctgctggcgacctggatgcgcgggctggagaatgacgtgtacttccaggtgggtctgttgacagtgatcggcctgtcggcgaaaaacgccattctgatcgtcgagttcgccaatgagctcaacgagaagggccaggatctgctcagcgccacgctgtcggcttgccgtcagcgcctgcgccccatcctgatgacctcgctggcgttcatcttcggcgtgctgccgatggcgaccagcaccggcgccggttccggcagccagcatgcggtcggcaccggagtgatgggcgggatgatctccgccaccgtgctggcgatctttttcgtgccgctgttctttgtgctggtgcgtcgccgttttccgctaaaggagcgtccgcaataa

SEQ ID NO: 1980 - DNA, 900 bp, Klebsiella pneumoniae
tacataacagggaatgaggtgcttatgcgctggcaagggcgtcgcgaaagcgacaatgttgaagatcgacgtggacaatcaggctcgccgtttggcggcggcgggggcggcggcttccgtctgccgagcgggaagggcggcattgtactgctgattattgtgctggtggcgggctactacggcgtggatttgaccggcatgttgaccggcgaaccgatgccgcagcagcagacctccacgcagcgctccatcagtccgaaagacgatgaagcggcgaagtttacttccgtcattctggctaccaccgaagatacctgggggccgatctttgaaaagataggccgccagtacccgcagccaaagctggtgctctaccgcggcgcgacccgtaccggctgcggcaccggtcagtcggtgatgggccccttctattgtcctgccgacagtacggtctatatcgacctgtcattctacgatgagatgaaaaataaactgggcgccgacggcgactttgcccaggggtacgtcattgctcatgaagtgggtcatcacgtacaaaaactgctgggcattgagccgaaggtccgccagcaacagcagcatgccacgcaggccgaagccaaccgcctgtcggttaagatggagctgcaggcagactgcttcgccggcgtctggggtcataatatgcagcagcaggatattctggaaactggcgatctgcaggaggcgctgaacgccgccgaggccatcggcgacgatcgtctacagcagcagagccagggacgcgtggtgccggacagttttacccacggcacctcgaaacagcgctacacctggttcaaacgcggtttcgatagcggcgatccggcgcagtgcaataccttcggcagcgcgctgtaa

SEQ ID NO: 1981 - DNA, 1098 bp, Klebsiella pneumoniae
cctgtcggaggtgccgggagcggcttgcccccggctttaacgattatgaaaaagcgtcgttctgcaaatttgcaccatctctgttgcgaggcgttgccggaaaacaccaggctgacgcctcaggttgaaattgacaatattcatcaacgacacacaaccgatgtgtatgagcacgccctgaccattaccgcctggcaacagatctacgatcagctgcatccggggcagtttcgcggcgagtttaccgaaatcctgctcgatgagatccaggtcttccgcgaatataccgggctggcgctgcgccagtcctgcctggtctggccgaactccttctggtttggcattccggcgacccggggagaacaaggttttatcggctcgcagtgtctgggccgggcagaaatcgccacccgtcccggcggtacggagttcgagctcagcacgccggatgattacaccattctcggggtagtgatttcgcaggaggtgattgcgcgtcacgccagtttcctgcaccacccggaacgggtgctacatatgctacgcaaccagtcagcgctggcggtccgcgagccgcataaggccgcgctgtgggggtttgtccagcaggcgctggccacctttagcgagcatccggatacccttcatcagccggccgtgcgtaaagtcctgcgggataatctgttgctggcgatgggcacgatgctggaagaagcgcagccgatggtaagtgcagagagcgtcagccaccagagctaccgccgcctgctggcgcaggcgcgcgaatatgtgctggaaaacagcgcggagccgttaaccgttctcgatctgtgccagcagctgtacgtcagccgtcgcaccttgcaaaacgccttccatgcgatactggggattggtcctaacgcctggctcaaacggatccgcctgaacgccgtgcgtcgggagctgataagcccctggtcagagcgcgagacggtcaaggaggcggccatgcagtggggattctggcatttggggcagttcgccaccgactatcagcagctgtttgctgagaaaccgtcgatgacgctgcaccatcgtctgcgccagtgggtgtga

SEQ ID NO: 1982 - DNA, 2067 bp, Klebsiella pneumoniae
gcggtaatgggccaggaaaagctatacatcgaaaaagaactcagctggttgtcttttaacgaacgcgtgctgcaggaagcggcggacaagagtaacccgctgattgagcgcatgcgcttcttaggtatttactccaacaacctggatgagttttacaaagtgcgcttcgctgagctgaagcgccggattattatcagtgaagaacaaggcagtaccgcccattctcgccacctgttaggcaaaattcaggcccgcgttctgaaggccgatcaggaattcgatagtctgtataatgaactgttgctggagatggcgcgtaaccagatcttcctgatcaacgagcgccagctgtccgtcaatcagcaggcctggctgcgcaactacttcaagcagtatttacgccagcatatctcgccgatcctgatcaaccgcgaaacggacctcgtgcagttcctgaaagatgattacacctatctggcggtggagattatccgcggggaaaacatcaactatgctctgctggaaataccgtcggataaagtgccgcgcttcgtgaacctgccgccggaagcgccgcgtcgccgcaagccaatgatcctcctggataacatcctgcgctattgcctggacgatatttttaaaggcttctttgattacgatgcgctgaacgcctactcgatgaagatgacccgtgacgccgagtacgatctggtgcatgagatggagtcgagcctgatggagctgatgtcctccagcctcaagcagcgcctgaccgccgagccggttcgcttcgtctaccagcgcgatatgccggatgcgatggtcgaaatgctgcgcgataagctctccatttccaactacgactcaatgctgccgggcggccgctatcacaactttaaagactttatcggcttcccgaacgtcggtaaggccaatctggtcaataagcccatgccgcgcctgcgtcatctgtggtttgataaattccgcaacggcttcgacgccattcgcgaacgcgacgtgctgctctactatccctatcacacctttgagcacgtgctggagctgctgcgtcaggcctccttcgaccccagcgtattggcgatcaaaatcaacatttaccgcgtggccaaggattcgcgcattattgacgcgatgatccacgccgcccacaacggtaagaaagtcaccgtagtggtggagctgcaggcgcgcttcgatgaagaggctaacattcactgggcgaaacgcctgacggaagcgggagtccacgttatcttctctgcgccaggtctgaagattcacgccaagctgttccttatctcgcgtaaagaaggcgatgaggtggtgcgctacgcccacatcggcaccggtaactttaacgagaagacggcgcggatctacaccgactattcgctgttaaccgccgatgcgcgcattaccaatgaagtccgccgggtgtttaactttatcgagaacccctatcgtccggttagcttcgactacctgttggtgtcgccgcagaactcgcgtcgtctgctgtatgagatgatcgatcgcgagatcgccaatgcgcaaaacgggcaaccgtccgggattacgctgaagctgaacaacctggtggataaaggtctggtggaccgactgtatgccgcctccagttccggcgtgccggttaatctgctgatccgcggcatgtgctcgctgatcccgggtctggaaggtatcagcgaaaatatccgcgtcatcagtattgtggaccgtttcctcgagcacgaccgggtctactgttttgaaaacggtggcgataaacaggtctggctctcctctgccgactggatgacgcgtaacatcgattatcgcatcgaagttgccgctccgctgctcgatccgcgtctgaagcagcgggtgctggatatttttgatatcctgttcaacgatacggtaaaagcgcgctatcttgataaagaactgagtaaccgctatgtgccgcgcggcaatcgccgtaaagtgcgcgcgcaaatggcgatttacgattatctcaaatcactcgaacaacccgactaa

SEQ ID NO: 1983 - DNA, 1263 bp, Klebsiella pneumoniae
ggatttgtggggctttttgagcatggtatttttgagaggaaacccaacccgaccatgctgactgataccaagctgcgcaacctcaagccaaaggacaagctctacaaagtgaatgaccgtgacggcctctacgtggccatcacccctgcgggttcgatttcgttccgctacaactactcgatccacggcaggcaagagaccatcaccttcggccgctatggtgtcggagggatcacgctagcggaagctcgcgaacggctgggcgaagccaagaagatgatcgccgcagggaaatctccagccaaggagaaagcgcgggacaaagcccgcgtcaaggatgctgagacattcggcgcgtgggccgagaagtggttgcgcggctatcaaatggcagattccacccgcgacatgcgccgtggaacatacgagcgagagctaaagccgaaattcagcaacaggaaactgatagaaattacccacgaggacttgcgggcgctgactgatgccatcgtggaacaaggcaggccatcaacggccgtgctttgccgcgaaattatgatgcaggtcttccgctgggctatcgaacgcggacagaaggttgagaacccggccgatttggtgcgcccgtcaactatcgccaagtttgagccgcgagatcgagcactgacgcccgaggaaattggcttgatgtaccagtacatggagcgtatcggcaccacaccttcaattcgagcggctgccaagctgctgttgctaacgatggttcgcaaaagcgaactgaccaacgcaacgtggaacgaaatcaatttcaccgacgcgctctggacaatccccaaggagcggatgaagcgccgcaatccccatctggtgttcctgtcgaggcaggcgctggatattttcatcgcgctgaagaccttcgccggcggttcggagtacattctgccatcacgttatgactcagacttgccgatgagcagcgcaacgctcaatcaggtgcttacccttacctatcggctggcccagaaggaagggcagtcacttggcaagtttggaccgcacgacttgcggcgcacagccagcacgctgttgcatgaggcgggctataacaccgactggatcgagaagtgccttgcgcacgaacagaagggcgttcgtgccatctacaacaaggccgagtaccgcgatcagcgccgggcgatgctccaagattgggccgacatgatcgacgagtggacaatcaggaagacccgcctcaaggactga

SEQ ID NO: 1984 - DNA, 1059 bp, Klebsiella pneumoniae
atcaattttatttctcaaatgaaaaaaagcacaatagcgcatctcttttcaggagcgtttatgaaacttttccgtattctcgatccgtttacggcaacgctaatcaccgttgtcctgctggcctcattcttcccggcccgtggcgctttcgtccccttctttgaacatctgaccaccgccgccatcgcgctgctgttctttatgcatggcgctaaactctcccgggaggcgattatcgccggcggcagccactggcgtttgcatctctgggtgatgtgcagcacctttattctcttcccgctactcggggttctgtttgcctggtgggcgccggtgaatgtcgatccgatgctctacagcggctttatctatctgtgcattctgccggccaccgtgcaatccgctatcgcctttacttcgctggccgggggcaacgtcgcggctgcggtttgctcagcctcggcctccagcctgctggggatctttgtttccccgctactggtgggggtcttgatgaaccttcacggcgcaggcggcagtctggagcaggtcggtaaaattatgctgcagctgctgctgcctttcgtgctcggtcacttatcgcggccgtggattggcgactgggtggcgaagcataagaagtggattggtaagaccgaccagacctcgattctgctggtggtttactccgcctttagcgaggcggtggtgaatggcatctggcataaagtcggtctgggatcgctgctgtttatcgtggtggtcagcctggtgctgctggccatcgtcatcgcggtcaacgtctttgtcgcccgccgctgcggctttaacaaagccgatgagattaccatcgtcttctgcggttcgaaaaagagcctggccaacggcattccgatggccaatattctcttcccgacctccatcctcggcatcatggtgctgccgttgatgatcttccaccaaatccagctgatggtctgcgcggtgctggcgcggcgctacaagcagcaaaccgatgcgcgtctcgctgaggaaaaggccaacgcggccaaagcctaa

SEQ ID NO: 1985 - DNA, 1737 bp, Klebsiella pneumoniae
ggtagggttatgatttcaggcattttagcatccccgggtatcgccttcggcaaagcattgctgctgaaggaagatgaaattgtcatcgaccggaagaaaatttctgccgataaggttgatcaggaagtcgaacgtttcctgagcggccgcgccaaggcctccgcccagctggaggtcatcaaaaccaaagctggtgaaactttcggtgaagaaaaagaagccatcttcgaagggcatattatgctgctggaagatgaggagcttgagcaggaaatcatagccctgattaaagataagcacatgactgccgacgcggcagccaatgaagttatcgacggtcaggccactgccctggaagagctggatgatgaatacctgaaagaacgtgcggctgacgtacgtgatatcggtaagcgcctgctgcgcaacatccttggtctggcaatcatcgatctgagtgcgattcaggatgaagtcatcctcgtcgccgccgatctgaccccgtctgaaaccgcacagctgaacctgaaaaaagtgctgggtttcatcaccgatgcgggcggtcgtacctcccacacctctatcatggcgcgttccctggaattgccggccatcgtgggcaccggcagcatcacggcacaggtgaaaaacggcgactatctgattctcgacgcggtgaacaaccaggttctgatcaacccgtctaacgagcaaattgaagcgctgcgtagtctgcaggctcaggttgcggaagaaaaagccgaactggcgaaactgaaagatctgccggcgattaccctcgacggccatcaggttgaagtctgcgccaacattggtaccgttcgcgatgtcgaaggtgctgagcgcaacggcgccgaaggcgtaggtctgtatcgtaccgaattcctgttcatggaccgtgacgcgctgccaactgaagaagaacagtttgcggcttataaagcggtggctgaggcctgtggctctcaggccgttatcgtccgtaccatggatatcggcggcgacaaagagctgccgtacatgaacttcccgaaagaagagaacccgttcctcggctggcgtgccgtgcgtattgcgatggatcgtaaagagatcctgcgcgaccaggttcgcgccatcctgcgtgcctccgctttcggtaagctgcgcattatgttcccgatgatcatctctgttgaagaagtgcgtgcgctgaagaaagagatcgaaatctacaaacaggaactgcgtgacgaaggtaaagcatttgacgaatccattgagatcggcgtaatggtggaaacaccggctgcggcgaccattgctcgtcatctggccaaagaagttgatttctttagtatcggcaccaatgatttaacgcaatatactctggcagttgaccgtggtaatgatatgatttcacatctttaccagccgatgtcaccgtctgtactgaatctgattaagcaagttattgatgcttctcacgctgaaggtaaatggactggcatgtgcggtgagcttgcgggcgatgaacgtgctacacttctgttgctgggtatggggctggacgaattctctatgagcgccatttccatcccgcgcatcaagaagattattcgtaatacgaacttcgaagatgcgaaagtattagcagagcaggctcttgctcaaccgacaacggacgagttaatgacgctggttaacaagttcattgaagaaaaaacaatctgctaa

SEQ ID NO: 1986 - DNA, 1443 bp, Klebsiella pneumoniae
ggagagactatgtccggatttaaagcaggttttctgtggggcggcgcggtcgcagcgcatcagttagagggcggctggcaggagggcggcaaggggatcagcgtggcggatgtgatgaccgccggcgcccacggcgtgccgcgggaaattaccgacggcgtggtggccgggaaaaactacccgaaccatgaggcgatcgatttttatcatcgttatccacaggacctggcgctgtttgccgagatgggcttcaaatgttttcgcacctcgattgcctggacgcgtattttcccgcagggcgatgagctggagcccaacgaggctggcctgcagttttatgatgatctgttcgacgaatgcctgaaacacggcattgagccagtcattacgctgtcgcattttgaaatgccttatcacctggtcaccgagtacggcggctggcgcaaccgcaagctaatcgactttttcgtgcgctttgccagggtcgtcttcacccgctatcaacataaagtgaagtactggatgacctttaacgagatcaacaaccaggccaacttccatgaggactttgcccccttcaccaactccggtttgaaatatttgccggatgaagaccgggaaccggtgatgtaccaggccgcgcactatgagctggtggccagcgccctggcggtgaaagcggcgcgcgagatcaacccggcgctgcagattggctgcatgatcgctatgtgccccatctatccgctgacctgcgccccggacgatatgatgatggcgatgaacgccatgcaccgccgttactggtttaccgacgtccacgtgcgcggtcgctatccgcagcatctgctcaactattttgcccgccgcggctttactctggatatcaccgaagccgatcgtcaggcgttaaccgagggctgtgtcgactacattggctttagctactatatgtcgttcgctaccaaagccaccgaagacaaccccttgcttgattatgatgaaaccaccagcctggtctccaacccgtacgtcaaaaagtcggactggggctggcagattgacccggtcggcctgcgctattcgctgaactggttctgggatcactaccagctgccgctgtttattgtcgaaaacggctttggcgcgattgatgtccgcgaagcggacggcagcgtcaatgaccagtatcgtatcgattatctctccgcccatatcgcggagatgaaaaaggcggtggtcgaggatggcgtcgatctgatgggctacaccccctggggctgtatcgatctggtttccgccggcacgggggaaatgaaaaaacgctacggctttatttatgttgataaagataatgaaggcaatggcacgttggcacgcagccggaaaaagtcctttgcctggtatcagcaggtaattgccagcaacggggagaacctgtcgtag

SEQ ID NO: 1987 - DNA, 2025 bp, Klebsiella pneumoniae
tggtgtgatatggaaccaatcgaacaacaactgactgaactgcgaaccacgcttcgccatcatgaatatctgtaccacgttatggacgcgccggaagtgccggatgcggaatatgaccgcctgatgcgcaagctgcgcgagctggagagccagcacccggagctgattaccccggattcgccaacacagagggtgggggcggcgccactcaccgcctttagccagatccgccatgaagtgccgatgctgtcgctggataacgtgtttgacgaagagagctttctcgccttcaacaagcgggtacaggatcgcctgaaaagcacagatcatcttacctactgctgcgagcttaagctcgacggcctcgcggtgagcattctctacgaaaacggcgtgttggtgcaggcggcaacccgcggcgacggcaccaccggcgaagatattacctctaacgtgcgaactattcgcgccatccccctcaagctgcatggcgagaatattcctgcacgccttgaggtacgtggggaagtgttcctcccgcaggccgggtttgaaaaaatcaatgaggaagctcgccgcaccggcgggaaagtgtttgctaacccgcgtaatgcggcagcgggttcgctgcgccagctcgatccgcgcatcactgcgaagcgaccgcttactttcttctgctacggcgtgggcgtgctggagggcggcgagctgccggccagccactcggctcggttgctgcagttcaaagcatgggggctgccggtgagcgatcgcgtcaccctgtgccatacccccgaggaagtgcttacttactatcgtaaagtcgaggaagagcgtccccacctgggctttgacattgatggcgtggtgatcaaagtcgattcgctggcgctgcaggaacagctgggtttcgtcgcccgcgcgccgcgctgggccgtggcctttaagttcccggcacaggagcagatgaccttcgtccgggacgtggagttccaggtgggccgcaccggggcgattacgccggtggcgcgtctggagccggtccatgttgccggcgtgttggtgagcaatgccaccctgcataatgccgatgaaattgaacgcttaggcttgaaaatcggcgacaaggtggtgattcgccgggcaggcgatgtgatcccgcaggtggttaacgtggtgctttccgagcgtccggcggatgcccgggatgtcgtcttcccgacccactgtcctgtatgtcagtcagacgttgaacgggtggaaggcgaggcggtagcccgctgtacgggcggcctgatctgcggcgcgcagcgcaaagagtcgctcaagcacttcgtctcccgtcgcgcgctcgacgttgacggcatgggcgacaagatcatcgaccagctggtggagaaagagtacgtccataccccggcggatctgttccggctgacggcggggaaactgaccgggctggatcggatggggccgaagtccgcgcaaaacgtagtcaacgccctcgagaaagccaaagagacgaccttcgcacgcttcctctacgccttaggtattcgcgaggtaggagaagcgacggcggcgggcctggcggcgcatttcggcactctcgaagccctggagcaggcttccattgaggagctacagaaagtccctgatgtcggcatcgtagtcgctacccataccttcaacttctttgccgaagagagcaaccgcgatgtcattgcgcaactgctggcggagggggttcgctggcctgcgccggtggtggtgaaggcggaagagattgatagcccgtttgcaggcaaaaccgtggtccttaccggcagcctcagccagctgtcgcgcgatgacgccaaagcgcgtctggtggcgctgggggcgaaggtggcaggcagcgtgtcgaaaaaaaccgacctggtgattgccggcgaagcggcggggtctaagctggcgaaagcgcaggagctgggcatcgaggtgattgacgaagccgaaatgatgcgtctgctgggagaataa

SEQ ID NO: 1988 - DNA, 441 bp, Klebsiella pneumoniae
ggccaattcatgaaaatcaaaactcgcttcgcgccaagcccaaccggctatctgcacgttggcggtgcgcgtactgctctctattcctggctttttgcccgtaaccacggcggtgagtttgtgctgcgtattgaagacaccgatctcgaacgctccaccccggaagcaattgaagccatcatggatggcatgaactggctgaatctgcaatgggacgaaggcccctatttccagaccaaacgtttcgatcgttataacaacgtaatcgatgagatgttggaagccggtaccgcttacaaatgctattgctcgaaagaacgtctggaagcgctgcgcgaagagcagatggcgaagggtgagaagccgcgttacgatggccgctgccgccatagccacgagcaccatgctgacgatgagccgtgcgtcgtgcgtttctgctaa

SEQ ID NO: 1989 - DNA, 669 bp, Klebsiella pneumoniae
ggaggcatcatgccagcattagatttgattcgaccctcggttaccgcgatgcgcgtgattgcctcggtgaatgacggtttcgcgcgcgagcttaaattaccgtcgcatatacgtagcctcggactcatcacggcagattctgacgatgtgacgtatattgccgccgacgaagcgacaaagcaggcgatggtggaggtggtctatggccgctccctctacgccggcgcggcccatggtccgtcgcctaccgccggcgaagtactgatcatgcttggcggcccgaacccggcggaagttcgcgccgggctggatgccatgatggcgcatattgaaggtggggcggcattccagtgggctaacgacgcgcaagataccgcctttctggcgcacgtggtgtcgcgtaccggctcttatctttcatcggccgctggcatcgcgttgggcgatccgatcgcttatctggtggcgccgccgctggaggcgacgtttggtatcgatgcggcgatgaagtcggccgacgttcagctggtgacctacgtcccgccgccatcggaaaccaactattcggccgcctttttgacgggaagccaggccgcctgtaaagccgcctgcaatgcctttaccgatgccgttctcgatattgcccgtcatcctgtacagcgtgcgtaa

SEQ ID NO: 1990 - DNA, 387 bp, Klebsiella pneumoniae
gagttgatcatcatgagtggcgtggttgcaccaaaaaatacgacggcgcggcggcgcggtaagcccatagaggtttgggtaacggacgaggaaaaaactgcgattacggagcttgctgaccaaactggtttgtctcgttccgcttatttgcgcgccgttggtctgaatagaccggtcggagcacgtgccgatcttgaagcagtgcgtgaactggtgaagctgaatggagacctgggccgggtggctggcctgttgaaactctggcttgcggaaaagcgaggccaaggtgcaaggcccatcgacatcgaaagcgtaatgatcgaattctgggaattgcaggcgcagattcgagagaagatgagcgccatagtctttgcccggaaatga

SEQ ID NO: 1991 - DNA, 519 bp, Klebsiella pneumoniae
gagaagatcatgggtttgtttgataaattgaaatctctggtttctgatgacaagaaagacaccggaactattgagattgttgctcccctctccggtgagatcgtcaacattgaagacgtgccggatgtggtttttgcggaaaaaattgtgggcgatgggattgccatcaaaccgactggcaacaaaatggtcgcgccggtagacggtaccattggtaaaattttcgaaaccaaccacgcgttctctattgaatctgatagcggcatcgagctgttcgttcacttcggtattgataccgttgaactgaaaggcgaaggcttcaagcgtatcgctgaagaaggtcagcgcgtgaaagtcggcgatccggttatcgaatttgatctgccgctgctggaagagaaagccaagtcgactctgacgccggtggttatctccaacatggacgagatcaaagagctgatcaaactgtccggtagcgtgaccgtgggtgaaaccccggtaatccgcatcaagaagtaa

SEQ ID NO: 1992 - DNA, 2013 bp, Klebsiella pneumoniae
tcgtcccccatgatggacgcgctgcttaacctcaccgcgcaaatggcgcgggaggggatccgtcgcctgctggtgctcagcggcgatgagagctggacgctgcagcaggcgcaggcgctacgggagaggctcggcggcgatggcctgtgggttggccccgagccggtttctgcgccctgcgtggcgcccggcgcgctgaaaacgctgctggggcgggaagtgatgcacgcctttttcgatgcccggcgcgggtttgatgtggccgccatggcggccctgagcggcacgctgcgggcgggaagctggctggtgctgctgacgccccccttcgccgactggccgacccgggcggatgaggactctctgcgctggagcgatacgcctgaccctatcgttacccctaactttgttcaccgctgctgtcggcagtttatcgccgatccggaggtgttgctctggcggcagtcggaccggccacgtttcccgctggccgccccgcgtccagactggcatcccgccgatggccgcccgcaggccgagcaggcggcaatccttgagcaactgatacgcctgccgcccggtatcgcggcggtgacggcggagcgtggacgggggaagtccgcgctggcgggtatgctcctgcgccagcttgggggcgaggccatcgtcaccgccccaacgcgtagcgctgtcgaggtgctggccagctttgccggggagacgttgcgctttatggcgcccgatgcgctgctggcgtcgaaagaaaaggcggcgtggctgatagtcgatgaggccgcggctatcccggctccgcttctccggcaactggtgagccgttttccccgcacgctactcaccacgacggtgcaagggtacgagggcaccggtcgcgggttcctgctgaaattttgcgccagtctgccccatctgcaatcgttcaccctgagcgccccgatccgctgggcggcgggctgtccgctggagtcagccatcagtcagttgcttatctttaacgatgaggcatttcgcgacgcgccgatgggggagatagccctggaggcggtcaatcagtcctgctggcaaacgcagccagcgctaccggaggcgatgtaccagctattgtccggggcgcattaccgaacttccccgctcgatctgcggcgcatgatggatgctccgggccaggctttccgctgcgctcgcgccggcggcgcggtagcgggcgctctgtggctggtggccgaggggggactttctcgcgaactgagccgggcggtatgggcgggttttcgccggccacgcgggaatctggtcgcccagtcgctggcggcgcacggcggcagtcccctggcggcgacgctgcgcgggctgcgggtcagtcggatcgctgtccatccctcccgccagcgggaaggcctggggcggaagatgatcgccgatatcgccgccgatgccgctggctatgactatctctccgtcagcttcggctataccgctgagctgtggcgcttctggcaacgctgcgggtttaccctcgtacgactgggtacccatcgcgaggccagcagcggctgctatacggcgatggccctctatccgttgaccgcggcagggcgccagctggcgcagcgggaggcgcagcggctgcagcgcgatgaatactggcttcgcccgtggcgagaggaatccgcgccgctgccggccgtcgcagacgctatgcttagtgatgaggactggctggaagcggcgagctttgccttcgcccaccgcccgctggcagcggcgctgggctgcctcaaccgcctactgatgcaggccgacatgccgttgccggccctgcggggacgactgcagggcaaagaggaggccgcactctgcgccgtgctgcagctgacggggcgaaaagccttgcaggcgagatggcgtcgggaggccgctgacgccttgcgctcccttgatgcagcgcgcgctgaggcgctgcgtcagcaggtggcgcatctgcaatttttttaa

SEQ ID NO: 1993 - DNA, 369 bp, Klebsiella pneumoniae
ggagaccccatgaccgacgcggtaaaaatttaccataacccacgctgctccaagagccgcgaaacgctgagcctgctgcagagtcgcggcatcgatcctgaggtggtgctttatcttgagacgccaccggatgccgggacactgcgccagctgctgcagctgctgggtatggagagcccccgcgagctcatgcgccagaaagaggagctgtataaatcgctcaatctggccgacccggctctcagcaacgcggcgctgatacaggcgatggtcgacaatccgaaactcatcgagcgccctatcgtcgtcagccgcggccaggcgcgtattggccgcccgccggaacaggttcttgagatcgtaagctaa

SEQ ID NO: 1994 - DNA, 888 bp, Klebsiella pneumoniae
ggatggcccatgttcacgggaagtattgtagcgcttgtcacgccgatggatgaaaacggtaatgtctgccggacaagcctgaaaaaactgattgattaccatgtcgccaacggaacctcggcgatcgtttcggtagggactaccggtgaatccgcaacgctgagccatgaagagcatggcgacgtggtgatgatgacgctggagctggccgacgggcgtattccggttatcgctggaacgggagccaatgcaaccgcagaggcgattagcctgaccaaacgttttaacgatagcggtgttgttggctgcctgacggtcactccttattataaccgtccgacccaggaaggcctgttccagcactttaaagctatcgccgaacatactgacctgccgcaaattctgtataatgtgccgtcccgtaccggttgcgatatgctgccggaaaccgttggccgtctggcggaaattaaaaatattgtcggtattaaggaagcaacagggaacttaagtcgcgttcaccagatcaaagagctggtttcagacgactttattctgctgagcggtgacgatgcgaccggtatggacttcatgcagctcggcggcgtaggcgtgatttctgttacggccaacgtggcggcgcgcgaaatggccgacatgtgccgtctggcgctggcgggtcaatttgccgaagctcgtgcgattaaccagcgtctgatgccactgcatacaaaattatttgtcgaacccaatcctatcccggtgaaatggggatgcaaggcgttgggtcttgtggcgaccgatacgctgcgcttgccgatgacgcctatcaccgatcatggtcgtgaagccgtcactgccgcgctgaagcatgccggtttgctgtaa

SEQ ID NO: 1995 - DNA, 981 bp, Klebsiella pneumoniae
ggacgggccatgagtaagatttttgaagacaactccctgactatcggtcatacaccgctggtacgactgaaccgcatcggtaatggccgtatcctggcaaaggtagaatctcgtaacccgagctttagcgtaaaatgccgtatcggcgccaatatgatctgggatgctgaaaagcgcggcgttctgaaacctggcgtggaactggtcgagccgaccagcggcaacaccggtatcgccctcgcctacgtggcgggggcccgcggctacaaactgacgctaaccatgccggaaaccatgagcatcgagcgtcgtaagctgctgaaaaccctgggcgccaacctggtgctgaccgaaggcgccaaaggcatgaaaggcgctatccagaaagcggaagagattgtcgccagcaacccggaacaattcctgctgctgcagcagttcagcaacccggctaacccggaaatccacgagaagactaccggcccggaaatctgggaagataccgatggtcaggtggatgtgtttatctccggcgtaggtaccggcggaacgctgaccggcgtcagccgctatatcaaaaacaccaaaggtaaaaaagatctgatcaccgtcgccgttgaaccgaccgattccccggtgatcgcccaggcgctggcgggggaagagctcaagccgggtccgcacaaaattcagggtatcggcgccggcttcattcctggcaacctggatctgaagctggtcgacaaagtgatcggcattaccaacgaggaagctatctccacggcgcgccgcctgatggaagaagaaggcatcctggcgggtatctcttccggggccgccgttgccgccgcgctgaagctgcaggaagatgaggcctttaccaataagaatattgtggttatcctgccttcctcaggtgagcgttatttaagcaccgcgctgttcgccgatctcttcactgagaaagagctgcaacagtag

SEQ ID NO: 1996 - DNA, 849 bp, Klebsiella pneumoniae
gggatgaacatggcgcacgacgaacaacgctggctttcgccgagactgcaaaaagccgctgccctgtgtaaccaggcgcccgccgccagcgagtcgccgctgtggctgggcatcgatttgggcacctgcgacgtggtgtcgatggtggtcgaccgcgatggccagccggttgcggtatgtcttgactgggccgatgtggtgcgcgacggcatcgtctgggacttcttcggcgccgtcaccctcgtgcgccgacatcttgcgactctcgagcagcagctgggctgccgcttcacccatgcggcgacctcgtttccgcccggcaccgatccgcgcatttcgatcaatgtcctggagtccgccgggctggagatcagtcatgtgctggatgagcctaccgcggtggccgatctgctgcagctcgataacgccggggtggtggatatcggcggcggcaccaccgggatcgccatcgttaaacagggcagggtgacgtattcggcggatgaagccaccggcggccaccatatctccctgactctggccgggaatcgcggcatcgggcttgaggaggcggagcagtacaagcgcagccacgccggggagatctggccggtggttaagccggtgtacgagaagatggccgaaattgtcgcccgacatattgccggacaagggattgtcgatttgtggctggcaggcggcgcctgtatgcagccgggcgtgcatgagctgtttcgtcagcgcttcccggcattaccggtgcatttgccgcagcacagcctgtttatgaccccgctggcaatcgccaacagcgggagggaaaaagcggaggggatgtatgcaagctga

SEQ ID NO: 1997 - DNA, 1536 bp, Klebsiella pneumoniae
cctatgccaataaacgataacacccctcggccgcaggagttcgctgcggttgaccttggttcgaacagttttcatatggtgatcgcccgtgtcgtcgacggcgccatgcagatcatcggacgcctgaaacagcgcgtacatctggccgatggcctcgatgaaaactcggtgttgagcgaagaagccatgacccgtgggctgaactgcctgtcgctgtttgccgaacgcctgcaggggttctccccctccagcgtctgtatcgtcgggacgcatacgctgcgtcaggcgaccaacgcggcggagtttcttaaacgcgcggaaaaagtgatcccctacccgatcgagatcatctccggtaatgaagaagcgcgcctgatttttatgggcgttgagcacacgcagccggagcgcggccgcaagctggtgattgatatcggcggcggttcaaccgagctggtcattggcgaagattttgagccccgcctggtggaaagccgccgcatgggctgcgtgagcttctcgcaggcctatttccctggcggcgttatcaataaagagaacttccagcgcgcgcgcctggcggcggtgcagaagctggagacgctggcctggcagttccgtattcagggatggaccgtggcgctgggcgcctccggcaccattaaagccgcccaggaagtgctggtggcgatgggcgagaaggacggatttattacgccggagcgcctcgagatgctggtaaatgagctgttgaagcataaaaacttcgacgcgctcagtctgcccggtctctcagaagaccgtaaagcggtctttgcgcctgggctggcgatcctctgcggtgtgtttgacgcgctggccatcaaagaacttcgtctgtccgatggcgcgctgcgcgaaggtgtcctgtacgagatggaaggccgcttccgccaccaggatattcgtagccgcacggcacagagtctggcaaatcagtacaacatcgatcgcgaacaggcgcgccgggtactggaaactaccacccagatgctggagcagtggcaggagcagaatcccaagctggccaatccgcacctcgcggcgctgttgaaatgggcggtgatgctccatgaggtagggctgaatatcaaccacagcggcatgcatcgtcactcggcctacattctccaaaatagcgacctgccgggcttcaatcaggagcagcagatgctgatggccaccctcgtacgctatcatcgcaaagcgatcaagctcgacgatctgccgcgctttacgctattcaggaaaaagcagtttctgccgctaattcagctactgcgcctgggcgtactgctgaataatcagcgtcaggctaccactacgccgccgacgctgcgcctgcagacggaagctcaccactggacgctgacgtttccgcacaactggtttagccagaatgcgctggtgctgctggatctggaaaaagagcaacagtactgggaaggcgtgccggaatggatgctgaagattgctgaagaagagccagacgcctga

SEQ ID NO: 1998 - DNA, 1026 bp, Klebsiella pneumoniae
gggtgcgcaatggccgttaaatcactgaaaaaaggatatctggcgctggcggcttccatgctgctggtggcgcaggcgcaggcgacggagctgctgaacagctcctatgatgtctcccgcgagctgtttgccgcccttaacccgccttttgagcagcagtgggcgaaagacaatggcggggacaagctgaccgtcaagcagtcgcatgccggttcatccaagcaggcgctggctattttgcagggcctgaaggcggacgtggtcacctacaaccaggtgacggacgtgcagatcctgcatgacaaaggcaacctgatcccggccgactggcaaagccgtctgccgaacaacagctcaccgttctattcgacgatgggtttcctggtgcgtaaaggcaatccgaaaaacattcatgactggaacgacctggttcgctctgacgttaagctgatcttcccgaatccgaaaacctcgggtaacgcccgatacacctacctggcggcatggggcgcggcggataaagctgatggcggcgataaagctaaaaccgaacagtttatgactcagtttctcaagaacgtcgaagtctttgacaccggcgggcgcggagcgaccaccaccttcgccgagcgcggcctcggcgatgtgctgattagcttcgaatcggaagtgaataatattcgcaagcagtatgaggcgcagggatttgaagtggttatcccgaaaaccaacattctggcggagttcccggtagcctgggtcgataaaaacgtcaaagccaatggcacggaaaaggcggcgaaagcctacctgaactggctctatacgccacaggcgcaaactatcattaccgactactactatcgggtaaacaacccgaaagtgatggatgctctgaaggataaattcccgcagaccgagctgttccgcgtggaagataagtttggctcctggcctgaggtaatgaaaacccacttcgccagcggcggcgaactggacaaactgctggcggcggggcgtaagtaa

SEQ ID NO: 1999 - DNA, 1044 bp, Klebsiella pneumoniae
ggagatttgatggcttactcagtacagaagtcgcgcctggcgaaggttgcgggtgtttcgctggttctactcctcgcggcctgtagttctgactcgcgctataagcgtcaggtgagcggtgatgaggcctatttacaggcatcaccgttgagcgaacttcacgcgccggcggggatgatcctgccgattcaggtgggtgattacaatattccggtggctaacagcaccggcgcggtcggtaaagcgctggacattcgtccgccggcgcagccgctggcgctggtgagcggtgcgcggacccagtttaacggcgataccgcgacgctgatggtcgagaacggccgcagcggttcgctgtgggcacaggtcaccagtattcttcagtcgaagaactacgttatcgccaagcgcgatgatgcgagccagacgctgaacaccgactgggttgagtggaaccgtcttgatgaagatcagcagtatcgcggtcgttatcaaatctccgtcaaaccgcagggttatcagcaagcggtggtcgttaagctggtgaatctggagcaggcgggtaaaccggttgccgatccggcgtctctgcagcgctacagcaccgctatgctgaacgtcatttcggaaggccttgacatgaatgccaccagcgcccagaacgccgcacagcgcagcgcgggggccaccttcgacgtgcagagcgccgccgacgataccggcctgccgatgctcgttgttcgcgcgccgtttaacctggtgtggcagcgtctgccgggcgccctcgagaaagtggggatgaaagtgaccgacagcacgcgctctcagggcagcatggcgctgacctataagccgctgtctgacagcagctggcaggagctgggcgcacgtgacccgcagctggtctccggcgactacaaactgcaggtcggcgacctcgataaccgcagtagcctgcagtttatcgacccgaaaggccacaccctgacgcagtcgcaaaatgacgccctggtagccgtattccaggccgcatttaacaagtaa

SEQ ID NO: 2000 - DNA, 207 bp, Klebsiella pneumoniae
gggcaattgatgaaagaccgcagtcacgatgaggcgatggccgagcacttccgcgccgatcctgcctatgcagcggagctgcttgccgaagtgcgccgcaatggtgatccagccgagctggccatgttgttgcggctgatggccacggcctcggcagatgacgctaggtcggatgacgccgatacagggcgcactctacctcgctga

SEQ ID NO: 2001 - DNA, 195 bp, Klebsiella pneumoniae
tggtgggtgatgacgggatcgaaccgccgaccccctccttgtaagggaggtgctctcccagctgagctaatcacccccgctgtgtggagtcgcattatagggagagttgaaaatgagtcaacgccttttctaaagaattcgttcgttcgtcgtaaaattaaacaaagcgatcgcgaaaccggcgccatagcatga

SEQ ID NO: 2002 - DNA, 870 bp, Klebsiella pneumoniae
attgtggcgattgacttacgggcagcgttcgagaacgaaccgcccacactagactttatttggccgggcttccttgctgggacagtaggagcgttggtggctcccggagccacgggtaagagcttttgggcgttggaagcggcaatggccatcgcgtgcagcgttgccggtggcgatcttttaaggctttccccggccggtactggccgcgtggtctattgcgccggagaagacccgaaagtcgcacttgtgcgccgcattcattccattggccaacacctgaacccgcagtcacgcgaagccatcgcgcagaacctcactcttgagccgatcatgggtaggcgcttgaacgtgatggatgagcggcaccttgctcgcgtcattgaattttgcgccggtgcccggttgatcgtactggataccctgagccgcattcatgatagggacgagaacagcaatggtgacatggcaaggcttgtcgccactcttgagcatattgcgaccagtaccggggcgtcagttctgtatctgcaccatgtcagcaagggcagtgcccgcgatgggcagacggatcaacagcaagcggcacgaggcgcatccgctctaatcgacaatgcccgctggtgcggcttcgtcgcaaagatgaccgaggacgaggccaagagcctcagcgaccgcgcctatgaccgtcagcccatcggcaacgaccggcgcggcttctttgtccgttttggtgtcagcaaacagaattacgactctaccccgcatgaccaatggtatgaacggcgggatggcggtgtgttgctgccggtggagctgttggacgccaagcagggcagtggaaaggggcgtcaacgtgagcaagtatga

SEQ ID NO: 2003 - DNA, 936 bp, Klebsiella pneumoniae
ataaaaaagatgaattactctctgcgtcagttaaaagtatttgtcaccgtcgcccgggccagaagcttcagccgggcaggggagatgattggcttaagtcagtcggccgtcagccatagcgtcaaggagctggagcatcagaccggcgtccgtctgctcgaccgtactactcgcgaagtggtgctcaccgaggcgggtcagcagctggcgggcaggctggaacgtttgcttgatgagttgaggattaccctgcgtgacgccgggcgggtaggccagcagctgagcggcaccgtcaaggtcgccgccagtcagacgatttccgcccaccttattccgcagtgtattgctcacagcaatcgtcgttatcccgatatcgattttgtgctgcacgatcggccccagcagtgggtgctggagagtatccgccagggggaagtggattttggcatcgtgattgatccgggcccggcggcagaccttcagtgtgaagtggttctggcggaaccatttttgctgctctgccgggaggatcatccttttgccagcctgacagaagtgccgtggcaggcgctgcaggatgaaaggctaatcctgcaggattatgcgtccggcagccgcccgctgatcgatgcggccctcagcagactggctatccgggcgaacatcgtccaggagattggccacccggcaacgctgtttccgatggtagaatcgggaattggcatcagcgttctgccggcgctggcgctaccgttaccgcaggggagccatctgacggtgaaacggctgactccggtgatggagcggcagctgatgctggcatgcaggaaaaatcgctcgctgtcgaccgccgctcaggcgttatgggaaattgtgcgtgaagaaggggagaatttaaccgccgccagggttgaagatccgctatatcagcgctga

SEQ ID NO: 2004 - DNA, 921 bp, Klebsiella pneumoniae
gtaaaaatcgtgaatacactcgaacaaaccatcggcaataccccactggtcaaacttcagcgtctgggaccggacaacggcagcgaagtgtgggtcaaactcgaaggcaataatccggccggctcggtgaaagatcgcgccgcgctgtcgatgatcgtcgaagcggaaaagcgcggcgaaattcagcccggcgacgtgctgatcgaagcgaccagcggcaacaccggtattgcgctggcgatgatcgccgcgctgaaaggctaccggatgaagctgctgatgcccgacaacatgagccaggagcgtcgggccgcgatgcgcgcttacggcgccgagcttatcctggtcagcaaagagcaagggatggagggggcccgcgacctggctctggaaatggcccagcgcggagaaggcaaactgctcgatcagtttaacaacccggataacccctacgcccactacaccaccaccggcccggaaatctggcagcagaccgcggggcgtatcacccactttgtctccagtatggggaccaccggcaccattaccggcgtgtcacgttttctgcgtgaacagagtaaaccggtgaccattgttggcctgcagccggaggaggggagcagtattcccgggatccgccgctggccggcagagtatatgccggggatctttaacgcttcgctggtggatacggtgctggatattcatcagcaggatgccgagaacaccatgcgtcagctggcggtgcgggaaggcattttctgcggcgtcagttcgggcggcgcggtagcgggcgcgttacgcatagcccgcgaaaatcctggcgcggtggtggtggcgatcgtctgcgatcgcggcgatcgttacctttccaccggcgtgttcggcgaagaacactttagccagggggcgggcatttaa

SEQ ID NO: 2005 - DNA, 630 bp, Klebsiella pneumoniae
tatgagggcgtccttttacgctgtggggtcggtatgtcactcaatattcacgtcattaaagataaaatcctctctgagaactggttcgtactacgcaacatgacctatgagctgacgcgggcggacggcagcgtcgtgcgccacaagcgcgaggtctacgatcgcggcaatggcgccaccgtgctgctgtataaccgccataagcagacggtggtcctggtgcgtcagttccgtgtcgccacctgggtcaatggcaatcatgacggcatgctgattgaaacctgcgccgggctgctggacaacgacgagccggaagcctgcattcgtaaagaggcggtggaagagaccggctacgaagtgggcgaggtgagaaagctgtttgagctgtttatgtcgccagggggcgtcaccgaggtagtgcatttctttatcgccgagtacagcgacgcgcagcgaaccaccagcggcggcggggtggatgatgaagccatcgaggtgctggagctgccttttagccaggcgctgcagatggtcgctgacggggagatccgcgacggtaaggcggtcattctgctgcaatatctgcaaacctccggcctgatgtcggggaactctgacaaatccgattga

SEQ ID NO: 2006 - DNA, 447 bp, Klebsiella pneumoniae
ccgtcaatggtggggaataccatggagattcgcgtttttcgccagcaggatttcgaagaggttgtgacgctgtgggagcgctgcgatctgctgcgcccgtggaacgatccggagatggatattgagcgcaagctgaatcacgacgtcagcctgtttctggtggcggaagtgaatggcgaagtggtcggcacagtgatgggcggatatgacggtcatcgcggatcggcctattatctcggcgtccatccggaatatcgcggccggggtatcgcgaacgcgctgctcaaccgtctggagaaaaagctgattgcccgcggctgcccgaaaatcaacattatggtccgtgaagacaacgacgtggtgcagggaatgtacgagcggttgggctatgagtacgccgatgtcctgaccctgggcaagcgcctgatcgaagatgaagaatactga

SEQ ID NO: 2007 - DNA, 1032 bp, Klebsiella pneumoniae
ccgcccgcggtgaaggcaaggcgtcggggaatagcgtttatttccatggtttttcattccgttaagacagttgtcctgagcatacccggcaggctattgttctggcagagcggctaccttatgcgcggtataagagaaacttttatgacaacactgaacctgggaaatctggcgaccttccggctggtcgtacagcgcggcagcttttctgccgccgccgacgcgctggggatctcccaacctgccgtcagcctgcaggtacgtcagctggagcagtttttacagaccaggctgctggagcgaaccggacgtgggatcaaggcgacggcggcgggaatggcattgctggcccacagcgagcagatcgatcgggcggtgaatagcgcggtgcagtcggtcagcgcattcagtcaggaggttaatggatcgttgacgctggggaccggcgcgacggcctgcattcatcttcttccaccgctgctgcagcatcttcgtcagcagcacccgctgctgacggtgggggtgaccaccggcaacacgctggatatcgtccgcgcggtggaagaaaaccggctcgatctcgggctggtcacgctgcccgtgcaggggcgcagtctggcggtgactgcgatgttagatgaggagttcgtgaccatctatgccagccgcgagacggagatgccggcggtttatactcccgccgagctgcaggcgcagccgctcattgccttcgaggcgggtagcggcacgcgggatctgattgaccgctggttccgctcggcgggactggcggtgacgccggtaatgcagttggggagcatcgaggcgattaagcgcatggtgcgggcagggctgggctacagcatcgtgccccgcatggcggtggagcgggtggaggatcgcgacggattacgcgtacactcgctggcgccgcggctatatcgacagctggcggtagtcatgcgtcaggacaaaattgtgacaaaaggtatcgctgaaatgctgcgcctgctgcataccgtgcgcttataa

SEQ ID NO: 2008 - DNA, 249 bp, Klebsiella pneumoniae
caaaatgaggtattcggtgtggaaagagaattaaggagtgcgcgtaaagttctcattagcaaaaagcagctgctagagatgattccactgtgcgagcgcacgatctacaacttcgaaaagcgggggaaattccctcagcgcatcgcacttagtagccgcaaggtcgtgtgggatttagccgaggtcgaggcatggattgatgcatgcaaacattccggctcggcccctcgtcccggcatgggggcttga

SEQ ID NO: 2009 - DNA, 810 bp, Klebsiella pneumoniae
caaaaagaggtattcggtatggaactagaatcgcaaaaaatgtcgacttatgccgcccgaaaattcggtcgcggcgcggcgctcgccctggcaatggcaagtgcaggcctcggtgtaagtctctacatggcaccggctccagcctatgccatctactgctcgaactgctcgacgttctatcagcagatgtacgagtacgccgaagcggtgaatacgcaactgaacaccgcgcagcagttgcagacgcagatccagcagtacgacaacatgattaagcagggcatgtcactgcccagccgcatgttcaacaccatcactggcgaccttcagcgcgtggccagcgtctacaactcggcgcagtcgctcggccgcaacatcagcaatctggacgagcagtttcgccagcagttcaagggctatgacagctatctgaactcgattggccaagggcaaaacaacatgccgcagcgctatcgggactgggcacaatccggcttcgataacgcccgcacggccatgcaggccgctggcgtaaataccagcacattcgaggatgagaacgcgatgctggatcagttggtgagccgttcgcagtcggccgttggccgtcagcaggccattcaagccgggaacgagattgcggcgcagaacgtgcagcagctccagaaactgcgcgatctggtggccacgcaaatcaccctgcaaggcaactacatggcgcagcaaaacgaacgacagtccgttagcgatgcctccgaacagcaattccgcagccgtgaaaatacacgcggcccgtctgaggggttctaa

SEQ ID NO: 2010 - DNA, 2028 bp, Klebsiella pneumoniae
gcatgcgcattgaggggttattcaccaagaagacaaaaggaagccatgaaccactttattttgagcgatagccgaaagtgcatcggctgccaggcctgcgaagtggcctgcgtgatggcgcataacgaggagcaacacgtgctgaccccgcagcgctttttgccacgtatcaccgtgatcaaagcggagggccagcgtaacgccatcacctgccgccactgcgaggacgccccctgcgtccgcagttgtcccaacgacgccatcgcccagtccggcgacagcgttcaggtccgtcaggagaaatgcattggctgtaaatcctgcatggtggcctgcccgttcggggtgatgcaggtggtggtgacgccgcaggccgcaggcctggtgaaagccagcgcgcacaagtgcgatctatgccagggccgcgaggcggggccggcctgtgtggaaaactgtcccgcgcaggcgctgaccctcgccgacgatgagacgttgatcaccctggcgaagcagcggcgactgcgctcggcatgccaggaggtgcagccgtggcagcgcgctacgccgctctgcagccagcccaatgctggcgcgaaggtcaggcaaatggcgatgacgcccccgcgcggggagccggataagctggcggcggaggtgcgtaagagccactttgaggagatctatcagccgttcaccccgcagcaggcgcagcagcaggccgcccgctgtctcacgtgtggggagcacagtatttgcgaatggacctgcccgctgcataaccatatcccgcagtggatcgagctggttaaagcggggaatatcgccgccgcggtcgcgctttcccatcagaccaactgcctgccggagatcaccggccgcgtctgtccccaggaccggctgtgtgaaggcgcctgcaccctgcgcgatgaaagcggggcagtcaccatcggcaatattgagcgctatatttccgaccaggcgctggccagcggctggcgtccggacctttcgcaggttaagccgagcggcaagcgggtggcgattatcggcgccgggcctgccgggctggcctgcgccgatatgctggtgcgccacggcgtccagccggtggtcttcgaccgtcatccggagattggcggtctgctgaccttcggcattccggcgttcaagctggataaatcgctattggcccggcggcgggcgatcttcagcgagatgggtatccgctttgagctcaattgcgaggtggggaaagatatctccatggcgacactgctggccgattatgacgcagtgttcgtcggcgccggaacctatcgctccatgaaggcagggctgccgaacgaagaggcccccggggtctacgatgcgctgccgttcctcatcgccaacaccaaacaggtgatggggctggcggcatcggcgcaagagccttatgtcaacaccgccgggctgaacgtggtggtgctgggcggcggcgatacggcgatggactgcgtgcgcaccgcgctgcgccacggcgcccgccaggtgacctgcgcctatcggcgagatgaagccaacatgccgggctcgaaaaaagaggtcaaaaacgcccgcgaagagggggcgctctttgagtttaacgtccagccggtgacgcttgagctggacgagaacgggcgggttaacggggtacgctttttgcgcaccgagctgggcgctccggacgccgggggaagacgccgcccgacgccgatccccggcagcgagtttgttatgccggcagatgcggtgatcatggcctttggcttccacccgcaccgcatgccctggctggaagcggcgggggtggcgctggacagtcaggggcgtattaaagccggagtggagagccgttaccgttatcagaccagtcaggagaagatctttgccggcggcgatgccgtgcgcggcgcagaccttgtagtgacggcgatggcggaaggccgtcacgcggcgcaggggatcctggactatctggcgcggaaaacgacgccgcttcactga

SEQ ID NO: 2011 - DNA, 1770 bp, Klebsiella pneumoniae
tggaatgaattttatatgataaaaagaatagataaaatcgccataacgaatgttaaggggatcgaaagctctgtttttgatgttcagcttattccaaacaaaccgacactcgttgtagctcctaacggtttcggaaaaagctctattgctgctgcttttggttgcctgcgttcgaaaaagatggatttggataaggacgaatgccacaagggtgatgaaggtcgccatccatctcttaaaattagttataccatgcagggcggagacaagattgaaaaagaagcgaatcatacaaaaaatgaactagcagcgacatttggcgttcatgtaattaatagccagttagtttcgaaagcaaagaaactcaaaattgcgggcgctaacattgtcacttcagcaattgaagtcactccgatcgtactgatcaaaaatattcctccgaaagaaaaatttagctactccttcgcagcagtaaaagtgggcttcggaaaaaacggaaaggtattgccaaacatttcaaatcttcttgccgataatcggataatggctaaaatttggaatcaggtcgattttaccaagcaggatcaggccggtgttaagaaggcaataaaagctctacaagatgagatcaacgccgggacaggaaatacggataaaatccttgccgatgttaaggatgaaacaacacaagcggtattagccattgactttgttagcggcattttggcagccttggcggaatccggattaaacgatttctcgcaaatcgaggctatcctcgtagccttgcagattggtgatattcacgccaacgataaggccgcctttaaaaaagcagcggagcgcgctaactatgcgttcgaaaaagcagcctatattgaggatttttctgcgcttaaaggcacttggcgtaatattcagccaaaggaaacagcggatggacttgtgattgcctttccgaaggcaaatcagatttccaacggagagcgagatatcatttgctttgtagctcagttgaaaaaagccaagctccaactcaagaaaaaaaaggccattattttagtcattgatgagatatttgactatctggatgacgccaatctggttgcctgccagtattatctgacgcaaatgattgcggaacttaaatctgaaggtcgccaaatttttccattgattatgactcacttaaatcctgggttcttcaggaattttacttttagcgatcaaaaagtttgttatctaaacaaaattgcggtctcgaacaaagcggtcgaaaacataatctctaagcgagatgaccctgccatatcggatgcaatttctaagcacttcctgcacttccactctgaagacgtagacctatctaatgagtttcaggcccttggactccctgctgatttggccaaggcgtctcagttttcagtacattgtgccagccaaatgcagcgatatgttgaaggtaagggctttgatccccttgcagtttgcagtggcgtacgccgaaaggtagagcaattgacatttgattcgttagcggaagagtcccgagaagagtttctgtcggtacacaaaaccgtcaacaaattacaattcgcagaggctgcgggaactacagttcctgaagtctattatttgttggcggtgatttataatgatgcgatgcatatcaggcccaatcaagataatttctccggattgggaacaaaactggctaacctgaccatcaagcacatgatttccacactaattcagcctgatgccctttaa

SEQ ID NO: 2012 - DNA, 348 bp, Klebsiella pneumoniae
cgctaccgctcgctcaaaaaaacgctatataatttattatataacgattgggagggcgcgatggaaaatcattttggcaaaggcttaatggcggggctacaggcatcctatgctgacaccgccgcgcatgcggcgaatttttgcgccgactataaacgcgggtttgtgctcggctactcgcaccgcatgtttgaaaaaaccggcgaccgccagctcagcgcctgggaagcggggatcctcacccgtcgctatggcctggacagggatatggtgatggatttcttcaaagaaggtgggtcgggtatggcgatgcgctattttctggcgggctatcggctggaaagctaa

SEQ ID NO: 2013 - DNA, 1377 bp, Klebsiella pneumoniae
atggttatgtcactgtttcattccgtgagcgacctgatcggtcatactcccctgctccagttgcacaaactggataccgggccctgcagtctgtttttaaaactggaaaatcagaaccccggcgggtcaattaaagatcgggttgcgctgtcgatgattaatgaagccgagcgccagggaaaactggcgcccgggggaacgattatcgaagccaccgccggcaacaccggtctcggcctggcgctgatcgcggcgcagaaaaattaccgcctgatcctggtggtgccggacaaaatgagccgcgagaaaatctttcatctgcgggcgctgggcgcgacggtgctgctcacccgctccgacgtcaataaaggccacccggcctattaccaggattacgcccgccggcttgccgatgaaacgccgggcgccttttatatcgaccagtttaataacgacgccaatccgctggcccatgccacctccactgcgccggagctttatcggcagctggagggcgacatcgacgccatcgtcgtcggcgtcggctccggcggcacgctgggtgggcttcaggcctggtttgctgagcactcgccgaaaacggaatttattctcgccgatccggcgggttcgatccttgccgatcaggtcgacaccggacgctacggcgaaacgggatcctggctggtcgaagggatcggcgaagattttatcccgccgctggccaggctggagggggtacataccgcgtatcgcgtcagcgaccgcgaagcattccagactgcgcgccagctgctgcaggtcgaaggcgtgctggccggctcttccaccggcaccctgctcagcgccgcgctgcgctactgccgggcacaaagccgtccgaaacgggtagtaaccttcgcctgcgacagcggcaataaatacctgtccaaaatgttcaacgacgactggatgcgccagcaaggactgatcgcccggcccgaacagggcgatctcagtgattttatcgccctgcgccatgacgaaggcgctaccgtcacggccgcgccggacgacaccctggccgcggtctttacccgcatgcggctgtatgacatctcccagctgccggttctggaggatggccgcgtggtcggcatcgtcgatgagtgggatttgatccgccacgtacagggcgatcgccaacgcttctccctaccggttagcgaagcgatgagtcgccatgttgaaaccctcgataagcatgcgcccgagagcgaactgcaggccattctcgatcgcggtctggtggcggtgatcgctgacaacgcgcgttttcttggcctggtcacccgcagcgatgtattgaccgcctggcgtaaccgagtcgcacaataa

SEQ ID NO: 2014 - DNA, 1308 bp, Klebsiella pneumoniae
actaattcgtcttctctgccagacttacgtatcatcttgcgaaaaacggatacgggagaatcaggcgtgaagagttatctggtcggtggcgcggtgcgtgacgcgctgttagggctgccggtcaaagaccgagactgggtggtggtgggcgccaccccgcaacagatgctagacgcgggctatcaacaggtaggccgcgattttcccgtgttcctccatccgcaaagccgggaagagtatgccctggcccgcaccgagcgcaaatccggcgcgggctataccggttttacctgctatgccgccccggacgtcaccctcgaagccgatctgctgcgccgcgacctgacggtcaacgccctcgcccaggatgccgacggcgcaattatcgacccctacggcggacagaacgatctccgtcagcgcctgctgcgccatgtctctcccgcgtttagtgaagatccgctgcgcgtgctgcgcgtcgcgcgctttgccgcccgctacgcccacctcggttttcgcattgccgaagagacccaggccctgatggccgcgatggttgaggccggcgagctggcgcatttaacgccggagcgggtgtggaaggagacggaaagcgcattaactactcgcaacccgcaggtctttttccagacgctgcgcgactgtcaggccctcaaggtgctgttcccggagattgacgccctgtacggcgtgccggccccggcgaaatggcatccggaaatcgacaccggcctgcacaccctgatgaccgtcacgatggccgcgatgctgtcgccggatgtcgacgtacgtttcgccaccctgtgccatgacctcggcaaagggctgacgccgaaggcgctctggccgcgtcaccacggccatggtccggcgggagtcaagctggtggagcagctctgcgcgcgtctgcgggtgccgaacgatatccgcgatctcgcgaaactggtggcggagtaccatgacctaatccacaccctgccaattctgcagccgaaaaccctcgtcaaactcttcgacagcattgacgcgtggcgcaaaccgcagcgcgtgcagcagatcgcgctcaccagcgaagccgacgtccgcggacgcaccggtttcgaggccagcgattacccgcaggggcgcctgctgctggaggcctgggaagtggcgcagtcggtctccactaaagaggtcgtggcggcgggctttaaaggggcggaaattcgcgaggagctgacgcggcggagaattgcggcggtagcgcagtggaaggaacagcgttgcccccagccgcaaggctga

SEQ ID NO: 2015 - DNA, 1146 bp, Klebsiella pneumoniae
tcactccctccgcagcgcctgctgccagtcggcaatcagatcgtgaggatcttcgatccccaccgacaggcggatcagctgcggtgtgataccgttcgccaggcgtttctccagcgggatcgaggcatgggtcatgctgaagggctggctcaccagactctccacgccgcccaggctctccgcaagcgtaaaccagcgcagcttgctgatgatgcgctcggcgtaaccttcatcgcccttcaccaccaccgaaatcatgccgccgggcagggccatttgctggcgcgccagctgatgatgcgggtgcgaagccagccagggaaaccagactcgctccacttccggctgctgttccagccattcggcgagctgcagcgcgttcgcgctgtggcgctccatccgcagcgccagggtacggatgccgcgcagcgtcaggaagctgctgaacgggtcaagcacgccgcctaccgcattctgcagatagccaagcttttccgcgagctcggagttatcgccaaccaccgccaggccggcgacgacatcggaatggccgttgaggtacttggtcgcggagtgcaccacaatatcaaacccatgctccagcgggcgatggatcgccggcgaagcaaaggtgttatcggcgacgctgatcaggttatggcggcgcgcgatggcggcgatggcgctgagatccgcgagcttcagcagcgggttggtgggcgtttccacccagatcatgcgggtgtcggggcggatcgccgcttcaattcccgccaggtcgtcgggtttcacccagctcacctgcagacccgcgctacggcggcgaacgttttccagcaggcggtaagtgccgccatacacatcatcgaccgccaccaggtgactgtccttatccagcagctccagcacggtggagatggcggccagcccggaggcgaacgcgtagccgcgcgtgccgttttccaggtcggcgatcgccgtctccagcgcgtggcgggtgggattcccgctgcgggaatattcataaccggtatgctgccccggcgctggctgagcaaaagtggaggtggcataaatcggcggcatcactgcgccgtggctgtcggtgaaggttccgctatgtacactcagggtgtggatagatga

SEQ ID NO: 2016 - DNA, 663 bp, Klebsiella pneumoniae
ccagtttatccgagattacttttattaaaaaatagcctctcacctcatcaggagtctgccatgaaaattatcgttatcggtgccagcggcaccatcggtcgcgcggtcagcgaagaactgagtcagagacatgaggttatccgcgtcggccgcacccggggagattatcaggtggatatcacctcgcaggagagcgtcgaggcgctatttgcccaaacgggtgaagtagatgccatcgtctccaccaccggcaatctgcactttgggccgttaagcaccatgaccgacagccagttcaacctcggactgcaggacaagctgctgggacaaattcgcctggcgctggtcggccagcattttctgcgcgacgggggggcgattaccctggtcagcggtattgtcgcgcaggaacccattgctcagggggtcaatgccacgacggtcaacgccggtctggaaggctttgtccgcgccgccgcctgcgaactgccgcgcgggatccgcatcaatctcatcagccccaccgtgctcagcgagtcgctggcggcctacggcgactttttcccgggcttccccagcgttcccgccgccgccgtggcgcaggcctatcgccgcagcattgaaggcgttcagaccggccgcatctacccggtcggctactag

SEQ ID NO: 2017 - DNA, 783 bp, Klebsiella pneumoniae
atacaatatccatcacgccctgcctgctttttagctaaaccggataccacttccggcgaattatgcgtattatccacagatgcagagaatacaacgacattttcaaaacggaacagcgttatgagtgcaatcgcgcctggactggtactcctcgcctacctctgcggctccatttccagcgccattctggtatgtcgccttgctggcctgcccgacccacgcgacagcggctcaggcaaccccggggccactaacgtactacgaattggcggaaaaggggcggccgtagcggtacttatttttgatgtgctgaagggcatgctcccggtgtggggcgcctgggcgctgggccttacgccgttctggctggggttagtggcgattgccgcctgcgtgggccatatctggccagtcttctttcatttccgcggcggtaaaggcgtcgccacggccttcggcgctatcgcccccatcgggctcgatctcaccggggtgatggccgggacctggctgcctgaccatcctgctcagcggctactcttccctgggcgctatcgtcagcgcgctgatcgccccgttctacgtctggtggttcaaaccgcagtatacctttccggtgtcgatgctctcctgcctgatcctcctgcgccatcacgacaacattcagcgtctgtggcgtcgccaggagagcaaaatctggacccgcgtgaagaagaaaaaaacgccagagcagaagtaatctcccctcccggctccgccagccggggaactctcctgcgctaa

SEQ ID NO: 2018 - DNA, 243 bp, Klebsiella pneumoniae
tggccgggacctggctgcctgaccatcctgctcagcggctactcttccctgggcgctatcgtcagcgcgctgatcgccccgttctacgtctggtggttcaaaccgcagtatacctttccggtgtcgatgctctcctgcctgatcctcctgcgccatcacgacaacattcagcgtctgtggcgtcgccaggagagcaaaatctggacccgcgtgaagaagaaaaaaacgccagagcagaagtaa

SEQ ID NO: 2019 - DNA, 822 bp, Klebsiella pneumoniae
tgcgcatcgcctgtccgtcggacaggcgatgcgttaaacgtaaggcaacgtaaagatcccccgcttagcgcccctcttcgcttcattttccaccactcatcctctatcctgagcgttaacacacgccataccactgggtcctggaagacaaatatgaaacggacaaaaaatattaatcattcgtcgttccgcaaaagctggagcgcacgccatctgacgccggtcgcgctggccgttaccgcggtctttatgctcgccggttgtgaaaaaagcgacgaaacggtatcgctgtaccagaacgccgatgactgctccgccgccaaccctggcaaagcagccgaatgcaccacggcctacaccaacgcggtaaaagaggcagagcgcactgcgccgaagtatgccacccgcgaagactgcgtcgccgagtttggcgaaggccagtgccagcagacgccagcccaggcgggcgtcgccccggaaaaccaggcgcaggcgcaaagcagcggcagcttctggatgccgctgatggccggctacatgatgggccgcctgatgggcggcggcatggcgcaacagcagccgctgttcagctcgaaaaatccggccagcccggcctacggtcagtacactgacgccagcggcaagagctatggcgccgcccagccgggccgcaccatgaatgtgccgaaaaccgcgatggcgccgaagccagccaccaccaccgtcacccgcggcggctttggcgagtcggtagcgaaacagtcgaccatgcagcgtagcgccgcaggctcaacgtcctcttctcgctcaatgggcggctaa

SEQ ID NO: 2020 - DNA, 621 bp, Klebsiella pneumoniae
ggtttttttaccatgaatcagacgctcctttcttcttttggtaccgcttttgaacgtgtggaacacgctttggacgccctgcgcgaaggccgcggcgtgatggtgcttgatgatgaagaccgtgaaaacgaaggcgatatgatcttcgccgctgaaaccatgaccgttgagcagatggcgctgaccattcgtcacggcagcggcattgtgtgcctgtgcctgaccgaagatcgccgcaaacagctggatctgccgatgatggtagagaacaacaccagcgcctacggcaccggcttcaccgtgaccatcgaagcggccgaaggtgtgaccaccggcgtctccgctgccgaccgcgtgaccaccgtccgcgcggccatcgccgacggcgcgaaaccttccgatctcaaccgtccaggtcacgtcttcccgctgcgtgcgcagccgggcggcgtactgacccgcggcggccacactgaagccactatcgacctcgtgaccctggctggctttaaaccggcaggcgtgctgtgcgagctgaccaatgacgatgggcaccatggcccgcgcgccggagtgcatcaagttcgctcagcagcacaatatggcggtagtcacgattga

SEQ ID NO: 2021 - DNA, 192 bp, Klebsiella pneumoniae
tacaaactgacaaccttgcgagaattgaaggcatctaaatttccctttagtaatattagcttcctgttagcaattatcatccttcgcgttcaacatagcaacaaattattacttagaacatgcaggtttattcatcccctccccgttttgccgtttccggaacacagcgttcatagcggcgataaaatgtga

SEQ ID NO: 2022 - DNA, 297 bp, Klebsiella pneumoniae
tgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaa

SEQ ID NO: 2023 - DNA, 231 bp, Klebsiella pneumoniae
acaggagggacagctgatagaaacagaagccactggagcacctcaaaaacaccatcatacactaaatcagtaagttggcagcatcaccgaacatcctttgtcggattttcccagctacagcggggagcttattacttagatctgcatccacgtctattcgcgttcaaagagcttgatagccagtcacggtacgacaaatctgcattacttggttcagactgttatgcataa

SEQ ID NO: 2024 - DNA, 759 bp, Klebsiella pneumoniae
ccgatggtcgccagctacgctttatgtttctggctgacggggaagacccggatacgctggtgcgtaaagagggcaaagcggcgttcgaggcgcgaatggagcaggctcagccgctctccacgttcttgtttaacagcctgctgcccgcaggtcgatctgagtactccggacgggcgcgcgcagctgagcacgctggcgctgccgctgataacccaggtcccgggcgaaacgctgcgcatctatttgcgtcaggagttgggcaataagctgggcattttagatgacgcgcagcttgaacgattaatgccaaaacaggcggaaaatggcgcgccgcgtcccgcaccgcagctaaaacgcacgaccatgcgtatactgataggactgctggtgcaaaacccggatctggcgccgttagtcccgccgctggagggactggactcgcgcaaaatgccgggactgagcctgttcagcgaactagtgaagagctgtctggcgcagcctggtctgacaaccgggcaacttttagagcaatatcgcggcacaaaagaggcggcaacccttgaaaaactgtcgatgtgggacgatatagcagataaagacatcgctgaacaaaccttcaccgactcgctcaaccatatgtttgattcactgctggaactgcgacaggaagagttgatagctcgcgatcgcacacacggtttaagcagtgaagaacgccgggagctctggaccatcagccaggagctggcgaaaaaataa

SEQ ID NO: 2025 - DNA, 483 bp, Klebsiella pneumoniae
ttcgctgacgccggcaagctgtctggaggtggtacagcgcatcaccggcgtcatgcgcgagatggatggcgaaagctgcgatttactgtgcagtatctttggaccacgcaccgtatgccggaagcggtactgaatgaatttcttacgctccgggaacatccggaactcaatccagcccggtaccatgagattatcgataaatggtggggcataagcttttccagtccttccatcgcgtcgtcggactggctgactgtcggtgttctggtgctggtcaccatcccgtttattgcttattttgggttgcgtcatgcccggcccctgtcggcgcagttcagccagctcagaatagctgcagatgaggtgactgacggtcattttggtgcccaggcagagttaacgcctgaagcacccgccgaacttgtgcagtttgcgcaaaattttaatgccatgatgtcttcacggcggggtgaagataagcgt

SEQ ID NO: 2026 - DNA, 738 bp, Klebsiella pneumoniae
tttctgcgcgctgcgcaccggcttcacgccgctggcgctgaggtccagatcgcggctttgcagcaggagtacctgagcggcgacatcgccgagcgaggccttgtagctgccgatcatgcgggcgaagatgttatagatgaccaccgccgggatggcggcgaacaggccgatggccgtcgccagcagcgcttctgcgatgcccggcgctaccaccgcaagattggtggtctgggtctgggcgatgccgataaagctgttcatgatgccccagacggtaccaaacagacccacaaacggggaaatggcgccgatggtcgccagatagccgttaccgcgccccatatggcgaccaaccgccgcaacgcggcgctcaaggcgaaaaccggttcgttccttgatgccttcattgtcttcggcaccggcagagagttcgagttcgttctgcgcttcattgataagctgggtggtgaggcttttcgcctcaaaggcgctggcgatatcgctggcctgatcgagagagcgggcttccgccagctgctgctgttcacgtttgaggcgacgcttgctggcgaggatttccgcccctttaccgaagaaaatggcccatgtgacgaccgacgccagaatcaggccaatcatcaccaccttaacgacaatatcggcatgatgatacataccccaaacggagagatccgcctgcatcaaattattacccacgctctatctccacgacgataa

SEQ ID NO: 2027 - DNA, 468 bp, Klebsiella pneumoniae
actgcgtcagcttcggcaggggccgacgatcctggcgccagagcagatgcacaggccgcggctgcggagtccacgcctccagcacccgaaccaggctgccgctggccagcgcatcggccagcagtacctccggctgcatcagcagcccggccccggcgatcgccgcctggcgcagcgcgtagccatcgttgcagcgcaaaaccgcatcgcgtttccagcgcacttctccctctacgcccggcagccgccactcgttgcgggcggtccagaccgtatgggacaggcagagatgatcggcgagatcctctggcgtcccgggggtcccgtaacgcgccagataagccggcgcggcgcagatcaccatccgatacggcgccaggtagcgagccaccagatcctcctgatggatctcgccgatacggatcgccagatcgaacccctcatccaccagatcgaccatccggttag

SEQ ID NO: 2028 - DNA, 1899 bp, Klebsiella pneumoniae
atgtcgacagcccgtctgccgacaccaatcaaacgaattaagtgtggataccgtcttatggagcaaaacccgcagtcacagctgaagcttcttgtccaacgtggtaaggagcaaggctatctgacctatgccgaggtcaatgaccatctgccggaagatatcgtcgattccgatcagatcgaagacatcatccaaatgatcaacgacatgggtattcaggtgatggaagaagcaccggatgccgatgatctgatgcttgccgaaaacaccgcggatgaagatgctgccgaagccgccgcgcaggtgctctccagcgtggaatccgaaatcgggcgcacgaccgacccggtgcgtatgtacatgcgtgaaatgggtaccgtagagctgctgacccgtgaaggcgaaattgacatcgccaaacgcatcgaagacggcatcaatcaggtgcagtgctccgttgccgaatatccggaagcgatcacctacctgcttgagcagtacgaccgcgttgaagcggaagaagcccgtctgtccgatctgatcaccggtttcgtcgatccgaacgccgaagaagatatggcgccaaccgccacccacgttggctccgagctgtctcaggaagagatggatgacgacgaagacgaagacgaagatgaagacgccgacgacaacagcgatgacgacaacagcatcgacccagagctggcccgtgagaaattcgccgagctgcgtacccagtacgagctgacgcgcgacaccatcaaagccaaaggtcgtagccatgccgccgcccaggaagagatcctgaagctgtctgaagtcttcaagcagttccgcctggtgccgaagcagttcgattacctggtcaacagcatgcgcagcatgatggatcgcgttcgtactcaggaacgtatcatcatgaagctgtgcgttgagcagtgcaaaatgccgaagaaaaacttcatcaccctgttcaccggcaacgaaaccagcgagacctggttcaacgccgcggtggcaatgaacaagccgtggtctgagaagctgctggaagtgaaagaagatgtgcagcgcggcctgcagaagctgcagcagattgaagaagagaccggcctgaccatcgagcaggttaaagatatcaaccgtcgcatgtccatcggcgaagcgaaagcccgtcgtgcgaagaaagagatggttgaagcgaacctgcgtctggttatctctatcgccaagaaatacaccaaccgcggtctgcagttcctcgacctgattcaggaaggcaacatcggtctgatgaaagcggtcgataagttcgaataccgtcgtggctacaagttctcgacctacgccacctggtggatccgtcaggccatcacccgctctatcgcggatcaggcgcgcaccatccgtattccggtgcatatgattgagactatcaacaagctcaaccgtatctcccgtcagatgctgcaggagatgggccgtgaaccgaccccggaagagctggctgagcgtatgctgatgccggaagacaaaatccgtaaagtgctgaagatcgccaaagagcctatctccatggaaacgccgatcggcgacgatgaagattcgcatctgggggatttcatcgaggataccaccctcgagctgccgctggattctgcgaccaccgagagcctgcgcgcggcaacgcatgacgtgctggccggcctcaccgctcgtgaagcgaaagtgctgcgtatgcgtttcggtatcgacatgaacaccgaccacacgctggaagaagtgggtaaacagttcgacgttacccgcgaacgtatccgtcagatcgaagcgaaggcgctgcgtaaactgcgccacccgagccgttctgaagtgctgcgtagcttcctcgacgattaa

SEQ ID NO: 2029 - DNA, 1011 bp, Klebsiella pneumoniae
agagcagcagctggaggcgttgcgccagttcaagcaggcgcagcagctgcatatcgcggcggcgggatatcgccgggcaccctgccggtgatgaaagtcagcgatcatttaacctggcttgccgaagcgatcctcgacgcggtggtgcagcaggcatgggggcagatggtggctcgctacggcctgccgacccatctgcacgatcgccaggggcgcggcttcgccgtcgtcggctacggtaagctcggcggttgggagctgggctacagctccgatctcgacctggtgttcctccatgactgcccggcggaggtgatgaccgacggcgagcgggagattgacggccgtcagttctacctgcggctggcccagcggatcatgcatctgttcagcacccgcacctcgtccggtattctttacgaagtggacgcccggctgcgcccttccggcgcggcggggatgctggttaccaccgctgacgcgtttgccgactatcagcagaacgaggcctggacgtgggagcatcaggcgctggtgcgcgcccgcgtggtctatggcgacccggcgttgcaggcgcgctttgacgccattcgtcgcgatatcctgaccaccccgcgggagggcgcaaccctgcagaccgaggttcgcgagatgcgcgagaagatgcgcgcccacctcggcaacaagcatcccaatcgttttgatatcaaagccgatgccggcgggatcacggatattgaatttattacccagtatctggtcctacgctatgccagcgacaagccgaagctgacccgctggtctgataatgtgcgtattctcgagctgctggcgcagaacgacatcatggacgaggaggaagcgcgcgccttaacgcacgcgtacaccaccttgcgtgacgcgctccatcacctggccctgcaggagctgccgggacacgtggcgccagaggccttcagccgggagcgcgagcaggtcagcgccagctggcagaaatggctgatggcttaa

SEQ ID NO: 2030 - DNA, 432 bp, Klebsiella pneumoniae
tcggctatggcgatgcgtcttaatgaaaatctggacgataacggcgaaatgcatgagatcaacgtgacgccgtttatcgacgtcatgctggttctgctgattatctttatggtggccgcgccgctggcgacggtcgacgtgaaggtcaatctgccagcctcctccagccagccgcaaccgcgaccggaaaaacccatctacctgtcggtgaaggcggataagagcatgttcctcggcaacgacccggttaccgaagcgaatatgattaacgccctggatagcctgaccgccggcaaaaaagataccactgtcttcttccgcgcggataaaaccgtcgattacgagacgatgatgaaagtgatggataccctgcatcaggcgggctatctcaagatcgggctggtgggcgaagagaccgtcaaagcgaagtaa

SEQ ID NO: 2031 - DNA, 1572 bp, Klebsiella pneumoniae
accgccgtggcggcgctaagcgcgagcaaagtaaaagtaatcaggcgtaattttggcatcaggtcatcgtttggtcataaaaagtggaacgatagtagaggcatcgccagagcgacgcaaagttttccgccacaatcggaatcatccaggaggtggcccggcaaaaagcgcgttgcatggcgattcaccgcaaaatactatctactgacaaaaaatatcgtcgtaagttcgccgcaatttgtcggcgcagcacagaagcggaagaattcagtcatggctcaagaaatcgaactcaagtttatcgtcgctcaggatggggtagagacgctgcgcgagcagctcaatgcgctcgaggcgaaacatacgcccgcgggccagttgctgaacatttattacgaaaccgccgataactggctgcgtcgtcacgatatggggctgcgcatccgcggcgatcaggggcgttatgagatgacgctgaaaatcgccggtcgggtggtcggcggcctgcaccaacgcccggaatataatattccactggataaaccggagctggcgcttgagcgcctgccggcggaggtctggccgcaaggggaacttccggccgcgctggcggagcatgtccagccgctgttcagcaccgattttgcccgtgaacgctgggtgatccaggaaggaaagagtgagattgagattgccctcgatcgcggcgaagtagaggcgggcgaacatcaggagccgatctgcgaactggagctggagctgctcgccggggagaccaccgatctgctgcgcctcgcgcatcgtttgctggagagcggcgtcctgcgtcaggggagcctgagcaaagccgcgcgcgggtatcatctggcgcaaggtaacaatgagcgtccggtgacccggctggcggtgctgccggtggcagcgaaggccagcgtggagcaggggctggaggcggcgctggagagcgccctggcgcattggctgtatcacgacgagatctggctgcgcggcaacgcaaaagccaaagcggaaattctgctggcgatagcccgcgtgcgccatgccctcgtgctgtttggtggcatcgtgccgcgtaaggcgaccacccacctccgcgcgttgctgaacgacgccgacgccgttctgctggctgcggacaccgccgacgaagcgttattccgcaccgaggtcgttggcgccaaactggccctgaccgaatggctggtccagcgcgggtggcgtccgttcctcaacgaggcgggagagaaaaaaatagccggctcgttcaaacggtttgccgatattcacctctcgcgggtggcggccgagctgcgcagcgccgtgcagcatctggcggtagaagatgccgctgaccagttgccgaagctgtcccgcgacatcgacagcgtccagctgctggcgggcgcctatggcgacgccgtcgcgccctggctggagaactggcaggaacttcagcgtgcgatagagcatgacgaccgcagcgtgtttgaatatttccgtcgccaggcgctggctgccgagccgttctggctgcatagtggaaaacgataa

SEQ ID NO: 2032 - DNA, 366 bp, Klebsiella pneumoniae
ttgtctccggccgaaaaactgatgttgaaaaaattatccttaattatcccgctactggcgcttatcgcgctgctggtctggtggttcaccccgcattacaccgaggaagatgaagcttactaccgggcggtattttgcataatcgatcatgacgacagccgccagttcctccacgatatgcagaatatcgtcgaggggggaaattctgactacgcgctgcataaaacccattaccttccggcgctggggcagcggatgctggatacctggcgccagctcagcccgcaggaacagcaggcgctgcgtcaggacaagcagcgctgcggcgagatattgcgcgaaaaacaacaggggaaatcatcctga

SEQ ID NO: 2033 - DNA, 2298 bp, Klebsiella pneumoniae
ccctggccggcgcacggtcagggtttgagaaaatcctccttcatttccactatcattccggcttataatccacgcccttttggttatttttttatcattttccccggaagcaatatgagcgcaatatccctgatccaaccggatcgtgaccttttttcctggccgcaatactgggctgcctgttttggccctgcgccttttttaccgatgtcgcgtgaagagatggatcaacttggctgggatagctgcgacattattctggttaccggcgacgcctatgtcgaccacccgagcttcgggatggctatctgcggccgcatgctggaagcgcagggtttccgggttgggatcatctcccagccggactggaacagcaaagacgactttatgcgtctgggaaaaccgaacctgttcttcggcgtgaccgccggcaacatggactccatgatcaaccgttacaccgccgaccgtaaactgcgtcatgacgatgcctatacggcgggtaacgtggcgggcaaacgtccggaccgcgctaccctcgtctatacccagcgctgtaaagaggcgtggaaagatgtgccggtgatcctcggcggcatcgaagccagcctgcgtcgtaccgcccactatgattactggtccgacaccgtgcgccgctcggtgctggtggactccaaggccgatatgctgatgttcggcaacggcgagcgtccgctggtggaagtggctcatcgcctggcgatgggcgaaaccatcgaccagatccgcgatgtgcgcaataccgccatcatggtgaaagaggcgctgccgggctggagcggcgtggactccacccgtctggatacgcccggtaaaattgaccccatcccgcatccgtacggtgaagatctgccgtgcgccgataacaaaccggtcgcgccgaaaaaacaggaagcgaaaagcattactgtgcaaccgccgcggcccaaaccgtgggaaaaaacctatgtgctgctgccctccttcgagaaggtgaaaggcgataaggtcctgtacgctcacgcctcgcgcattttgcaccacgaaaccaaccccggctgcgcccgggcgctgatgcaaaagcacggcgagcgctacatctggatcaacccgccggcaatcccgctctccaccgaagagatggacagcgtcttcgcgctgccgtacaagcgggtgccgcatccttcctatggcgatgcgcgtattccggcgtatgagatgatccgcttctcaatcaacatcatgcgcggctgcttcggcggctgttcgttctgctcgatcaccgagcacgaaggacgcataatccagagccgttctgaggattcgatcattaatgagatcgaagccattcgcgacaccgtgcccggctttaccggggtgatctccgatctcggcgggccaacagccaacatgtatatgctgcgctgtaaatcgccgcgcgctgagcagacctgccgccgtctctcctgcgtctatccggatatttgcccgcacatggataccaaccatgagccgacgatcaatctttatcgccgcgctcgtgagctgaagggcatcaagaagatccttatcgcctccggggtacgctatgacatcgcggtcgaagatccgcgctatatcaaagagctggcgacccaccacgtcggcggctatctgaagatcgccccggagcataccgaagagggaccgctgtcgaagatgatgaagccgggaatgggcagctacgaccgctttaaagagctgttcgacacctattcgaagcaggcgggtaaagagcagtatctgatcccgtactttatctccgctcatccggggacccgtgatgaagatatggtgaacctggcgctgtggctgaagaagcatcgcttccgtctcgaccaggtgcagaacttctatccgtcgccgctggcgaactcgaccaccatgtattacaccggcaagaacccgctgggtaaaattggttataagagcgaagaggtggtggtgccgaagggcgataaacagcgccgtctgcacaaagcgctgctccgctaccacgatccggcaaactggccgctgatccgtcaggcgctggaggcgatgggcaagaagcacctgattggctcccgtcgcgactgcctggtgccagcgccaaccctggacgaaatgcgtgaagcgcgtcgccagaaccgccatactcgtccggcgctgaccaagcacacgccgatcgcccatcagcgccagccgcctgccgctgcgggcgcgaaaaaacgcgttaagccgaaggccgtatcacgctaa

SEQ ID NO: 2034 - DNA, 837 bp, Klebsiella pneumoniae
ggacaccatttggaaagcctgttaaacctacctctggctggtgaggccagagtcaggatattacaaattactgatactcacctgtttgctgaaaagcatgaaacgttgttaggcatcaatacctgggatagctatcaggccgtactgtcggccattcatgcctcacagcgtccatgcgatctgattgtcgcaacaggcgatctggcgcaggaccactcctccgcggcctatcagcattttgctgagggcatcgcgagttttgctgcaccctgcgtctggctaccgggcaaccatgatttccagccggcgatgtacagcaccctgcaggaggcgggcatttcccctgccaagcgcgtgtttctcggcgatcgctggcagatcctgctgctcgacagccaggtgtttggcgttccccatggcgagctgagcgacttccagctggagtggctcgaacataagctggcggaggcgccggagcgctatactttactcctgctgcaccatcatccgctgccggccggctgcagctggctggatcagcatagtctgcgcaacgccggcgcgctggacagcgcgttgagcgcctggccgcgggtgaagcatcttttgtgcggccatattcatcaggaactggatctcgactggaatggccggcgcatgatggcgacgccgtcgacctgcgtccagtttaaaccgcactgtgccaatttcactctggatacggtgtcaccgggctggcgctggctggagcttcaccctgacgggacgctgaccaccgaagtgtgccgcctggaaggcgccgcgtttcatccggatattgcttcagaaggctactga

SEQ ID NO: 2035 - DNA, 1476 bp, Klebsiella pneumoniae
gatagtttttatcctgcctctacagtgaataccacttcatctgagagggattatattgtgaatcacgataataaactgtcatttgcggagaagctgggatatggcatgggggatgcagcctgcggtatcgtttactcttcggtaaccatgtttctgacatggttttatacggatatttacgggctttctgctgccgcagtcggagtgatgttcctggtgacgcgggttctggatgcgattaccgatccgctaaccggcattgttgcagaccgtgtaaagacccgctggggccattttcgcccgtggcttatctggtttgccgtaccttatgccgtgctggcggtaatgaccttcacgactccggaatttggcgcatcgggtaaactggtttatgcctatctgacctacaccttactcatgctgtgttacacctttatcaatattccctactgcgcattgggcggagtcattacgcgtgatgagaaggatcgcctttcagcccagtcatatcgttttacgatctcatctctggccggtctgatggtttctgtcgcaaccctgttcctggtggattttttcggtaaagaaaataagcagtttggttttcaggcgacaatgggaatcatgggcgcgatcgctattgtaatgctggctttttgcttcttctctaccaaagaacgcgtggctccagctgttgaacagcaggggagcatacgcgaagacctccgtcagctgctggcgaatgaccagtggcgtattgtggcgataattacttttttctccagtatggccggggttatgcgcagcgccgccacgctctattatgcaacctacctgatgttaggcggtgtggagtcagcggcgggaacggccatgaaatcagcatttgtttccaccagcgtcgttggcacgattatcggcagcatcgccgccggatggctggccaagcgctatcgcgcggtatcgctgtttaaaaatatcaacctcctgctggtcctggttggcgtcgtaatgttctttgtgccgccgacctggctgccggtggtgttccctttatacttcctggtcggcttcttccatcagatgtaccagccgtttaaatggaacatgatggccaacgctgccgattatggcgaatggaagtttggccgtcgcatcacgggattatcctattccggtaatctgtttgctttgaaaatgggcatggcggttgctggcgccgccgtaggtttttcgcttgggctatttggctatcaggcgggcgtaacggcgcagactccgctggcgacaatgggaattgtggggctgttaaccctcggtccatcactatcttacctgctcctgtggtggctggcgcgtttctataagctggatgacaaaatgatgcagacaattcagcgcgagctgtccatgcgtcagcagcaggggcattcagagacgcatttgccgctaaacgccgttccggaaaaggcctga

SEQ ID NO: 2036 - DNA, 528 bp, Klebsiella pneumoniae
gattggtcttacaagttattgcgtcacctattaaaaagctggcgcaaggccagcctgaggagaaaagtggaaagggggaggttacttcgctttgacggtctcttcgcccaccagcccgatcttgagatagcccgcctgatgcagggtatccatcactttcatcatcgtctcgtaatcgacggttttatccgcgcggaagaagacagtggtatcttttttgccggcggtcaggctatccagggcgttaatcatattcgcttcggtaaccgggtcgttgccgaggaacatgctcttatccgccttcaccgacaggtagatgggtttttccggtcgcggttgcggctggctggaggaggctggcagattgaccttcacgtcgaccgtcgccagcggcgcggccaccataaagataatcagcagaaccagcatgacgtcgataaacggcgtcacgttgatctcatgcatttcgccgttatcgtccagattttcattaagacgcatcgccatagccgatcaacctacccgtaa

SEQ ID NO: 2037 - DNA, 1500 bp, Klebsiella pneumoniae
tggcttaactataaaatcgggtgtgctattatcgcgcgcaaagtttgcgtctcgcaggagagagtcatgaaagtaacgctgccggagtttgaacgtgcaggagtgttggtggtgggtgatgtgatgctggaccgctactggtacggccccaccagtcgtatttccccggaagccccggtgccggtggtgaaggtggaaaatatcgaagaacgtcctggcggcgcggcaaacgtagcgatgaacattgcctcgctgggggcaacctcgcgcctggtgggattgaccgggattgatgacgccgcccgcgcgctgagccaggcgctggccaacgtcaatgtgaagtgcgacttcgtctccgtcccgactcacccgactatcaccaagctgcgggtgctgtcgcgcaatcaacagctgatccgcctcgactttgaagagggcttctccggcgtcgatccgcagccgatgcacgagcgcattcagcaggcgctgggctctattggcgcgctggtcctttcggactatgccaaaggggcgctgaccagcgtccagaccatgatccgactcgcacgtgaagcgggcgtgccggtgctgatcgatccgaaaggcaccgatttcgaacgctatcgcggcgcgacgttgctcaccccgaacctctctgagtttgaagcggtggtgggcaagtgccaggatgaagcgcagatcgttgagcgcggcatgaagctcatcgccgaattcgaactgtcggcgctgctggtgacgcgctctgagcaggggatgacgctgctgcagccgggacgtccgccgctgcatatgccgacccaggcccaggaagtgtacgacgtgaccggcgccggcgacacggtgattggcgtactggcggcgaccctggcgtccggcaacaccctggaagaggcctgctatttcgctaacgccgcggcgggcgtggtggtcggtaagctgggtacatccaccgtttcccctgtcgagctggaaaacgcggtccgcggccgggctgagaccggctttggcgtgatgagcgaagaggagctcaaacaggcggttgcggcggcgcgcaagcgcggcgagaaagtggtgatgaccaacggcgtcttcgacattctgcatgccggtcatgtctcctatctggcgaatgcgcgcaagctgggcgaccgtctgatcgtggcggtcaacagcgatgcctccaccaaacgtctgaaaggcgaaacccgcccggtgaacccgctggaacagcggatgatcgtgctgggggcgctggaagcggtcgactgggtggtatcatttgaagaagatactccgcagcgcctgatcgctggcatcctgccggatctgctggtcaaaggcggcgactacaaaccggagcagatcgccggcagcgaagaggtctgggcgaacggtggcgaagtgctggtgctcaactttgaagatggctgctcaactaccaatattattaagaaaatacaaaaagatagcgacaaataa

SEQ ID NO: 2038 - DNA, 249 bp, Klebsiella pneumoniae
ttgatctggtacgaactaactcttattttgcttcacagttttcaaaatgagataaaactgatgcctgtcattattgccagtagtgttaaagaagccaaagcgttaattaacggtggaaaatacagggaaattattcttaacttcgatattgatgccgatgactttttctctctcgccagccattccgccggaactaaaatctccatcgccgaccgcaacgatcgctctccggtagaatcagcaaaataa

SEQ ID NO: 2039 - DNA, 2370 bp, Klebsiella pneumoniae
cggaatcctcagccgatctcacggcctgtgactcagggcgtgagatcgggtattatcgcgggtagttttgccgtccgaacggtcggtacccagattgaggatccacgattaatgagcgatatggcagagcgccttgcgctgcatgaatttacggaaaatgcttacctgaactactccatgtacgtgatcatggacagggcattaccgtttattggcgatggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatctttcgccgccatgcgttacaccgaatcccgcctgtcgaagtatgccgagctgctgctcagcgagctggggcaggggacggtcgactgggtgccaaactttgacggcacgctgcaggagccgaaaatgctgccagcgcgtctgccgaacatcctgctgaacggtaccaccggcatcgcggtaggcatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgcaaaatctaccagaacgggcgcggctcagtgcgcatgcgcgcggtgtggagtaaagaggacggcgcggtggtgatcagcgcgctgccgcatcaggtctctggcgccaaagtgctggagcagattgcggcgcagatgcgcaataaaaagctgccgatggttgacgatctgcgcgacgaatcggaccacgaaaacccgacccgtctggtgattgtcccgcgctccagccgggtggatatggaacaggtgatgaaccacctgttcgccaccaccgatctggagaagagctaccgcatcaacctcaatatgatcggccttgacggccgcccggcggtgaaaaacctgctggagatcctcagcgagtggctggtgttccgtcgcgataccgtgcgtcgccgtctaaaccatcggttagagaaagtgctgaagcgcctgcatatcctcgaaggtttgctggtggcgtttcttaatatcgatgaagtgattgagatcatccgcactgaagatgaaccgaagccggccctgatgtcgcgctttggcatcagcgaaacccaggcggaagcgattctggaattaaaactgcgccacctcgccaaactggaagagatgaagatccgcggcgagcagagcgagctggaaaaagagcgcgaccagctgcaggcgattctggcgtctgaacgtaagatgaacaacctgctgaaaaaagagctgcaggccgatgccgatgccttcggcgacgaccgtcgctcgccgcttcacgagcgtgaagaagcgaaagcgatgagcgaacatgacatgctgccgtctgagccggtgactatcgttctgtcgcagatgggctgggtgcgcagcgccaaaggacacgacattgacgcccagggcttgagctataaggcgggcgacagctggaaagcctcggcgaagggcaagagcaaccagccggtggtgtttatcgataccaccggacgcagctatgccatcgatccgattactctgccttccgcacgtggccagggtgaaccgcttaccggcaaactgaccctgccgccgggcgcgaccgtggagcatatgctaatggaaagcgacgatcagaaactgctgatggcttccgacgcaggctacggtttcgtctgtaccttcaacgatctggtggcgcgcaaccgtgccggtaaagcgctaatcaccctgcctgacaacgcgcacgtgatgccgccgctggtgattgaggatgagtccgatatgctgctggccatcaccgccgccgggcggatgctgatgtttccggtcagcgatctgccgcagctgtcgaaaggcaagggcaacaaaattatcagcattccggcggcggaagccgcagccggccaggacggtctggcacatctgtttgttctgccgccgcagagtacgctgaccattcacgtcggcaaacggaagatcaaactgcgtccggaagagctgcaaaaagtcaccggcgagcgcggccgccgcggttcgctgatgcgcgggctgcagaaaattgaccgcgtggaaattgactcgccgcgtcgtgccgcggcaggcgatagcgaagagtaa

SEQ ID NO: 2040 - DNA, 249 bp, Klebsiella pneumoniae
acgcgcggacagagtaggggcaggtgggctcaaggaacacctcaaacgtccgcgggccgtgtccccagaccagcggttgggcattcagatgcgagggtgtgctcattgtcgactcctgatgttgcgttgtttttttgttatatcaccgataacgatatcacttttgtttccggctgcagggttattttccttaacggcacgattagcgaaacgaatgagtggtatcatcgttacacctctgtctggtaa

SEQ ID NO: 2041 - DNA, 675 bp, Klebsiella pneumoniae
cccccgccgcacctgcaccaggcatcgcccttcttttttcatatcaggatttacgcccccatgaatgcgataatcattgacgatcatccattggcacgtatcgccattcgcaaccttctcgacagcaacggtattaccgtcgcggcagagctcgacagcggcgctcatgccgtgcagaccgcggaaagcatgcagcctgacctgctcatcgtcgacgtcgatattccggagctcagcggtatcgaggtgctggagcagctgcgcaaacgccgctaccagggaacaatcatcatcatttccgctaagaatgaactgttctacggcaaacgcagcgccgactgcggagcaaatggttttgtgagtaaaaaagagggaatgaataatatcctcgccgcaatcgacgcagccaataatggctacagctatttccccttttcactggaacgcttctgcacccacggcatcaccgatcaggaccggctggatacgctgtcaacgcaggagatgaaggtgttccgctatattctcagcggcgtcgactacaccaccatcggcagcaaaatgaatatcagcaataaaacggtaagtacctataaggtccgtctgatggataaattaggctgcagcaccctgcttgagctatatgactttgcgcaacgcaataaaatagggtga

SEQ ID NO: 2042 - DNA, 915 bp, Klebsiella pneumoniae
agagcgcttaacaacggaggcagggtgatgacgcgattaacggccaaagatttcccgcagcagttgctcgagtattatgactactatgcccacggcaaaatcagtaaacgcgagtttctccagctggcggggaaatatactgtcggcgggatgaccgcgctggcgctgtttaatctgctgaagcccgactatgccctggcagagcatgtaccgttcaccgacccggatatccgcccggagtatattcattatccctctcctgacggtcacggcgaagtgcgggcttacctggtgacgccgacaaaaatagccgacaaagcgcccgctgtggtggtggtgcatgagaaccgcggcctgaacccctatattgaagatgtagcccggcgggtagcgaaagcggggtacatcgcgctggcgccggatggcctgagcgccgtcggcggctatccggggaatgatgatgaaggccgcgccctacagcagaaagtcgatcccgtgaagctgatgaatgatttttttgcggcggtcgcgtttatggcgaactatccacaggcgacggggaaggtcggtatcaccggtttttgctacggcggcggcgtcagcaacgcggcggcggtggcgatcccggagctggcctgcgcggtgccgttttacggtcgccagccgccgctgaaggaggttgataaaattaaagcaccgctgctgctgcactatgccggcctcgatagcggcattaatgaaggctggcctgcctatgaacaggcgttgaaggaacaccataaagtctacgaggcctatttctatcagggcgtgaatcacggctttcataatgattccacgccgcgctacgatcgggctgcggctgatctggcctggcaacgcacgctggcatggtttgagaagtatttacgctag

SEQ ID NO: 2043 - DNA, 1167 bp, Klebsiella pneumoniae
gcaatgaataatttcgacctgcataccccaacccgcattctgtttggcaaaggcgcgattgaaaagctgcgtgaacagatcccggcggaagcccgcgtactgatcacctacggcggcggcagcgtcaaaaaaacaggcgtcctggatcaggtcctcaccgctctgaatggactggatgtccttgaatttggcggcatcgagccgaacccgtcttacgaaaccctgatgaatgcggtgaaactcgcccgggaagagaaagtgaccttcctgctggcggtcggcggcggttcggtgctggatggcaccaagtttatcgctgcagcagcccactacgacgcggatatcgatccgtgggaaattctggaaacctatggcagcaaaattgccagcgccattccaatgggctcggtactgactctgccggcgaccggttctgaatccaacaaaggcgcggtcatatcgcggaaaaccaccggcgacaaacgcgcgtttatgtcttcgcacgtccagccgcagttcgcgatcctcgatccggtttatacctataccctgccgccgcgccaggtcgcgaacggcgtggttgacgccttcgtccataccgtcgagcagtacgtgacctacccggtagacggcaaaatccaggaccgtttcgccgaaggcattctcctgaccctgatcgaggatggcccgaaagccctgcaggaaccggagaactataacgtgcgcgccaatattatgtgggcggcgacgcaggcgctgaacggcctgatcggcgcaggcgtgccacaggactgggcgacgcatatgctcggccacgagctgacggcgatgcacggcctggatcacgcccagacgctggctatcgtgctgccggcgctgtggaatgagaaacgcgatgccaagcgcgagaagctgctgcagtatgccgagcgcgtgtggaatattaccgaaggctctgacgaccaacgtatcgatgccgccatcgccgcaacgcgtcagttcttcgagcagatgggcgtgccgacccgcctttccgattacggtctcgacggtagctccatcccggcgctgctggcgaaactggaagagcacggcatgactaaacttggcgaacatcaggatatcaccctggacgtcagccgccgtatttacgaggctgcacgctaa

SEQ ID NO: 2044 - DNA, 366 bp, Klebsiella pneumoniae
atttatcgtaatgacatctgcgttacgcgtgttgtatacttaatatccacagaaacacaagaggacaacacgatgccagccgcaaacagcatgtccataaaacgcgaaacgttaaatctgcgcattaaacctgccgaacgcgatcttattgatcgggcggcgaaagccagagggaaaaaccgcacagactttgtgctggaggccgcccgcgctgccgctgaggaagcgctgattgagcaacgcatcattatggccgatccgcaggcttatcaggaatttctcgctcgtctggatcaggctcctgcacctaatgccgcactgcgtaaaactatgcagacccctgcgccgtgggaacaggaagaatga

SEQ ID NO: 2045 - DNA, 1878 bp, Klebsiella pneumoniae
acgatgagtaatatttcacgccaggcctatgccgatatgttcggccccaccgtcggcgacaaggtgcgcctggcggataccgagctgtggatcgaggtggaggacgatctgaccacctacggggaagaggtcaaattcggcggcggcaaagtgatccgcgacggcatgggccaggggcagatgctggccgccgactgtgtcgacctggtgctcaccaacgcgttgatcgtcgatcactgggggatcgttaaggccgatatcggcgtgaaggacggccggatcttcgccatcggcaaagccggtaaccccgatatccagcccaacgtcaccatccccatcggtgcctcgacggaagtgattgccgccgaaggaaaaattgtcaccgccggcgggatcgatacccatattcactggatctgtccgcagcaggcggaagaggcgctggtctccggcgtgaccaccatggtcggcggcggcaccggcccggccgcgggcacccatgccaccacctgcaccccgggcccgtggtatatctcacgcatgctgcaggcggccgacagcctgccggtcaatatcggcctgctgggcaagggcaacgtttctcagccggatgccctgcgcgagcaggtggcggcgggcgttattggcctgaagatccatgaggactggggcgccaccccggcggcgatcgactgtgcgttaaccgtcgccgatgaaatggacatccaggtcgccctgcacagcgacaccctgaatgaatccggttttgtggaagacaccctcgccgccatcggcgggcgcaccatccacaccttccataccgaaggggccggcggcggccatgcgccggacatcatcaccgcctgcgcccacccgaacattttgccgtcgtccaccaacccaacgctgccctacaccctcaacaccatcgatgaacatctcgatatgctgatggtctgccaccatctggacccggacatcgccgaggacgtggcctttgccgagtcgcgcattcgccgggaaaccatcgctgcggaagacgtgctgcacgatctcggtgccttctcgctcacctcctccgattcgcaggccatgggccgcgtcggggaagtgattctccgcacctggcaggtggcgcatcgcatgaaggtgcagcgcggagcgctggcggaggagaccggggataacgacaacttccgcgtgaagcgctacatcgccaaatacaccatcaacccggcgctgacccacggcatcgcacacgaagtcggatccattgaggtgggtaagctggctgacctcgtggtctggtcaccagccttcttcggcgtgaaaccggccaccgtgatcaaaggcggcatgatcgccatcgcgccgatgggcgatatcaatgcctctattccgaccccgcagccggtgcactaccgcccgatgtttggcgcgctgggcagcgcccgccatcactgccgcctcaccttcctgtcgcaggcggcggcagccaatggcgttgccgagcggctgaacctgcgcagcgcgatcgccgtggtgaaaggctgccgtacggtgcagaaagccgacatggtgcacaacagcctgcagcctaacatcaccgtcgacgcccagacctatgaggtgcgggtggatggcgaacttatcaccagcgagccggcagacgttctgccgatggcgcaacgatatttaatgagatggtcactccctccttcccggtactatgctgaggataggctttcattcggagaactatcatggaaaacattgcgctcattggtatcgatctgggtaaaaactctttccatattcattgccaagatcgtcgcggcaaggctgtttaccgtaaaaaatttacacggccaaagttaa

SEQ ID NO: 2046 - DNA, 735 bp, Klebsiella pneumoniae
agcgtgggtaataatttgatgcaggcggatctctccgtttggggtatgtatcatcatgccgatattgtcgttaaggtggtgatgattggcctgattctggcgtcggtcgtcacatgggccattttcttcggtaaaggggcggaaatcctcgccagcaagcgtcgcctcaaacgtgaacagcagcagctggcggaagcccgctctctcgatcaggccagcgatatcgccagcgcctttgaggcgaaaagcctcaccacccagcttatcaatgaagcgcagaacgaactcgaactctctgccggtgccgaagacaatgaaggcatcaaggaacgaaccggttttcgccttgagcgccgcgttgcggcggttggtcgccatatggggcgcggtaacggctatctggcgaccatcggcgccatttccccgtttgtgggtctgtttggtaccgtctggggcatcatgaacagctttatcggcatcgcccagacccagaccaccaatcttgcggtggtagcgccgggcatcgcagaagcgctgctggcgacggccatcggcctgttcgccgccatcccggcggtggtcatctataacatcttcgcccgcatgatcggcagctacaaggcctcgctcggcgatgtcgccgctcaggtactcctgctgcaaagccgcgatctggacctcagcgccagcggcgtgaagccggtgcgcagcgcgcagaaattacgggtaggttga

SEQ ID NO: 2047 - DNA, 717 bp, Klebsiella pneumoniae
cacaacaacaagacagaaaaggaaaatagtatgcacgatcggcgtctcgccgcccgcgcgggtgaactcaagccctccgccgtccgcgaacttctcaagcacagtaaactgcccggcgtgatttcgcttggcggcggcattccggccccggaactgtttgataccgaaggcctggagctggcggtgcagaaggtgatgagcgagcgttttaatgacgcattccagtacggtctgacggaaggctacccgccgctgcgccaggcggtgagtgaaatttgccactcccgtggcgtcgcctgttcagccgcccaggtctatatcacctccggctcccagcaatcgctggatatcgttgcccgtacgctgctcgatccgggcgatactatcgtcgttgagcgtcccacttatctggcggcgctgcaggtatttcagctggcgcaagccaatattctcagcgttgacaccgacgatgacgggatgctggtggagcagctggccgacctgctggagaccacccgcgtcaaagctggttacctggtgccgacgttcggcaatcccggcggcaaaacgctgagcgaggcgcgtcgtcgccggctggttgagctggcgaaaaaatatgatttcgtcattctggaagacgatccctacggcgaaattagctttactgacgccgttcggcgccccgctctatcaacatgctgtcgagctgggctgtga

SEQ ID NO: 2048 - DNA, 585 bp, Klebsiella pneumoniae
aaaatgagcaacatcctgattatcaatggggcgaaaaagttcgcgcactctaatggtcaactgaacgacaccctgaccgaggtcgcggagagttatctgcgcgacgccgggcacgatgttaaaagcgttcgcgccgaaagcgagtacgacgtaaaagaagaagtacagaatttcctgtgggccgatgtggtgatctggcagatgccgggctggtggatgggcgctccgtggacggtgaaaaaatatatggatgacgtctttaccgaaggccacggctcgctgtacgccagcgatggccgtacccgctccgacgccagcaaaaaatatggctccggcggcctggtgcaggggaaaaaatatatgctttctctgacctggaacgcgccgatggaagccttcaccgacaaagaccagttcttccacggcgtcggcgttgacggcgtttacctgccgttccataaagccaatcagttcctcggcatggaggcattgccaacctttatcgccaacgacgtgattaaaatgcctgatgtcccacggtatatcgcagaatatcgcaagcatctagcggaaatttttggttaa

SEQ ID NO: 2049 - DNA, 852 bp, Klebsiella pneumoniae
ttcgcggtaaagggacgtgtcccgtacgcgcatcctcaggcaatatactcgtatgtaattattttcacagggagagaagcgatgtcatcacccttaatattgacgctgttcgccggtagcgcaaccttcattggcgccatattcggcgtgattggccagaaaccctctaaccgcctgcttggcttctccctcggctttgccgccgggattatgctattgatttcgttgatggaaatgctgcctgccgcgctggccgccgagggcatgtcgccgctgctcggctacggaatgtttgttgtcggcctgctgggttacttcggccttgaccgcctgctgccgcacgcccacccgcaggatctgatgactcccgccatgccgcgcccgcgcaacttacgccgcaccgctattcttctgacgctggggatcagcctgcataactttccggaagggatcgccacctatgtcacggccagcaacaacctcgagcttggcatgggcgtcgcccttgccgtcgccctgcacaatattccggaaggactggcggttgccggaccggtgtatgccgccaccggctcgcgcagcaaagcggtgctctgggccgggctttccggcatggcggaaattttgggcggcgtgctggcgtggttgattctggggagcctggtctcgccgctggtgatgggcgcgatcatggctgccgtcgccgggattatggtggcgctgtcggtcgatgaactgatgccgctggcgaaagagatcgatccgcaaagcaatccaagctacggcgtcctgtgcgggatgtcggtcatggggctgagcctggtggtactccagacgatgggcatcggttaa

SEQ ID NO: 2050 - DNA, 1032 bp, Klebsiella pneumoniae
agcgaggtaaaacaactcatgcgtgtactgggcattgaaacatcctgcgatgaaaccggcatcgcgatttatgacgaccagcaaggtctgttagccaaccaattgtatagtcaggtgaaactgcatgcggattacggcggcgtggtgccggagctggcatcgcgcgaccacgtgcgcaaaacggtgccgctgatccaggcggcgctgaaagaagccggtctgacggcgaaagatatcgacgccgtcgcctatacggcgggtccaggcctggtcggcgcgctgctggtcggggcgaccgttggccgggcgctggccttcgcctggaacgtgccggcgatcccggtacaccatatggaagggcatctgctggcgccgatgctggaagataatccgccggcgttcccgttcgtcgcgctgctggtttccggcggccacacccagttgattagcgtcaccggtattggtcagtatgaactgctgggcgagtcgattgacgatgcggcgggcgaagcctttgataagacggcgaagctgctgggactggattatcccggcgggccgatgctgtcgaaaatggcgtcccagggcaccgaaggccgctttgtcttcccgcggccgatgaccgaccgtccggggctggacttcagcttctccggcctgaagaccttcgccgccaacaccattcgcagcaacggcgacgatgagcaaacccgcgccgacatcgcccgggcgtttgaggatgcggtcgtcgatacgctgatgattaaatgtcgccgcgcgctggagcaaaccggctttaagcgtctggtgatggcgggaggcgtgagcgccaaccgtaccctgcgggcgaagctggcggagatgatgcaaaaacgcggcggcgaggtgttctacgcccgccctgagttctgtactgacaacggcgcgatgatcgcctacgccggcatggtgcgtctgcaaaccggcgccaaagccgagctcggcgtgacggttcgcccgcgctggccgctggccgagctgcctgccgcctaa

SEQ ID NO: 2051 - DNA, 597 bp, Klebsiella pneumoniae
tataacaaaaaaacaacgcaacatcaggagtcgacaatgagcacaccctcgcatctgaatgcccaaccgctggtctggggacacggcccgcggacgtttgaggtgttccttgagcccacctgcccctactctgtccgcgcgtttaataaactcgacgatctgctcgatgaggtcggcgccgataacgtgaccatcaagatacgcctgcagtcgcagccgtggcatctgttctccggggttatcgtccgctgcatcctcgccgcgtccaccctgccgcacggcagagagcaggcgcataaggtgatgcaggccgtggccgaccatcgggaagagtttgagtttaccgatcactgcagcgggccgaacatgaacgccacgccgcagcaaatcattgagcgcattgaacgctacagtcacgtgctgctgggggccgcctttgcccgcccggagctgcaggacgtgatcaagtggcacagtaaatacgcccgtcagaacggcatccatgtctcgccgacctttatggtcaacggcctggtgcagccggatctgggcagcggcgatgatgtcagcgtgtgggccgcgcggattatggcctga

SEQ ID NO: 2052 - DNA, 1926 bp, Klebsiella pneumoniae
acggccctgaacgacctacgaatacacaccatgacgcaatcttcatataatgctgatgccattgaggtactcaccgggctagagccggtgcgccgccgtccgggcatgtataccgacaccactcgtcctaaccatcttggtcaggaagttattgataacagtgtggatgaagcgctggcaggccacgccaaacgcgtggaagttatccttcatgccgaccagtccctggaggtcattgacgatggtcgtgggatgccggtcgacatccacccggaagagggcgtgccagcggttgagctgatcctctgccggctgcatgcgggcggtaagttttccaataaaaactatcagttttccggcggcctgcacggggtggggatctcggtggtcaacgccctgtcaaaacgcgtggaggtcaacgtgcgtcgcgacggtcaggtctacagcatcgcctttgaaaatggtgaaaaagtggaagacctgcacgtcaccggcacctgcggcaaacgcaataccgggaccagcgtccatttctggccggacgaaagcttcttcgacagcccgcgcttttccgtttcacgtctgacccacctgttaaaagcgaaagcggtgctgtgcccgggcgtggaaattgttttccgcgaccaggtgaacaacagcgagcagagctggtgctatgccgatggcctgaacgattacctgagcgaagcggtgaacggcctgccgctgctgccggaaaaaccattcgtcggcgccttctccggcgagacggaggcggtggactgggcgctgctgtggctgccggaaggcggcgaactgctgaccgaaagctacgtgaacctgatcccgactatgcagggcgggacgcacgttaatggcctgcgtcaggggctgctcgacgcgatgcgtgagttctgcgagtaccgtaatatcctgccgcgcggcgtgaagctgtcagcggaagatatctgggatcgctgcgcctacgtgctgtcggtgaagatgcaggatccgcagttcgccgggcaaaccaaagagcgcctgtcgtcgcgccagtgcgcggcgttcgtctccggcgtggtgaaggacgccttcagcctgtggctgaatcagaacgtgcaggccgcggagctgctggcggagatggccatctccagcgcccagcgccgtctgcgcgcggccaaaaaagtggtgcgcaaaaagctgaccagcggtccggcgctgccgggtaagctggcggactgtaccgcccaggatctgaaccgtaccgagctgttcctcgtcgaaggggattcggcgggcggctcagccaagcaggcgcgcgatcgcgaatatcaggcgatcatgccgctgaagggcaagatccttaatacctgggaagtctcttccgatgaagttttagcttcgcaagaagtgcacgacatttcggtggcgattggtattgacccggatagcgatgatttaagccagctgcgctacggtaaaatttgtattctggcggatgcggactccgatggtctgcacattgccaccctgctgtgcgcgctgttcgtaagacatttccgtaccctcgtgaaagaggggcacgtctatgtggcgctaccgccgctgtaccgtatcgacctcggtaaagaggtttactacgcgctgacggaagaagaaaaaaccggcgtgctggagcagctaaagcgcaagaagggcaagccaaacgtccagcgctttaaagggctcggtgagatgaacccgatgcagctgcgcgaaaccacccttgacccgaatacccgccgcctggtgcagctggtgatcagcgatgaggacgagcagcagaccacggcgataatggatatgctgctggccaaaaagcgttcggaagatcgtcgcaactggctgcaggagaagggcgatatggcggatctggaagtgtaa

SEQ ID NO: 2053 - DNA, 222 bp, Klebsiella pneumoniae
actaacatgaatctgcttttctgtaccagcgcaccgccgatacaggcgaaaattttacccggcccgcggttagccgcttttttactgcgtaagcgcaaggaaaataaacgtgatttgctgcacagtgtaaatactaatgagaaccactatcaattcgatgtcgttttgatattattgtgggcagattttgtgattatcgtcgtggagatagagcgtgggtaa

SEQ ID NO: 2054 - DNA, 414 bp, Klebsiella pneumoniae
gttctcgggaatatcgtccggcgacaactggcaggtaaaataataacaatggcgaaagaaaaacgcgccttctggcgaaaatgggtttggaaacatctaatggcaggaataacagtactggcaatgagtagcgccgcggtgggaaaggatgtcgtccccgatgaggcgcggactcgagatatgatgcgctgtcaggattatctgcaactggatccgcgcacctggacgccgatggtgatttggctgatgaacgatcctttttcactggagccgccggagtggaccgacttccatgaagccgagctggtgctgacgccgatcctcaccgaaatctgccgtcaggagccggatgtctggctcacctcgctgcgggaacggctcaattcttatcagcaggtgcggtcgctgaactaa

SEQ ID NO: 2055 - DNA, 321 bp, Klebsiella pneumoniae
cagggcgttgaccaccgagatccccaccccgtgcaggccgccggaaaactgatagtttttattggaaaacttaccgcccgcatgcagccggcagaggatcagctcaaccgctggcacgccctcttccgggtggatgtcgaccggcatcccacgaccatcgtcaatgacctccagggactggtcggcatgaaggataacttccacgcgtttggcgtggcctgccagcgcttcatccacactgttatcaataacttcctgaccaagatggttaggacgagtggtgtcggtatacatgcccggacggcggcgcaccggctctag

SEQ ID NO: 2056 - DNA, 651 bp, Klebsiella pneumoniae
cgggacgctgaccaccgaagtgtgccgcctggaaggcgccgcgtttcatccggatattgcttcagaaggctactgatggcgacgctcctttatctgcatggctttaacagctctccgcgctcggcgaaggcgacggcgttaaagacctggctggcgcagcactatccagagatcaccatggtggtgccggagttgccgccttacccggcggaaacggcggagctgttggagtccatcgtgctggagcacggaggcgagccgctgggggtcgtagggtcgtcgctgggcggctactacgcgacctggctttcgcagtgctttatgctgccggcggtggtggttaacccggcggtgcggccgtttgaactactaaacaattttctcggccacaatgagaatccatacaccgggcagcaatatgtgctagagtctcgccatatttacgatctcaaagtcatgcaaatcgacccgctcgaagcgccggatttactctggctgctgcagcagaccggggatgaagtgcttgattaccgccaggccgttcattactacgcctcttgccggcagacggtagaggagggcggtaatcacgcatttgtcggctttgacgatcatttcactcagattatcgaatttctcggcctgcgctaa

SEQ ID NO: 2057 - DNA, 525 bp, Klebsiella pneumoniae
tatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataa

SEQ ID NO: 2058 - DNA, 636 bp, Klebsiella pneumoniae
ccaaacgatgacctgatgccaaaattacgcctgattacttttactttgctcgcgcttagcgccgccacggcggttcacgcagaagaaaagcgctacgtttccgatgagctgaacacctgggttcgcagcggcccgggcgataattatcgtctggtcggcaccatcaacgccggggaagaagtgtcggtactgcaaacgaacgacagcaccagttacgcgcaaattcgcgacagcaacggccgtaccgcctggatcccgctgaaagagctgagcaacgagcccagcctgcgcacccgcgtcccggatctggaaaaccaggtcaaaacgctgaccgataagctgaataacatcgatgccacctggaaccagcgcacggcggatatgcagaagaaagtcgccggcagcgacagcgtgattaacgcgctgaaggacgagaaccaaaagttgaaaaacgagctggttgtcgcgcagaagaaggtgaatgcggcaaatctgcagcttgatgataaacagcgcaccattatcatgcagtggtttatgtacggcggcggtgtgctgggcgtcggtctgctgctcggtctagtgctgccgcatctggtgccaagccgcaaacgtaaagaccggtggatgaactaa

SEQ ID NO: 2059 - DNA, 1278 bp, Klebsiella pneumoniae
aattttcgcctgtatcggcggtgcgctggtacagaaaagcagattcatgttagtttagacgtccagacgtataaaaacaggttcgtcaacatggctgataaacatcttgataccgcgctggtcaacgccgggcggagcaaaaagtacacccagggctcagtgaacagcgttatccagcgcgcgtcatcgctggttttcgacactgtcgaggccaaaaagcacgccacccgcaatcgggccaacggcgagctgttctacggtcgtcgcggcaccctgacccatttctcgctgcaggaagcgatgtgcgagctggaaggcggcgccggctgcgccctcttcccctgcggcgccgcggcggtggctaacactatcctggcgtttgtcgagcaaggcgaccatgtgctgatgaccaataccgcctatgagccaagccaggacttttgtaccaaaattctcgccaaactcggcgtcaccaccagctggttcgatcccttaatcggcgccgatatcgcccgtctggttcgccctgagacccgcgtggtgttcctcgaatcgcccggctcgatcaccatggaagtgcacgatgtgccggcgatagtcgccgccgtgcgtcaggtcgccccggaagcgattatcatgatcgataacacctgggcggcggggatcctgtttaaagccctggattttggcattgatatttccattcaggcaggcaccaaatacctgatcggccattccgacgccatggtgggcaccgcggtggcgaacgcgcgctgctggccgcagctgcgtgaaaatgcctacctgatggggcaaatgctggacgccgatactgcctatatgaccagccgcggcctgcgcaccctgggcgtgcgcctgcgtcagcatcatgaaagcagcctgcgcatcgccgagtggctggcgcagcacccgcaggtggcgcgggtaaaccaccccgccctgcccggcagtaaaggtcatgagttctggaaacgtgatttcaccggcagcagcgggctattctcgtttgtgctcagcaagcgcctcaatgatgccgaactggcggagtacctcgacaatttcagcctgttcagtatggcctattcgtggggcggctttgagtcgctgattctcgccaaccagccggagcaaatcgctcacattcgaccggatgctgaagtcgacttcagcggcacgctgatccgcctgcacattggtctcgaaaatgttgacgatctgcaggcggatttagcagcgggcttcgcgcgtatcgtgtaa

SEQ ID NO: 2060 - DNA, 1851 bp, Klebsiella pneumoniae
caggctgtagacgatgccccgcgacgattaatcgtcgaggaagctacgcagcacttcagaacggctcgggtggcgcagtttacgcagcgccttcgcttcgatctgacggatacgttcgcgggtaacgtcgaactgtttacccacttcttccagcgtgtggtcggtgttcatgtcgataccgaaacgcatacgcagcactttcgcttcacgagcggtgaggccggccagcacgtcatgcgttgccgcgcgcaggctctcggtggtcgcagaatccagcggcagctcgagggtggtatcctcgatgaaatcccccagatgcgaatcttcatcgtcgccgatcggcgtttccatggagataggctctttggcgatcttcagcactttacggattttgtcttccggcatcagcatacgctcagccagctcttccggggtcggttcacggcccatctcctgcagcatctgacgggagatacggttgagcttgttgatagtctcaatcatatgcaccggaatacggatggtgcgcgcctgatccgcgatagagcgggtgatggcctgacggatccaccaggtggcgtaggtcgagaacttgtagccacgacggtattcgaacttatcgaccgctttcatcagaccgatgttgccttcctgaatcaggtcgaggaactgcagaccgcggttggtgtatttcttggcgatagagataaccagacgcaggttcgcttcaaccatctctttcttcgcacgacgggctttcgcttcgccgatggacatgcgacggttgatatctttaacctgctcgatggtcaggccggtctcttcttcaatctgctgcagcttctgcaggccgcgctgcacatcttctttcacttccagcagcttctcagaccacggcttgttcattgccaccgcggcgttgaaccaggtctcgctggtttcgttgccggtgaacagggtgatgaagtttttcttcggcattttgcactgctcaacgcacagcttcatgatgatacgttcctgagtacgaacgcgatccatcatgctgcgcatgctgttgaccaggtaatcgaactgcttcggcaccaggcggaactgcttgaagacttcagacagcttcaggatctcttcctgggcggcggcatggctacgacctttggctttgatggtgtcgcgcgtcagctcgtactgggtacgcagctcggcgaatttctcacgggccagctctgggtcgatgctgttgtcgtcatcgctgttgtcgtcggcgtcttcatcttcgtcttcgtcttcgtcgtcatccatctcttcctgagacagctcggagccaacgtgggtggcggttggcgccatatcttcttcggcgttcggatcgacgaaaccggtgatcagatcggacagacgggcttcttccgcttcaacgcggtcgtactgctcaagcaggtaggtgatcgcttccggatattcggcaacggagcactgcacctgattgatgccgtcttcgatgcgtttggcgatgtcaatttcgccttcacgggtcagcagctctacggtacccatttcacgcatgtacatacgcaccgggtcggtcgtgcgcccgatttcggattccacgctggagagcacctgcgcggcggcttcggcagcatcttcatccgcggtgttttcggcaagcatcagatcatcggcatccggtgcttcttccatcacctgaatacccatgtcgttgatcatttggatgatgtcttcgatctgatcggaatcgacgatatcttccggcagatggtcattgacctcggcataggtcagatagccttgctccttaccacgttggacaagaagcttcagctgtga

SEQ ID NO: 2061 - DNA, 522 bp, Klebsiella pneumoniae
aactatgcagacccctgcgccgtgggaacaggaagaatgatctcggcaccagaaccgcttcatgccgggcatattcttaccccgttttgctgcggtatagattccatggatcactggctgaaacagcgggcgatgaaaaatcaggttactggcgcatcccgcacctttgtctgctgcgacgacgcgaaggtgatggcttactactcactggcttccagcgctgtgacgacaaatactgcgccgggtcgttttcgccgcaatatgcctgacccgatcccggttgtggtactgggtcgtctggcggtggataaatcactacatgggaaaggtgtcgggcgggccctggtacgtgatgccgggctgcgtgtgattcaggtggcggagactatcggcattcgcgggatgctggttcacgccctgtcggatgaagcacgggatttttacctgcgggtggggtttgagccgtcgccgatggatccgatgatgttgatggtgacgttgagggatttggttaatgcctga

SEQ ID NO: 2062 - DNA, 810 bp, Klebsiella pneumoniae
caccctaaggatatcatcatgtcccgtacccgaatgcccgcgttgtttctcggccatggcagcccaatgaacgtgctggaagacaaccgttatacccgcgcctgggctcaactgggcgaaaccctgccgcgtccgaaagcgatcgtggtggtctctgcgcactggtttacgcgcggtacgggcgtaacggcgatggaggcgccgaagaccattcatgacttcggcggttttccgcaggcgctgtatgacacgcattatccggcgccgggctctccggcgctggcgcaacggctggtggagctgctctcgccggtgccggtcaccctcgatacagaagcctggggatttgaccatggctcgtggggcgtgctgattaaaatgtatccgcaggcggatatcccgatggttcagttgagcatcgacagcaccaaaccgccggcctggcatctcgaaatggggcggaaactggcctcgctgcgtgatgaaggcgttatgctggtggccagcggcaacgtggtgcataacctgcgcaccgcccgctggcatggcgagaacacgccgtacccttgggcagagtccttcaataactacgtgaaggcgaatctgcaatggcaggggctggacgagcagcacccgatggttaactacctggcacacgaagggggctcgctctccaacccgacggcggagcatttcctgccgctgctgtatgtcctggggacgtgggatggcgttgaggcgatggcgatcccggtcgatggcatcgagatgggctcgctgagcatgctgtcggtgttggttggcgcctga

SEQ ID NO: 2063 - DNA, 657 bp, Klebsiella pneumoniae
aacccaatactctcgattattccgttcctaggagaagccatgaactcttataaacacccgctgcgcgtcggcgtcggcggcccggtcggttccggtaaaaccgctctgctggaagcgctgtgtaaagcgatgcgcgatacctggcagctggcggtggtcactaacgacatctataccaaagaagatcagcgcatcctcaccgaagcgggcgcgctggcgcctgaacgcatcgtcggtgtggaaaccggcggctgcccgcatacggcgatccgcgaagatgcctcaatgaacctcgccgccgtggaagcgctgagtgaaaagttcggtaacctcgaccttatcttcgtggaaagcggcggcgataacctgagcgccaccttcagcccggagctggcggatctgaccatctacgtcatcgatgtggccgaaggggagaagatcccgcgcaaaggcggaccggggatcaccaaatccgattttctggtgatcaataaaaccgaccttgccccctatgtgggcgcgtcgctggaggtgatggcgagcgatacccagcgtatgcgcggcgatcgcccatggaccttcaccaatctgaagcagggcgacggcctgagcaccattatcgccttcctcgaagacaaaggcatgcttggcaaatag

SEQ ID NO: 2064 - DNA, 234 bp, Klebsiella pneumoniae
tgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatga

SEQ ID NO: 2065 - DNA, 876 bp, Klebsiella pneumoniae
acgataccgtgttcctggtttttttcattttacttttttaaagggtttaattggatgagcgatatacactcgctgctggtggcggcaatattgggtgtggttgagggtttgacagagtttttacctgtttccagtaccggtcatatgattattgttggtcacctgctggggtttgaaggtgataccgcaaatacctttgaagtggtgattcagttaggttcgatactcgccgtggtggtgatgttctggcgtcgcctgttcggcctgatcggcatccatttcgggaaaccgccggcgcatgaaggccagggcagcggccgtttgtcgcttatccatatccttctcggcatgatccccgcggtggtgatggggctgattttccatgacaccattaaatccttgtttaacccggtgaacgtgatgtacgccctgattgtcggcggcgtattgctgattgcagcggaagtgctgaagccgaaacagccgcgcgcggtcgggattgacgatatgacctaccgtcaggcgttcgtcatcggctgctttcagtgcctggcgctgtggccaggtttctcccgctcgggggcgactatctccggcggcatgctgatgggcgtcagccgctatgcggcctcggagttctctttcctgctggcggtaccgatgatgatgggcgccaccgtgctggacgtctacaagagcatcggcttcctgaacatgggcgatgtcccgatgttcgccgtcggcttcgtgatggcgtttatcgtggcgctgattgcgattaaaaccttcctgcagctgatcaaacggatctcgttcattccgttcgctatctaccgctttatcgtcgcggcagcggtgtacgtggtcttcttctaa

SEQ ID NO: 2066 - DNA, 429 bp, Klebsiella pneumoniae
tcaactgggtgtggccgccggaaaccagcagcgcgacgaacgggaacgccggcggattatcttccagcatcggcgccagcagatgcccttccatatggtgtaccgggatcgccggcacgttccaggcgaaggccagcgcccggccaacggtcgccccgaccagcagcgcgccgaccaggcctggacccgccgtataggcgacggcgtcgatatctttcgccgtcagaccggcttctttcagcgccgcctggatcagcggcaccgttttgcgcacgtggtcgcgcgatgccagctccggcaccacgccgccgtaatccgcatgcagtttcacctgactatacaattggttggctaacagaccttgctggtcgtcataaatcgcgatgccggtttcatcgcaggatgtttcaatgcccagtacacgcatga

SEQ ID NO: 2067 - DNA, 1026 bp, Klebsiella pneumoniae
gctttcattcggagaactatcatggaaaacattgcgctcattggtatcgatctgggtaaaaactctttccatattcattgccaagatcgtcgcggcaaggctgtttaccgtaaaaaatttacacggccaaagttaatcgaatttttggcgacatgccccgctacaaccatcgcaatggaagcctgtggtggctctcactttatggcacgcaagttggaagagttggggcattttcctaagctgatatcaccacaatttgtccgtccattcgttaaaagtaacaaaaacgactttgtcgacgccgaagctatttgtgaagctgcatcgcgtccgtctatgcgttttgtacagcccagaactgaatctcagcaggcaatgcgtgcgctgcatcgtgtccgtgaatccttggttcaggataaggtaaaaacaaccaatcagatgcatgcttttctgctggaatttggcatcagcgttccacgaggagctgccgttattagccgactgagtacccttcttgaggacaatagtttgcctctatacctcagccagttattgctgaaattacaacagcattatcactatcttgttgagcagattaaagatttggaatcccagttgaaacgaaagttggacgaagatgagattggacagcgcttgctgagcattccctgcgtcggaacactgacagcgagtactatttcaactgagattggcgacgggaagcagtacgccagcagtcgtgactttgcggcggcaacagggctagtgcctcgacagtacagcacgggaggtcggacgacattgctgggaattagtaagcgaggtaacaaaaagatccgaactttgttggttcaatgtgccagggtattcatacaaaaactggaacaccagtctggcaaattggccgattgggtcagggatctactgtgtaggaaaagcaactttgtcgtcacttgtgctctggcaaacaagctggccagaatagcctgggccctaacggcacgacagcaaacttatgtagcataa

SEQ ID NO: 2068 - DNA, 525 bp, Klebsiella pneumoniae
cagaccttgctggtcgtcataaatcgcgatgccggtttcatcgcaggatgtttcaatgcccagtacacgcatgagttgttttacctcgcttcaataccgcgcagtgtaggtccaatgaccggcgatgtaaaactttgctcacccctggtgctctcttcgtgtatactcctcacccttataaaagtccctttcaaaaaaggcgccggtgctttacaaagcagcagtagttgcagtaaaattccgcaccattttgaaataagctggcactgcggccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgactaccgaacgtaagcgcgctaaagcttctgcagtgaaacgtcacgcgaagaagctggctcgcgaaaacgcacgccgtactcgtctgtactaa

SEQ ID NO: 2069 - DNA, 1560 bp, Klebsiella pneumoniae
acgccgttccggaaaaggcctgaggagatgcgaaatatgaccccttctgaataccagaatcctatcttatgcgccgattattccgacccggatatcgtgcgcgtaggcgatgatttctttatggtctcttccagttttaaccatgtgcccgctttaccgatcctgcattcaacggacctggttaattggactatcatcaaccacgttatggatgaactgccgctacctggttatgaccggtatcagccgggtaagggcgtatgggcgccgtcgattcgctggcacgatggcaagctgtgggtctgcttcagcacgccagatgaaggtatttttatctgccataccgaggatccgtggggggaatggagcgctccgcactgcctgcgcgaggccagaggttggatagatccctgcccgttctgggacgacgatggtcaggcctggttggtacatgccttcgcccatagccgcagcggcatcaagcataaactgcagttgtttgcgatggcgccggacgccagcgaattgctgggcgaagggcagattatctatgacggctgctgcgatttacctacccttgaggggccaaaggtttatcaacgcgccggttggtactacatctttgctcctgcgggcggggttgaaaatggctggcagacggtactgcgcgcgcgccagatgacggggccctgggaagccaaaaacgtgcttttccagggaaacacctcgataaacggaccacatcagggcggctgggtggagggtgaggagggcgaatgctggtttgttcatttccaggacttacacctctatggccgcgtggttcacctccagccgatgtcctggggtaacgatggctggccgcgtatcggtgagcagattggcaactgcggcgtcggacagccggttttacgttggccgcgtcctaaagggttaacgccttcaccggcaatggcgccgcaaaccagcgactattttgcgcaaggccaaccgggaatacagtggcagtggcaggctaaccccagccctgagtggctgctgccggcggaaggcgaacttcgattacgctgcgtcccattatccgaagtcgatggacagagagcgttatactgggcgccgcagctgttgctgcagaaattcccggcgctaacttttagcgcgaaaacaagcgtaacgttatatgccgctcaggacggtgatgccggaggcctgatcgtatacggcgaacgctacgccgctttgctggtggagtttgggcaagggggttaccggctcgtgtggcgacacggttggatgagcgatgcgggcgtggtgcgcgaaactcgtcaggttcttgctgagcttaagtgcggcaagtgtcagctgcaggtggccgtaggcgaaggcggcctgtgtcaattttcctggcgagccgaggaggagtggcggaaggttcctctttgttttgctgccgggaagggaaaatgggtcggcgcgaaatttggcctgctggctgcttcaatggttggcctacaaagcgagggctactccgctttgcaggactttgaggtcatactttaa

SEQ ID NO: 2070 - DNA, 303 bp, Klebsiella pneumoniae
tcaatcatccgacccgagcaggaaaccaccatgattgacccgaaaaaaattgaacaaatcgcccgccaggtccatgagtcgatgccaaaaggacttcgcgatctgggtgaggatgttgagaagaaaatccgccaggcgctgcagtcgcagctgacccgtctggatctggttagccgcgaagagtttgatgtgcagactcaggtgctgctgcggacccgggaaaaactggcgctgctggagcagcgcctgaatgacctcgaaaaccgcccggcggcgacgccgggcagcgaagagcagcagtaa

SEQ ID NO: 2071 - DNA, 690 bp, Klebsiella pneumoniae
tcaacaatacggtaccacttaggaaagtccatggttgtcattcaagagattgtcgccgcgctgtggcaacatgattttgccgcattggcgaaccctcacgttgtgggcgttgtatatctggttatgttcgcgaccctgtttctggaaaacgggctgctgcccgcctcctttttaccgggagacagcctgctgctgctcgccggcgcgctgattgctaaaggcgtcatggactttgtgcccactatcgccattctgaccgccgccgccagcctcggctgctggctgagctatgtgcaagggcgctggctgggcaatacgcaaacggtgaaaggctggctggcgcatctgccgcataagtaccatcagcgcgccacctgcatgtttgaccgccacggcctgctggcgctgctcgcgggccgttttctggcgtttgtccgcaccctgctgccaaccatggccgggatttctggcctgccgaaccgccgcttccagttcttcaactggctgagcgccctgctgtgggtctgtgtggtgacgggtcttggctatgcgctgagcatgatcccgtttgtgaagcgccatgaagatcaggtgatgacctgtctgatgatcctgccgattgccctgctgctggctggcctgctcggcacgctgttcgtggtcattaaaaagaaatattgcagcgcctga

SEQ ID NO: 2072 - DNA, 1914 bp, Klebsiella pneumoniae
  unsure (1300),(1329): Identity of nucleotide at the above locations are unknown.
gcggcgatacggatttgttcgaccagcaccacttcgtcgcgcaccgggtcaaagggtagcaagacggcggcgtgcccgcgctcaaaaatttcacgggtgatttcgccactcatgccgccgttaaacaggcggtggcgaaaacggtataaatcgagcgaaaaaaaaccacgatatagcgtttcgcgtgcaataatttatacatcatttttggagaaggtaattccctgctgcgtgggtttgctcattgtcatgtcctgcgaatctgaaattagggatttccaaaccgtttggctaccgttttacggtccgtatgttagattggtgcaaattaccgccggatggcacgtaacgccaactttttacggcggcagaatcgatacaatcagcggaatttttcttagaattagaccagcgctaaatgcttcacaacaaggaatgcaaatgaagaaattgctccccattcttatcggcctgagcctgaccgggttcagcgccatgagccaggcggaaaacctgcttcaggtttaccagcaggcacgcatcagcaaccccgatctgcgtaaatcggcagccgatcgtgacgccgcgttcgaaaagatcaacgaagcgcgcagtccattactgcctcagcttgggctgggagcggattatacctataacaatggctatcgcgacagcaacggcatcaattcaaacgtcaccagcggctcgctgcagttaacgcaggttctgtttgatatgtcgaaatggcgcgccctgacgctgcaggaaaaaacggcagggattcaggatgtcacgtatcagaccgatcagcaaacactgattctgaataccgcgacggcttattttaaagtgctggccgccatcgacacgctttcctataccgaagcgcagaaacaggctatttaccgccagttggatcaaaccacgcagcgctttaacgtaggcctggtggcgatcaccgacgtgcagaacgcccgttcacaatacgatgccgtgctggcgaacgaagtcaccgcgcgtaacgatctcgacaacgccgtcgaagaactgcgtcaggtcaccggtaattactatccggagctggcctccctgaacgtgaatggcttcaaaaccaacaagccgcaggcggtcaacgccctgctgaaggaagcggagaaccgcaacctgtcgctgctgcaggcgcgtctgaaccaggacctggctcgcgagcagattcgccaggcgcaggacggccatttgccgacgctcagcctatccgcgtcgagtgggatatcgaatactagctacagtggttcanaaacccataataatcctcagcaaatacangataacgatgccgggcagaaccaaatctgcctgaaattctctctgccactgtatcagggcggcgcggtgacctcgcaggtcaaacaggcgcaatacaacttcgttggcgccagcgagcagctggaaagcgcccaccgcagcgtcgtgcagactgtgcgttcatcgtttaacaacgtgaacgcctccatcagcagcatcaacgcctacaaacaggcggtggtctctgcgcaaagctccctggatgccatggaagctggctactcggtgggtacgcgtactatcgttgacgtcctcgacgccaccactacgctgtataacgctaagcagcagctctcgaatgcgcgctacaactacctgatcaacgagctgaacattaagtcggcgttaggtaccctgaacgagcaggatctggtcgccctgaacaacacgctgggtaaacccatctccacctccgcagatagcgtcgcgccggaaaatccgcaacaggatgccaccgctgatggctacggcaacactaccgcggcggtgaagccggcgtccgcacggaccacccagagcagcggcagcaatccgttccgtcagtaa

SEQ ID NO: 2073 - DNA, 582 bp, Klebsiella pneumoniae
attattgcacgcgaaacgctatatcgtggttttttttcgctcgatttataccgttttcgccaccgcctgtttaacggcggcatgagtggcgaaatcacccgtgaaatttttgagcgcgggcacgccgccgtcttgctaccctttgacccggtgcgcgacgaagtggtgctggtcgaacaaatccgtatcgccgcctatgataccagcgagagcccttggctgctggagatggtcgccggcatgattgaagcgggtgaaacggtggaagatgttgcccgtcgggaagcgctggaggaggccgggcttgaagttgggcggacgaaaccaatattaagctatctggccagtcccggcggcaccagcgaacggttatcgatcctggtgggagaagttgatgcatcgacggcaaaaggcattcacggcctggccgaggaaaacgaggatattcgggtgcatgtggtgagtcgggagcaggcttaccagtgggtagaagaggggaaaatcgacaacgcagcctctgtcatcgccttgcaatggctgcaattgcattatcacaatttacgaaatgagtggacaaaatga

SEQ ID NO: 2074 - DNA, 1542 bp, Klebsiella pneumoniae
tctggacaacgaagtggccgagcgcgaagcggctggaaagcaataagacaggaaacgccgccaacgcgcgcgtattgctggcgggaaacgaattccctttttcatttgtcagtatgtcatggagttaatatgtcactcagtcggcgtcagtttattaaggcttccggcgtagcgctgtgcgctggcgccgcgccgctgaaggcccatgccgccggccagcagcctgcgctgccggttccgccgctgctggaatctcgtcgcggccagccgctgtttctgacgctgcagcgttcccactggtcgtttacccccggcacccgcgcccccgtctgggggatcaatggccgctatatggggccgacgatccgcgtctggaacggagacgacgtcaagcttatctacagcaaccgcctgacggagaacgtggcgatgaccatccgcggtctgcaggtgcctggcccgctgattggcggcgcggcgcgcatgatgtcgccgaacgccgactgggcgccggtgctgcctatccgccagagcgcggcgacgctgtggtatcaggccaacacgccgaaccggatggcgaaacaggtttacaacggtctggccggcatgtggctggtggaagacgaggtcagcaagaacctgccgatccctaaccactatggagtcgatgacttcccggtgattattcaggataaacggctggataacttcggcacgccggaatatagcgaaccgggcagcggcggctttgtgggcgacacgctgctggttaacggcgtgcagagcccgtatgttgaagtgtcgcgcggctgggtgcgcctgcgcctgctgaacgcttccaactcccggcgctatcagctgcagatgagcgatggccgactgctgcatgtgatttccggcgatcagggattcctgccggcgccggtttcgctcaagcagctatcgctggccccgggggagcggcgtgaaattctggtcgatatgactaacggcgatgaagtatccattacctgcggcgaagcggcgagcatcgtcgaccgtatccgcggtttttttgaaccgtcaagcatcctggtctccacgctggtgctgacgctgcgtccgaccgggctgctgccgctggtgaccgacagtctgccggtgcgcctgctgccgaccgagctgctctccggtacgccgatccgcagccgggatatcacccttggcgacgatccgggcatcaacggccagctgtgggatccgcagcgtatcgatatcacggcgcagcaggggacctgggagcgctggacggtgcgcgccgaccgcccgcagtcgttccatattgaaggggtgatgttccagatccgtaatgtcaacggctcgtctcctttcccggaagatcgcggctggaaggacaccgtgtgggtcgacgggcaggttgagctgctggtctattacgctcaaccgtcgtggccgcacttcccgttccagtatctgagtcagacgctggagcttgccgatcgcggctcgatcggccagatgctggtgaatcccgcgccgtaa

SEQ ID NO: 2075 - DNA, 1353 bp, Klebsiella pneumoniae
cgcatgaaacgacttgcccgcctgagcctgcgcctgcgcctgacgctgctgtttgccgtactgaccaccgccgcctgggggatggccagcgttatcgcctggcagcagaccagcaaaaagctggataagctgttcgatacccagcagctgctgttcgctcgccgcctgagcgtcatgcatttcgatgaactgcgcgccccgcccgccttgctcggggaaaagaaaaaggtacgccacgggcacatcgacgacgacgcgctggcgttcgccatcttcacccgcgacggcaaaatggtgcttaatgacggcgagaacggagaggatattcagtggaattcgcagcgcgagggattcagcgatggctatctgcgtgacgacgatgacgagtggcgtttcctgtggttaaccaccgccgacggccgctaccgcatcgccgtcggccaggagtgggattaccggcgcgaaatggcgatggatatcgtgacctcgcagctcaccccgtggatggttgccctgccgctgatgttcgtgctgctcatcgtgctgttaagccgcgagctggcgccattgaaaaatctggcgcgcacgctgcgcctgcgcgcgccggactcggcggattcgctcagcgtggagaagatccccgccgaagttcgcccgctggtcgaagcgctgaatcagctgttccgacgcactcacgacgccatgctgcgcgagcgtcggtttacctctgatgccgcccatgagttacgcagcccgctggcggcgctgaaggtgcagaccgaagtcgcccaactctccctggacgatcccgaagggcgtgagaaagcgttggatcagctccaccaggggatcgatcgcgccacccgactggtggatcagctgctgacgctgtcgcggctggactcgctcgcccaactggatgatgtgcagcaggtcgctatcgccgatctgctgcagtcggcagtgatggagatgtatcacccggcgcagcagtccgggattgagctgcgcctgcatcttaatgccagccatatcgtccgcaccggccagccgctgctgctcagtctgctggtgcgcaatctgctggataacgccgtacgctatagccctcgcggcagccaggtcgatatcacgctcaacgcccgcgagttccgggtgcgcgataacggcccaggcattagcccgcaggcgctctcgcgcattggcgagcgtttttatcgtccgccggggcaggaggcgccgggcagcggcctgggcttgtcgatcgtccggcgcatcgcctcgctgcacggcatgcaggttgattttgccaacgcgcgcgacggcggcttcgaggcccgcgtgtactggtag

SEQ ID NO: 2076 - DNA, 210 bp, Klebsiella pneumoniae
aggagtatgcgcatgaaccataacgatatgtattcaatgaagaattttgattttttggcgcggagtttcgccagaatgcacgcccagggccagccagttgatcttcaggccattgtcggcaatatggatgaagaacatcgtgaatggttttgccagcgctatgaactgtactgtcgccaggtgagtagtcaggcggaagccgcccattaa

SEQ ID NO: 2077 - DNA, 537 bp, Klebsiella pneumoniae
tcatgttttagccatacagccggagaaaacatgattagcgatatccttgcgccgggcctgcgcgttgtcttttgcggtatcaacccggggaagtcctccgcccataccggctttcattttgcccatcctggcaatcgcttctggaaggtcatccatcaggccgggttcaccgatcggcagctcaggccggaagaggagctgcagctgctggatacgcgctgcggcatcaccatgctggtagagcgtccgacggtgcaggccagcgaggtcgccttgcaggagttacgcagcggcggccgtgagctggtacgtaaaattgaggagtatcagccgcaggcgctggcggtgctcggcaagcaggccttcgagctggcctttaaccagcgcggcgcgaagtgggggaaacaggctatgaccatcgggacgacccaggtgtgggtgctgcctaatcccagcggcttaaaccgggcgacgctcgataagctggtggcggcctatcgtgaactggacgatgccctggcaacccgcggccagtag

SEQ ID NO: 2078 - DNA, 927 bp, Klebsiella pneumoniae
ccagaggttagcaatatggacaaattacgagggatggagacgtttattgccgtggtggagtgcggcagctttaccggggcggcgtcgcgcctggggctgtcggcggtgatggttgggaaatatatcgcccagctggaaagccagctggcgacgcgtctgctggagcgtaacacccgacgccagagcctcaccgacgccgggcgagtctattttgacgaagcgaaacgggtgatggagcaggtctccatcgccgaaagcgcggtcgagcggctgcggctggcgccggccggcaccctgcgggtgagcgctcccacctcgttcggcgccagcgtgatcgcgcccctgaccgccaacttcctgcaggcctggcctgcggtccgggtggaactggatctgactaaccggatggtcgatctggtggatgaggggttcgatctggcgatccgtatcggcgagatccatcaggaggatctggtggctcgctacctggcgccgtatcggatggtgatctgcgccgcgccggcttatctggcgcgttacgggacccccgggacgccagaggatctcgccgatcatctctgcctgtcccatacggtctggaccgcccgcaacgagtggcggctgccgggcgtagagggagaagtgcgctggaaacgcgatgcggttttgcgctgcaacgatggctacgcgctgcgccaggcggcgatcgccggggccgggctgctgatgcagccggaggtactgctggccgatgcgctggccagcggcagcctggttcgggtgctggaggcgtggactccgcagccgcggcctgtgcatctgctctggcgccaggatcgtcggcccctgccgaagctgacgcagtttatcgcccaccttcagcagggaatggccgacgcgctgacaacgacccgcgcgtcggaataa

SEQ ID NO: 2079 - DNA, 777 bp, Klebsiella pneumoniae
cctttggccagctgccgttcgagccggaagccggcgcttacgccagcgagagccacggtcatcatcatgctcatcatgaccaccacgctcacagccactagcatgtcgacagcggaacaacgcctgcggctgatgcagctggccagcagcaacctgccggtagggggttacagctggtcccaggggctggagtgggctgtggaagccggctgggtgccggacgtcgcggccttcgagcgctggcagcgacgccagatgacggaaggcttttttaccgttgacctgccgctgttcgcccgcctgtaccgcgcctgcgaacaaggcgatatcgctgcggcccagcgctggaccgcctatctgctggcctgccgggaaactcgtgaactgcgggaggaagagcgcaaccgcggcgcggcgtttgcccgtctgctgagcgactggcagccggactgtccgccgccgtggcgctccttgtgccagcaaagccagctcgccgggatggcctggctcggcgtgcgctggcgtatcgccctgcccgagatggccctcagcctgggctatagctggattgagagcgccgtgatggccggcgtcaagctggtccccttcggccagcaggccgcccagcagctgattttacgtctttgtgaccactacgcggccgagatgccccgcgcgctggccgcgccggacggcgatatcggatcggccaccccgctcgccgccatcgcctctgcccggcatgaaacccaatactctcgattattccgttcctag

SEQ ID NO: 2080 - DNA, 405 bp, Klebsiella pneumoniae
ctaaaaagcaggcagggcgtgatggatattgtatttatagagcaactttcggtaatcaccaccattggtgtttatgactgggaacaaaccattgagcagaagctggtgttcgatatcgaaattgcatgggataaccgcaaggcggccgccagcgatgatgtcagcgattgcctcagctatgctgatatcagcgagcgcgtgatcgcgcatgtggagggggggaaatttgcgttagtggagcgggtggcggaagaggtggccgacctgctgctggaaacattccagtcgccatgggtgcgcataaaagtcagcaaacctggcgccgtggctcgcgcggcaaacgtcggggtgattattgaacgtggccttaatctgaaacaaaacttttcaggtcatacttgttaa

SEQ ID NO: 2081 - DNA, 1209 bp, Klebsiella pneumoniae
cgccgcaggctcaacgtcctcttctcgctcaatgggcggctaagcaacatggaaagagtcagtattaccgagcgcccggactggcgcgagaaagcgaccgagtacggtttcaacttccataccatgtacggcgagccctactggagcgaagaggcgtattacaagctgaccctcgcgcaggtggaaaagctggaagcggtcaccgctgagctacatcagatgtgcctccaggtggtggaaaaagtgatcgccagcgatgagctgatgaccaaattccgcatccctaaacacacctggggttttgtgcgccagtcgtggaaaaccaaccagccgtcgctctactcacgtctcgacctggcctgggatggcgtcggcgaaccgaagctgctggagaacaatgccgacaccccgacctcgctgtatgaagcggccttcttccagtggatctggctggaagatcagctcaacgccggcaagctgccggcgggcagcgaccagttcaacagtttgcaggaaaagctgatcgatcgcttcggcgagctgcgcgagcagtttggctttcagctgctgcatatggcctgctgccgcgataccgttgaagatcgcggtaccgtgcagtatctgcaggactgcgccgctgaagcggggctggcgacggaattcctctacgttgaagatatcggcctgggcgaaaaaggccagtttaccgatctgcaggatcaggtgattggcaatctgttcaagctctatccgtgggagtttatgctgcgggagatgttctccaccaagctggaagacgctggcgtccgctggctggagccggcgtggaaaagcattatctccaacaaggcgctgctgccgatgctgtgggagatgttccccaatcaccctaatctgctggcggcctacttcagcgaagatactcacccggagatggagaagtacgtcattaagccaatcttctcccgcgaaggtgctaacgtgtcgatcgttgaaaatggcaaagtggtagaggcagtagaaggcccgtacggggaagaaggcaccatcgtgcaggcgttttacccgctgccgaagtttggcgatagctatacgctgattggcagctggctcatcaacgaccagcctgcagggatcggtattcgcgaagaccgggcgctgatcacccaggatctgtcgcgcttctatccgcacattttcgtcgaataa

SEQ ID NO: 2082 - DNA, 1089 bp, Klebsiella pneumoniae
gtcctccaaagagtaaaaccgtcgacagggacgataccgctgcccgatgaaggttattgtggtcctggcgccgttgaccctcaatgcacatttctgccgatgtcttgcctatttctccatatggctggagaatttgtagcggcctgcgcacaatgtacaggtgaagaaacatcgggagagacggtggcaatgcaacacgcagagatatgtcggacattaacggagaagattaacctgctgaaagataagcacgaaatgttaagttcgttgctgcctgacgtccgtttgctgtacggaacgcaaccggggccccggacgccggtgatgtatcagccggggatcgtttttctcttttcgggccataaaattggttatatcaatgaacggacttttcgctacgatacaaacgaatatttactgttgaccgtgccgctacctttcgagtgcgaaacctttgccaccccggaggtgcccctcgccgggatgcgcctgaacgtcgatatcctgcaactgcaagagctgctgatggatattggcgaagatccgctgtttcagcccgcggtcgcctccagcgggataaactccgcggtactctcagaggatattctgtgcgctgccgaacggctgcttgacgtgatggagcggccgctggacgcacggatccttggcaagcaaatcgtccgcgaaattctgtattatgtgctgacggggccctgcggcggcgcgctgttggcgctggtcagccggcagacccacttcagcctgataagccgcgtgctcaagcatatcgaaagccagtacaccgaaaacctcagcgtcgatcggctggcggcggaagcgaatatgagtgtgtcagcgtttcaccataattttaaagcggtgaccagcacttctcctttgcagtatctgaaaaactaccgtttgcacaaagcacgaatgctgatgatccatgacggcatgaaggccagcgcggcggcgatgcgcgtgggatatgaaagcccttcgcagttcagccgcgagtttaagcgctacttcggtttgacgccgggagaagacgccgcgcgtattcgcacgatgcaggggatgtaa

SEQ ID NO: 2083 - DNA, 744 bp, Klebsiella pneumoniae
gcggaaaaaagaaattttaatgctgtacatcacccgcttcaacgcggtttactgcgcaaagaaacgggatcgtcggagggaaacatgcgcatattactggtggaagatgacaagcttatcggcgacggcatcaaagccgggctgagcaaaatgggctttagcattgactggtttaccgccgggctggagggcaaaaatgccttatacagcgccccctacgacgccgcaatccttgacctcaccctacccggcatcgatggcctcgatattctgcgcgaatggcgcgataaaggccgccatgagccggtgctgatcctcaccgcccgcgatgccctcaaccagcgggtggagggcctgcgcctgggcgccgatgactacctgtgcaaacctttcgccctgattgaggtggcagcgcgcctcgaagcgttgatccgccgcgcgcacggccagagcagcagcgaactgcgccacggcaaggtgatcctcgatccgaaccgcttaaccgccagcctcgacggcgaaagcctggcgctgaagccgaaggagttcgccctgctggaactacttatgcgcaacgccgggcgcgtattgccgcgtaagcttatcgaggaaaagctctacacctgggacgacgaggtctccagcaacgccgtggaagttcacgtccatcatctgcgccgcaagctcggcagcgactttatccgtaccgtccacggcatcggctataccctgggtgacgcatga

SEQ ID NO: 2084 - DNA, 1347 bp, Klebsiella pneumoniae
actcggcgaagcaggatccgccgaggggtagcattaagtctggacgaaatagctaaaaacggtagtaaaaacacctctccccggcgtttgtttaacgtaaggagaggtgaatcaggcggggagcgcttagcgtgcagcctcgtaaatacggcggctgacgtccagggtgatatcctgatgttcgccaagtttagtcatgccgtgctcttccagtttcgccagcagcgccgggatggagctaccgtcgagaccgtaatcggaaaggcgggtcggcacgcccatctgctcgaagaactgacgcgttgcggcgatggcggcatcgatacgttggtcgtcagagccttcggtaatattccacacgcgctcggcatactgcagcagcttctcgcgcttggcatcgcgtttctcattccacagcgccggcagcacgatagccagcgtctgggcgtgatccaggccgtgcatcgccgtcagctcgtggccgagcatatgcgtcgcccagtcctgtggcacgcctgcgccgatcaggccgttcagcgcctgcgtcgccgcccacataatattggcgcgcacgttatagttctccggttcctgcagggctttcgggccatcctcgatcagggtcaggagaatgccttcggcgaaacggtcctggattttgccgtctaccgggtaggtcacgtactgctcgacggtatggacgaaggcgtcaaccacgccgttcgcgacctggcgcggcggcagggtataggtataaaccggatcgaggatcgcgaactgcggctggacgtgcgaagacataaacgcgcgtttgtcgccggtggttttccgcgatatgaccgcgcctttgttggattcagaaccggtcgccggcagagtcagtaccgagcccattggaatggcgctggcaattttgctgccataggtttccagaatttcccacggatcgatatccgcgtcgtagtgggctgctgcagcgataaacttggtgccatccagcaccgaaccgccgccgaccgccagcaggaaggtcactttctcttcccgggcgagtttcaccgcattcatcagggtttcgtaagacgggttcggctcgatgccgccaaattcaaggacatccagtccattcagagcggtgaggacctgatccaggacgcctgtttttttgacgctgccgccgccgtaggtgatcagtacgcgggcttccgccgggatctgttcacgcagcttttcaatcgcgcctttgccaaacagaatgcgggttggggtatgcaggtcgaaattattcattgcttaagtcctccaaagagtaaaaccgtcgacagggacgataccgctgcccgatga

SEQ ID NO: 2085 - DNA, 1866 bp, Klebsiella pneumoniae
atgagcaaaggatcgacaagcagtgacgccccgtttgggacattgttaggctatgcacccggtggcgtagcgatttattcatcgaattacagtagcttaaatccgcaggactacccggatgacgcgacgtttcgcagctacatcggcaatgagtatatggggcataaatggcagtgcgtggagtttgcgcgccgctttctgttcctgacctatggctttgtcttcaccgatgtggggatggcttatgaaatcttctccctgcgtttcctgcgcgaagtggtcaatgacaatattctgccgctgcaggccttcgccaacggctcccgccgtccacctatcgctggttcgctgctgatctggcagaaggggggcgagtttaagcacaccggccatgtggcggtgatcacccagcttgtcggcaataaggtgcgtatcgccgagcagaacgtgattcactcgccgctgccgcagggccagcagtggacccgcgagctgaccctcgaggtcaacgacggccggtacaccatcaaagatacctttgccgataccgaaattttaggctggatgatccagaccgctgataccgaacacagcctgccgcagccggtgctgccgggcgaggcgatggccatcaaaggcgcgcggctgccaaacaacggccagtttcgcggtaaatggctgaacgagaaagacccgctgcagaaagcctatgtggcagccaacggtcatttcatcaaccaggatccctatcagtatttcaccatcagcgaaagtgccgaacaggagctgatcaaagccaccaacgagctgcacctgatgtatctgcacgccaccgataaggtgatgaaggatgacaacctgctggcgctgttcgatattccgaaaattctctggcctcgtctgcgcctctcgtggcagcgccgccgtcatcatatgatcaccgggcgcatggatttttgcatggacgagcgcgggctgaaggtgtacgagtacaatgccgattccgcttcctgccataccgaaggcgggctgatcctcgaacagtggctgaagcagggctactacggcaccggccacaatccggcggaaggtctgctcgatgagctggcgggggcgtggaaacacagccgggcgcggcccttcgtccacatcatgcaggacaaggatctggaagagaactaccacgcgcagtttattcagcgttcgctgacccaggccggttttgagagcaaaattctctttggccttgatgagctgcgctgggacgctgccggccagctgatcgacgccgacggacggctggtcaactgcgtctggaaaacctgggcatgggaaaccgccattgagcaggtgcgcgaagtcagcgccgaggagtacgcggcggtaccgattcgtaccggacatccgcagaatgaggtgcggctgattgacgtcctgctgcgtcctgaagtattggtattcgaacctctgtggacggtgatccccggcaacaaagccattctgccggtgctgtggtcgctgttcccgcatcatcgctatctgctggataccgattttgaggttaacgacgagctggcgaaaaccggctatgcggtgaagcctatttccgggcgctgcgggaacaatatcgacctgatcggccctcaggatgaacttctggataagaccagcggccagtttgtcgatcgcaagaatatctaccagcagctgtggtgcctgccgaaagtggacggtaagtacattcaggtgtgcacatttaccgtcggcggtaactacggcggtacctgcctgcgcggcgattcgtcgctggtggtgaaaaaagagagcgatatcgagccgttaatcgttttgaaagacaaagcatga

SEQ ID NO: 2086 - DNA, 840 bp, Klebsiella pneumoniae
caggaggaaggcatgacacatccaaccgttataaaactgcacgacggcaacctgatgccgcagctgggtctcggcgtgtggaaagctggcaacgaggaagtcgtctccgccattcataaggcgctggaagtcggttatcgctcttttgacaccgccgccgcgtaccaaaatgagaccggcgtcggcaatgcgctgcacagcgctggcgtcaaccgcgatgagctcttcatcaccaccaagctgtggaacgacgatcaaaaacggccgcacgaggcgctgaaagagagtctcagcaaactgaagctggactatgtggatctctatttaatccactggccggtaccggctatcggccattacgtcgaggcctggcaggcgttgatcgagctgcagcagcaggggctgaccaaaagcattggcgtgtgtaatttccaggtaccgcatctgcagaagctgattgatgaaaccggcgtcgccccggtgatcaatcagatagaactccatccacttatgcagcagcgtcagctgcacgcgtggaacgccacccacaagatccagaccgaatcctggagcccgctggcccagggcggcgaaggcgtcttcgatcaaaaagtcatccaccagctcgccgataagtacggcaaaacgccggcgcaaatcgtcatccgctggcatcttgatagcggtctggtggtgatcccgaaatccgtcacgccgtcgcgtatcgcggaaaactttgacgtctgggacttccgtctcgacaaagatgagctgggagcgatcgcgaagctggaccagggtaaacgtctcggtccagacccggatcagttcggcggataa

SEQ ID NO: 2087 - DNA, 447 bp, Klebsiella pneumoniae
gttttgtcgggcgtaataggagccataccaacacaaaagggagaatataagatgaaaaaaattgctgcgatgaccgcgattattgctttggtttccatgccggtactggccgccgggcagggaggattcaccggaccgtcgactaccactaccacccaggctggcggcttcaccgggccgagcggcgcggtgaccaccgtggcgaacgccaagtcgctgcgcgatgacacctgggtgaccctgcgcggtaaaatcgtcgagcgcatctctgatgacctgtataaattccaggatgcttccggggtgatcaatgtcgatatcgaccacaagcgctggaacggcgtgaccgtcggcccgcaggacacagtagaaattcagggggaagtcgataaggactggaactcggtagaaatcgacgttaaacagatccgtaaaatcgcgccataa

SEQ ID NO: 2088 - DNA, 843 bp, Klebsiella pneumoniae
ttttgcaggggcgcaacattgcacggcaccgtgttaccaccactcaaaaaaggctggcaggctacgctgaatctccgctttcagcaggccggcggcaagaccgttctcgccagcgcccaacacgtcggcccgctgaccgtccagcgcccgttttacccggaagaagagacctgtcatctctatctgcttcacccacccggcggcatcgtcggcggtgatgagctgacaattagcgcgcaccttgcccccggctgccatacgctgataaccatgcctggcgccagcaagttttaccgcagcagcggcgcgcaagcgctagttcgccagcagttgacccttgccccacaggcaaccctggagtggctcccgcaggatgccatcttctttcccggggccaatgcccggctgttcaccacctttcatctttgcgcctccagcaggctgctggcctgggatctgctctgccttggccgcccggtgattggcgaaaccttcagccacggcaccctcagcaaccggctggaggtatgggtggacgatgagccgctgctggtcgagcgcctgcagctgcaggagggagagctctccagcgtcgccgaacgtccctgggtcggcactttgctgtgctatccggctaccgatgccctgctcgacggggtgcgcgacgcgctggcgccgctcggcctctacgccggcgccagcctgaccgaccgcctgctgacggtgcgtttcctcagtgacgataatctgatttgccagcgggtgatgcgcgacgtatggcagtttctgcgccctcatctcaccggtaaatctcccgtacttccccgaatctggctgacttaa

SEQ ID NO: 2089 - DNA, 504 bp, Klebsiella pneumoniae
caggatcttatggaacgctttctggaaaatgctatgtacgcctcgcgctggctgctggcgccggtttattttggcctctcgctcggtctgattgcgctgaccatcaaattttttcaggagatcttccacatactgccgcatatttttagcgtcagcgagtcggatatgattctgaccctgctgtcgctggtggatatgaccctggtgggcggtttgctggtgatggtgatgttctccgggtatgaaaattttgtctcgcagctggatattaacgagggtaaagaaaaactcagctggctgggcaaaatggacgcgacttcgctgaaaaataaggttgccgcctccatcgtggcgatctcctctattcacctgctgcgggtgtttatggatgcgaaaaacgtcccggacaataagctgatgtggtacgtgattatccacctgaccttcgtgctttcggcctttgtgatgggctaccttgatcgtctgaccaaagtgaaacactga

SEQ ID NO: 2090 - DNA, 312 bp, Klebsiella pneumoniae
gagaacgttatggaactgaccccccgagaaaaagacaagctgttgctgtttaccgccgcgctggtggcggagcgtcgcctggcccgcggcctgaagctcaactatccggagtccgtggccctcatcagcgcctttattatggaaggcgctcgggacggcaaaagcgtggcctcgctgatggaggaaggccgtcatgtcctgacccgcgagcaggtgatggagggcgtcccggaaatgatcccggatatccaggtcgaagccaccttcccggacggctcgaagctggtcaccgttcacaacccgattatctga

SEQ ID NO: 2091 - DNA, 1617 bp, Klebsiella pneumoniae
ggaatgactatgtcatcactggatcttaaccctgaattacccgcgacaacgcggacttccggctcccgggaaaccttagaagattacaccttacgttacgccccgctgagctttcgccgctggggtccgggcgtcgtcgcggtcaccgcgctgggcggcattgcctatctggccgacttttccatcggcgccagcatcggtatggcctggggcaccagcaacgccatctattcgatcctggtggcggcgctggtgatcttcctcaccggcattccgctggcgatcaccgccgcgcgctacaacattgaccttgacctgatcacccgcagcgccggcttcggctatttcggctcggtgatcaccagcattatttttgccggcttcacctttatcttcttcgccctcgaaggctcgatcatggcccagggcctgctggtgggcctcgggaacccgctgtggatgggatatctgatcgccaccctgatggtgctcccgctggtggtctatggcatgaaagccctgacccgcctgcaggtgtggaccacgccgctgtggctggtgctgatggtggtgccggtggtgtggctgattgtcaaagatccgcagctggtggacggcttcctgcatttcgccggtaaaaacagcgcgtcgacggtggatattaccgccatcatgctcggcgccggggtatgcctgtcgctgatcatgcagattggcgagcaaattgattacctgcgctttatgccgcctaagaccgcggagaatcgtaaaagctggtggctggcggtcttttccgccggcccgggctgggtggtgttaggggcgatcaaacagatcatcggcgccttcctcggcttctatctgttgacccgtttcccggcggtgcacaataccgaaccggtgcagcagttcgtcagcgtcttcgataacctggtgcccggctggctggccctgacgctggcggtggtgctggtggtgatctcgcagatcaaaattaacgtcaccaatgcctactccggctcgctggcgtggaccagcgcctggacccgcaccaccaaacgctatccgggacggattatttttgtggtggtcaacctggcgattgccctggcactgatggagggcgatatgttcagcgccctgtcgtggatcctcggcttttactccaacttcgccatcgcctgggtcgtggtggtggcgaccgacatcacctttaataaaggcttgctcaagctggcgccggcgcagccggagtatcgtcgcggcatgatctacaacgttaacccggtgggcgtggtctcctttggtctggccgccgggctgtcgatctgcgccttcttcggtctgctgggggcgacgctggcgccgttctcgccgctgattgcgctggtcgttgcctttgtcatgaccccgctgatggggctccttacccgcgggcgctactatattaagcaggtggatgacggcatcgccgagccgcgctatgacgcggcggggaacgcctccaccaccgtgtatcaatgcgttagctgtgaggaagagtacgagcgcccggacgtgatgcactcgcacaagcatcagggagccatctgctcgctgtgtaaaagtatggagtag

SEQ ID NO: 2092 - DNA, 1284 bp, Klebsiella pneumoniae
cggctcgatatcgctctcttttttcaccaccagcgacgaatcgccgcgcaggcaggtaccgccgtagttaccgccgacggtaaatgtgcacacctgaatgtacttaccgtccactttcggcaggcaccacagctgctggtagatattcttgcgatcgacaaactggccgctggtcttatccagaagttcatcctgagggccgatcaggtcgatattgttcccgcagcgcccggaaataggcttcaccgcatagccggttttcgccagctcgtcgttaacctcaaaatcggtatccagcagatagcgatgatgcgggaacagcgaccacagcaccggcagaatggctttgttgccggggatcaccgtccacagaggttcgaataccaatacttcaggacgcagcaggacgtcaatcagccgcacctcattctgcggatgtccggtacgaatcggtaccgccgcgtactcctcggcgctgacttcgcgcacctgctcaatggcggtttcccatgcccaggttttccagacgcagttgaccagccgtccgtcggcgtcgatcagctggccggcagcgtcccagcgcagctcatcaaggccaaagagaattttgctctcaaaaccggcctgggtcagcgaacgctgaataaactgcgcgtggtagttctcttccagatccttgtcctgcatgatgtggacgaagggccgcgcccggctgtgtttccacgcccccgccagctcatcgagcagaccttccgccggattgtggccggtgccgtagtagccctgcttcagccactgttcgaggatcagcccgccttcggtatggcaggaagcggaatcggcattgtactcgtacaccttcagcccgcgctcgtccatgcaaaaatccatgcgcccggtgatcatatgatgacggcggcgctgccacgagaggcgcagacgaggccagagaattttcggaatatcgaacagcgccagcaggttgtcatccttcatcaccttatcggtggcgtgcagatacatcaggtgcagctcgttggtggctttgatcagctcctgttcggcactttcgctgatggtgaaatactgatagggatcctggttgatgaaatgaccgttggctgccacataggctttctgcagcgggtctttctcgttcagccatttaccgcgaaactggccgttgtttggcagccgcgcgcctttgatggccatcgcctcgcccggcagcaccggctgcggcaggctgtgttcggtatcagcggtctggatcatccagcctaa

SEQ ID NO: 2093 - DNA, 210 bp, Klebsiella pneumoniae
gttggagtcattaccaggatgttctatatggactcacaggatgtattgtatatcgtccgatgttacggcgtcgtcaagcggtcctttaccgctccaggtcaccaattagcatatggaagcttaaaggtcgccgatggcgaactagataaggttgcctgcaaaattcaccgcacaggtgaaaacagcccagttagtcacgacaagccataa

SEQ ID NO: 2094 - DNA, 960 bp, Klebsiella pneumoniae
aatcgcgccataagtctccgtcggataagcgcaagatcggtcaggaatcgcgatcctcgctctgtcagagtatgtcgcgaggaggagacgatgaacgatattaaggccagcccggcgtatgtcgggcgcttccagcgcgtctgtaggtacattgcgcgccatcttgatgagccgctgtcgttggagacgctgagcgcgatagcgcacagttcgccttaccattttcaccggcaatttagcgcttataccggcattccattgtaccggtatattcagtggttgcgtctgcgacgcgcctgttggcgcctggcgttcaacccccgcgataaagtcatcgatattgcccttgatgccggatttcagaatgcggagtcgttcagtcgtgccttccgtaccgcgtttgaccaaagcccgacccaattccgtcaacaaccggactgggccgagtggcatcgacgcgtaccgaaacatacgctacaggagcaaacgtcgatggacgtcaacattatttcgtgcccctccacccggatagccgtactgcaacatcgcggtagcccggaccttgtcaacgccaccgccgcgcgttttatcgcctggcgtaagacgagcggactatcgcccgtcgccaccagcgatacctgggggatcgcctgggacgatccgcagaccaccccgcaggaggcatttcgttttgatatctgcggtacggtcgatcggccggttggtgaaaacgcctttggcgtgattaacggcgaaatccccggcggacgctgcgccgtcgtgcgccatcacggctcgctggacacgctggcgaacagcgtttggtttctctatcgcgactggttacccgcttcaggcgagacgttacgggattttccggtgtacttccgttacctcaattttgtccatgaggtggctgagcatgaactgcaaaccgatatttatctgccgctggcctga

SEQ ID NO: 2095 - DNA, 330 bp, Klebsiella pneumoniae
ggtagcgccatgatccccggtgaatatcacgttaagcccggtcagatagccctgaataccggccgggcaacctgtcgcgtggtcgttgagaaccacggcgatcggccgattcaggtcggttcgcactaccatttcgccgaggttaacccggcgctgaagttcgaccgtcagcaggccgccggctatcgcctgaatatcccggcgggcacggcggtacgctttgaacccggccagaaacgcgaggtcgagctggtggccttcgccggtcaccgcgccatcttcggcttccgcggcgaggtcatgggccctctggaggtaaacgatgagtaa

SEQ ID NO: 2096 - DNA, 3288 bp, Klebsiella pneumoniae
ggtgatggcatggcggttcgtcttattttatccgtcgttgtcgggctggcgctgagcctctcgcctgccgcgtatgccatgaaacagctggagctgaagagccattctcatatcgcggcgatcgatatcccgcttagcggtaaggagaaagcatggctggcggcgcagcctacgctgaccgtcgggacctggcttcccgagaggacgcccatcgtctatgacggcgacgagaaaagttatcagggcattaacgccgactatctagcgctgatggcgcacagcctcggactgaaggtgattatccgccagtatgacaccgagcagcaggcgctcaccgccctggccgaccgccaggtggataccctgctcactcaggtggcgcaccgggatgcgctcgccccgggcctggatcaatccgcgccgctgcttaaaacctggccgacgctggtcacctcgctgaaatcccctctgccgccgctgaccactgaccgccgcgtcacgctggcctgcacccgcgattgcgcttttttcgatattattcagcaggcgtttcccaacgccaaaatcaccctttatgatagcgactatcaggctctcgcctcggtggtcagcggcgagaatcagtattttatcggcaacaacatcaccactggccactgcatctcgaaatatttctcgcaatcgctggttatcgcgcactattttcgtcagcaggagcaacacaaccgctttgtcacccgtgacgatcggccagagctgcatcaactcttcgaccgttttatccatgccgtcgacagcgacaccgcgatgcggatcatgcaaaactggctcaaccgtggcgatctgtcgtttctcaataccccgcttacctttagccccgaagagcagcgctggctgcagaagcatcgtcgcgtccgcctgctggtgaacccctattttccgccatttactctggtggataacgaggatgaactgcgcggcatcatggccgatatgctgaatattgtctcactccagaccggcctgcagtttgacaccattctggtgcgcaaccgtcaggctctggcaaagcgcatggaaaaagaggactgggcgatcatgcccgccgccaccctgaccccacagccgcaggcttacgtcaccctcagcgatccgctcattaacgtggcctttgtgctggtcgcccgcggcagcgcccccgaccagcatctgctgacgcgctcggcacggatcgccctgccggtcgggcctatcgccgcccatgatctgaaagcgcgttttccgctgattaactgggtggaaacggataacgttggcgtcgccatgaagatggtagaggaaggcgaagtggatgccgccgtagcctcggagctttccgcccgctatatgatcgaccactactatccacagggtctgcactacacccgcattgatggactccccgtcgcggccattcggctggccatcccgcgcgatgaaccggtgctggccgccattcttaacaaagcgctgcaggttattccgccacgggatattctgcagatgaccgagaagtggtcgaaaatctccagtcagcaaatagagaactggagccagtacagccgccagttttaccagctgatcgcctttgcgctggtgctgatcgccatcagcctcggctggggactctctctgtgtcgggaagtgtgcaaacgtaaagactcccagcagcggctcgaggaggagctggcgcagaaggaggccctctcctgtgcgctggagcgcgaaaaagacaaagcgattcaggcgacaaaagccaagagccgctttctggccagcatgagccacgagctgcgcacgccggtgagcgccatcgtcggctttctggagctgctggcgaaacctgagctgaacgtcggccagcgtaaagaggcgatcgagctggcggggtcgacggcgcaaaccctgctgggacttatcggcaatattcttgatatcgacaagattgaatcgggaaaataccaggttaccccgcagtggagcgatgtcgcacagttagtgtcgcagcagtgtcataccttcgacgcgctggcgcagcaaaagggcatcgatctgcactaccataacgcgctgcaggaagggaccatgctgtgggtcgacccgcaggcgctacggcaaatcctcaataatctcatcggcaatgcgctgaagtttaccgtcgaaggcgcaattcaggtctcctgccggctgacgccggcgaatgagacacagggagagctggccctcatggttagcgacagcggctgcgggatcagtgaagcagagcaggccaccctcttccaccgctatgcccaggcgcgccagggacgccagcagaccggctccggactggggctggtcatttgcaaagagctggttgcgctgatgcagggtcgcctggagatggtcagccgtccgggcgtggggaccactttcaccatcacgctgccggtcaaggcgagccgctgcgcgatccacgcgccgcaggcgtcgcccgccagaccgcaggctctacccgggctggcgatactgatagcggacgatcaccccaccaaccggctactgctcaagcgccagctcagcactatcggctatagcgtcgatgaagcctgcgacggtgaagaggcagagaataagctcgccagcaaacattacgatctgctgataacggacctcaatatgccgaagaaagatggcctggagctggcggcctcgctacgccgtcgctatccgggcctggtaatttggggcgtgactgccagcgcgctgccgcagtcgcgggaggcgtgtctggccagcggcatgaatatgtgtctgtttaagccggtgtcggtccagacgctgagtcatgagctcagccgtttagcggtgggccgcgcatcacctcacgctacccggcacctgaagctcagcgtgctgagcgagaatacggggggagaccaggcgctgatgaatgagatgctggagacgttccgcgatgcgtcggccgccgatttacaggctgccggacaggcaatcgcccggcatgagccgcagatttttctgcgggcgctgcaccgtctgcacggttcagcacaaattctggggattactgcgctacaacaactgtgcgccccttttgaggcaaagcggcctgattcgctgacgccggcaagctgtctggaggtggtacagcgcatcaccggcgtcatgcgcgagatggatggcgaaagctgcgatttactgtgcagtatctttggaccacgcaccgtatgccggaagcggtactga

SEQ ID NO: 2097 - DNA, 594 bp, Klebsiella pneumoniae
atgccttcaattctcgcaaggttgtcagtttgtattattctgtcattgtttatggtttcttgttcgggaagttttgataaaactattgattatcaagacgctaaacagatgcccggctatgggtatatagtcatggatttcagactggcaaatgaaatggcgtatggcaatggctatattccaggaaaaacaaactatacaatttcttataaaaataaaggtgatattttttttgttgatattcagcatgctgattttcgtaatagaatattaaaggcatacataccatatatgaaaggttataccttaataggtatagggagaagttattggtatcctttttttagatgtgataaatgtgacaatgagccacagttaaaatttttatatataaacattgtaaaatctgtggatgaagcatggtgtagtgaaacaacttataaaaatttacgatcatttaatgcaatggacggttgctcccaaatggtaggtgtagaagaatctagaaaagttacaggagatgttcttatcaccccagaattaaaatctgatttccaggggatgttcaccccttatctgaagccaggacgttaa

SEQ ID NO: 2098 - DNA, 432 bp, Klebsiella pneumoniae
gtggacaaaatgaagcgttatacacctgacttccctgagatgatgcgcctgtgcgagaccaatttcgcgcagttgcgccgcctgttgccgcgaacggatgcagcgggtgagaaggtaagctatcaggtgggaagcgcgcagtatcggttaacgatagttgaatcgacccgctacactactctggtggcaatagagcagactctgcctgcagtgagctactggagcctgccatcgatgaccgtccgcctctaccatgacgccatggtggccgaagtgtgttcgagtcagcagatctttcgcttcaaagcgcgatatgattatcctaataaaaagttgcatcaacgcgacgaaaagcatcaaattaaccagtttttggccgactggctgcgttactgtttagcacatggagcgatggcgattccggtttgttag

SEQ ID NO: 2099 - DNA, 1275 bp, Klebsiella pneumoniae
tcatcagaaataacggggcttatggctggacgaattccacgtgtatttattagcgatctgcttgccagaaccgacatcgtcgatctgatcgatgcgcgggtaaagctgaaaaagcagggcaaaaattttcacgcgtgctgtccgtttcataacgaaaaaaccccctctttcaccgtcaacggtgaaaaacagttttaccactgcttcggctgcggggcgcacggcaatgctatcgacttcctgatgaactacgacaagctcgagttcgtggaaacggtcgaagagctggccgccatgcacaacctcgaagtgccttatgaagcaggcaacggacccagccagatagagcgccatcaacggcagaacctctaccagttactggatggtctgaatgcgttttatcaacagtctctgatgcagcccgccgccgatcctgcgcgccagtacctggcgaaacgggggttaagcagcgaggtgattacgcgctttgccatcggctatgctcccccaggttgggataacgttttaaaacggtttggcggcaatcaggaaaaccgccagtcgcttattgatgccggcatgctggtcaccaacgatcagggacgcagttacgaccgcttccgcgaacgggtgatgttccccatccgcgataagcgaggccgggtgattgggtttggcggacgggtgctgggcgatgccctgccgaagtatctgaactccccggaaaccgacatattccataaaggccgccagctgtatggcctgtatgaagcgcagcaggataaccccgaaccaccgcgtttgctggttgtcgaagggtatatggacgtcgtggcgctggcgcagtacgacattaattatgccgtggcctcgctgggtacctcgaccacggccgaccatatccagctgctgttccgggtgacgaataacgtcatctgctgctacgacggcgaccgggccgcccgcgatgccgcctggcgcgcgctggagacggcgctggcgtacatgaccgatggtcgccagctacgctttatgtttctggctgacggggaagacccggatacgctggtgcgtaaagagggcaaagcggcgttcgaggcgcgaatggagcaggctcagccgctctccacgttcttgtttaacagcctgctgcccgcaggtcgatctgagtactccggacgggcgcgcgcagctgagcacgctggcgctgccgctgataacccaggtcccgggcgaaacgctgcgcatctatttgcgtcaggagttgggcaataa

SEQ ID NO: 2100 - DNA, 1953 bp, Klebsiella pneumoniae
tggaaaacgataattacaggccagggagcccttatgatgccgctttctccgcagttacagcagcactggcagacggtcgctgaccgtctgccagcggattttcccgttgccgaactgagcccacaggccaggtcggtgatggcgttcagcgattttgtcgaacagagtgtgatcgctcagccgggctggctgaatgagcttgcggactccgcgccggcggcggaagagtggcggcattacgaagcctggctgcaggagcgcctgcaggccgtcactgacgaagcggggttgatgcgagagctgcgtctcttccgccgccagatgatggtccgcatcgcctgggcgcaggcgttgtcgctggtgcgcgaagaagagacgctgcagcagctgagcgtcctggcggagaccctgattgtcgccgcccgcgactggctgtacgccgcctgctgtaaagagtggggaacgccatgcaacgccgagggtcagccgcagccgctgctgatcctcgggatgggaaagctgggcggcggcgagctgaacttctcttccgatatcgatctgatctttgcctggccggagcatggcgccacccgcggcggccgccgcgagctggataacgcccagttctttacccgcctggggcagcggcttatcaaggcgctcgaccagccgacgcaggacggctttgtttatcgggtggacatgcgcctgcggccgtttggcgacagcgggccgctggtgctcagctttgcggcgctggaagattattaccaggagcaggggcgggactgggaacgctacgcgatggtgaaagcgcggatcatgggcgataacgacggcgcctacgccagcgaactgcgcgcgatgcttcgccccttcgtcttccgccgctatatcgacttcagcgtgatccagtcgctgcgtaacatgaaaggcatgatcgcccgtgaagtgcggcgtcgcgggctgaaagacaacatcaagctcggcgccggcggcattcgtgaaattgaatttatcgttcaggtctttcagctgatccgcggcggtcgcgaacctgcgctgcagcagcgcgcgttattgccgacactggcggcgattgatgagctgcatctgctgccggaaggcgacgcgacgctgctgcgcgcggcctatctgttcctgcgccggctggaaaacctgctgcaaagtatcaacgatgaacagacccagaccctgccgcaggatgaactgaaccgcgccagactggcgtgggggatgcataccgatgactgggagacgctgagcgcgcagctggcgaaccatatggccaacgtacggcgggtgtttaatgaactgatcggcgatgacgaggctcagtcgccagatgagcagctggccgagtactggcgcgagctgtggcaggatgcgctggaagaagatgacgccagtccggcgctggcgcatttaaacgacgccgaccgccgcagcgtgctggcgctgattgccgatttccgcaaagagctggatcggcgcaccatcggcccgcgcggccgccaggtgctggatcagctgatgccgcatctgctgagcgaaatctgctcgcgcgccgatgcgccgctgcctctggcgcggatcacgccgctgttgaccgggatcgtcacccgcaccacctatcttgaactgctgagcgaattccccggcgcgctgaaacacctgattacgctctgcgcggcatcgccgatggtcgccagccagctggcgcgccacccgctgctgctggatgagctgctggatcccaacaccctctatcagccgacggcgaccgatgcctatcgcgacgagctgcgtcagtatctgctgcgggtgccggaagaggatgaagagcagcagctggaggcgttgcgccagttcaagcaggcgcagcagctgcatatcgcggcggcgggatatcgccgggcaccctgccggtga

SEQ ID NO: 2101 - DNA, 843 bp, Klebsiella pneumoniae
atgcttgcgatattctgcgatataccgtgggacatcaggcattttaatcacgtcgttggcgataaaggttggcaatgcctccatgccgaggaactgattggctttatggaacggcaggtaaacgccgtcaacgccgacgccgtggaagaactggtctttgtcggtgaaggcttccatcggcgcgttccaggtcagagaaagcatatattttttcccctgcaccaggccgccggagccatattttttgctggcgtcggagcgggtacggccatcgctggcgtacagcgagccgtggccttcggtaaagacgtcatccatatattttttcaccgtccacggagcgcccatccaccagcccggcatctgccagatcaccacatcggcccacaggaaattctgtacttcttcttttacgtcgtactcgctttcggcgcgaacgcttttaacatcgtgcccggcgtcgcgcagataactctccgcgacctcggtcagggtgtcgttcagttgaccattagagtgcgcgaactttttcgccccattgataatcaggatgttgctcattttttaccctcatatatgaaaatttgccgacgatcttaccccgcgaagcggggcagtaaaatgagcaaaatgtgcaaagtcttttgccaaatgagcaataatctcgctaccagtacacgcgggcctcgaagccgccgtcgcgcgcgttggcaaaatcaacctgcatgccgtgcagcgaggcgatgcgccggacgatcgacaagcccaggccgctgcccggcgcctcctgccccggcggacgataaaaacgctcgccaatgcgcgagagcgcctgcgggctaa

SEQ ID NO: 2102 - DNA, 486 bp, Klebsiella pneumoniae
ggagagcggatgctttatttaactcaacgtctggagatccccgccgccgcgaccgccagcgttacgctgccgattgatgttcgcgtcaaaagccgggttaaggtcaccctcaacgatggccgggaagccggcctgctgctgccccgcggcctgctgctgcgcggcggcgatgtgctcagcaacgaagaaggcaccgagtttgtgcaggtgattgccgctgatgaaggggtgtcggtagtgcgctgcgacgatccgtttatgctggcgaaggcctgctaccacctcggcaaccgtcacgtgccgctgcagatcatgccgggcgagctgcgctaccatcacgatcacgtgctggacgatatgctgcgccagttcggcctgacggtgacctttggccagctgccgttcgagccggaagccggcgcttacgccagcgagagccacggtcatcatcatgctcatcatgaccaccacgctcacagccactag

SEQ ID NO: 2103 - DNA, 948 bp, Klebsiella pneumoniae
tgtcagcgtgtgggccgcgcggattatggcctgaggtcacctgctacactttttgtacatccacgaaaaaggcaaaccagcatgtcagagcaaaactaccagccaccaaaagtgtgggaatggaagcaaaacagcggcggcgcgttcgccaacatcaaccgtcccgtttccggcgcgactcatgaacgcgtcctgccggtgggaacccatccgctccagctatactcactcggcacgcccaacggccagaaggtgacgatcatgctggaggagctgctggcgctgggcgtcagcggcgcggagtacgacgcctggctgatacgcattggcgaaggggatcagttttccagcggctttgtcgagatcaacccgaactcgaagatcccggccctcagcgaccattccaccacgccgccgacccgggtatttgagtccggcaacattcttctctatctggcggaaaaatttggtttcttcctgccgaaagatcctgccggtcgcaccgaaaccctcaactggctgttctggctgcagggcgcggcgccgttcctcggcggcggcttcggccacttctataactatgcgccagtgaagatcgagtacgcgatcgaccgctttacgatggaagccaaacgccagctcgacgtgctggacaaacagctcgcccgcggtcgctatgtggccggcgaggagtacaccatcgccgatatggctgtctggccgtggtatggcaacgtagtgctgggcaatgtctataacgcggcggagttcctcgacgccgggagctataaaaacgtgctgcgctgggcgcaggatgtcggcaaccgcccggccgtcaagcgcggacgcatcgtcaaccgcaccaacggcccgctcaatgagcagctgcatgagcgccatgacgcccgcgactttgacacccaaacggaagataagcgccaggcgtaa

SEQ ID NO: 2104 - DNA, 639 bp, Klebsiella pneumoniae
gcgaggcgcgtcgtcgccggctggttgagctggcgaaaaaatatgatttcgtcattctggaagacgatccctacggcgaaattagctttactgacgccgttcggcgccccgctctatcaacatgctgtcgagctgggctgtgaagatcaaggggtttacacttcgaccttttcgaagatcctcgcgccgggaatgcgcatcggctggatcgtcatgccggactggctggcgcagcagacggtgattgtgaagcaggcggcggatctgcataccaatatgctgtcgcaggtgatcactgcggaatacctcagtctgaaccggctggataaccagattgcgttgattcgcgaagactaccgcaagaagtgcgtgtcgctggccgatgcgctggaaagccgccttggcgagcacctggaattcagccgcccgcagggggggatgttcctgtgggcgcgtttccgctatccgttcgataccatggaatggatgaagaaaacgctggaaaacggcgtggtgtacgtcccgggtgaagcgttctatcacgataagccggatacccgtaccctgcgtctttcttactccacggtgtcagaagccggattgctgacggccgttgagcggctggcggcctccctgtaa

SEQ ID NO: 2105 - DNA, 1188 bp, Klebsiella pneumoniae
ccgcctggcgtaaccgagtcgcacaataaggaattttttatgtcatctatccacaccctgagtgtacatagcggaaccttcaccgacagccacggcgcagtgatgccgccgatttatgccacctccacttttgctcagccagcgccggggcagcataccggttatgaatattcccgcagcgggaatcccacccgccacgcgctggagacggcgatcgccgacctggaaaacggcacgcgcggctacgcgttcgcctccgggctggccgccatctccaccgtgctggagctgctggataaggacagtcacctggtggcggtcgatgatgtgtatggcggcacttaccgcctgctggaaaacgttcgccgccgtagcgcgggtctgcaggtgagctgggtgaaacccgacgacctggcgggaattgaagcggcgatccgccccgacacccgcatgatctgggtggaaacgcccaccaacccgctgctgaagctcgcggatctcagcgccatcgccgccatcgcgcgccgccataacctgatcagcgtcgccgataacacctttgcttcgccggcgatccatcgcccgctggagcatgggtttgatattgtggtgcactccgcgaccaagtacctcaacggccattccgatgtcgtcgccggcctggcggtggttggcgataactccgagctcgcggaaaagcttggctatctgcagaatgcggtaggcggcgtgcttgacccgttcagcagcttcctgacgctgcgcggcatccgtaccctggcgctgcggatggagcgccacagcgcgaacgcgctgcagctcgccgaatggctggaacagcagccggaagtggagcgagtctggtttccctggctggcttcgcacccgcatcatcagctggcgcgccagcaaatggccctgcccggcggcatgatttcggtggtggtgaagggcgatgaaggttacgccgagcgcatcatcagcaagctgcgctggtttacgcttgcggagagcctgggcggcgtggagagtctggtgagccagcccttcagcatgacccatgcctcgatcccgctggagaaacgcctggcgaacggtatcacaccgcagctgatccgcctgtcggtggggatcgaagatcctcacgatctgattgccgactggcagcaggcgctgcggagggagtga

SEQ ID NO: 2106 - DNA, 285 bp, Klebsiella pneumoniae
ggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaaccgcccgcattatgggcgttggcctcaacacgattttccgccatttaaaaaactcaggccgcagtcggtaa

SEQ ID NO: 2107 - DNA, 1323 bp, Klebsiella pneumoniae
taccacccagtcgaccgcttccagcgcccccagcacgatcatccgctgttccagcgggttcaccgggcgggtttcgcctttcagacgtttggtggaggcatcgctgttgaccgccacgatcagacggtcgcccagcttgcgcgcattcgccagataggagacatgaccggcatgcagaatgtcgaagacgccgttggtcatcaccactttctcgccgcgcttgcgcgccgccgcaaccgcctgtttgagctcctcttcgctcatcacgccaaagccggtctcagcccggccgcggaccgcgttttccagctcgacaggggaaacggtggatgtacccagcttaccgaccaccacgcccgccgcggcgttagcgaaatagcaggcctcttccagggtgttgccggacgccagggtcgccgccagtacgccaatcaccgtgtcgccggcgccggtcacgtcgtacacttcctgggcctgggtcggcatatgcagcggcggacgtcccggctgcagcagcgtcatcccctgctcagagcgcgtcaccagcagcgccgacagttcgaattcggcgatgagcttcatgccgcgctcaacgatctgcgcttcatcctggcacttgcccaccaccgcttcaaactcagagaggttcggggtgagcaacgtcgcgccgcgatagcgttcgaaatcggtgcctttcggatcgatcagcaccggcacgcccgcttcacgtgcgagtcggatcatggtctggacgctggtcagcgcccctttggcatagtccgaaaggaccagcgcgccaatagagcccagcgcctgctgaatgcgctcgtgcatcggctgcggatcgacgccggagaagccctcttcaaagtcgaggcggatcagctgttgattgcgcgacagcacccgcagcttggtgatagtcgggtgagtcgggacggagacgaagtcgcacttcacattgacgttggccagcgcctggctcagcgcgcgggcggcgtcatcaatcccggtcaatcccaccaggcgcgaggttgcccccagcgaggcaatgttcatcgctacgtttgccgcgccgccaggacgttcttcgatattttccaccttcaccaccggcaccggggcttccggggaaatacgactggtggggccgtaccagtagcggtccagcatcacatcacccaccaccaacactcctgcacgttcaaactccggcagcgttactttcatgactctctcctgcgagacgcaaactttgcgcgcgataatagcacacccgattttatagttaagccatcagccatttctgccagctggcgctga

SEQ ID NO: 2108 - DNA, 450 bp, Klebsiella pneumoniae
tgtcccacggtatatcgcagaatatcgcaagcatctagcggaaatttttggttaactagaggtctagctctacatatttcgagttattcgaacctggagtatgacgagatccacacagaaggagttgagttaaccatgttaacagtgattgcagaaatccgtacccgcccgggccagcaccaccgccaggcggttctcgatcagttcgcgaaaattattccgaccgttttgcaggaggccggctgccacggctatgccccgctggtggatcatgccgccggcgtcagcttccagaccacggcgcccgactctatcgtcatggtcgagcagtgggaaagcgtcgcgcatcttgaagcacacctgcaaaccccgcacatgaaagcctggtcggaagcggtcaaaggcgatgtgctggagaccagcatccgtattctgcaggctggcgtttaa

SEQ ID NO: 2109 - DNA, 762 bp, Klebsiella pneumoniae
gcggtttgggttttagaggtagctatgctattcatttttcgagtaattttcgtggtcatttattgcatcgtagtgtgcgtacttggctgtctgtactgcttgttcagcccacgtaatccaaaacacgttgccactttcggccatctgtttggccgtttatctccggtatttggcctcaaggtagagctacgcaaacccgccgacgcggaaagctatggcaacgcgatctacatcgctaaccaccagaacaactatgatatggtgacggcgtcgaatatcgtgcaggctccgacggtcaccgtaggtaaaaagagcctgctgtggatcccgttctttggccaactgtactggctgacgggcaatttgctgattgaccgtaataaccgaaccaaagcgcacggcactattgccgaagtcgtcaacgcttttaaaaagcgtaaaatttcgttctggatgttcccggaagggacccgtagccgcggccgcggcctgctgccgtttaaaaccggggcttttcacgcggctattgccgctggggtgccgattattccggtgtgtgtctcgaatacatcgaataaaataaagctcaatcgctggaacaacggtctggtgattgtggaaatgctgccgccggtagataccactcagtttggtaaagacaacgtgcgcgcgctggcgacgcattgccgcgagctgatggccgccaaaatcgctgatctggacaacgaagtggccgagcgcgaagcggctggaaagcaataa

SEQ ID NO: 2110 - DNA, 843 bp, Klebsiella pneumoniae
  unsure (791): Identity of nucleotide at the above locations are unknown.
tcgcactgctccggtacgctccgttcaggccgcgcttcactggccggcgcggataacgccagggctcatcatgtctacatgcgcacttatttgagggtgaaaggaatgctaaaagttattcaatctccagccaaatatcttcagggtcctgatgctgctgttctgttcggtcaatatgccaaaaacctggcggagagcttcttcgtcatcgccgacgatttcgtaatgaagctggcgggagagaaagtggtgaatggcctgcagagccacgatattcgctgccatgcggaacggtttaacggtgaatgcagccatgcggaaatcaaccgtctgatggcgattttgcaaaaacagggctgccgcggggtggtcgggatcggcggtggtaaaaccctcgataccgcgaaggcgatcggttactaccagaagctgccggtggtggtgatcccgaccatcgcctcgaccgatgcgccaaccagcgcgctgtcggtgatctacaccgaagcgggcgagtttgaagagtatctgatctatccgaaaaacccggatatggtggtgatggacacggcgattatcgccaaagcgccggtacgcctgctggtctccggcatgggcgatgcgctctccacctggttcgaagccaaagcctgctacgatgcgcgcgccaccagcatggccggaagacagtccaccgaggcggcgctgaacctcgcccgcctgtgctatgatacgctgctggcggaaggcgaaaaggcccgtctgggcggcgcaagccggggtaatgaccgaancgctggaacgcatcatctaggcgaacacttacctcagcggcattggctttga

SEQ ID NO: 2111 - DNA, 636 bp, Klebsiella pneumoniae
aaaacgcctttggcgaatagcgtaataccagaagtaagggatcccgtgctcgacagaatcaaagcctgctttaccgaaagcattcaaacccaaattgccgcagcggaagcactcccggacgccatctcccgggcggcgatgacgctcgtccagtccctgcttaacggcaacaaaatcctctgttgtggtaatggcacctccgccgccaacgcacagcattttgctgccagcatgattaatcgctttgaaacggaacgccctggtttacctgccattgcactaaataccgataatgtggtcttaaccgccatcgctaacgatcgcttgcatgacgagatctacgccaagcaggtgcgcgccctgggacacgccggcgatgtgctgctggcgatctctacgcgcggaaacagtcgggacatcgtcaaggcggtggaagccgccgtgacccgcgacatgaccatcgtcgcgttaaccggctatgacggcggtgagctggcgggcctgttaggtcaacaggatgtcgaaatccgcatcccctcccatcgcagcgcgcgtatccaggagatgcacatgctgaccgtcaactgtctgtgcgatttgatagataacactctttttccacaccaggacgattaa

SEQ ID NO: 2112 - DNA, 894 bp, Klebsiella pneumoniae
acaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaagcatgtggtgcaggacgccgagcccgtcaccctgcacatcgacttagtaagggagtgaccatgagcgagaaaaccatgcgcgtgcaggattatccgttagccacccgctgcccggagcatatcctgacgcctaccggcaaaccattgaccgatattaccctcgagaaggtgctctctggcgaggtgggcccgcaggatgtgcggatctcccgtcagacccttgagtaccaggcgcagattgccgagcagatgcagcgccatgcggtggcgcgcaatttccgccgcgcggcggagcttatcgccattcctgacgagcgcattctggctatctataacgcgctgcgccccttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaa

SEQ ID NO: 2113 - DNA, 807 bp, Klebsiella pneumoniae
gccgcgcgatcggcaggcgtaaataagagcgccgaggccactttatacgcctggtctgacagctgtcagaccaggcccgcaatattacttccgggctctgattctcaatgtccacgatattttttaagctggctgcgtttggtgatgcttaccgattttaatcaggagtcaacgatgaaaaaagtcattctggcgagcctgctggcaaccatgatgagtacctctccggtatgggcaacagatagcgcgacggcagcgccagccgcggcagccacgacgcaggtacagaaagaagccgccgatgtgctgcaggtggcggtgcagggcgcgaatgcgatgcgcgacatccagttcgcccgtctggcgctgttccatggccagccggatagcgccaaaaaactgacagacgacgccgccgcgctgctggccgccgatgatgccagctgggcgaagtttgtgaaaactgatgctaaagccaaaatgatcgccgatcgctatgtgatcattaacgcctctatcgccctgtctgaagactatgtggccacgccggaaaaagagagcgcgatccaatccgccaacgaaaagctggcgaaaggcgatcagaaaggggctatcgataccctgcgtctggccggtattggcgtgattgagaaccagtatctgatgccgcttaaccagacccgtaaggcggtagcgcaggcgcaagaactgctgaaagccggtaaatattacgaagcgaatctggtgctgaagggcgctgaagagggcattgtggtggatagcgagatgctggtggcaggcaactga

SEQ ID NO: 2114 - DNA, 1008 bp, Klebsiella pneumoniae
cggagttcgtcaacgtttatgatacgtttcgcagttgttggcacaaactggatcaccaagcagtttgtcgatgccgcccatgaaaccggcaaatataaacttaccgccatctactcccgcagcctcgaacaggcgcaagccttcgccaaagactatccggtcgagcatctgtttacctcgctcgatgaactggcacagagccctgacgttgacgcggtctatattgccagcccgaactcgctgcactttccgcagacccggctgttcctgagccataagaagcacgtcatttgcgaaaagccgctggcgtcgaacctgcaggaagtcgaggcggcgatagcgctggcgaaagaaaataacgtggtgctgtttgaagcctttaaaaccgccagtctgcctaactttctcctactgaaagaaacgctcgctaaagtgggcaaactacgcaaagccttcatcaactactgtcagtactcctcacgctatcagcgctaccttgacggcgaaaaccccaacacctttaacccggcgttctctaacggttcgattatggatatcggcttctattgcctggcgtccgctgtggcgctgtggggcgagccgcgggccgttcttgccaccgccagcctgctggacagcggcgtagacgcccagggcaccgtggtgctgagctatggcgacttcgacgtgacgctgcatcactccaaagttagcgattccgcgatccccagtgaaattcagggcgaagacggcgcgttagtgatcgaaaaaatctccgaatgtcagaagctggcgtttgtgccgcgcggcggtaaagcccaggacctgacgcagccccagcacattaataccatgctgtatgaagcggagacctttgcgcgcctggtggagacacaggatgtggatcacccgggcctggcggtgagccggatcaccgccaaactgtccagcgaaattcgtcgccagaccggggtgatcttcccggccgatacgcagccgctggcgtaa

SEQ ID NO: 2115 - DNA, 1506 bp, Klebsiella pneumoniae
ggccagaggtcggttgatatgcaatacatcaaaatccattcgcaggataacgtcgcggtcgcgctgacggatatcgctgccggtagcgtggtgacgattgataatgactcggtcaccctcggccaggatatcgttcgcggccacaagtttgcactgcgcgctatcgcgaaaggggaaaacgtcgttaagtacgggttgccgattggccatgcgctggcggatatcgcgccgggcgagcatgttcatgcgcacaatacgcgcaccaatctcagcgaccttgacgcgtatcgctatcaaccggacctggttgcccaaccgccacagcctgcggatcgcgaagtacagatttatcgtcgcgccaacggtgacgtcggcgtgcgcaatgagctgtggatcctgccgaccgtcggctgcgtcaacgcgatggccagacaaatgcagaaccgtttcctgaaagagacgtatggcgctgaggatatcgatggggtacatctcttcagccacacctatggctgctcgcagcttggggacgatcacatcaacactcgcaccatgctgcaaaatatggttcgtcacccgaacgccggggcggtgctggtggttggccttggctgtgaaaacaaccaagtggaggcctttcgcgagacgctgggcgagtttgacccgcagcgcgtgcactttatggtttgccagcatcaggacgatgaagtggaggcgggggttgagcatctgcatcagctgtatgaagtgatgcgtcaggataaacgccagccgggcaagctcagcgagctgaagtttggcctcgagtgcgggggatcggacggcctgtcgggcattaccgctaatccgatgctgggccgcttctcagactatgtgatcgccaacggcggcactaccgtgctgaccgaagtgccggagatgttcggcgctgaacagttgctgatgagccactgccgcgacgaagcgaccttcgacaagctggtgaccatggtcaatgactttaagcagtactttattgctcacgaccagcctatttacgaaaacccctcgccgggtaataaggccggagggatcactaccctcgaagataagtcgctgggctgtactcagaaagcgggctccagccaggtggtggatgttctgcgctacggcgagcgcctgaaggttcatggtctgaatttactgagcgcgccgggcaacgacgcggtcgccaccagcgcgctggccggcgccggctgccatatggtgctgttcagcaccggtcgcggcacgccgtacggcggctttgtgccaacggtgaagatcgccaccaacagcgagctggcggcgaagaaaaagcactggatcgactttgatgccgggcagctgctccacggcaaaacgatgccgcagctgctggaagagtttgtggatgccattgtagccttcgccaacggtaaaccgacctgtaatgagcagaatgacttccgcgagctggccatctttaaaagcggtgttaccctgtaa

SEQ ID NO: 2116 - DNA, 597 bp, Klebsiella pneumoniae
ggcggtattcctgtgcaacagacaacccaaattcagccctcttttaccctgaaaacccgcgagggcggggtagcttctgccgatgaacgtgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgctgcgcgctatgcgcgcaaagagtcaccttcgccggtgccggtggtgaacgatcagatggtgcggccgaaatttatggccaaagccgcgctatttcatatcaaagagaccaagcatgtggtgcaggacgccgagcccgtcaccctgcacatcgacttagtaagggagtga

SEQ ID NO: 2117 - DNA, 483 bp, Klebsiella pneumoniae
ccaatctcgttatcaacaaactcgatagccatcagcatgcctttcccgcgcacttcattcaccaggtccggatactcctgcgccagcaggcggaaaccgtccagcagcatatcgcctttctgcgccgcctgcgccggcaggttttgcgtcagcagcacgttgatcgtcgccagcgccgccgcacaggccaacgggttgccgccgaaggtggtggtgtgcaggaacgggttatcgaagagcaccgagaagacctcttccgtcgccaccgtcgcgccgatcggcatcacaccgccgccgagcgctttcgccagacacagaatgtccggctggacgttctcatgctcacaggcgaacatcttgccggtgcggcccatgccggtctgcacttcgtcgaggatcagcaacgcgccaaactcgtcgcacagtttacgcaccgccggcaaataccccgttggcgggaggatcacgcccccttcgccctga

SEQ ID NO: 2118 - DNA, 342 bp, Klebsiella pneumoniae
cgcgctgcacctcaggatgggcggcattgcccaaatggcctaaggcggcggccaggtcgctcgggccgacaaacacaccgtccacgccctcggtcgcggcaatcgcctcgacgttgtccactccggtctggctctcaatctgcaccagaatggaaatgttcttgttggactgggcgaagtagtccggcacggtgccaaacatattgccgcggtgggaaacggagaccccgcggatcccttccggcggataacgggtcgaagccaccgcctgcgccgcctgttcagccgtctcgacaaacggcaccaggaagttatagaagccgatgtccagcatgcgcttga

SEQ ID NO: 2119 - DNA, 2064 bp, Klebsiella pneumoniae
ctcatccgaccacataacaataattttacattggaagccactatgagccgctatccgtcgcttttcgccccgcttgagctgggcttcacaacgctcaaaaaccgcgtgttgatgggctcaatgcacaccgggctggaagagctgccggacggcgcgcagcggctggcggccttttacgccgagcgcgcccgtcacggcgtggcgctgatcgtcaccggcggcatcgctccggcgccctctggggtcaccatggccggcggcgcggtactcaacgacgccagccatctggcgcatcatcgccatattaccgatgcggtacatcaggaaggcggcaaaatcgctctgcagatcctgcacaccggccgttacagctaccagcccgcgctggtggccccctcggcgctacaggcgccgatcaaccgttttaccccccatgaactgagccacgatgagatcctgacgctgatcgatgattttgcccactgcgcccagctggcgcgcgaagcgggctatgacggcgtcgaggtgatgggctctgagggctatctgattaacgaatttctcgccgcgcgcactaaccagcgcgacgaccaatggggcggcgattatgccaggcgcatgcgtttcgccgtagaggtggttaaggcggtgcgccagcgcgccggccacgatttcattatcatctaccgcctatcgatgctcgatctggtcaacgacggcagcacgctggcggaagtcaccgaactggccaaagcgattgaagcggcgggagcgaccatcatcaataccgggattggctggcacgaagcgcgcattccgacaatcgccacgccggtaccgcgcggagctttcagctgggtcacccgcaagctgaagggcgctgtatcgatcccgttgatcaccaccaaccgcattaacgatccgcaggtcgcggaggatattctcgcccgcggcgatgccgatatggtatcgatggcccgcccgtttcttgccgacgccgaatttatatcaaaagcgcaggccgatcgcgccgatcagatcaacacctgcatcggctgcaatcaggcgtgtctcgatcggatcttcgtcggcaaagtcacctcctgtctggtcaacccgcgcgcgtgtcatgaaaccctgatgccggtcctgcctgccaacgcgcctaaacggctggcggtggtcggcgccgggcctgccggtctggccttcgccgtaaacgctgccgcccgcggtcatcacgtcacgttgtttgatgcgctcccggagatcggcggtcagtttaatatcgccaaacagatccccggcaaagaggagtttcacgagacgctgcgttactaccgcaccatgctcgatcttcatggtgtcgatctacgcctgaatacccgcgtcacgacagacgatctgctggcgttcgatgagacgatcctcgccaccggtatcgccccgcgcctgccggcgatcgacgggatcgatcatccaaaagtgctgagctaccttgatgtcttgcgcgataaagcgccggttggcgcgaaggtggcgattatcggctgcggcggtatcggcttcgacaccgcgatgtttttaagccagtcgggcgtggccaccagccaggatatcggcgagttctgccgcgaatggggtatcgataccagcctgcaaacggcgggagggctgagtgctgaaggcccgcagttgagtaaaagcccacgacagattgtgatgctgcagcgcaaagccagcaaaccgggcgaagggctcggcaaaaccaccggttggatccaccgcgcgacgctgctggcgcgcggggtgaaaatgatcccggcggtcagttatgaaaagatcgatgatgaaggattacacgtcactatcggcggcgagcgccagctgttggcggtcgatcaggtggtgatctgcgccggtcaggagccgcgccgcgagctggcggatccgctgcgcgcggcggggaaaacggtgcatctcatcggcggttgcgacgtggcggcggagctggatgcgcgccgggcgattgcccagggcactaaactggcgctggcgatttag

SEQ ID NO: 2120 - DNA, 1152 bp, Klebsiella pneumoniae
gttcatcggcctggccgaccgggtgctggtgatgcatcagggccgctacagcggcgagctggcgcggcaggcggtgaccgtcgatcgcatgatgaccctggccttcggagggcaggcatgaaaacgttactcaagaatcgcgaactgagcgccttctttgccatcgtggcgctctttgttgtgctggtggtgctcaatccggcctatttcagcctgcagaccctggcgatgattttcgccagctcgcaaatcctctgcctgctggcattgggcgcgaccctggtgatgctgacccgcaatattgacgtgtcggtaggctccaccgttgggctatgcgccatcgccgtcggcgtggcgctgaacaacggctacgggttggcgacggccatcgccttcgcgctggctattggcgcgctggccggggcgtttaacggcctgctggtggtggggctgcgcattccggcgatcgtcgcgacgctcggcacgctggggttgtatcgcggggtaatgctgctgtggaccggcgggaaatggatcgagggcttgcccgacagcctgaaatcgctctcggagcctgcgtttatcggcgtgtcgccgctgggctggctggtgctggcgctgctgctggcgggcggctggctgctgtcgcgcaccgcctttggtcgtgatttttacgccgttggcgataacctcgccgccgcgcgccagctgggcgtggcggtcaaccgcacgcggatgctggcctttaccctcaacggtatgctggcggcctgcgccgggatcgtcttcgccgcgcagattggttttgtgcctaatcagaccggcagcggcctggagatgaaagccatcgccgcctgcgtactgggcgggatctcgctgcttggcggtaccggtacgctgctcggcgcgtttctcggcgcctttttccttacccaaatcgacaccgtactggtgctgttccgccttcccgcctggtggaatgactttatcgccggtctggtgctgctcggcgtgctggtgctcgatggccgcctgcgccaggcgctggcccgccatcagcgggcgctaaagtacagccgtttccagcccggtaacaaaggggggaaacaggttgcccgctttcccgaacgcaaaagcaaagaggtggcttaa

SEQ ID NO: 2121 - DNA, 885 bp, Klebsiella pneumoniae
atcggcaatacggacgagacaatgaaacaacacgaatcagcggataattctcaggggcagctctatattgtgcccactccgataggaaatctgtctgatatcacgcagcgtgcactggaagtgctgcaagccgttgatttaattgcagcggaagatacccgtcataccggtttgctgctgcaacattttgcgataaacgcccgtttgtttgcgcttcacgaccataatgagcagcaaaaggcggaaaccctgcttgccaaactgaaagaagggcaaaacatcgcgctggtttccgatgccggcacgccgctgattaacgatcctggttaccatctggtgcgcacctgccgcgaagcgaatattcgcgtggtgccgctgccgggcccctgtgcggctatcgccgccctgagcgccgccggcctgccttccgaccgtttctgttatgaaggcttcctgccggcgaaatcgaaaggccgccgcgataccctgaaagcgctggaagaagagccgcgcacccttatcttctatgagtcgacccaccgtctggtggagagtctggaggatatctgcgcggtactgggagaatcccgctatgtggtgctggctcgtgagctgaccaaaacctgggagtcgatccatggcgcgccgattggtgagctggtggcgtgggtgaaggaagatgaaaaccgtcgcaaaggcgagatggtgctgatcgtcgaaggtttcaaggctcaggaagaggcgctgccggcggccgcgctgcgtactctggcgctgctgcaggcggagctgccgctgaagaaagccgccgcgctggccgcggaaatccacggcgtgaagaaaaatgcgttgtataagtacgccctggagcagcagggggagtga

SEQ ID NO: 2122 - DNA, 336 bp, Klebsiella pneumoniae
gaggtggatactgtagcttacgctgattttgccaaactggagatgcgcgtcggcaagattgtcgaggtgaaacgccatgacaatgctgacaaactgtacatcgcgcggattgatgtcggcgaccgcacgctgcagacggtcaccagcctggtgccctactacagcgaagaggatctgctggggaaaacggtggtggtgctgtgtaacctggcgaaagccaaaatgcgcggcgaaacttctgagtgtatgctgttatgcgcggaaaccgaggatggaagcgaaagcgtgctgttgacgccggagcgcgtcatgccggcaggcgtgcgggtggtataa

SEQ ID NO: 2123 - DNA, 924 bp, Klebsiella pneumoniae
aaaataatcaccaggatgaagagagagaacattatgacaatcaaagtaggttttatcggtcttggcattatgggcaaaccgatgagcaaaaatttgctgaaagcgggttactcgctggtggtgtctgaccgtaacccggaagcgattgccgacgtgatcgccgctggcgctgagaccgcgacgacgccgaaagcgattgccgaacagtgcgaggtgatcatcaccatgctgccgaactctccgcatgttcaagaggtggcgctgggtgaaaacggcattattgaaggggcgaaaccgggcaccgtagtgatcgatatgagctccattgcgccgctggcgagtcgggaaatcagcgaagcgctgaaagccaaaggtattgatatgctggatgcgccggtgagcggcggcgaaccgaaagccatcgacggcacgctgtcggtcatggtcggcggcgataaagcgatcttcgataaatactacgatctgatgaaagcgatggccggctccgtagtgcataccggcgatattggcgcgggcaacgtcaccaaactggctaaccaggtgattgtcgcgctgaacatcgcggcgatgtctgaagcgctgaccctggcgactaaagccggcgtcaatccggatctggtttatcaggctattcgcggcggtctggcgggcagtaccgtgctggatgcgaaagccccgatggtgatggaccgtaacttcaaaccgggttttcgtatcgacctgcatattaaagatctggccaatgcgttggatacctcacacggcgtgggcgcccaactgccgctgacggcggcggtgatggagatgatgcaggcgctgcgcgcggacggtctcggcactgcagaccatagcgcgctggcgtgctattacgaaaaactggcgaaagtggaagtcactcgctaa

SEQ ID NO: 2124 - DNA, 351 bp, Klebsiella pneumoniae
tcaccattaactttcgcaacacggaccacgctacaggagaacgacatggctaaagagaatgtgactgacgaccttcgtgcagaactgaaaacgctggcggataccctggaggaagtactaaattcctcggcggacaagtcgaaagaagagatgggtaaactgcgcagtaaagccgagagcgcgctgaaagagagccgcgctcgtttgggtgaaaccagcgaagcgattcttcgtcaaactcgtgagaccgccgcgcgagcggatgattatgttcgcgaaaatccgtggactggggtaggaattggcgccgccgtcgggctggtgctgggtgtcctgctgtcgcgtcgctga

SEQ ID NO: 2125 - DNA, 1251 bp, Klebsiella pneumoniae
attatgacaacacgcactccctcatcagggtggctctcccgcctggcgcaaggcagcctggtgaaacaaattttaatcggcctggtgcttggcgtactgttggcgctggtctctaagcctgcggctatcgccgtcggtctgctggggaccctgttcgtcggcgcgttaaaagcggtagcgccggtgctggtattgatgcttgtcatggcctcgatcgccaaccatcagcacggacaaaaaaccagtattcgccccattctgtttctctatctgctgggcacctttagcgcggcgctgaccgcggtgttgttcagttttctctttccctcgaccctgcacttaaccaccgccgccgacagcatcacgccgccgtcggggattgttgaggtgctgcgcggcctgctgatgagcatggtgtccaacccgatcgacgctctgctgaacgccaactatatcggcattctggtgtgggcggtggggcttggcttcgccctgcgtcatggtaacgacaccaccaaaaacctgatcaacgacgtctcccacgcggtgacctttatcgttaaagtggtgatccgctttgcgccgctggggatcttcggcctggtatcttccaccctggcgaccaccggtttcgagaccctgtggggctatgcccagctgctgctggtgctggtgggctgtatgctgctggtagcgctggtgattaacccgctgctggtgttctggaagatccgccgcaacccctatccgctggtgctcacctgcctgcgcgaaagcggcgtttacgcgttcttcacccgcagttccgccgccaacattccagtgaatatggcgctgtgcgagaagctgaatctggatcgcgatacctattcggtctctattccactgggggcgaccatcaatatggcaggcgcggcaatcaccatcaccgtgctgacgctggcggcggtgcatacgctgaatattccggtggatctgccgacggcgctgctgctgagcgtggtcgcttcgctgtgcgcctgcggcgcctccggcgtggcgggcggctcgctgctgctgatcccgctggcctgtaatatgtttgggatcccgaacgatgtggcgatgcaagtggttgccgttggctttattatcggcgtgctgcaggactcctgcgaaaccgcgctgaactcctccaccgacgccctgtttaccgccgcggcctgcatggcggaagacgaccagctggcgaaaaacgccctgcgcggataa

SEQ ID NO: 2126 - DNA, 1167 bp, Klebsiella pneumoniae
actcgcgggttttactattccggaggcggagaggcgatgagccaggcagagttaaacggtgagttattcacattagagcggttcccacctaacgctgaagaagaagcgcttcaggcatgggaagcggcggatgaatatctgctgcaacaggtgaatgacgtcgacggcctgacgctcatcttcaacgacggcttcggcgcgctcgcctgcgcgctggcggatcgcaacccggtcagcatcaacgactcctttatttccgagctggcgacccgccacaacctgcggatgaacggtatcgatgaagagagcgtgcgctttcaggatagcctgagcccgctaccggccgcgccggcgctggtgctgattaaggtgccaaaacagctggcgctgctggaacagcagctgcgcgccctgcgcgaagtagtcacgccggaaacccgcatcatcgccgcggcgaaagcccgtgatgtgcacaactcgacgctggcgctgtttgaaaaaatcctcggcaccaccaccacctcgctggcgtggaaaaaagcgcgtttgatccactgcgttttcaccgctcctgagcttgccgatgcgccgcaaacctacagctggaagctggacggcacgccgtggaccatccataaccacgccaacgtttttgcccgcagcgggctggatatcggcgcgcgtttcttcctgcagcatttaccatctgatctagaaggcgagatcgccgatctcggctgcggcaatggggtgattggcctgcaggcgctggcgcagaacccgaacgcgcgggtcatgtttaccgatgagtcgcacatggcggtggcttccagccggttgaacgtcgagcgcaatctgccggacgatatcgcacgctgtgaatttatggtcaacaactcgctctccggcattgagcctgaccgctttacggcgattctgtgtaatccgccgttccatcagcaacacgctattaccgaccatatcgcctggcagatgtttaacgatgcccgccgcagcctgaaatacggcggcgagctgtacgtcgtcggcaaccgccacctcgattacttccgtaagctgaagcgcgcgtttggtaattgcacgacgattgcgacgaacaataagtttgtcattttgaaagcaaccaaggtgcgtaagcagcgctga

SEQ ID NO: 2127 - DNA, 657 bp, Klebsiella pneumoniae
actggggaaactaaggagcacgacatgtcactgaacagaacgcaaatcgtcgactggctgtaccgctgcggcgatattttcaccaaagagagcgattttctcaccggcctcgataaagagattggcgacgccgaccacggtctcaatatgcaccgcggtttcagtaaagtggtcgaaaagctgccgtcgattgccgataaagatattggctttatcctcaaaaacaccggcatgacgctgctctccaacgtcggcggcgccagcggcccgctgttcggcaccttcttcattcgcgccgcgcaggtgacccaggcccaccagagcctgacgctcgacgagctgtacctgatgatccgcgaaggtgcggacggagtcgtcaaccgcggcaaagcggagccaggggataaaaccatgtgcgacgtctggctgccggtggtggactccctgcgccagtccagcgagcagcacctgtcgatcgccgccgcgctggatgccgcctgcgaagtggccgagcgtgcggcccacgccaccatcactatgcaggcgcgtaaaggccgcgccagctatctcggcgagcgcagcatcggacatcaggatcccggcgcgacctcggtgctgtttatggttcagatgctggccgccgccgccaaagagtaa

SEQ ID NO: 2128 - DNA, 1014 bp, Klebsiella pneumoniae
gcctttatgactgacaaatctgttccattctcggtgctcgatctggcgccgatcccgcaaggatcttctgccaaagaagcctttacccactctctggatctcgcccggctggccgaatcgcgcggctatcatcgctactggctggcggagcaccataatatggtcggcattgccagcgcagcgacctcggtgctgattggctatctcgccgccaacaccaccaccctgcatctcgggtccggcggcgtgatgctgcctaaccactctccactggtgatagctgagcagttcggcaccctgaacaccctttaccccgggcggatcgacctcggccttggccgcgcgccgggcagcgatcagccgaccatgcgcgccctgcgtcgccatatgagcggcgatgtcgataatttcccgcgcgatgtagcggaactggtggactggtttgacgcccgcgatccgaacccgcacgtgcgcccggttcccggctacggggagcgcattccagtatggctgctgggctcaagcctctatagcgcgcaactggcggcgcagctcggcctgccgtttgccttcgcctcgcacttcgcgccggatatgttgttccaggccctgcatctgtatcgcagcaatttcaaaccttcggcgcggctggaaaaaccgtacgcgatggtgtgtatcaatatcatcgccgccgacagcaaccgcgatgcggagtttctcttcacctccatgcaacaggcgtttgtgaagctgcgtcgcggcgagaccggtcagttgccgccgccggtggaaaatatgcatcagctgtggtcagcgtccgagcagtatggtgtgcagcaggcactgagcatgtcgctggtcggcgataaaactaaagtccgccatgggctagagtcgattctgcgtgaaaccgaggcggacgaaatcatggtcaatggccagatcttcgaccaccaggcgcgtctgcattctttcgatttagcgatgcaggtgaaagaggagctgttggggtaa

SEQ ID NO: 2129 - DNA, 222 bp, Klebsiella pneumoniae
gacgttttcgcccttaagtttccacacattttaactcttagcgcgttgtggcaacaaaaggggtatcattggcgtacccttagacgggtgcaaaagggcccaattttggggttaaacccagagggtttggcccaattcttcaattatttctacggccaacggttaaaatttaccgttaaaaggcgaattagagttttccttccgcctacccccggggaataa

SEQ ID NO: 2130 - DNA, 438 bp, Klebsiella pneumoniae
aaggcattcgcgcaccacagctcgtcttcacgggagacgcaccaggtgacgacgtgctgtttactcagccagcgaccaatggcggcaagcgtatccatctttcttctccattatgctatggtgcacacaccttaccatagtgactttgtgaccgtgtgctggtttctgtatctcattcgaaccgcggataatcgcctttataccggcatcaccaccgacgtgccacgccgctttcgccagcatcaggcgggaaaaggcgcaaaggcgttgcgcggcaaaggcgacctgcagctggcctttagccacgaagttggtgaacactcacttgcattgcgactggaatatcgcgtcaagcagctaacgaagcgcgaaaaagagcgcctcgttgccggagaggatgccttcgaaaccctgctggcgaggcttaaagacgattaa

SEQ ID NO: 2131 - DNA, 1068 bp, Klebsiella pneumoniae
acgccgttcgccaccaccgtgttgagcatggcgctgttcgccttctccacctggatctccaccaacggcgcgaaaatgctggggcctatcacctccgtcacctcatcgctgatgctgctgctgacgctctcttatattttgctggccggtaccgcgctggtgggcggcgtgcagccagcggatccgatcaccgtcgaggcgatgatccctaacttcaactgggcgttccttggtattaccacatggatctttatggcggcgggcggcgcggaatcggtggcggtatacgtcaacgatgtgaaaggtggctcgaaatccttcgtcaaagtgatcatcctcgccgggatcttcatcggcgtgctttactcgatctcctccgtgctgatcaacgtcttcgtcagcagtaaagagctgaagtttaccggcggatcggtgcaggtgttccacggcctggcggcttactttggcctgccggaaattctgatgaaccgcttcgtcggcctcgtttcgtttaccgcgatgtttggctcgctgctgatgtggaccgccaccccggttaaaattttcttctcggaaattccctccggcatctttggtaaaaaaaccgtcgagctcaatgagaacggcgttccggcgcgtgcggcctggatccagtatctgatcgtcattccgctgatgatcatcccgacgctgggctccaacaccgtgcaggatctgatgaacaccatcatcaacatgaccgccgccgcttccatgctgccgccgctgttcatcatgctggcctacctcaacctgcgccgcaagctcgaccatctgccgcgcgatttccgcatgggctcgcgtactaccggcatcgtggtggtatccatgctgattgtgattttcgccatcggtttcgtcgcctcaaccttcccaaccggcggcaacatcctgaccattattttctacaacgttggcgggattgtgattttccttggcttcgcgtggtggaaatacagcagatacgtcaaaggattaacccaggaacaacaacaaatagaagcggctccggcttcccatacctcttaa

SEQ ID NO: 2132 - DNA, 204 bp, Klebsiella pneumoniae
tctgctaccgcgccgtcggccctcgctggcggcgcggtaatcagctatagcagacgttctcgtaacgagaatacctgctcatgtcacaattatgttgctacgcagttaaaaaataagatccatattaaaatcacagtattttacgcttcccgccagtctttctttccgtatactcgactatgcaaacatctacttacatcctga

SEQ ID NO: 2133 - DNA, 2013 bp, Klebsiella pneumoniae
accgctggcgcaagttggcggtttttctttctcccctccggcagtcgctgccggaggggttctctatggtacaacgcggaaaaggatatgactgttcagactcaggataccgggaaggcggtctcttccgtcatcgcccagtcatggcaccgctgcagcaagtttatgcagcgcgaaacctggcaaacgccgcaccaggcccagggcctgaccttcgactccatctgtcggcgtaaaaccgcgctgctcaccatcggccaggcggcgctggaagacgcctgggagtttatggacggccgcccctgcgcgctgtttattcttgatgagtccgcctgcatcctgagccgttgcggcgagccgcaaaccctggcccagctggctgccctgggatttcgcgacggcagctattgtgcggagagcattatcggcacctgcgcgctgtcgctggccgcgatgcagggccagccgatcaacaccgccggcgatcggcattttaagcaggcgctacagccatggagtttttgctcgacgccggtgtttgataaccacgggcggctgttcggatctatctcgctttgctgtctggtcgagcaccagtccagcgccgacctctccctgacgctggccatcgcccgcgaggtgggtaactccctgcttaccgacagcctgctggcggaatccaaccgtcacctcaatcagatgtacggcctgctggagagcatggacgatggggtgatggcgtggaacgaacagggcgtgctgcagtttctcaatgttcaggcggcgagactgctgcatcttgatgctcaggccagccaggggaaaaatatcgccgatctggtgaccctcccggcgctgctgcgccgcgccatcaaacacgcccgcggcctgaatcacgtcgaagtcacctttgaaagtcagcatcagtttgtcgatgcggtgatcaccttaaaaccgattgtcgaggcgcaaggcaacagttttattctgctgctgcatccggtggagcagatgcggcagctgatgaccagccagctcggtaaagtcagccacacctttgagcagatgtctgccgacgatccggaaacccgacgcctgatccactttggccgccaggcggcgcgcggcggcttcccggtgctactgtgcggcgaagagggggtcgggaaagagctgctgagccaggctattcacaatgaaagcgaacgggcgggcggcccctacatcgccgtcaactgccagctatatgccgacagcgtgctgggccaggactttatgggcagcgcccctaccgacgatgaaaatggtcgcctgagccgccttgagctggccaacggcggcaccctgtttctggaaaagatcgagtatctggcgccggagctgcagtcggccctgctgcaggtaattaagcagggcgtgctcacccgcctcgacgcccggcgcctgatcccggtggatgtgaaggtgattgccaccaccaccgtcgatctggccaatctggtggaacagaaccgctttagccgccagctgtactatgcgctgcactcctttgagatcgtcatcccgccgctgcgcgctcgacgcaacagtattccgtcgctggtgcataaccggttgaagagtctggagaagcgtttctcttcgcgactgaaagtggacgatgacgcgctggcgcagctggtggcctactcgtggccggggaatgattttgagctcaatagcgtcattgagaatatcgccatcagtagcgacaacggccacattcgcctgagtaatctgccggaatatctcttttccgaacggccgggcggggatagcgcgtcatcgctgctgccggccagcctgacctttagcgccatcgaaaaggaagctattattcacgccgcccgggtgaccagcgggcgggtgcaggagatgtcgcagctgctcaatatcggccgcaccaccctgtggcgcaaaatgaagcagtacgatattgacgccagccagttcaagcgcaagcatcaggcttag

SEQ ID NO: 2134 - DNA, 369 bp, Klebsiella pneumoniae
tttacgctagcgggcggcgttgattacgcatcgccaccgaagcgacggcgaccggctgagtcatcgcggcgcggcgcggatgcatcgtcacgacgcggcgcacggccttcacgacgttcgccgctgaaacgacgtccttcaccacgaccgccttcacgacgttcgccaccgaagccacggccgccttcacgacgctcgccgccgaagccacggccgtcttcgcgacgctcaccgccgtcacgacgttcggtgcgcggctgcgcatcgcccagcagctgcatgttcatcggcttgttcaggatacgggtactagtaaagtgctgcagcactttgcccggcatccctttcggcagctcaatggtggagtga

SEQ ID NO: 2135 - DNA, 987 bp, Klebsiella pneumoniae
gatcccgcagcttatcacggaagccttgtcgcactatggcgtggtcgccgggcagggcaatattcggggaacagaagggccgcgcaatgcggtcgccaccgggctgctactggccggtcaggcgaattaaacgggcgctcgcgccagcctctctctttaacgtgctatttcaggatgccgataatgaaccagacttctaccttaaccgggcagtgcgtggccgagtttcttggcaccggattgctcattttcttcggcgcgggctgcgtcgctgcgctgcgggtcgccggggccagctttggtcagtgggagatcagtattatctggggccttggcgtcgccatggccatctacctgacggccggtgtctccggcgcgcaccttaatccggcggtgaccattgccctgtggctgttcgcctgttttgaacgccgcaaggtgctgccgtttattgttgcccagacggccggggccttctgcgccgccgcgctggtgtatgggctctatcgccagctgtttctcgatcttgaacagagtcagcatatcgtgcgcggcactgccgccagtcttaacctggccggggtcttttccacgtacccgcatccacatatcacttttatacaagcgtttgccgtggagaccaccatcacggcaatcctgatggcgatgatcatggccctgaccgacgacggcaacggaattccgcgcgggccgctggcgccgttgctgattggcttgctgatcgccgtgatcggcgcgtcgatggggccgctaaccggctttgcgctgaatccggcgcgcgacttcggcccaaaactgtttaccagtctggccgggtggggctcgatcgcctttaccggtgggctggcgatcccttactttctggtgccgctgctggcgccggtggtgggggcgattatcggggcgtttttgtatcgcaagcttatcggccgccatctgccgtgcgaatgcggtatcgatgagtaa

SEQ ID NO: 2136 - DNA, 420 bp, Klebsiella pneumoniae
aggcaacgagcaggagattgccgcgattttccgccaggcattctgagtgttaacgagggggccgtcatgtcgctttcaccgccaggcgtacgcctgttttacgatccgcgcgggcaccatgccggcgccatcaatgagctgtgctgggggctggaggagcagggggtcccctgccagaccataacctatgacggaggcggtgacgccgctgcgctgggcgccctggcggccagaagctcgccccttcgggtgggtatcgggctcagcgcgtccggcgagatagccctcactcatgcccagctgccggcggacgcgccgctggctaccggacacgtcaccgatagcgacgatcatctgcgtacgctcggcgccaacgccgggcagctggttaaagtcctgccgttaagtgagagaaactga

SEQ ID NO: 2137 - DNA, 618 bp, Klebsiella pneumoniae
ccactcccggctgtgcggcgccgctggcgatcctcgatctcggcgccggctcgacggatgcggcgatcgtcaacgcggaggggcagattaacggcggtccatctcgccggggcggggaatatggtcagcctgttgattaaaaccgagctgggcctcgaggatctttcgctggcggaagcgataaaaaaatacccgctggccaaagtggaaagcctgttcagtattcgtcacgagaatggcgcggtggagttctttcgggaagccctcagcccggcggtgttcgccaaagtggtgtacatcaaggagggcgaactggtgccgatcgataacgccagcccgctggaaaaaattcgtctcgtgcgccggcaggcgaaagagaaagtgtttgtcaccaactgcctgcgcgcgctgcgccaggtctcacccggcggttccattcgcgatatcgcctttgtggtgctggtgggcggctcatcgctggactttgagatcccgcagcttatcacggaagccttgtcgcactatggcgtggtcgccgggcagggcaatattcggggaacagaagggccgcgcaatgcggtcgccaccgggctgctactggccggtcaggcgaattaa

SEQ ID NO: 2138 - DNA, 252 bp, Klebsiella pneumoniae
acaaaaccggcccccttcttccccgttatgcccagggggccaggaccgccaccagccggtttcggattggggctggtcatttgcaaaagctgggttgcgttaatgcagggtcgcctggaaatgttcagccgcccgggcgtggggaccactttcaccatcacgctgccggtcaaggcgagccgctgcgcgatccacgcgccgccaggcgtcgcccgccagaccgcaggctctacccgggctggccgatattga

SEQ ID NO: 2139 - DNA, 393 bp, Klebsiella pneumoniae
gcgaacacttacctcagcggcattggctttgaaagcagtggcctggccgctgcccatgcaatccacaacggtttcaccattcttgaagagtgccaccatctgtatcacggtgagaaagtggccttcggtaccctggcgcagctggtgctgcagaacagcccgatggacgagattgaaacggtgctgggcttctgccagcgcgtcggcctgccggtgacgctcgcgcagatgggcgtcaaagaggggatcgacgagaaaatcgccgcggtggcgaaagccacctgcgcggaaggggaaaccatccacaatatgccgtttgcggtgaccccggagagcgtccatgccgctatcctcaccgccgatctgttaggccagcagtggctggcgcgttaa

SEQ ID NO: 2140 - DNA, 1677 bp, Klebsiella pneumoniae
gttttcgcttactcttcaggaaccactatgtctcaattcttttttaaccagcgcgccagcctcgtcaacgatgtgattgagggtaccattatcgccagcccgtggaataacctcgcccgtctggagagcgacccggcgatccgggtggtggtccgtcgcgatctgaataaaaacaacgtggcggtgatctccggcggcggcgccggccatgaaccggcgcacgtcggctttattggtaaaggcatgctgaccgccgcggtctgcggcgatctgttcgcctcgccgagcgtcgacgcggtgctcaccgccattcaggcagtgaccggcgaggcgggctgcctgctgatcgtcaaaaactacaccggcgatcggcttaacttcggtctggcggcggagaaagcgcgccgactcggctacaacgtggagatgctgatcgtcggcgacgatatttcgctgccggataacaaacagccgcgcggcatcgccgggaccattctggtgcataaagtggcgggctatttcgccgagcgcggcttcaacctcgccaccgtcctgcgtgaagcgcaatacgccgccagccataccgccagcatcggggtggcgctggccagctgccacctgccgcaggaagctgacagcgcgccgcgccatcaggccggtcacgccgagctgggaatgggcatccacggtgagccgggcgcctcgacgatcgccacgcaaaacagtgcggagatcgttaacctgatggtggaaaaactgaccgccgccctaccggaaaccggccgcctggcggtgatgctcaataacctcggcggcgtgtcggtggctgagatggcgattctgacccgcgagctggccaacaccccgctgcaggcgcgcattgactggttaataggcccggcctcgctggtgacggcgctggatatgaaaggcttctcgctgaccgccatcgtgctggaggagagtattgagaaagcgctgctttcggatgtggaaaccgccagctggcagaagccggtgcagccgcggactatcaacgtcgtgccgtccaccctcgacagcgcccgggtggattttacaccctcggccaacccacaggtgggcgattacgtggcgcaggtgaccggcgccctcatcgatcttgaagaacatctcaacgcgctggatgccaaagtaggcgacggcgataccggctccaccttcgccgccggggcgcgcgagattgccgagcggctcgagcgtcagcagctgcccctgaacgatctgccaacgctcttcgcgctgatcggcgaacgcctgacggtggtgatgggcggctccagcggggtattgatgtctatcttcttcaccgctgccgggcagaagctggggcaaggcgccagcgtggccgaggcgctgaacgccggtctggaacagatgaagttttacggcggcgccgatgagggagaccggacgatgatcgacgctctgcagccggccctggcggcgctgctggccgaaccggagaatctgcaggccgctttcgccgcggcgcaggccggggcggatcgcacctgccagtcaagcaaagccggcgccggacgcgcgtcctatctcaacagcgatagcctgctcggcaacatggaccccggcgcccaggcggtggcgatggtgttaaaggcgctggcggaacgttaa

SEQ ID NO: 2141 - DNA, 1434 bp, Klebsiella pneumoniae
tccctgcaatacttaatccagtatcgtgtgatacgtccgccccaggagcacattttgaacaggttaccttccagcgcatcggctctggcctgcagcgcacacgcactgaatctcattgaaaagcgcacgcttgatcatgaggaaatgaaagcacttaaccaggaggtgagagaatactttaaagagcatgtgaatccggggtttttagagtatcgaaaatcggtcacagccggcggggattacggagccgtagagtggcaagcgggagggttaaatacgcttgtcgacacccatggacaggagtttatcgactgccttggtgggtttggcatcttcaatgtagggcaccgtaatccagttgtggtatccgccgtcgagaatcaactcgcgaaacaaccgcttcacagtcaggagctgctggacccgctacgcgcgatgctggcgaaaaccctggcagccttaacgcccgggaaactaaagtacagtttcttctgcaacagcggtaccgaatcggtagaggcggccatcaagctggcgaaagcctatcagtcgccgcgcggtaaatttaccttcatcgccaccagcggcgcgttccacggtaaatcgctgggcgcgctgtcggccaccgccaagtcgaccttccgcaagccgtttatgccgctgctgccgggcttccgccacgtgccgttcggcgatatcaacgccatgcgcaccatgctgagcgagtgcaagaaaaccggcgacgacgtcgcggcggtgatcctcgagccgattcagggcgaagggggcgtgatcctcccgccaacggggtatttgccggcggtgcgtaaactgtgcgacgagtttggcgcgttgctgatcctcgacgaagtgcagaccggcatgggccgcaccggcaagatgttcgcctgtgagcatgagaacgtccagccggacattctgtgtctggcgaaagcgctcggcggcggtgtgatgccgatcggcgcgacggtggcgacggaagaggtcttctcggtgctcttcgataacccgttcctgcacaccaccaccttcggcggcaacccgttggcctgtgcggcggcgctggcgacgatcaacgtgctgctgacgcaaaacctgccggcgcaggcggcgcagaaaggcgatatgctgctggacggtttccgcctgctggcgcaggagtatccggacctggtgaatgaagtgcgcgggaaaggcatgctgatggctatcgagtttgttgataacgagattggctacgactttgccagcgagatgttcagacagcgggtgctggtcgccgggacgttaaacaacgccaagacgatccgcattgaaccgccgctgacgctcacccttgagcagtgcgagcaggtgctgaaggcggcgcgcaaggcgctggcggccctgcgcgtttcggtcgaagagacataa

SEQ ID NO: 2142 - DNA, 813 bp, Klebsiella pneumoniae
caaatcgaatattgtcgccatcttccgggagcgaatatggaaatcattgaaccacgccgtctatatcagcagcttgccgctgagctgaagacgcgcatcgaacaaggtgtctaccttgtaggggataagctgcccgccgagcgcttcatcgccgatgaaaaaaacgtcagccgcaccgtggttcgtgaagccattatcatgctggaagtggaagggtatgtcgaagtccgcaaagggtcgggtatccacgttatctccaaccatccgaaataccagcaggtggccgatgaaagccttgagttcgccaactatggcccctttgaactgctgcaggcgcggcagctaattgaaagcaatattgccgaattcgcggcgactcaggtgaccaaacaggacatcatgaagctgatggagattcaggagaaagcgcgtaacgagaaatgtttccgcgactccgagtgggacctgcagtttcacgtccaggtggcgctggcgacgcagaacagcgcgctggcggcgatcgtggaaaagatgtggacccagcgcgtgcataacccctactggaaaaagctgcatgagcatatcgacctgcgtacggtcgataactggtgcgacgaccacgatcaaatcctgaaagctctgctgcgaaaagatcccaacgccgccaagctggcgatgtggcagcatctggaaaataccaagcaaatgttgttcaacgaaaccagcgatgactttgaatttaatgccgatcgctacttatttgccgaaaacccagtcgttcatctcgataccgcagtcaacggcgcgaaataa

SEQ ID NO: 2143 - DNA, 447 bp, Klebsiella pneumoniae
ggtcgcgatcacggcgttaaagtgcgtcatatcgtgggcgcgatcgccaataaaggcgatatcagcagccgttacatcggtaacatcaagctgttcgcttctcactccaccattgagctgccgaaagggatgccgggcaaagtgctgcagcactttactagtacccgtatcctgaacaagccgatgaacatgcagctgctgggcgatgcgcagccgcgcaccgaacgtcgtgacggcggtgagcgtcgcgaagacggccgtggcttcggcggcgagcgtcgtgaaggcggccgtggcttcggtggcgaacgtcgtgaaggcggtcgtggtgaaggacgtcgtttcagcggcgaacgtcgtgaaggccgtgcgccgcgtcgtgacgatgcatccgcgccgcgccgcgatgactcagccggtcgccgtcgcttcggtggcgatgcgtaa

SEQ ID NO: 2144 - DNA, 300 bp, Klebsiella pneumoniae
gctgtgggtcaggccactcttggcatcgacaccaatgtgggccttcatgccaaagtgccactgattgcctttcttggtctgatgcatctccggatcgcgttgctgctctttgttcttggtagagctgggtgcctcaatgatggtggcatccaccaaagtgccttgggtcatcatgacgcctgcttcggccagccagcgattgatggtcttgaacaattgacgggccagttgatgctgctcgagcaggtggcggaaattcatgatggtggtgcgatccggcagggcgctatccagggataa

SEQ ID NO: 2145 - DNA, 1344 bp, Klebsiella pneumoniae
gaagcggcccagcatcggattagcggtaatgcccgacaggccgtccgatcccccgcactcgaggccaaacttcagctcgctgagcttgcccggctggcgtttatcctgacgcatcacttcatacagctgatgcagatgctcaacccccgcctccacttcatcgtcctgatgctggcaaaccataaagtgcacgcgctgcgggtcaaactcgcccagcgtctcgcgaaaggcctccacttggttgttttcacagccaaggccaaccaccagcaccgccccggcgttcgggtgacgaaccatattttgcagcatggtgcgagtgttgatgtgatcgtccccaagctgcgagcagccataggtgtggctgaagagatgtaccccatcgatatcctcagcgccatacgtctctttcaggaaacggttctgcatttgtctggccatcgcgttgacgcagccgacggtcggcaggatccacagctcattgcgcacgccgacgtcaccgttggcgcgacgataaatctgtacttcgcgatccgcaggctgtggcggttgggcaaccaggtccggttgatagcgatacgcgtcaaggtcgctgagattggtgcgcgtattgtgcgcatgaacatgctcgcccggcgcgatatccgccagcgcatggccaatcggcaacccgtacttaacgacgttttcccctttcgcgatagcgcgcagtgcaaacttgtggccgcgaacgatatcctggccgagggtgaccgagtcattatcaatcgtcaccacgctaccggcagcgatatccgtcagcgcgaccgcgacgttatcctgcgaatggattttgatgtattgcatatcaaccgacctctggccttagttcagttcaatggcgaaatagtcacgcgcattgttaaagcaaatgtttttcaccatctcgcccagcagcgcgatatccgcaggcgcttcgccggcagccacccaacggccgatcatctggcacagaatgcggcggaagtattcgtggcgcgtgtaggagaggaagctgcgactgtcggtcaacatcccgacgaagcggctcagcagcccgagctgcgccagctgggtcatctgccgctccataccgtctttctgatcgttgaaccaccagccggagccgaactgcatcttgcctggcatgccttcaccctggaagttaccgatcatggtgcccagcacttcgttatcacgcgggttcaggcagtagagaatcgttttcggcagcaggttttcttcgttctgcttgctcagcagcttagacagctcttccgccatcggacgatcgttgatcgagtcgaagccgacgtctggccctaa

SEQ ID NO: 2146 - DNA, 2142 bp, Klebsiella pneumoniae
gcattgagccaaaaaaaatatcactggacacttatggtaccgtcaacatttcttcgttctaagcccgcgcgctgcctgcccgtattgctggcgactcttatttttgctggctgcggcacccacacgcaggatcaaagcgcggcgtttatgcagggtacgtcgcaggccaactccagtttctacttacagcagatgcagcaaagcacgaatgatagcaagaccaactggcaattactcgccattcgtgcactactgcaggaagggaagaagcagcaggctatcgacctgtttaaccagctgccggcgaacctgaacagcactcaggcccgtgaacagtcgctgctggcggtggaagtgaagctggcgcagaacgattatcaggccgcccgtaatctgctggctaagatcgatccgacaaaccttgagcagcctcagcaggcgcgctactggcaggcgcaaatcgatgccagccagggcaaaccatcgctgaccctgctgcgcgccttaatcgcccagcagccgctgctgagtgacgccaaacagcgtcagaaaaatattgatgcgacctggcaagcgctcacctcgatgccccaggaccaggccaatgcgctggtgatcaacgccgatgaaaatatcctccagggctggctggatctgcagcggatgtggtttgacaaccgcaacgatccgacgctactgaaagcgggcgttaaagactggcagacgcgctatccgcaaaacccgggcgctaaaatgctgccgacggcgcttgtgaatatgcaaaactataagcctgcgtccatcaacaagattgcgctttttctgccgctgaacggtcaggcgtcgatcttcggccgcactatccagcagggctttgaagccgccaaaaacggcgcgccgtcggtgacgggcagcgcggttcccgcccaggtcgcccaggcggcgaatgtctccggtaatgatgatgtggtgagtccgtcgcaggcagaaatcagcgatcttaccgccgccggaagccgcgcggatccggttcaggccccgacgcaggaccaggcagcgcctgctgcggaaccggcagcccaggcgccggcaacatccgccacgccgcagactaccgcttccccggccacccagccggttaccgcgccggccgcacagccgcagcccgtggtcgcaaccgccgctaacccttctgcggaactgaaaatttacgacaccaccagccagccgataagccagctgctcgcccaggcgcagcaggatggcgccaccctggtggttgggccgttgctgaaagaaaacgttgaagaggttatcaagagcaacacgccgctcaatgtgctggccctcaaccagccggaaaaagtcgaaagccgcgctaacctctgctatttcgcgctttctccggaagacgaagcgcgtgacgccgcccgacatatccaccaacaggggaaacagaccccgctgctgctggttccgcgcggcgcgctgggcgatcgtgtggttagcgcttttgccgacgagtggctgaagctgggcggcgccagcgtcctgcagcagcgttttggatccacggccgagctgcgcgccggcgtgaacggcggcgggggcattgcgctgagcggcaccccggtctccaccctgccatcagcgcagaacagcatcctcggcagtgcggatgagatgccggtaagcagcggcggcagcgtcgatgcggcctatatcctcgccaccccggaacagattgcctatatcaaaccgatgatcgccatgcgcaacggcagccagagcaatgtcaccctgtacgccagctcgcgcagcgcccagggcaccgcggggccggatttccgtctggagatggaaggcttgcagtatagtgagatcccaatgctggccggcagcaatccgtcgctaatgcagcaggcgctgtccgcggtgcgtaatgactactcgctggcgcgtctgtatgccatgggcgctgacgcctggtcactggcaaatcacttcacgcaaatgcgccagacgcctggcttcgagctgaacggcaataccggcgatctgacggccaaccaggattgcgtgattaacaggaaactgtcatggctcaagtaccagcagggaaaaatcgttccggccagctaa

SEQ ID NO: 2147 - DNA, 348 bp, Klebsiella pneumoniae
tcgggcaaacaggcgcatggaggcgatttcgtacagggcatcttccatggcaccgtcgctcaggttgtaccaatgctgcatgcagtgaatacgcagcatggtctccagcggatagggccgtcggccattgcccgccttgggataaaacggctcgatgacttccaccatgttttgccatggcagaatctgctccatgcgggagaggaaaatctcttttcgggtctgacggcgcttagtgctgaattcactatcggcgaaggtgagttgatggctcatgatgtccctctgggatgcgctccggatgaatatgatgatctcatatcaggaacttgttcgcaccttccttag

SEQ ID NO: 2148 - DNA, 1680 bp, Klebsiella pneumoniae
cggaagagacaacagcacgcgcggtgcttaccctggcctcctgacggcctggcgccgcgcgacaacagcgaggcgcatgtcatgagttacctgttagcgttagatgccgggaccggcagcattcgggcggttattttcgatcttaatggccgccagctggcggtaggccaggccgaatggaaacacctgagcgttgataacgtccccggctcgatggagttcgaccttaccaccaactggcagctggcctgccagtgcattcgccaggcgctcgacgccgcccggctctctgccgccgatattcagtccgtcgcctgctgttcgatgcgcgaaggcatcgttctctatgaccgcaacggcgaggccatctgggcctgcgccaacgtcgatgcccgcgccagccgcgaagtggcggagcttaaggagatccacgactatcgcttcgaatccgaggtatacgaggtctcgggacaaaccctggcgctcagcgccatgccgcgcctgctgtggctggcgcaccaccgccccgatatctaccgcaaagcggcaaccatcaccatgatcagcgactggctggcggcgaagctttccggcgagctggcggtcgacccgtcaaacgccggcaccaccggcatgctcgatctgttcagccgcgactggcgtccggcgctgctggatatggccgggctgcgcgccgatatgctgtcgccggtcaaagagaccggtaccctgctgggcgccgtcaccgaagcggcggcgcagcagagcggcctgcgcgccgggacgccggtggtgatgggcggcggcgacgtccagctcggctgcctgggccttggggtggtgcgcgccgggcaaaccgcggtactcggcggcactttctggcagcaggtggtcaacctgccgcaggtgcgcaccgatccgcagatgaatattcgtgttaatcctcatgtcattcccggcatggcgcaggcggaatcgatcagcttctttaccggcctgaccatgcgctggtttcgcgacgccttctgcgctgaagaaaaactaattgccgagcggctcggcgtcgatgcctattcgctgctggaggagatggccagccgcgtccccgccggttcccacggcgtgatgcctattttttccgacgctatgcactttaagcagtggtaccacgccgcgccgtcgtttattaacctctccatcgatccggagaagtgcaataaagcgaccctgttccgcgcgctggaagagaacgcggcgattgtctccgcctgcaacctcgcgcagatttcgcagttctccggggtaacattcgagagcctggtgtttgccggcggcggctctaaaggcgcgctgtggagccagatcctcagcgacgtcaccggcctgccggtgcgggtgccggtggtccgcgaagccaccgcgctgggctgcgccatcgccgccggaaccggcgccgggctgtatgacgatatggccagcaccggagagcggttagtgagctggcaccgcgagttcaccccaaatccgcagcatcgcgagctgtatcaggagatgatgagcaaatggcagacggtgtacgccgatcagcttggccttgtcgatagcggactgacaacgtcgatgtggcaggcgccgggtctggagcgccgccagcgcgttgtgtcttccccctcaccctaa

SEQ ID NO: 2149 - DNA, 1476 bp, Klebsiella pneumoniae
ctttgtcagcattgtagtcaatcatctgaaaggctcccgcactggagcgaagaggacacgcgaatgacatcgtttatgactgaagattttctacttgataccgagtttgcccgccgtctgtaccatgattacgccaaagatcagccgattttcgactaccactgccaccttccgccgcagcaggttgccgaaaactatcgctttaaaaacctgtatgacatctggctgaaaggcgatcactataaatggcgcgcaatgcgcaccaacggcgtgccggagcgtctgtgtaccggtgatgcgtccgatcgcgagaaatttgacgcctgggcggccacggttccgcacactattggcaacccgttataccactggacccatttagagctgcgtcgaccttttggtattacaggtaagctgttgtcgccatccaccgccgatgagatctgggaccagtgtaatgatttgctggctcaggatgccttctccgcccgcggaatcatgaagcagatgaatgtgaagatggtcggtaccaccgacgatccgattgattctcttgagcaccacgcggctgtcgccaaagacaactcctttgacatcaaagtactgccgagctggcgcccggataaagcgttcaacatcgagttggcgaccttcaatgattatatggctaagctgggcgaggtatccgataccgatattcgccgcttcgctgacctgcaaagcgccctgaccaaacgtctggatcattttgccgcacacggttgcaaagtctccgatcatgcgctggacgtggtgctgtttgccgaagcgaccgacgccgagctggatgacattctggcgcgccgcctggctggcgagacccttagcgaacacgaagtggcgcagttcaaaaccgcggtgctggtattcctcggcgcagagtatgcccgtcgcggctgggtccagcagtaccacattggcgcgctgcgtaacaacaacctccgtcagttcaaactgttagggccagacgtcggcttcgactcgatcaacgatcgtccgatggcggaagagctgtctaagctgctgagcaagcagaacgaagaaaacctgctgccgaaaacgattctctactgcctgaacccgcgtgataacgaagtgctgggcaccatgatcggtaacttccagggtgaaggcatgccaggcaagatgcagttcggctccggctggtggttcaacgatcagaaagacggtatggagcggcagatgacccagctggcgcagctcgggctgctgagccgcttcgtcgggatgttgaccgacagtcgcagcttcctctcctacacgcgccacgaatacttccgccgcattctgtgccagatgatcggccgttgggtggctgccggcgaagcgcctgcggatatcgcgctgctgggcgagatggtgaaaaacatttgctttaacaatgcgcgtgactatttcgccattgaactgaactaa

SEQ ID NO: 2150 - DNA, 237 bp, Klebsiella pneumoniae
agacgagagcatcgatcagcagctggtgcgttcccaggcgtactggcacagcaagtaaaaagccatcgtggtaaaacccggatagcggcgcgtcgcgccttatccgggctaccggcggtgccgttttttgtcgggtggcggcttacgccttacccgacctgctattcggcggtgttacatcgccccggtaagcgcagcgccaccggggaaggcttaacgttccgccagcgcctttaa

SEQ ID NO: 2151 - DNA, 717 bp, Klebsiella pneumoniae
agagaggtcaagaacatgattactacccgaacagccaaacaatgcggacaagcagacttcggctggctgcaggcccgctacaccttctcctttggccactacttcgacccgaaattactgggcttcgcatccttgcgcgtcctcaaccaggaagtgctggcgcccggcgcttccttccaggccagaacgtacccaaaagtcgatatcctgaacctgattctggaaggtgaagcggagtatcgcgacagcgacggcaaccacgtgcaggccaaagccggtgaagcgctgctgatcgccacccagcctggcgtgagctatagcgagcataatctgagtaaagagcagtcgttaacgcgaatgcaactttggcttgatgcctgcccgcagcgggaaaacccgctgcagcagaaaatcaatgtcgcagacgcgacgctgcagctgctggcctctccggagggcggggataacaacctccagcttcgccaacaggcctgggtctaccatatcgcgatggagaaaggtgagcagatcaacgtgcaattacatggtccacgcgcctacctgcagtcgattcacggctccgtccatgccgtcgcacaggaacagcaaaagcaggctctcacctgcggtgacggcgcatttattcgtgacgaagctaacattaccctcgtcgccgatacgccgctgcgcgctttgctgatagatttaccggtgtaa

SEQ ID NO: 2152 - DNA, 786 bp, Klebsiella pneumoniae
cgcaaggtaaaaatcatggataacgcaatttttccgaacaaatttaaggccgcgctggcggcgcatcaggtgcagattggctgctggtgcgctttggctaacccgattagcaccgaggtgctgggtctggcggggttcgactggctggtgctggacgcggaacacgcgccaaacgacgtcaccacgctcattccgcagctgatggccctgaaaggtagctccagcgcgcaggtagtccgtgtgccgaccaatgaacccatcatcatcaagcgcatgctggacatcggcttctataacttcctggtgccgtttgtcgagacggctgaacaggcggcgcaggcggtggcttcgacccgttatccgccggaagggatccgcggggtctccgtttcccaccgcggcaatatgtttggcaccgtgccggactacttcgcccagtccaacaagaacatttccattctggtgcagattgagagccagaccggagtggacaacgtcgaggcgattgccgcgaccgagggcgtggacggtgtgtttgtcggcccgagcgacctggccgccgccttaggccatttgggcaatgccgcccatcctgaggtgcagcgcgctatccagcatatcttcgccagcgcgaagaagcacggtaagccaagcggcattctggcgccagtggaagccgatgcgcgccgctatctggaatggggcgcgaccttcgtcgccgttggcagcgatctgggcgtcttccgttctgcaacccagaaacttgccgacgcgtttaaaaaataa

SEQ ID NO: 2153 - DNA, 873 bp, Klebsiella pneumoniae
ctatatcaaaaaaagacttgcattctttttagttggcaatcattatcatttgcatcaagtttagatatatctatttaccgttcacgaaggcaatcgatgatgacaaaaaccaaagcagacaagtacccgcagcgtgtccgcaatgagctgcgtttccgtgagctgacggtgctgcgcgtggagcgcgcaggcgcggcgttccagcgtatcgtgctgggaggcgaggcgctggaaggcttcgcctctcacggctttgacgaccataccaagctttttttccccgagccgggcgcggcatttaccccgccgcaggtgaccgaggaggggattgactggggggaaggcgtgcggcctgccacccgcgactatacgccgctgtacgatgccgaacgtcacgagctggcttacgatttctatatccacgatggcggtatcgccagccgttgggcgctggaagcaaaagtgggcgataagctggtgatcggcggcccgcgcggctcgctggtggtgccggaagattatgcctggcagctgtatgtttgcgatgagtccggcatgccggcgctgcgccgtcgtctgctgggattacgccagctgccggcgaggccgcaggtgacggccatcgttactatcgccgatgcgtcgtataaagattatctggcggatctcgacggctttaacatcgagtgggtggtgggccacaatccggccttcgtcgccgagcgtctggcgcaggtgaaggtgccggcggaggattattttatctggctgaccggcgaaggcgcggtggtgaaatcgctgctggcgcgctttgaagacgagagcatcgatcagcagctggtgcgttcccaggcgtactggcacagcaagtaa

SEQ ID NO: 2154 - DNA, 582 bp, Klebsiella pneumoniae
atatatcaaaaacagcaggaggtaaccatgcgacatcatcatgaagaagggcgtgggccacgcgggcgccacggtgatcccagcgaacacggcgaccatggccgccgcggcggcggacgtcgccagcgtttctttggccacggcgaactgcggctgatcattctggatatcctcagccgcagcgccagccatggctatgagctgatcaaagagatcgaaacgcttacccaggggaactacagccccagcccgggggtgatctatccgacgctggatctgctccaggaccagggccttatcagcgtggaagacgacaacggacgcaagaaaatccttatcagcgaggaaggaaaacagctgcacgccgagaaccaggagcacctggcccatatccaggagcgtctgcaggcgcggatggtcggctgcgagctgcgccgcgatccgcagatgaagcgcgcgctggaaaacttcaaagcggtcctcgacctgaaagtgaaccagcaggccagcagtgccgcccagctcaagcagatcatcggcattattgaccgggcggcgatggagatctctcagctcgactaa

SEQ ID NO: 2155 - DNA, 1077 bp, Klebsiella pneumoniae
  unsure (512): Identity of nucleotide at the above locations are unknown.
ataatgaaaaagctgattaaccgtgttgaagatgtactgaatgaacaattacaggggctggctaaagcccatccgcagctgaccctgcatcaggacccgctgtatgtgacccgcaccgacgcgccggtggctggcaaggtggccctgctctccggcggcggcagcggacatgaaccgatgcactgcggctatatcggccagggcatgctctccggcgcctgtccgggggaaatcttcacctcgccgacgccggacaaaatgtttgaatgcgcgatgcaaattgacggcggcgaaggcgtcttgctgattatcaaaaactataccggcgacatcctgaattttgagaccgccaccgagctgctgcatgagagcggcattaaagtcaccaccgtggtggtcgacgacgacgtggcggtgaaagacagcctctataccgccggtcgtcgcggcgtcgccaacaccgtactgatcgaaaaactggtcggcgccgccgccgagcgcggcgacttcgntggaagccttgcgctgaaatgggccgccgccctgaacaatctcggccactcgattggtatcgcccttggcgcctgcaccgtaccggctgccgggcagccttcctttacgctgaaagatgacgagatggagttcggcgtcggcattcacggcgagccgggcatcgaccgccgccgcttcagctcgctggaccaaaccgtcgatgagatgttcgataccctgctggaaaacggcgcttacagccgcacgctgcgccagtgggataccgtcaagggcacgtggcaggaagtacagcagagcaaaaccgcgctgcaaaacggcgaccgggttatcgcgctggttaataacctcggcgccactccgctttccgaactgtatggcgtgtataaccgcctcgcccagcgctgcgaagcgtccggcatcatcatcgaacgcaacctcatcggcagctactgtacttcgctggatatggcgggcttctccatcactctgctgaaagtggatgacgagacgctgacgctatgggacgccccggttcacaccccggcgctgaactggggaaactaa

SEQ ID NO: 2156 - DNA, 396 bp, Klebsiella pneumoniae
aaaatgaaaaaattagaagatgttggtgtattggtagcgcgtattctgatgccgattctgtttatcactgcaggatggggcaaaatcaccggttatgcgggaacccagcagtatatggaagccatgggcgtcccgggcgcgctgctgccgctgaccatcctccttgagttcggcggcggtctggcgattctgttcggtttcctgacccggaccaccgcgctgttcactgcgggctttacgctgctgaccgcgttcctgttccatagcaactttgcggaaggcgtgaactccctgatgttcatgaagaacctgaccattgcgggcggttacctgctgctggccattaccggaccgggcgccttcagtattgaccgtgtactgaataagaaatggtaa

SEQ ID NO: 2157 - DNA, 1005 bp, Klebsiella pneumoniae
gaccaggaaaagctgcccttcatgttaaccgcaacgggttgcggatcagtaaacaaaaccggcccccttcttccccgttatgcccagggggccaggaccgccaccagccggtttcggattggggctggtcatttgcaaaagctgggttgcgttaatgcagggtcgcctggaaatgttcagccgcccgggcgtggggaccactttcaccatcacgctgccggtcaaggcgagccgctgcgcgatccacgcgccgccaggcgtcgcccgccagaccgcaggctctacccgggctggccgatattgatagcggacgatcaccccaccaaccggctactgctcaagcgccagctcagcactatcggctatagcgtcgatgaagcctgcgacggtgaagaggcagagaataagctcgccagcaaacattacgatctgctgataacggacctcaatatgccgaagaaagatggcctggagctggcggcctcgctacgccgtcgctatccgggcctggtaatttggggcgtgactgccagcgcgctgccgcagtcgcgggaggcgtgtctggccagcggcatgaatatgtgtctgtttaagccggtgtcggtccagacgctgagtcatgagctcagccgtttagcggtgggccgcgcatcacctcacgctacccggcacctgaagctcagcgtgctgagcgagaatacggggggagaccaggcgctgatgaatgagatgctggagacgttccgcgatgcgtcggccgccgatttacaggctgccggacaggcaatcgcccggcatgagccgcagatttttctgcgggcgctgcaccgtctgcacggttcagcacaaattctggggattactgcgctacaacaactgtgcgccccttttgaggcaaagcggcctgattcgctgacgccggcaagctgtctggaggtggtacagcgcatcaccggcgtcatgcgcgagatggatggcgaaatcgacgccctgatcggccgctag

SEQ ID NO: 2158 - DNA, 456 bp, Klebsiella pneumoniae
tggagaagaaagatggatacgcttgccgccattggtcgctggctgagtaaacagcacgtcgtcacctggtgcgtctcccgtgaagacgagctgtggtgcgcgaatgccttttacgtctatgacccggataccgtggccttttatctgctcagcgaggagcacacccgccatggccagatgaccggacagagggcgaaggtggccggcacggtcaacggccagccaaaaaccgtggctctgatccgcggggtgcagttcaaaggcgagatccgtcgtctgagcggtgacgaagaggcgcgaatgcgccagcgctacgtcaagcgcttcccggtggcccgcatgctgtcggcgccggtatgggagattcgtccggacgaaatcaaatttaccgacaacacgctgggtttcgggaaaaaattacactggcggcgtgatgccggcgccgagcaggcgtag

SEQ ID NO: 2159 - DNA, 999 bp, Klebsiella pneumoniae
atgaagctgaagcttaactgggaaagcgcgctgctggcgttgctgatcgtggagatcctgctgttcggcgcgctgaatccgcgcatgctggatctcaatatgctgctctttagcaccagcgactttatctgcatcggcatcgtcgcgctgccgctgacgctggtgatcatcagcggcgggatcgatatttcgctgggctcgaccatcggcctgtgcgccatcgccctcggggtgatgacccaggcgggctggccgctgtggctcgcggtatcgctgacgttgctcttgggactgctgtgcgggttattcaacgccgcgctgatccactacaccggcatcagcccgctggtgatcacgcttggtacgctgtatctgtacggcggcggcgcgctgctgctttccgggatggccggcgcgaccggttacgaggggattggcggttttcccgatagcttcaccgccttcgccaatttaaccctcgccggactgccgctgccgctggtgctgttcgcgattatcacctttttcttctggctgctgacccatcgcgggcgctttggccgccacctctttttactcgggcaaaacccgcgcgccgcgcgctatgccgcgctgtcggtgaacggcatcccgtacgtgctgtatggcctggttggcgtcgcctcggcggtcgcggcgctggtgatggtctcctatttcggctcggcacgttcggatttaggccgcgacctgctgatgccggcgctgaccgcggcggtgctcggcggggccaatatttacggcggctcgggatcgatactgggtaccgcgctggcggcattgctggtggggtatctgcaacagggtttacagatggtcggcatccccaaccaggtgtcgagcgcgctgtcaggggcgctgttggttgtggtggtgatggggcgttcgctgagcctgcaccgtgaatgggtgcgcgcgacctggcggcgtcttttctcgcataaaacaatcggagcataa

SEQ ID NO: 2160 - DNA, 543 bp, Klebsiella pneumoniae
ccgtggctgaactgccctcctgacagacataatgataagacgatgacaaaactcatttatttacagggctatcctgaatcgctgctggcgcaggtgaccacgttaatcgagcaaggccgcctcggcgaggtgctgcaaaagcgctatccgcaagggcacgacgttaacagcgataaagcgctgtatcagtacacccaggacttgaaaaaccgctttctgcgcggcgcggcgccgatcaacaaagtgatgtatgacagtaagatccacgtgctgaacaatgcgctcggcctgcataccgccatttcccgcgtgcagggcggtaagctgaaagctaaagcggaaattcgcgtggcgacggtatttcgcgacgcgccggaagcctttctgcggatgatcgtggttcatgaactggcgcatctgaaagagaaggatcacaacaaggctttttatcagctgtgctgccatatggagccgcagtaccaccagctggagttcgacacccgcctgtggctgacgcacctttcgttaaatcgttctgcgtag

SEQ ID NO: 2161 - DNA, 465 bp, Klebsiella pneumoniae
atcgctgggaaaaccttcaactcactcatgaaaacaggctgccgccgcgggcgtatttcttttcttacgactcactggcccaggcgcggaccttcgcccgcgagatcagcagccgcttcctgtccctcagcgggcagtggaacttccgcttcttcaccaacccgctgctggtaccggagagctttacctcatgctatcagaacgagtgggggccgattaccgtaccgggtatgtggcagatggaaggccacggccagctgcagtacaccgacgaaggtttccccttccccatcgacgtgccctatgtcccgaccgataacccgaccggcgcctaccagcgcctgtttaccctcggcgacggctggcagggcaaacaaaccatcatcaaattcgatggcgtcgaaacctatttcgaagtctacgttaacggccagtacatcggctttagcaaaggcagccgcctga

SEQ ID NO: 2162 - DNA, 1818 bp, Klebsiella pneumoniae
  unsure (702): Identity of nucleotide at the above locations are unknown.
gcctggaacctgagcctgaaagtgcaaggcggagaattctgtaaaggagaaccaatgagtcaggtattattaaccggcgcgaccgggttagttggcggtcacttactccggctgctgcagaatgagccccgtataagcaccatcgccgcgccgacgcgtcgcccgctggcgccagcggaaggtgtctttaatcctcacgatccccagctgaccgatgccctggcgcaggtggttgacccggtggatatcgtcttctgttgcctgggaacgacgcgccgggaggccgggagcaaagaggccttcgtccatgctgactacacgctggtggttgataccgcgctgaccggcaaacgactgggtgcgcaacatatgctggtggttagcgcgatgggcgccaacgcccactcgccgtttttctacaatcgggtgaagggagaaatggaggcggcgctgattgagcaagactggccgcggctgaccatcgccaggccgtcgatgctgtcaggcgagcgggaaaaaaagcgggccaatgagaccttcctcgcaccattgttccggctcttgccggggaactggaaatccattgcggcccgcgatgtggcgatcgccctgctggcggaggcgctgtcgcccacccacgaaagggtgcgaattctgtcatcatcggaactacgggagcgcgccgcgcggcaggctgaatancggtttgcaaacgcatgcttccggcgtattattcacggcttcaattcatatccacatttcttgctggggaatgctatggctggtcagtcttcatctcaggcggcgtcaccatttcaatggtggaaacccgcgcttttctttctcgtcgtgattgttggtctttggtacgtcaaatggcagccgtactacgggaaagccttcaccgctgcggaaacccacagtatcggtaaatccattctcgcccaggccgacgctaacccgctgatggcggcgtgggactatgcgatggtttacttccttgccgtctggaaagcggcggtgctcggcgtgctgctcgggtcattgattcaggtactcattccgcgcgactggctgctacgcaccctgggacaatcgcggtttcagggcacgctgctgggagcgattttctcgctgcccggcatgatgtgcacctgctgcgccgcgccggtcacggccgggatgcgcaaacagcaggtgtcgatgggcggggcgttggcgttctggatggggaacccgctgctcaatccggcgacgctggtgtttatgggttttgttctgggctggcagtttgcgctggttcgcctggtggcgggtctggcgacagtattaactgtggcgacgctggtgcagaaatgggtgaaagaggcggcgacgcagccggtagcggtgcctgctgcaccgtcggaagcgactcagggcggcttctttagccgctggcttcaggcgctgtggacgctgttctggaacacgatcccggtttatatcctcgcggtgctggtgctgggagcggcgcgcgtctggctgttcccgcacgccgatggcgtggtggataatacgttgttctgggttatcgcgatggcgatcgccggctgcctgtttgtgatccctaccgcggcggaaattccgattgtgcagacaatgatgctggcgggtatggggacggcgcccgcgctggcgctgctcatcacactgccggcagtgagcgtgccgtcgctgattatgctgcgtaaagccttcccggccaaagcgctgtggctgacgggcggactggtggcgctgtgcggggcgattgtcggtgcgctggcgctggtgtag

SEQ ID NO: 2163 - DNA, 495 bp, Klebsiella pneumoniae
agatcagctgatgtcctgcctgatgctcctgccggttgccctgttggtcttcggactgatcggctcgctggtggtactgtggaagaaaaaatacagaagccggggctaatgatggtcatgaaacgcccttccctgcgccagttcagctggctgctgggtggttctcttctgctcggcgccctgttctggctttggctggcggtgcagcagcaggaggccacgctggcgatacgcccggttggccagggtatcggaatgccggacggtttctccgtctggcatcatctcgatgccaacggcatccgctttaaaagcatcacgccgcagaaggatggtctgctgattaagttcgattccaccgcccagggcgcggcggcgaaagaagttctcggccgcgctctgccacatggttatattattgcccttctggaggacgataactcgcccaccgcctggctatcccgcctgcgcgacgcgccgcatcgcctcgggtaa

SEQ ID NO: 2164 - DNA, 1332 bp, Klebsiella pneumoniae
atgattttggattctacattagatgaaaaaaaaggaataccgacccgctatttaattctgttgatgatatttgtggtgacggcagtgaactatggcgaccgcgcgaccttgtctatcgccggtactgaagtcgcgaaagagctggggctcagcgcggtgtcgatgggatacattttttccgccttcggctgggcttatctgctgatgcagatccctggcggctggctgctggataaatttggctcgaaaaaggtttattcatacagtctgtttttctggtcactgtttaccttcctgcaaggctttattgatgtgttcccgctcgcctgggccggggtctccatgttctttatgcgttttatgctgggcttttccgaagcgccctcgtttcccgccaacgcccgcattgtggcggcctggtttccggccaaagagcggggtacggcttcagctatctttaatgccgctcagtacttctcgctggctctgttctcgccgctgctcggctggctgaccttcgcgctgggctgggaacatgtctttaccgtgatggggataatagggtttgtgctcaccatcatctgggtgaagtttgtgcataaccccaccgatcatccgcgaatgtccgccgcggagctgaaatatatctcagaaggcggcgcagtggtcgatatggaccataaaaaagaggccaccccggcggccgggccgaagatggactatatccgccagttgctgactaaccgaatgatgttaggcgtatttttcggtcagtatttcctgaataccattacatggttcttcctgacgtggtttccgatctacctcgtgcaggacaagggaatgtcgattctgaaagtggggtttgtggcttcgattccggcgctgtttggctttgctggcggcgtactgggcgggctgttttcggattatctgattggccgcggctgcacgctgacttttgcgcgtaagctgcccattgtgctgggaatgctgctggcgtcgtccatcatcctgtgtaactacacggccagcacgccgctggtcattacgcttatggcgctggcgttctttggcaaaggctttggcgcgctgggctggccggttatctcggatgtcgcgccgaaggagattgttggcctgtgcggcggggtattcaacgtctttggcaatgtggcctcgatcgccacgccgctggttattggctacatcgtgagcgaactgcactcatttaatggcgcactgatttttgttggcggctccgcgctgatgatgatggtctgctacctgtttgtggttggcgatatcaaacgtatggaattgcagaagtaa

SEQ ID NO: 2165 - DNA, 528 bp, Klebsiella pneumoniae
atggcgacactaaccactacggcaacccgtccgtctctgtttggcggcgtggtgattatcggcggcacgattatcggcgcgggcatgttctcgctgccggtggtgatgtccggcgcgtggtttttctggtcgctggcggcgctggtcttcacctggttctgcatgctgcactccggtttgatgatcctcgaggccaatcttaactaccgcatcggctccagcttcgacaccattaccaaagacctgctcggcaagggctggaacctggtgaacggtgtatcaatcgcctttgtgctctatatcctgacctacgcctatatttcggcgagcggttcgatcctccaccacaccttcagtgaactgtcgctaaaggtgccggcgcgcgcggcgggcttcggctttgcgctgctggtggcgtttatcgtctggatgagcaccaaagcggtgagccgcatgacggctatcgtactgggcgctaaggtgatcaccttcttcctgaccttcggtagcctgctcgggcacgtctag

SEQ ID NO: 2166 - DNA, 270 bp, Klebsiella pneumoniae
aaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccgcggactgttaccagccgcgcggtgcgctcttaccgcaccctttcacccttacctgatcccgcttgcgcgggccatcggcggtttgctctctgttgcactggtcgtgggctgtga

SEQ ID NO: 2167 - DNA, 684 bp, Klebsiella pneumoniae
aggcgtatttgcgttggcgcccagaggcttggtttgtgtatcggcctgatagcgttgcgccatcgggctcgtaacagcggcgtttcagccagtgaagcgccgtttgtttttttcagtcagggagcttacatgaccgcgtattggctggcccagggggtcggcgtcatcgcctttcttatcggcattaccacctttatcaaccgcgatgaacgccgtttcaggctacagctggcggtctatagcgctattatcggcgttcattttttcctgatgggcgccgggccggctggaatgagcgccgggctcaatgcgcttcgcacggtcatttccttacgcacccgtagcctgtgggtgatgacagtctttatcctcctgacgttgattctcggcctgggtaaactgcagcatgccatggagctgctgccgatcattggcaccgtcgccagcacctgggcgctgtttcgctgcaaagggctaaccgtccgctgcgtgatgtggtgctccaccgcctgctgggtcacgcataatctgtggttgggttccattggcgggacgctgatagaaggcagtttcctgatcgtcaacgggctgaacatcattcgcttccgccggatgcaaaagcgcggtatcgatccgtttaaggttgaaaacgcagtacaggaagagagcccctccgcccgatag

SEQ ID NO: 2168 - DNA, 555 bp, Klebsiella pneumoniae
cggaactattgcattcatggagtaaagcttgtgttggataaactgcgttcccggctggtccactttggcccgtctttaatgagcgtgccggttaagctggcgccttttgccctcaagcgccaggtgctggagcaagtgctgagctggcagtttcgccaggcgctggcggagggggagctggagtttcttgaggggcgttggttaagtattcatgtgcgtgacatcggtctgctgtggtatacctcggtagtcgatggtcgactggtggtcagccagcaggccgacgccgacgtcagcttcagcgccgacgccagcgatctgttaatgatcgccgcgcgcaagcaggatccggatacgctattcttccagcgtcgtctggtcattgaaggcgatacggagctggggctgtatgtaaaaaatttgatggacgccattgagctcgagcagatgccaaaagcgctgcgcgtgatgttgctgcaactggcggattttgtcgaagctggactgaagagcccgcagaaacctgaacagacatcggtaggtgaggcatgctga

SEQ ID NO: 2169 - DNA, 1305 bp, Klebsiella pneumoniae
tgcaggcgctgcgcgcggacggtctcggcactgcagaccatagcgcgctggcgtgctattacgaaaaactggcgaaagtggaagtcactcgctaacaagaagggcgccctgcgcgccctgttatgcttgccttgcgcggcactgtcaggctacaaaattatgaaaatcgtcattgccccagactcttacaaagaaagcctgtctgccagcgaggtagctcaggcgatagaaaaaggatttcgggaaattttccctgatgcacagtatgtttccctgcccgtcgccgacggcggcgaggggacggtggaggcgatgattgccgccacgcagggaaaggcacatttcgcgtgggtaacgggtccgctgggtgagagagtgaaggcctgctggggcatgtccggcgacggcgtcaccgcgtttattgagatggcggcagccagcggtctggggctcgttccgcccgacaaacgtaacccgctcatcaccacttcacggggtaccggggagctaatattacaggcgctggagcatggtgcggaacggatcattatcggcatcggcggtagtgcgaccaacgacggtggggcgggtatgatgcaggcgctaggcgcccgcctctgtgacgccgagggacaagagattggccatggcgggggcagtttgagccgtctgagccggatcgatctttccgccatcgatccgcgcttacgtgacaggatgatccacgtggcctgcgatgttaccaatccgctggtgggcgagcgtggggcgtcgcggatctttggcccacagaaaggggcgaccgaggcgatgatcgtcgagctggatcgtaatctggcgcattatgccgacgttattaaggcgtcgctgcaggtggacgtgaagtcgatccccggcgcgggagcggccggcggcatgggcgcggcgctgatggcctttctcaatgcggagctgcgcagcgggattgagatcgttaccgaggcgctgaagctggaagagcagatccatgactgctcactggtggtcaccggggaagggcggctcgatagccagtctgttcacggtaaggtgccggtgggggtggctcgggtggcgaagaaataccgtaagccggtgatcggtattgctggcagcctgactcacgatgtcggcgtggttcaccagcacggtatcgatgccgtattcagcgtgttaacttccgtttcgacgctggaagaggcatttcgcggggcgtttgataatatttaccgcgcgtcgcgtaatattgctgccaccctgcaggttgggatgaccactgagggatga

SEQ ID NO: 2170 - DNA, 282 bp, Klebsiella pneumoniae
acatgcagctgctgggcgatgcgcagccgcgcaccgaacgtcgtgacggcggtgagcgtcgcgaagacggccgtggcttcggcggcgagcgtcgtgaaggcggccgtggcttcggtggcgaacgtcgtgaaggcggtcgtggtgaaggacgtcgtttcagcggcgaacgtcgtgaaggccgtgcgccgcgtcgtgacgatgcatccgcgccgcgccgcgatgactcagccggtcgccgtcgcttcggtggcgatgcgtaatcaacgccgcccgctagcgtaa

SEQ ID NO: 2171 - DNA, 1101 bp, Klebsiella pneumoniae
aagcggctccggcttcccatacctcttaaataccttaaaaaaatgaaaactaactcttacttatacggggcactcgttgccctggctgtttgcgcccctgcggcggccgctgagactgtccatccggccgagcacgacgataccaaaacgccggaattaaccaccacctcctatcgcttttacggcgagttgggggttggcggatacatggatttagaaggcgaggacaaacataaatacagcgatggcacctatatcgagggcgggctggaggtcaaaaacggccactggttcgggctgatttacggcgaagcctggacggtacaggccgatagccagggcaatgcctggacgccaggccacagctggggcggcgtggaaggcggccttaaccgcctctatggcggctataaaaccgataacaacaccgagatcatgctcagcctgcgccaggactcgtcgctggacgacctgcagtggtggggggactttacccccgatctgggttacgtgatccccaatacccgcgacatcatgtacgcgctgaaggtacaaaaccgcagcggcgatttccgctatagcgtcaccgccacgccggccggtcatcacgatgaaagcaaggcctggctgcacttcggcaaatacgatcgctatgacgataagtacacctacccggcaatggtcaacggctacgtgcagtacgacatcgtcaaagatgtcacctggatgaacggccttgaagtgaccgacggcaccgggcagctattcctgaccggcgttctgtcgcccaatctggccttccgcgcctggcaccataccggccgcgccaaagggctggatgtccccggcagcgaaaccggctttatggccagcgccatgtatgaagcattaagcgggctctacttctccaccgcatacagctacgccaaacaccgcccggaccacgccgctgatgaaaccaccgcgtttatgcaatttggcatctggtacgaatacggcggcgggcgtttcgccaccgccgccgacagccgtttctataccagcaacgccagcggcgacccgagcgacaaaattttcctgatgcaatacttctactggtaa

SEQ ID NO: 2172 - DNA, 573 bp, Klebsiella pneumoniae
ctcgcccaccgcctggctatcccgcctgcgcgacgcgccgcatcgcctcgggtaagctgccgccagactgcgtttttaacccagtctggtggtttcccgcatttgttactatgcttaaacctgcgggaatcaacgcattcacgttcaccaacgggaacgggtatatcctccgggtatcccctcagacaatggaaggtactatccatgaaacaccgcatcgctctgcttctggtcctgacttcacttagcgccagcgccctagccgcctctccctgccaggaaaaagagcaggatattcaacgagagatcagctacgccgaaaagcatcataatcaaagtcgcattgatgggctaaataccgcgctacgtcaggttcgggaaaactgtagcgacagtaaactcaaagccgatcatcagcaaaaaattgccaaacagcgggaagagatcgctgaacgtcagcgcgatctgcaggaagcccggaagaaaggcgatgcggacaaaattaacaaacgccagcataaactcaatgaagcgcaacaggagttaaaaacgctggagtctcgggattactaa

SEQ ID NO: 2173 - DNA, 1017 bp, Klebsiella pneumoniae
aagtcgaaccgaacagcgtgcagggctatcagtatgagccgaagggcaacggtatcgtgctgctgcccggaggcgcgtggtgttcagcaaagagaacatcaacaactacgacttctgacggaggatgagatggcagatttagacgatatcaaagaggggaaggagttcggcatcgaccgcccgcagcagaatacgctgtataccctgaaaggctgcggctcgctggactggggcatgcagtcgcggctggcgcgcatttttaatccgcacagcaaccgcacggtgatgctggccttcgatcacggctacttccaggggccaacgaccgggcttgagcgtatcgacctgtcgattgcgccgctgtttgccgacaccgacgtgctgatgtgcacccgcggcgtactgcgcagccaggtaccggcggccaccaataagccggtggtgctccgcgcctccggcggcaattcgattttgagcgaactctccaacgaatgcgtggcggtggcgatggaagacgcgctgcggctcaacgtatgcgcggtggcggcgcaggtctatatcggcagcgaatacgaacatcagtcgatcaataacatcatcaaactggtggacgccggcaatcgctacggtatgccggtcctggcggttaccggcgtcggcaaagagatgacccgcgatgcgcgctacttctcgctggccagccggattgccgccgaaatgggggcgcagtttgtgaagacctatttcgttgaggaaggctttgaaaaagtgaccgccagctgtccggtgccgatcgttatcgccggcggtaaaaaactgccggagcatgaggcgctggagatgtgctggcgggcgatcgaccagggggcttccggggtggatatggggcgcaatatcttccagtccagcgccccgcgcgcgatgctgaaggcggtgaaaaaggtggtgcatgagaatctgaacgcgcgcgaagcgtatcagttctggcaggaagagaaacagggagagctgaaatga

SEQ ID NO: 2174 - DNA, 834 bp, Klebsiella pneumoniae
gccttcagccgcgtggcgacggcgcgacttacctggtcgacatcagatcctgaatcggtcgttatattgacttttacgttcattggtcactatgatgaaacaaattggtcattacaggattatcgaatgcgtagcgtaacgccgtcaatcgaatctgcggtcagccgcctggcgccgggctttcgggcattaagtattgtggtggagagcgcgccggtggccgatcccgccgtcgcggagcaggcgctggccgaggcctgcctggcggtgcagcaggatgatgtgccctgggcgcaagcgcacctggcggcatgggatgaagcgttcagcgccttcggcgcgaaggcgaaacgtaccccctgttcggcgcaggcgctgcgcaagcgggtgctgaaagaggggagcctgccggccatcgatccggtggtggatatctacaacgcgatcagcattcgctatgccgtcccggtcggtggggaaaatctggccgcctaccgtggcgaaccgcggctggccattgcccgcggcgatgagccattcgatacgctaaaatcggcagagccggtagtggaatatccggagccgggcgaagtcatctggcgggatgatataggcgtaacctgccgacgctggaactggcgacagggcgtgcgcacccggctggacagcggcgcgcagacgatgtggtttattctcgaaagcctgccggcgatgccgttgtcggccctgcatgaggcgggagagcggctggtaggttatctgcagcagctgatgcccggcgctcgcgcgtcgataacgctgctgcgagccgatgacgagggcgatctacgctga

SEQ ID NO: 2175 - DNA, 525 bp, Klebsiella pneumoniae
cgcatattacgttatccagcgcatcaaggatatcatttaaaaatagataaggagattgagatgttattacgttttcgcgtattaccgctggtttttgtcatctcgctgttaagcggctgcggcctggcttctaaagccttttattccgcgggagacaaattatttcaacccggagatgacgccgtcgcttcgatgcagacgtattcagtggctcagttcctgcagccgtttactctcaacccggcgaaggccagcagcgattatctgggtaaatgggtcaaggtacgcggggtgattgtcgacattcgtcggaagagcggtatcgccggcagctactattttatcgtgaccatgcgagatgaacagaataaaacggataaacgtcttacctttaattttggctcgcataacagcgcagacgtagaggctttaagcaacggcagcgtcgctacgatcgtcggccaggttcatcaggtgcaagattccacgatcccgacgctacagaatcctaaggtggttaaataa

SEQ ID NO: 2176 - DNA, 354 bp, Klebsiella pneumoniae
aatgaagcacgctcaggcttaagccctattttgacactggagaagaaaatgaatttacctaaagcactcgtattgaccgtggcggctaccacattctgtctgatgaccagcccggcgttcgcggttgaggaaaccacgccgcagaatatgacctgtcaggaatttatggatatgaacccaaaaagcatgaccccggtggccttctgggtagtgaatcgcaacaccgactttagcggcggcgactatgttgactggcatgaagtcgagaccgtttcggtaccgaaaatgctgcaggagtgccacaagaaccccgccgctaaacttggcgatctcagcgcggtcatcaaaaaataa

SEQ ID NO: 2177 - DNA, 357 bp, Klebsiella pneumoniae
gaatctgaacgcgcgcgaagcgtatcagttctggcaggaagagaaacagggagagctgaaatgaacgtcacgctagtggagatcaatattaaacccgagcgggtggatgagtttctcgaggtgtttcgcgccaaccacgagggcgcgctgcgggagccaggcaacctgcgctttgatgtcctgcaggatcccgaggtgaaaacccgcttttttatctacgaagcctataaagacgatgaggcggtgctggcgcataagaagacgccgcactatttagcctgcgtcgaaaagctggaggagatgatgtcgcagccgcggcagaagcgcagctttatcggcctgttaccgcaggtgtga

SEQ ID NO: 2178 - DNA, 966 bp, Klebsiella pneumoniae
aggtatggacgctgtattgttagccagatattctgcccggtatgttcaaatttcctgaatgagaaagcgatggccaaagagagagcattaacgctggaagcgttacgcgtgatggatgcgatcgaccggcgcggaagcttcgctgccgcggctgatgagctgggacgcgtgccttccgccctgagctacaccatgcaaaaactggaggaggaactggacgtggtgctgtttgaccgctcaggtcatcgcacgaagttcactaacgttggaagaatgctgctggagcgcgggcgcgtgctgcttgaagcggcggataaactcaccaccgatgctgaagccctgtcgcgtggttgggaaacccacctgacgatcgttaccgaagcgctggtgcccactccggatctgtttccgctgattgagaaactggcgactaaatcaaacacccagctgtcgattatcactgaggtgctggccggtgcctgggagcggctggagcaggggcgggcggatatcgttgtcgcaccggatatgcattttcgttcctcttcggagattaactcgcgcaaactctattcggtgctcagcgtgtacgtcgcggcgccggatcacccgatccatcaggagccggagccgctctctgaggttacccgcgtgaaataccgcggcgtcgcggtggcggataccgcgcgcgagcggcccgtcctcaccgttcaactgctggataaacagccgcgtttaacggtgagtacgatagaagataaacgtcaggcgctactggccggactgggcgtggcgactatgccctatccgctggtggagaaggatattgccgaaggtcgcctgcgggtcgtcagcccggaatacaccaatgaaattgacattatcatggcctggcgacgggacagtatgggcgaagcgaagtcctggtgtctgcgtgagatccccaagctgtttgccggcagatag

SEQ ID NO: 2179 - DNA, 717 bp, Klebsiella pneumoniae
ccgacgacgctatttaacgttgcggagaagaatgcctactatgcgccatacctgctgatgacgctcccgttctgcctggcctcgtttggctatcacggcaacgtgccgagcctgatgaaatactacggaaaagatccgcgcaccatcatccgctgcttaacctacggtacgctgctggcgctgggtctgtatgtcgtttggctgctggtgacgatgggtaacatccctcgtccgcagtttatcgacatcgcgcagaagggcggcaacattgatgtgctggtgcaggcgctgagcggcgtgctgaatagtcggagtctggatctgctgctggtggtgttctcgaactttgctgtcgccagttcgttcctcggcgtgacgctggggctgttcgactacctggcggatctgtttggctttgacgatagcgcgatgggacgctttaaaaccgcgctgctgacctttatcccgccgatgattggcggactggtcaaacccgatggtttcctctacgccatcggctatgctggcctggcggcgacgatctgggcggcgattgtaccggcgctgctggctcgcgcctcacgcaaacgcttcggcagcccacagttccgcgtttggggcggaacgccaatgattgtgctgatcctgctctttggcctcggcaatgcggttgtacatatcctgtcgagcgtcaatctgctgccggtttatcagtaa

SEQ ID NO: 2180 - DNA, 219 bp, Klebsiella pneumoniae
atatcgatgcgcaactgctcggtctcggctccaactcctggggcagcgaagttctggatagctggcgcgtctggctcaacaccttcaactatggctttacgctgctgccgctggagggcggatgcggcacctcgcaggtactggcgaaccatagcttcggcgccggtttcttttcccccgttgcacacagcgaggctgaacaatgagaattctcgataa

SEQ ID NO: 2181 - DNA, 273 bp, Klebsiella pneumoniae
tcaagcgtgcgcttttcaatgagattcagtgcgtgtgcgctgcaggccagagccgatgcgctggaaggtaacctgttcaaaatgtgctcctggggcggacgtatcacacgatactggattaagtattgcagggattacgccagttcggcagaagcggtgaaaatcgggataaatgcaaagcaaaagacgaattgtgtaaaatttaatctcattgcgccactattggcacgttttattcctgagctgacgagattttctgcctggcggcaatag

SEQ ID NO: 2182 - DNA, 486 bp, Klebsiella pneumoniae
ttatgttcgcgaaaatccgtggactggggtaggaattggcgccgccgtcgggctggtgctgggtgtcctgctgtcgcgtcgctgattatggcgaatactcaacacacgcagggaccgggtcagcgcgttttctccattggtcagcgcatcgtcacgctgctggtcgaaatggtggaaacgcggctgcgtctggtcgtcgtggagctggaggaggagaaagccaacctcttccagctgctgatcatgaccggactgacgctgctgtttgccgcgtttggcctcatgagtctgctggtgctggttatctgggccgttgacgctcagtaccgcctgcacgtgatgatcgccaccaccgttgtgctgctccttgccgccgcgatcgtgggtatcctaaccctacgtaaggcgcgccgctccacgctgctgcgtctaacgcgtaaagagctggagaacgaccgtgcccttctggaggaggataaatcgtga

SEQ ID NO: 2183 - DNA, 210 bp, Klebsiella pneumoniae
tctcatatcaggaacttgttcgcaccttccttagacattcctcgggcacagaacaccttttataattgttttaagtggtttctgatttatttaaaagacgatattgaaattgtctattcgcatatcgatcacctcaaaaacatgactcagtataatcagcacgcccccgccagacactatgcatacccacaatataaagttattatttaa

SEQ ID NO: 2184 - DNA, 1359 bp, Klebsiella pneumoniae
gcggaggtcagcatgccgttaatagccgggattgatatcggcaacgccaccaccgaggtggcgctggcgtccgacgacccacaggcgagggcgtttgttgccagcgggatcgtcgcgacgacgggcatgaaagggacgcgggacaatatcgccgggaccctcgccgcgctggagcaggccctggcgaaaacaccgtggtcgatgagcgatgtctctcgcatctatcttaacgaagccgcgccggtgattggcgatgtggcgatggagaccattaccgagaccattatcaccgaatcgaccatgatcggtcataacccgcagacgccgggcggggtgggcgttggcgtggggacgactatcgccctcgggcggctggcgacgctgccggcggcgcagtatgccgaggggtggatcgtactgattgacgacgccgtcgatttccttgacgccgtgtggtggctcaatgaggcgctcgaccgggggatcaacgtggtggcggcgatcctcaaaaaggacgacggcgtgctggtgaacaaccgcctgcgtaaaaccctgccggtggtagatgaagtgacgctgctggagcaggtccccgagggggtgatggcggcggtggaagtggccgcgccgggccaggtggtgcggatcctgtcgaatccctacgggatcgccaccttcttcgggctaagcccggaagagacccaggccatcgtccccatcgcccgcgccctgattggcaaccgttccgcggtggtgctcaagaccccgcagggggacgtgcagtcgcgggtgatcccggcgggcaacctctacattagcggcgaaaagcgccgcggagaggccgatgtcgccgagggcgcggaagccatcatgcaggcgatgagcgcctgcgctccggtacgcgacatccgcggcgaaccgggcactcacgccggcggcatgcttgagcgggtgcgcaaggtaatggcgtccctgaccggccatgagatgagcgcgatatacatccaggatctgctggcggtggatacgtttattccgcgcaaggtgcagggcgggatggccggcgagtgcgccatggaaaatgccgtcgggatggcggcgatggtgaaagcggaccgtctgcaaatgcaggttatcgcccgcgaactgagcgcccgactgcagaccgaggtggtggtgggcggcgtggaggccaacatggccatcgccggggcgttaaccactcccggctgtgcggcgccgctggcgatcctcgatctcggcgccggctcgacggatgcggcgatcgtcaacgcggaggggcagattaacggcggtccatctcgccggggcggggaatatggtcagcctgttgattaa

SEQ ID NO: 2185 - DNA, 189 bp, Klebsiella pneumoniae
acagcgtgcagcccggcgagactatcgtgctcgatatgcgccaccagcgccttatccgtgactaaaattcacgttgaccgttaccgctccgggggcctgcctccggagggtgagttttcgcttactcttcaggaaccactatgtctcaattcttttttaaccagcgcgccagcctcgtcaacgatgtga

SEQ ID NO: 2186 - DNA, 993 bp, Klebsiella pneumoniae
atttttataagagttcaatttatgagcgaaaaacgcattacggaagagaaccgctacgccgggctggcgttagccgaggaagagctggtggcgcgggtggcgtggtgctactaccacgacggcctgacgcaaaatgacatcggcgagcgtttggggctgccgcggctgaagatttcccgcctgctggagaaaggccgccagtccggggtgatccgcgtgcagatcaactcgcgctatgagggctgtctggcactggaaagtgaactccagcagcgctttggactcaagattgcccgcgtactgccggcgctcaacaccccgccgatgaatacccggctgggtatcggcgcggcgcagtcgctgatgggcattctgcagccgggacagctgctggcggtcggcttcggcgaagccaccatgagctgcctgcagcatctcagcggctttatcggctcgcagcaggtgcggctggtgaccctctccggcggcgtcggcccctatatgaccggtattggccagctggatgccgcctgcagcgtcagcattatcccggcgccgctgcgggtctcttcggcggaggtcgccgagatcctgcgccgtgagtcgagcgtgcgcgacgtgatcctcgcggcgacggcggcggacgcggcggtggttggcatcggcgccatcgatcagcggcgcgacgcgaccatcctgcgctccggctatatcagcgagggcgaacagcttatgtacgcccgcaaaggcgcggtcggcgacattttaggttatttcctgcaggccgacggcaggccggtagaaggactggagatccatcgggaactgctcggcgtgacccttgatgagctggcgcagctgccgaccatcgttggcgtcgccgggggagaagaaaaagcgcaggcgatttatgccgctctgattggcaagcgcattaatggcctggtaacggaagagacaacagcacgcgcggtgcttaccctggcctcctga

SEQ ID NO: 2187 - DNA, 1671 bp, Klebsiella pneumoniae
acaatgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgagctggacggcaaacgccgggaccagtttgacatgatcgaccggtttatcgccgattacgcgatcaacgttgagcgcacagagcaggcaatgcgcctggaggcggtggaaatagcccgcatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcacggaagcggtatttaccgacggcgatgatactccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattaccaaaggcgccggggttcagggactgcaaaacggcgcggtgagctgtatcggcatgaccggcgctgtgccgtcaggcattcgggcggtgctggcggaaaacctgatcgcctctatgctcgacctcgaagtggcgtccgccaacgaccagactttctcccactcggatattcgccgtaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatctccgacgaggaggtggaggccgccacctacgcgcacggcagcaacgagatgccgccgcgtaacgtggtggaggatctgagtgcggtggaagagatgatgaagcgcaacatcactggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataa

SEQ ID NO: 2188 - DNA, 894 bp, Klebsiella pneumoniae
atggcagtgagaaacatgaaatattcattagggccggtgctgtactactggccaaaagagacgctggaagatttttaccagcaggcggcaaactgcagcgccgacaccatttatctcggcgaagcggtatgcagcaaacgccgcgccaccaaagttggcgactggatcgaaatggcgaaaacgctggccgctagcggcaagcaggtggtgctctccaccctcgcgctggtgcaggcctcttctgaactgggcgagctgaagcgctatgtcgataacggcgaatttctgattgaggccagcgatttgggcgtggtaaatctctgcgccgaacgcaagctaccgttcgtcgccgggcatgcgctgaactgctacaacgccgttaccctgcgcctgctgcggaaacagggcatggtgcgctggtgcatgccggtggaactctcccgtgactggctggctaatttactgacccagtgcgaagagctgggtatccgcaaccagtttgaagtcgaagtgctgagctacggccatctgccgctggcttattccgcgcgctgctttaccgcccgctcggaagaccggccaaaggacgagtgcgaaacctgctgcatcaagtaccctaccgggcgcagcatgctgtcgcaggagaaccagcaggtgttcgtgctcaacggtattcagaccatgagcggctacgtctataacctgggcaatgagctgacctccatgcacggcctggtggatatggtgcgcctgtcgccgatgggcaacgagaccttcgccatgctcgaggccttccgcgccaacgaaaacggcgctgcgccgctggatctcaccagcaatagcgattgcaacggctactggaaacgattgccaggactggtgcttcaggcctga

SEQ ID NO: 2189 - DNA, 1185 bp, Klebsiella pneumoniae
cctgaagcgagaaggtatattatgagctatcgtatgtttgattatctggtgccaaacgttaacttttttggccccaacgccatttccgtagtcggcgaacgctgccagctgctgggggggaaaaaagccctgctggtcaccgacaaaggcctgcgggcaattaaagatggcgcggtggacaaaaccctgcattatctgcgggaggccgggatcgaggtggcgatctttgacggcgtcgagccgaacccgaaagacaccaacgtgcgcgacggcctcgccgtgtttcgccgcgaacagtgcgacatcatcgtcaccgtgggcggcggcagcccgcacgattgcggcaaaggcatcggcatcgccgccacccatgagggcgatctgtaccagtatgccggaatcgagaccctgaccaacccgctgccgcctatcgtcgcggtcaataccaccgccggcaccgccagcgaggtcacccgccactgcgtcctgaccaacaccgaaaccaaagtgaagtttgtgatcgtcagctggcgcaacctgccgtcggtctctatcaacgatccgctgctgatgatcggtaaaccggccgccctgaccgcggcgaccgggatggatgccctgacccacgccgtagaggcctatatctccaaagacgctaacccggtgacggacgccgccgccatgcaggcgatccgcctcatcgcccgcaacctgcgccaggccgtggccctcggcagcaatctgcaggcgcgggaaaacatggcctatgcctctctgctggccgggatggctttcaataacgccaacctcggctacgtgcacgccatggcgcaccagctgggcggcctgtacgacatgccgcacggcgtggccaacgctgtcctgctgccgcatgtggcccgctacaacctgatcgccaacccggagaaattcgccgatatcgctgaactgatgggcgaaaatatcaccggactgtccaccctcgacgcggcggaaaaagccatcgccgctatcacgcgtttgtcgatggatatcggtattccgcagcatctgcgcgatctgggggtaaaagaggccgacttcccctacatggcggagatggctctgaaagacggcaatgcgttctcgaacccgcgtaaaggcaacgagcaggagattgccgcgattttccgccaggcattctga

SEQ ID NO: 2190 - DNA, 1596 bp, Klebsiella pneumoniae
cacctgtttggagatgactggacaatggctgacattgcaattcgacaacaatcgccgaccgcgttttatattaaagttgacccgacagataatgtggcgattattgtcaacgatcgcggcttaaccgctggaacgcgtttcccggacggcctgacgctcgtcgagcatatcccgcagggtcacaaagttgccctggtggatatccccgcccatggtgaaatcatccgctacggcgaagtcattggctatgccgtacgcgatatcccgcagggaagctggattgacgagtcgctggtggagctgcccaccgccccgccgctgaataccctgccgctggccactaaagtgcctgaaccgctaccgccgctggaaggttacaccttcgaaggctaccgcaatgctgacggcagcgtgggtaccaagaatctgctgggtattaccaccagcgtgcactgcgtcgctggcgtggtcgattacgtggttaaaatcattgaacgcgacctgctgccaaactatcccaacgtcgatggcgtggtgggcctgaatcatctctacggctgcggcgtggcgattaatgcgccggcggcggtagtgccgattcgcaccattcataatatcgccctcaacccaaacttcggcggcgaggtgatggtcattggcctcggctgtgagaagctgcagccggaacgcctgctgcagggcacggaagacgtcaaaagtatcccggtggacagcgccagcatcgtcagcctgcaggatgaaaagcatgttggttttaaatcgatggtcgatgacattctgcaggtcgccgagcgccacctggcgaaactgaaccagcgccagcgggaaacctgcccggcctctgagctggtggtcgggatgcagtgcggcggcagcgacgccttttcaggcgtgaccgccaacccggcggtaggttacgcgtccgacctgctggtgcgctgcggggcgacggtgatgttctcggaagtgaccgaagtacgcgacgccattcatctgttgaccccgcgggcgattaacgaagaggtcggtaaacgtctgctggaagagatggcctggtacgataactatcttgatatgggcaaaaccgaccgcagcgccaacccctcccccggcaacaagaaaggcggtctggccaacgtggtggaaaaagcgctggggtcgattgccaaatcagggaaaagcgccatcgttgaggtgctctctccggggcagcgtccgaccaaacgcggcctcatttacgccgcaacccccgccagcgattttgtctgcggcacccagcaggtagcctctggcatcacggtgcaggtattcaccaccggtcgcggtacgccgtacggactgatggcggtaccggtgataaaaatggcgacccgtaccgagctggccaaccgctggtatgacttaatggacattaacgccgggaccatcgccactggcgaagagacgattgaggatgtcgggcggaagctgttcgaatttattctcgacgtcgccagcggacgcaaaaaaaccttctccgatcaatggggcctgcacaaccagctggcggtatttaacccggcgccggtaacctga

SEQ ID NO: 2191 - DNA, 555 bp, Klebsiella pneumoniae
ctaaatcatggcgggcgacaaaataacgctgacaaaaataaagcaagccaaccgaatggtaatagttttttactatcgcccctactgactattcgcgccagcgttaccctggtgcgggagagaatgatgaacaagagccaacaagttcagacaatcaccttggccgccgcccagcaaatggcggcggcggtggaaaaaaaagccactgagatcaacgtggcggtggtgttttccgtggttgaccgcggaggcaacacgctgcttatccagcggatggacgaggccttcgtctccagctgcgatatttccctgaataaagcctggagcgcctgcagcctgaagcaaggtacccatgaaattacgccagcggtccagccaggacaatctctgtacggtctgcagcttaccaaccaacagcgaattattatttttggcggcggcctgccagttatttttaatgagcaggtaattggcgccgtcggcgttagcggcggtacggtcgagcaggatcaattattagcccagtgcgccctggattgtttttccgcattataa

SEQ ID NO: 2192 - DNA, 300 bp, Klebsiella pneumoniae
atcgtgaatggccgacaggagcgtgaacggcaaaagacgcagctgctgcgccagatccagcagcaacggctggagctcagcgcctgccgccgtcactggcacgaggcgactgcgcccctcgaccgcggctggcatacgctgctgagtttacgttcgtggctgatggttggcagcggtctgatggccgtatggtccgtacgacatccgcattttttaatgcgctggaccaaacgcggactcggactgtggagcacctggcgcctggtgcgcgggatcctgcgccagtcggcagttcgctag

SEQ ID NO: 2193 - DNA, 474 bp, Klebsiella pneumoniae
cccgctgatggcggcgtgggactatgcgatggtttacttccttgccgtctggaaagcggcggtgctcggcgtgctgctcgggtcattgattcaggtactcattccgcgcgactggctgctacgcaccctgggacaatcgcggtttcagggcacgctgctgggagcgattttctcgctgcccggcatgatgtgcacctgctgcgccgcgccggtcacggccgggatgcgcaaacagcaggtgtcgatgggcggggcgttggcgttctggatggggaacccgctgctcaatccggcgacgctggtgtttatgggttttgttctgggctggcagtttgcgctggttcgcctggtggcgggtctggcgacagtattaactgtggcgacgctggtgcagaaatgggtgaaagaggcggcgacgcagccggtagcggtgcctgctgcaccgtcggaagcgactcagggcggcttctttag

SEQ ID NO: 2194 - DNA, 714 bp, Klebsiella pneumoniae
agtggcctcggcgctcttatttacgcctgccgatcgcgcggcctactattttcctcagacctttcttttggcccgctgaataaaccctcacgctttttattcagcgtcaggccgccaaccgggatctgcggagcaattatgtttatgtttagccattacaccttaaatgcgtttagcccacgcgtcttcattcgatataaacggcatgcctgcctgatggcggtattgctgtttatctgcggagcctgttgtctggcctggccgttggtcgccggctggtatctcgccacagtaaccggcatgttattgatgatctgcggcttctattcgctgtacagcctgattgtcttccgccagcagcactggaaatcacgcctggtggcgctgatcttcgccatcgcctggatcgtgctcggcctgagctttgtcgtcaatcctctcaacggtatgagcagtctggccattttatttggctttttatttgttctcggcggtatttcccgcatcgttaacggatgtcaaacccgcaaacaaagcggcgctggctggaatatttttatcggcctgttggatttacttatcgcctgcctgtggctggccatgaacccgcagcaaagctggttatttattaccgcctttatcggcattgaaatgatatttagcgccatcggcttgttggtcctgcgcaataaaatgaagcacgctcaggcttaa

SEQ ID NO: 2195 - DNA, 534 bp, Klebsiella pneumoniae
ccgccacccggcatccaatcccgctatgcgtacgtttacggcaaactacaccagcgccagcgcaccgacaatcgccccgcacagcgccaccagtccgcccgtcagccacagcgctttggccgggaaggctttacgcagcataatcagcgacggcacgctcactgccggcagtgtgatgagcagcgccagcgcgggcgccgtccccatacccgccagcatcattgtctgcacaatcggaatttccgccgcggtagggatcacaaacaggcagccggcgatcgccatcgcgataacccagaacaacgtattatccaccacgccatcggcgtgcgggaacagccagacgcgcgccgctcccagcaccagcaccgcgaggatataaaccgggatcgtgttccagaacagcgtccacagcgcctgaagccagcggctaaagaagccgccctgagtcgcttccgacggtgcagcaggcaccgctaccggctgcgtcgccgcctctttcacccatttctgcaccagcgtcgccacagttaa

SEQ ID NO: 2196 - DNA, 1575 bp, Klebsiella pneumoniae
tcttcgcacggttgtaaatatagttcaccgtctacgcttttgaacattattaaatttaaaaatcatttgttcaaacgaggcgcgacgatgaagccactgcttgaagctcgccagatccgcaaacagttctccggcgttgccgtgctgaagggcatcgactttacgctatgcgcgggccaggtgcatgccctgatgggaggcaatggcgcgggtaaatcgacgctgatgaagatcatcgccggcgtcgaaaccccggataacggtgaactgacgatcggcgaccgcgcgtttgcgcgcctcagcccggcgctggcccaccagctgggcatctatctggtgccgcaggagccgatgctgtttcccaacctcagcgtgcgcgagaacattctctttcgtttgccgaagcgggcggataccaccgcgcgactgcaggaaaaactgcagcagctgaactgccagatcaacctcgacgccagcgccagcacgctcgaggtagccgatcaacagatggtcgagatcctgcgcggcctgatgcgcgaagcgcggatcctgatccttgatgaacccaccgcctctttaaccccgggcgaaacggagaggttgtttagccagatccgcgcgttacaggcgctggacgtggggatcgtgtttatctcgcacaaactgcccgaaatccgccagcttgccagccatatttcggtgatgcgcgacggggcggtagtgctgagcggcgagaccgcaacttaccgcgatgagcaactgattagcgctatgacgccggccagccgcgaccatacgctgagcgacacgcaaaagctgtggctggcgctgccgggcaaccgccgcacccaggcgcaggattttcccgtgctgcgggtggaggatcttaccggagaaggctttatcgatctcaatctggagatccgcgccggggagatcgtcggcctcgccgggctggtgggatccgggcgcaccgaatttgctgaaaccttatacggcctgcgtccaccacgcgccgggcggatctggctggagaatcgcgagattagtaatgacagcacccgagcccggctggccagcaggctggtctatctgccggaagaccgccaggtctcggggctgtttcttgatgcgccggtgcgctggaacacggtgatgttcaatcagccgtcgtggtggcagcaggggaaacgggaggcggcggtggttgagcgctatcaccgggcgctggggatcaagctggccgatggcgatcagccggtgcgcactctctctggcggtaaccagcagaaggtgctgctggcgcgctgtctggaggccaacccgctgctgctaattgtcgatgagccgacgcgcggcgtggatgtctccgcccgcgccgatatctatcagctgctgaaaagcgtcgccgcgcaaaatgtggcagtgctgatgatctcctccgatctggatgagttcatcggcctggccgaccgggtgctggtgatgcatcagggccgctacagcggcgagctggcgcggcaggcggtgaccgtcgatcgcatgatgaccctggccttcggagggcaggcatga

SEQ ID NO: 2197 - DNA, 1032 bp, Klebsiella pneumoniae
aagcgcagcggctgccgtcttccgacgtcagccgttttgtttttatgtaaggaatatcaaatgaatactgtcggcacgccgttgctatggggtggattcgctgtcgttgtcgcgatcatgttggcaatcgacctgctgcttcagggacgacgcggttcgcatagcatgaccatgaagcaggccgctggctggtcaatcctctgggtcacgctttctctgctgttcaacgccgccttctggtggtatctggtgcaaacccagggccgggccgtcgccgatccgcaggccttagccttcctcaccggttatctgattgaaaaagcgctggcggtcgataacgtcttcgtctggttgatgctgttcagctatttcgccgtaccgcctgctctgcagcgccgggtgttggtgtatggcgtactgggcgcgatcgttctgcgtaccattatgatcttcgccggcagctggctgatttcgcagttcgactggctgctgtacgtctttggcgccttcctgctgtttaccggcgtgaagatggcgctggcgaaggaggacgagtccggcatcggcgataagccgctggtgcgctggatccgcagccatctgcggatgaccgataaaatcgagagcgagcgcttcttcacccgtaaaaacggggtgctgttcgccaccccgctgctgctggtgctgattctggtggaactgagcgacgtgattttcgccgtcgacagtatcccggcaatcttcgcggtcaccaccgatccgtttatcgtgctgacctcgaacctgttcgccatcctcggcctgcgcgccatgtacttcctgctggcgggggtcgctgagcgcttctcgatgctcaaatacggtctgtcggtgattctggtgtttattggcgtgaagatgctcatcgtcgacttctaccatatcccggttgccatctcgctgggcgtggtgggcggcatcctggccgtcacgctgctgattaacgcctgggtcaacaggcagcacgacaagcagcgcaaactgccagagtaa

SEQ ID NO: 2198 - DNA, 1449 bp, Klebsiella pneumoniae
atgattggaggacgtatgtccgagtctgtacgtgccaaaatcggcaagttcgcgctgctatcgatggcctttgccgccgtctttaacgtgcgaaacatcgtcaataataacattgagttaggtctcagttccgcgcctatcttcttattcgccactatcgtttactttatcccgttcgtgtttatcatcgccgaattcgtctcggccaataaacactctgaatccgggatgtacgcgtggctgaagcaaccgatgggcacccgcgccgcctatcttggttccttcctctactggtttgtgaacctgttctttttcctctcgctgttgccgaacgtggtggcctacgcctcatacgcgatcaccggttacgcgatccccttctcgccgatggtgacctcgcttatctccatcgtgctgttcgccatggccacccatatatccaccaagggggcgacctggctgggtaaaatttccgaatgcgtggcctacggcgtgttcgctttgttcgcgatttacgtcgtcggcgcgctgaccgcactgggttccggtcacgtcccggcgcagccgattaccctggcggcgatggagccgaccatcaactgggcgacgctcggtatcatgtgctggattttccaggccgcgggcggcgcggaaaccgttgccgcctacctcaatgacaccaagggcgggcagaaatcctttattaaagtcatcatcaccgccggggtgctgattggcggtatgtatgccttaggttcgctgctggttaacgtctttgtcgcccgagagaacctgacctacgccggcggaatggtggaaatctttaccggtctcggcgcctacttccacatttctgaagcgctgatgggccgcttcgttggcatcattctgtttatcgccatcttcggcagcatgatgatgtggaccgccgcgccggtcaaaatccacttttcggaaatcccgaagagtatctacggccagaaaaccaccgagctgaacgcccacggcgtgccggtacgcgccgcctggtggcagttcctgttcgtcttcctgatgttgattgttaacggcttcggttccgccagcgtgcagcagatgatgaacaccgccattaatctcaccgccggtaccgccatgctgccgccgctgttcatcatggccgcctacttcgtcttccgctggaaacacgatgacacgccgcgcgacttccgtatgggctcaagaaaagtgggcatgagcgtggtatcgatgctgatagtgattttcgtggttagcatgaccgcttccgccttcccgccgggcgtcgatctggttaacgctttctttatcaacgtctttatgaccgcggtcttctccggcctggcgtggtggtggatcacccgctttgaaaaaaagcagcaacgtttacgcgccgcagcgccggttaacgctgccgctgccggtaaataa

SEQ ID NO: 2199 - DNA, 1005 bp, Klebsiella pneumoniae
tctgaaggaggagcaaagatgggacaattagtcgacggcgtctggcaggatacctggtatgacacaaaatccaccggtgggcgttttaaacgttccgtttccgccttccgtaactggctgaccgccgacggcgcggctggccccagcggtgaaggcggttttgcagcggaaaaggatcgctatcatttgtatgtttctctcgcctgcccgtgggcgcatcgcacgttaattatgcgtaaattaaaaggtctggagccttttctccccgtatccgtggtcaatccgctgatgctggaaaacggctggacctttgacgatagcttcccggaagccaccggcgataccctctaccagcatgactttctctatcagctgtatctgcacgccgacccgcactacaccggacgcgtgaccgtgccggtgctgtgggataaaaaacagcagaccatcgtcagcaatgagtcggcagaaatcatccgcatgtttaataccgccttcgatggccttggcgcccgggccggggattactacccgccagcgctgcgggaacaaatcgatgagctgaacggctggatctatgacaacgtcaacaacggcgtgtataaagccggctttgccaccagccagcaagcttacgacgaagcggtggatgcggtctttacctcgctggagcggctggagcagatcctcggccagcatcgctatctgacgggcaatcagctaacggaagccgacattcgcctgtggacaacgctggtacgcttcgacccggtatatgtgacccattttaaatgcgataaacggcgcatcagcgattacctcaatctgtacggtttcctgcgcgacatctaccagatgccgggtatcgccgagacggtgagttttccgcatatccgtcaccactattaccgcagccataaaaccattaaccctaccggtattatttccattgggccgcagcaggatctcaacgaaccgcacggtcgcgatcagcgcttccgttga

SEQ ID NO: 2200 - DNA, 3111 bp, Klebsiella pneumoniae
gccgttcagggaggcgatatgaatcgctgggaaaaccttcaactcactcatgaaaacaggctgccgccgcgggcgtatttcttttcttacgactcactggcccaggcgcggaccttcgcccgcgagatcagcagccgcttcctgtccctcagcgggcagtggaacttccgcttcttcaccaacccgctgctggtaccggagagctttacctcatgctatcagaacgagtgggggccgattaccgtaccgggtatgtggcagatggaaggccacggccagctgcagtacaccgacgaaggtttccccttccccatcgacgtgccctatgtcccgaccgataacccgaccggcgcctaccagcgcctgtttaccctcggcgacggctggcagggcaaacaaaccatcatcaaattcgatggcgtcgaaacctatttcgaagtctacgttaacggccagtacatcggctttagcaaaggcagccgcctgaccgccgagttcgatatcagcgcggcggtgaaaaccggcgacaacctgctgtgcgtgcgcgtgatgcagtgggcggactccacctatattgaagatcaggacatgtggtggtcggcgggcattttccgcgacgtctatctggtggggaaaaatccgctgcacgtgcaggatttcaccgtgcgcaccgattttaacgatgactacatcgacgcgaccctctcctgccagctgacgctggaaaacctggctccgcagacggcagcggcgacgctggaatataccctgttcgacggcgaaaaggcgctatattcgggcaacgtcggtcaactgcaggtcagccagcagctaaacaccggcttcacgattgatgtgagcgcgccgcagcagtggtcggcggaaagcccgtatctttatcatctggtgctgacgttaaagaacgccgccggcgaggtgctggaaatcatcccgcagcgcgtcggtttccgcgatatcaaagtgcgcgacggcctgttctatatcaataaccgctacgtgatgctgcacggcgtaaaccgccacgataacgatcatctgaaaggccgcgcggtcggcatggatcgcgtggaaaaagatctgctgctgatgaagcagcacaacatcaactcggtacgcaccgcccactacccgaacgacccgcgtttctatgaaatgtgcgacatctacggactgttcgtgatggcggaaaccgacgtggagtcgcacggtttcgccaacgtcggcaacctcagcgccatcacagacgacccggcatgggaacacatctacgttgagcgcatcgtgcgccacgtgcacgcccagaaaaaccatccgtcgatcgtcatctggtcgctgggtaacgaatccggctatggctgcaatatccgcgccatgtaccacgccaccaaagcgctggatgatacccggctggtgcactacgaagaggaccgcgacgcagaggtggtggatatcatctccaccatgtacacccgcgtgccgctgatgaacgaatttggcgagcatccgcatgaaaaaccgcgcattatctgcgaatacgcccatgcgatgggcaacggtcccggcggattaaccgaataccagaacgtcttctaccagcatgactgcatccagggccactacgtgtgggaatggtgcgatcacggtattcaggccagcgacgaaaacggcgcggtgtggtacaagttcggcggcgattatggcgactacccgaacaactacaacttctgcctcgatggcctgattttctccgaccagacgccggggccaggcctgcgcgaatacaaacaggtcatcgccccggtgaaagtacaggcgcgggatatctgccgcggcgaactgagggtggaaaacaaactgtggttctccactctcgatgactacaccctgcgcgttgaagtgcgcgccgaaggcgaaacgctctccagtcagttgctgaaagtgaaagacctggcgccgaacagcggccgcgacctgcaaatcgccctgccgcagctcgacgaacgtgaagctttcgtcaacatcatggtgaccaaagattcgcgcaccccgtatagcgaagccaatcacgatatcgccgtctatcagttcccacttaaagcgcgaaccgccgcgcgaaccccgctgttaaacgccagcgccacgccgctgcagattgtcgatgaacgcctcagctacaccatctgcggccataacttccgcgtggtgttcagcaaggttagcggcaaactgagcgaatggcaggtcaacagcgtcgaccagataacccgcgagccgaagattaacttcttcaaaccaatgattgataaccataaacaggaatacgaaggactgtggcagcctgcccacctgcagataatgcaggagcatctgcgcgaattcagcgctgaaatagagggcgaaacggtggtgatcaccacccgcagcgtgattgcaccgccggtgttcgacttcggtatgcgctgtacctatcgctggcagattaccccgcagggccacatcaaggttgagctggccggcgagcgctacggcgactatccgcacatcgtcccgtgcatcggctttatgctgggcattaacggtgagttcgaccaggtgaactactatggccgcgggccgggcgagaactacgccgacagccagcaaagcaacatcattgatatctggcataccaccgtcgacgatatgttcgtcaattatccattcccgcagaacaacggtaatcgtcagcacgtgcgctgggcatcgttcagcgaccgccacggcagcggtctgctggtcgttccgcgtaatccgctcaacgtcagcgcgtggcactttacggcagaaaacctgcacgccgcccagcactgcaacgaactgcagcgcagcgatgacattaccctgaatatcgatgcgcaactgctcggtctcggctccaactcctggggcagcgaagttctggatagctggcgcgtctggctcaacaccttcaactatggctttacgctgctgccgctggagggcggatgcggcacctcgcaggtactggcgaaccatagcttcggcgccggtttcttttcccccgttgcacacagcgaggctgaacaatga

SEQ ID NO: 2201 - DNA, 489 bp, Klebsiella pneumoniae
tttcattttatgctccgattgttttatgcgagaaaagacgccgccaggtcgcgcgcacccattcacggtgcaggctcagcgaacgccccatcaccaccacaaccaacagcgcccctgacagcgcgctcgacacctggttggggatgccgaccatctgtaaaccctgttgcagataccccaccagcaatgccgccagcgcggtacccagtatcgatcccgagccgccgtaaatattggccccgccgagcaccgccgcggtcagcgccggcatcagcaggtcgcggcctaaatccgaacgtgccgagccgaaataggagaccatcaccagcgccgcgaccgccgaggcgacgccaaccaggccatacagcacgtacgggatgccgttcaccgacagcgcggcatagcgcgcggcgcgcgggttttgcccgagtaaaaagaggtggcggccaaagcgcccgcgatgggtcagcagccagaagaaaaaggtga

SEQ ID NO: 2202 - DNA, 531 bp, Klebsiella pneumoniae
atgtatcgtatctatacccgcaccggggataaaggcaccaccgccctgtacggcggcagccgcatcaagaaagaccatattcgcgtcgaggcctacggcaccgtcgatgaactgatatcccaactgggcgtctgctacgccacgacccgcgacgccgggctgcgggaaagcctgcaccatattcagcagacgctgttcgtgctgggggctgaactggccagcgatgcgcggggcctgacccgcctgagccagacggtcggcgaagaggagatcaccgccctggagcggcttatcgaccgcaatatggccgagagcggcccgttaaaacagttcttgatcccggggaggaatctcgcctctgcccagctgcacgtggcgcgcacccagtcccgtcggctcgaacgcctgctgacggccatggaccgcgcgcatccgctgcgcgacgtgctcaaacgctacagcaatcgcctgtcggatgccctgttctccatggcgcgtatcgaggagactaagcctgatgcttgcgcttga

SEQ ID NO: 2203 - DNA, 1026 bp, Klebsiella pneumoniae
tatgagatcatcatattcatccggagcgcatcccagagggacatcatgagccatcaactcaccttcgccgatagtgaattcagcactaagcgccgtcagacccgaaaagagattttcctctcccgcatggagcagattctgccatggcaaaacatggtggaagtcatcgagccgttttatcccaaggcgggcaatggccgacggccctatccgctggagaccatgctgcgtattcactgcatgcagcattggtacaacctgagcgacggtgccatggaagatgccctgtacgaaatcgcctccatgcgcctgtttgcccgattatccctggatagcgccctgccggatcgcaccaccatcatgaatttccgccacctgctcgagcagcatcaactggcccgtcaattgttcaagaccatcaatcgctggctggccgaagcaggcgtcatgatgacccaaggcactttggtggatgccaccatcattgaggcacccagctctaccaagaacaaagagcagcaacgcgatccggagatgcatcagaccaagaaaggcaatcagtggcactttggcatgaaggcccacattggtgtcgatgccaagagtggcctgacccacagcctagtcaccaccgcggccaacgagcatgacctcaatcagctgggtaatctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaagccagcatccgtgccagggtggagcacccgtttcgcatcatcaagcggcagttcggcttcgtgaaagccagatacaaagggctgctgaaaaacgataaccaactggcgatgttattcaccctggccaacctgtttcgggtggaccaaatgatacgtcagtgggagagatctcagtaa

SEQ ID NO: 2204 - DNA, 363 bp, Klebsiella pneumoniae
atcgacaccatgaagatcgagcatggtgcggtagtaacgcagcgtctcgtgaaactcctctttgccggggatctgtttggcgatattaaactgaccgccgatctccgggagcgcatcaaacaacgtgacgtgatgaccgcgggcggcagcgtttacggcgaaggccagaccggcaggcccggcgccgaccaccgccagccgtttaggcgcgttggcaggcaggaccggcatcagggtttcatgacacgcgcgcgggttgaccagacaggaggtgactttgccgacgaagatccgatcgagacacgcctgattgcagccgatgcaggtgttgatctgatcggcgcgatcggcctgcgcttttga

SEQ ID NO: 2205 - DNA, 585 bp, Klebsiella pneumoniae
ggagaacacatgaaggctctctcgcccctcgccatcctgctttctgcactactgctgcagggctgcgttgccgccgcggtagtcggaacggcagcagtcggcaccaaagccgcaacggacccgcgtacggtgggaacccaggtcgatgacagtaccctggaactgcgcgtcaatagcgccttgtcgaaagatgaacagattaagaaacaggcccgtatcaacgtcaccgcttatcagggcaaagtcctgctgaccggccagtcgccgacgccggacctctccgcgcgcgccaagcaaatcgccatgggcgtggaagggaccacggaagtgtttaatgaagtgcgccagggccagccgattggtttaggcaccgcctcgtctgatacctggattaccaccaaggtgcgttcgcagctcctgagcaccgatcaggttaaatcctcgaacgtgaaagtaaccacggaaaacagcgaagtcttcctgatggggctggtgaccgaccgcgaaggccgggcggcggcggatattgccagccgggtaagcggcgtatcccgggtgaccaccgcctttacctacattaaataa

SEQ ID NO: 2206 - DNA, 378 bp, Klebsiella pneumoniae
ggcgtagaaatggactggtatctcaaggtattaaaaaactatataggatttggcggccgtgcgcggcgcaaagagtactggatgtttattctggtcaacctcatcctgaccggcgtattgagcatcatcgataaaatgctgggctggcagcgggctggcggcgaaggcattctgaccactatctatggcgtactggtctttttaccgtggtgggcggtgcaatttcgccgtctgcatgacaccgatcgttcggcctggtggctattgctgctgttgatcccggtcatcggctggctggtgatcctgatctttaactgccagcgcggcaccgaaggcaataatcgcttcgggcccgatccgaaacccttttcctactaa

SEQ ID NO: 2207 - DNA, 453 bp, Klebsiella pneumoniae
acaatgagaattctcgataatttagaacagtttaaacaggtttatcatagcggccgcaaatggcagcgctgcgtggaagccatcaataacatcgacaacatccgcccgggcgtggcgcattccattggcgattcgctctcctatcgggttgaaaccgatagtacgaccgacgcgctatttgtcggcaaccgccgctactttgaggtgcactattacctgcaggggcagcagaaaatcgagtttgccgccaaagaaaatctgcaaaccgtcgcctgctaccgcgacgaaaccgatcgcgaatacctgaaagggatcggtgaaacggtgaaggttcatgaagggcagatggtgatttgcgatatcgacgaagcctaccgctttatctgcgatgcgccggtaaaaaaagtggtgctgcgagtcacggttgaagacggatacttcctcaataagtaa

SEQ ID NO: 2208 - DNA, 450 bp, Klebsiella pneumoniae
ggcatgctgattcgagtggagattgggattgatgcaccgggaatcgacgcgctgctgcgtcgtactttcggccgcgatgccgaagcgcagctggtgcacgatctgcgtgaagatggactgatcacgctgggggtagtggcgacggatgatgaaggccaggtgatcggctacgttgccttcagcccggtggcggtggaaggtgaagagctgcagtgggtcggcctggcgccgctggcggtagatgaacgctaccgcggacagggcattggtcggcagctggtttatgaagggctggactcgctgaatgagtttggctacgccgcggtggtgacgctgggcgacccggatttataccgtcgcttcggctttgaaccggccgcggcgtttcgatctccgctgccgctggccggacagcgccgaggcgttccaggttcaccgtctggcggatga

SEQ ID NO: 2209 - DNA, 993 bp, Klebsiella pneumoniae
aggaaaaagatggcaacgctaaaagacattgcgaccgaagcgggtgtttcgctggcgacggtttcccgggtgttaaacgacgatcccaccctgaacgtaaaagaagagaccaagcatcgtattctcgagattgcggagaagctggagtataaaagcagcagcgcgcgtaaaacgcaggtcctacccgtcggccatcatcatatcctggcgctgtatagctaccagcaagagctggaaattaacgacccttactatctcgccattcgccacggtattgaaacccagtgcgaaaagctggccatcgagctcaccaactgctatctcaataacaccctgccagagctgaaaaaagtcaccggcgtattgattatcggccagccgacgcgcgagctgcgcgagaccgccagcgcgctgaccgacaatatctgctttattgatttccacgaagccggcagcccgtacgatgcggtggatatcgacctggtacgcatcgctaaagaggtggtcgacttctttatccagcagggcgcgtcgcgtattggatttatcggcggccaggaccagcccggcaaggccgatattcgtgaagtagcgtttgtggagtacggtcagttgaagggcgtggtttcagccgatgatatctggcgcggcggtttttccagctcgtccggttatgagctggcgaagcagatgctggcgcaagcggagtttccgcgggcgctgtttgtcgcctcggactccatcgccatcggcgtactgcgcgccattcacgagcgcggactggcgatcccggaagatatttcgctgattagcgtcaacgatatccccaccgcacgctttaccttcccgccgctgtcgacggtgcgtatccactccgaaatgatgggcagccagggggtgaacctgctgctcgagaaggcccgcgatggccgcgccctgccgcttaacgtttttgttcccagcgtgttgaagctgcgcggcaccacccgttaa

SEQ ID NO: 2210 - DNA, 1332 bp, Klebsiella pneumoniae
tgcggaaagataacagacgatgaggtttacatgcgtaaaattaaagggttacgttggtacatgatcgcgctggtgacgctgggcaccgtgctgggctacctgacccgtaacaccgtagcggcggccgcgccgacgctaatggaagagttacacatttcgacccaacagtactcctatatcattgcagcctattccgctgcctataccgttatgcagcccgtcgcggggtatgtccttgatattctggggaccaaaattggctatgccttcttcgccatcgcctgggcggtattctgcggctcaaccgcgctggccggcagctggggtggactggcgctggcccgtggcgcagtcggcgcagcggaggccgcaatgatccccgccggcctgaaggccagctcagagtggttcccggcaaaagagcgctctatcgcggtgggctacttcaacgtgggttcctctattggcgccatgatcgcgccgccgttggtggtatgggcgattgtcatgcacagctggcagatggcgttcatcatctccggggtattgagcttcgcctgggccatcgcctggcttatcttctacaaacacccgcgcgaccagaaaaaattatctgacgaagaacgtgactacatcattggcggtcaggagtctcagcatcagaccaataacgcgaagaaaatgtcgccgtggcaaatcctgcgcaaccgtcagttctggggtatcgccctgccgcgcttcctcgccgagccggcctgggggacctttaacgcctggatcccgctgttcatgttcaaagtttacggttttaacctgaaagagatcgccatgttcgcctggatgccgatgctgttcgccgacctcggctgcatcgtcggcggatatctgccgccgctgttccagcgctggtttggcgtcaacctgatcgtgtcgcgtaaaatggtggtcaccatgggcgccctgctaatgattggcccggggatgatcggcctgttcaccagcccgtacgtggcgattgccctgctgtgcatcggcgggttcgctcaccaggcgctgtccggggcgctgatcaccttctcttccgacgtctttggccgtaacgaagtcgctaccgccaacggcctgaccgggatggccgcctggctggcgagcaccatgttcgccctggtcgtcggcgcgctggcggacaccatcggctttagcccgctgtttgcggtactggccgtctttgacctgctgggcgcgctggttatctggacggtgctgaaaaacaaaccggctgacgatgactcgacgccgcttagcagtcgcaaaccggtcacgcagagttag

SEQ ID NO: 2211 - DNA, 399 bp, Klebsiella pneumoniae
caggaaactgtcatggctcaagtaccagcagggaaaaatcgttccggccagctaagcaaacagaccggcgatgcctgggaaaaccaggcgcgccgctggctggaaggccagggcctgcgttttatcgccgccaatgcccgcgagcgtggcggcgaaattgaccttatcatgcgcgacggcacggtcaccgtttttatcgaagtgcgctaccgccgtagcgcccggtacggtgatgcggcagccagcgtcactccgcaaaaacaacaacgactgcttaaagccgcccgtttgtggctctgccgacagaatgggagctttgagactgtggattgccgtttcgatgtggtagccttcaccggaaacgacatccaatggctaaaaaacgcctttggcgaatag

SEQ ID NO: 2212 - DNA, 1083 bp, Klebsiella pneumoniae
gcctgcaccgtgaatgggtgcgcgcgacctggcggcgtcttttctcgcataaaacaatcggagcataaaatgaaattaaaactgatcgtgctggcgctggcgatgagcgtggttaccgcgcaggcggcggaccgcatcgcctttattcctaagctggtcggcgtcggcttctttaccagcggcggcaacggcgcgaaagaggcggggaaagcgctgggcgtggatgtcacctatgacggcccaaccgagcccagtgtctccggccaggtgcagcttatcaacaacttcgtcaaccagggctacaacgcgattatcgtttccgctgtctcgccggacggcctgtgtccggcgctgaagcgggcgatgcagcgcggggtgaaagtcctgacctgggattccgataccaggccggagtgccgcagcatctatatcaatcagggcacgccgcagcagcttggcggcctgctggtcgagatggcggaaaagcaggtgacgaagcctactgccaaggtagcgtttttctactccagcccgacggtgaccgaccagaaccagtgggtgaaggaagccaaagccaaaatcgaaaaagaacatccgcagtggcaaatcgtcaccacccagtttggctataacgatgccaccaaatcgctacaaaccgccgaggggatcttaaaagcctatccggatctcgacgccattatcgcgccggatgccaatgcgctaccggcggcggcgcaggcggcagagaacctcaagcgtcagggcgtggcgattgtcggctttagtacgccgaacgtgatgcgtccgtacgttgagcgcggcacggtgaaagcgttcggcctgtgggatgtggttcagcagggcaaaattgcggttaacgtcgccgatcgattactgaaaaagggcgatcttaacgtaggcgacagcgttgaggtgaaagatatcggctcgctgaaagtcgaaccgaacagcgtgcagggctatcagtatgagccgaagggcaacggtatcgtgctgctgcccggaggcgcgtggtgttcagcaaagagaacatcaacaactacgacttctgacggaggatga

SEQ ID NO: 2213 - DNA, 606 bp, Klebsiella pneumoniae
ccaatgaacgtaaaagtcaatataacgaccgattcaggatctgatgtcgaccaggtaagtcgcgccgtcgccacgcggctgaaggcctaccgtaaagcgaaaaaaatgtcgctggacgagctgtcgcgccgggccagcatcagcaaaggtatgctggtcgagatggaaaaagaggccgccaatcccagcattgcgatcctctgcaaactcgctgccgcgctgggcgtatcggtagcggatattgtcaatgtggcaagcgaacccgcgttgcatattattcccgccgagcagatccccaccctctggcaaggcccgctggggggcagcgccaggctcctcgccggcaccgccgggccgaatatgattgagctgtggcgctgggagatgcagcccggcgaagcctttacctcgcccggccacccggcaacaaccttcgagctgctgcacgtggaagccggcgcgctgacgctgacgcttggcgagacctgccgcacggtggcggccggggaatcggtggtggcccgcaccgaaatagagcacggttaccgcaatgagggtaccgcgccgctggtctttaccatgaccgtggctgaactgccctcctga

SEQ ID NO: 2214 - DNA, 2514 bp, Klebsiella pneumoniae
  unsure (498): Identity of nucleotide at the above locations are unknown.
aaccaccgcgtttatgcaatttggcatctggtacgaatacggcggcgggcgtttcgccaccgccgccgacagccgtttctataccagcaacgccagcggcgacccgagcgacaaaattttcctgatgcaatacttctactggtaacaaggagccgagataccatgaacttcaccactacgctgacgccgctggcctgcgcgctgatgctgagtttttccgcccatgccgtcaccgcgcaggcgtttaaaaacgtcatcgaccgcagcggcgcgccgcagtatatacaggatttcgacgccgacgaccaccagcgcttcaacccctttttcgacctcggggcgtggcacggccacctgctgcccgacggcccagcgaccatgggcggcttccccggcccggcgctgctgaccgaagagtacatcaactttatggccaccaacttcgatcgcctgacggtgtatcagaacggcaaaaaagtcgatttcaccctgcaggcntggagcctgccgggcgcgctgaaacaaaccctcaccgcccccggcgtgaaggtggagatgacgctgcgcttcgccagcgcccacacttcactgctggagaccaaaatcaccagcaacactccgctgaagctggtgtgggatggcgaactgctggaaaaactggccgccaaagagggtaaagcgctatcggacaaaaccatcgatgaagctttcccggactatcagcgccgtgtgagcgccacgcccgacggcctgacggtcagctttggcaaggttcgcgccgcctccgacctgatgacctccggcgaatcgcagtatcagatccaccgttcgctggtaaccgagacccgtatcgacggccaccgctttaccagcagcgcggagatccgcggctccaccaccctctacaccacctattcgcacctactcaccgcggaacaagcgcggcgggaaaaagcgcagatccgcgatattctggcgcgcccggcttactatctcaccgcctctgaacagcgctgggacggttatctgcaaaaagggctcagcaaccccgacgctaccgccgaacagacccgcgtggcggtgaaagctattgagacgctcaacggcaactggcgcgcgccgggcggcgcggtgcattaccataccgtcaccccatccgtgaccggccgctggttctccggcaaccagacctggccgtgggatacctggaaacaggcctacgccatggcccacttcaacccggatatcgccaaagagaatatccgcgccgtcttctcctggcagattaaagccaatgataaggtgcgcccgcaggacgccggatttgtgcccgatctgattgcctggaacctgagccccgagcgcggcggcgacggcggcaactggaacgaacgcaacaccaagccaagcctcgcggcctggtcggtgatggaggtgtataacgtcaccaaagataaagcgtggctggaagagatgtatccgaagctggtggcctatcacgactggtggctgcgcaatcgcgaccataacggtaacggcgtgccggaatatggcgcgacccgcgataaggcgcacaacaccgccgacggcgccatgctgttcacggtgaaaaaagggcaaaccgagcagacgctttcgggccttagcgcctacgaacaggtgacggccaaaggcgattacgacagcctcgaaatcccggcgcaggtagcggcgtcgtgggagtccgggcgcgacgatgcggcggtatttggttttatcgataaagaacagctggataaatacgtcgccaacggcggcaaacgcagcgactggacggtgaaattcgccgaaaaccgcgaccgcgacggcaacctgctggggtattcgctgctccaggaatcggtcgatcaggccagctatatgtacagcgataaccactatctggcgcagatggcgacaattcttggcaaagcggaagaggcaaagcgctatcaggcgctggcggcgaagctggcggattatatcaatacttgcatgttcgacccgcagactcgtttctattacgacattcgtatcgaagaacaaccgctggccaacggctgcgccggtaaaccgatcgtcgagcgcggcaaagggccggaaggctggtcgccgctgtttaacggcgcggcgacgcagcaacatgctgacgatgtggtttcggtgatgctcgacccgaaagagttcaacacctttgtgccgctgggcaccgccgcgctgaccaacccggcctttggcgccgatatttactggcgcggacgggtgtgggtggatcagttctggttcggcctgaagggaatggagcgctacggtcatcgcgatgaggcgctgaagctggcggacgccttcttccagcacgccaaaggcttaaccgccgatggcccgattcaggagaactacaatccgctgaccggcgcccagcagggggcgcccaacttctcgtggagcgcggcgcatttatatatgttgtataacgagtttttccgtaagccgtag

SEQ ID NO: 2215 - DNA, 1038 bp, Klebsiella pneumoniae
ccattcagcgtccctgacgggccgcatttttcaggaaaaattatggagctgctctgcccagccggtaaccttccggcgcttaaggcggccatcgaaaacggcgccgatgccgtctatatcgggctgaaagatgacaccaacgcccgccactttgccggccttaatttcaccgaaaagaaactgcaggaagccgtcagctttgtgcatcagcaccgtcgtaagctgcatatcgccatcaataccttcgctcatcccgacggctacgcccgctggcagcgagcagtggatatggccgctcagctgggcgccgatgcgctcattctggccgatatcgccatgctggagtacgctgcggagcgttacccacacattgagcgtcacgtttcggtgcaggcttccgccaccaatgaagaggccattcgcttctatcatcgcaacttcgacgtcgcgcgcgtcgtactgccgcgcgtgttgtctattcatcaggtgaaacagttggcccgcgctacgccggtgccgttggaagtcttcgccttcggcagcctgtgcatcatggcggaaggccgctgctatctctcttcctacctgaccggcgaatcgcccaacaccgtcggcgcctgttcgcctgcccgcttcgtacgctggcagcaaacgccgcaggggctggaatcgcgtctcaatgaagtgctgattgaccgttatcaggatggcgaaaatgccggttatccgacgctgtgcaaaggccgctacctggttgatggcgagcgctatcacgcgctggaggagcccaccagcctcaacaccctggaactgttgccggaattgatggccgccaatatcgcctcggtgaaaatcgaaggccgtcagcgcagcccggcttacgtgacccaggtggcgaaagtctggcgccaggcgatcgatcgctgcaaagccgatccgcagaatttcgtaccgcagtccgcctggatggagaccctgggcgccatgtccgaggggacacaaactacccttggcgcttatcaccgtaaatggcagtga

SEQ ID NO: 2216 - DNA, 1464 bp, Klebsiella pneumoniae
gcctttggcgtgctggaagaaggcgtccgccagcttcagcgcctcatcgcgatgaccgtagcgctccattcccttcaggccgaaccagaactgatccacccacacccgtccgcgccagtaaatatcggcgccaaaggccgggttggtcagcgcggcggtgcccagcggcacaaaggtgttgaactctttcgggtcgagcatcaccgaaaccacatcgtcagcatgttgctgcgtcgccgcgccgttaaacagcggcgaccagccttccggccctttgccgcgctcgacgatcggtttaccggcgcagccgttggccagcggttgttcttcgatacgaatgtcgtaatagaaacgagtctgcgggtcgaacatgcaagtattgatataatccgccagcttcgccgccagcgcctgatagcgctttgcctcttccgctttgccaagaattgtcgccatctgcgccagatagtggttatcgctgtacatatagctggcctgatcgaccgattcctggagcagcgaataccccagcaggttgccgtcgcggtcgcggttttcggcgaatttcaccgtccagtcgctgcgtttgccgccgttggcgacgtatttatccagctgttctttatcgataaaaccaaataccgccgcatcgtcgcgcccggactcccacgacgccgctacctgcgccgggatttcgaggctgtcgtaatcgcctttggccgtcacctgttcgtaggcgctaaggcccgaaagcgtctgctcggtttgcccttttttcaccgtgaacagcatggcgccgtcggcggtgttgtgcgccttatcgcgggtcgcgccatattccggcacgccgttaccgttatggtcgcgattgcgcagccaccagtcgtgataggccaccagcttcggatacatctcttccagccacgctttatctttggtgacgttatacacctccatcaccgaccaggccgcgaggcttggcttggtgttgcgttcgttccagttgccgccgtcgccgccgcgctcggggctcaggttccaggcaatcagatcgggcacaaatccggcgtcctgcgggcgcaccttatcattggctttaatctgccaggagaagacggcgcggatattctctttggcgatatccgggttgaagtgggccatggcgtaggcctgtttccaggtatcccacggccaggtctggttgccggagaaccagcggccggtcacggatggggtgacggtatggtaatgcaccgcgccgcccggcgcgcgccagttgccgttgagcgtctcaatagctttcaccgccacgcgggtctgttcggcggtagcgtcggggttgctgagccctttttgcagataaccgtcccagcgctgttcagaggcggtgagatagtaagccgggcgcgccagaatatcgcggatctgcgctttttcccgccgcgcttgttccgcggtgagtag

SEQ ID NO: 2217 - DNA, 1737 bp, Klebsiella pneumoniae
tccgcgaaggtgcggacggagtcgtcaaccgcggcaaagcggagccaggggataaaaccatgtgcgacgtctggctgccggtggtggactccctgcgccagtccagcgagcagcacctgtcgatcgccgccgcgctggatgccgcctgcgaagtggccgagcgtgcggcccacgccaccatcactatgcaggcgcgtaaaggccgcgccagctatctcggcgagcgcagcatcggacatcaggatcccggcgcgacctcggtgctgtttatggttcagatgctggccgccgccgccaaagagtaaggaaatcgcgatggtaaacctggttattgtttctcatagcgcccggctgggcgaaggtgtcggagaactggcccggcagatgttaatcaacgatggctgcaaactggcgatcgccgccgggatcgacgatcccgacagcccgatcggcaccgatccgcttaaagtcatggaggcgatcgaatccgtggccgataccgatcacgtgctggtgatgatggatatcggcagcgcgttgctcagcgccgaaaccgccctcgatctgctcgatccggcgattgccgcgaaggtgcgactgtgcgccgcgccgctggtggaagggacgctggcggccaccgtcagcgctgcctccggcgccgggatcgacaaggtgatcgccgacgccatgagcgccctggaggccaagcgggttcagctgggtttaccttcgccaacttctgacgccgcgccggcgccgatgcttgccgacgacggcgacacaaaatcggtgtcagtcattattaacaatcacaacggcctgcacgtgcgtccggcgtcgaagctggtcgccgcgctggcgggctttaacgccgatctgctgctggagaaaaacgggaagtgcgtcaaaccggacagcctcaaccaaatcgcgctattgcaggtccgccgcaacgataagctgcgcctgctggcccgcggtccggatgccgacgcggcgctggcggcgtttcaggcgctggccgccgataacttcggtgaatcgcctgcggcgcaaccggcagcggctccggcaacgcccgagcgcgtcgaaggcgctgccctgcgctatccgctggccctgatccagccgctccgcccggctgccgccgatgccgcccgcgagcagcagcgcctgcgccaggccattgaccagacgctggcggatcttatcgccctgaccgagctggcggaaaataaatttaacgccgatatcgcggcgatcttcgccgggcaccacaccctgctcgacgatgacgatctgtttgatgccgccaacgatcgtctgctcaccgaacaatgcacggcggaatgggcatggcatcaggtgttgatggagctcagccagcagtatcgccagctggatgacccctacctgcaggcgcgctatatcgatatcgaagatattttgcagcgcaccctgcgccatctgcagggcgttcaggagagagtgccgacgcccggcgagccaacaattattattgccgacaacatttatccctcaaccgtcttacagctggatgccagcttcgttaaaggcctgtgcctgcgcgatggcagcgaacaggctcacggcgcgattatcgcccgcgcggcggggatcgcctggctgagccagcagggcgaggcgctgaacagcgtgcagcccggcgagactatcgtgctcgatatgcgccaccagcgccttatccgtgactaa

SEQ ID NO: 2218 - DNA, 663 bp, Klebsiella pneumoniae
atggaactatttacccagttattgaatgccttgtgggctcaggattacgaaacgctcgcgaatccctccatgataggcatgctgtattttgtcttgtttatgattttgttccttgagaacgggttattgcctgccgcgtttttaccgggggatagtctgctcgtgctcgtgggcgtgctgatcgccaaaggggcgatgggttttccggaaaccttgctgctgctcaccgccgccgccagcctcggctgctggctaagctatattcaggggcgttggctgggtaatacgcggatcgtgcaaaactggctgtcacacctaccttcgcactatcaccagcgtgcgcatcacttgtttcataagcatgggctctccgcgctgctgatcggccgctttatcgccttcgtacgcacgctgctgcccaccatcgccgggctttccggccttaataacgcccgttttcagtttttcaactggatgagcggcctgctgtgggtgctcatcctgacctcgcttggctatctgctgggtaaaaccccggtattcctcaagtatgaagatcagctgatgtcctgcctgatgctcctgccggttgccctgttggtcttcggactgatcggctcgctggtggtactgtggaagaaaaaatacagaagccggggctaa

SEQ ID NO: 2219 - DNA, 447 bp, Klebsiella pneumoniae
tccgctatttctgccacctttacttcaggaaaaaaaatgaaattgataacccgtattgcctttgccacgctgttgaccaccggtttctctatcacggctcaggccgcagacgttaaggcggcgccagcaccggcgcaggatcctattgttcagcacttaaaacttaccaacgatcaggttgcgaaaattaaaagcctgcatcagcagttggagagtaatgtccagcagatttcccaacaggaaattaaagacggggctctgataaacgtgattgattccggtaaatgggatgaaaaagcggtcaacgatcagctggcggccttcagcaagattgatcagcaggtgcgttattaccgcgtgaagtactattttgaggtgaataaggtactgacgccggagcagcgcacgcaggtgaaaaaagatcttgccgacgcgctgaatgaataa

SEQ ID NO: 2220 - DNA, 690 bp, Klebsiella pneumoniae
ccgcggtcttctccggcctggcgtggtggtggatcacccgctttgaaaaaaagcagcaacgtttacgcgccgcagcgccggttaacgctgccgctgccggtaaataacgttcctttcgtcccgtcagcgcctcggcggctggcgggatttttttatccctcgcctgattacgtattactcaacctttttcgtgatcgagttaaagctattcggtttctttacttctatttactaaaagttttactaaaatcgacattaattcttaactacctctaccctacaaacaacacaacccccttcagcgaccctctgaaggacaatgtgtggagatgtgttatgtctgatactaaacgtaataccatcggcaagttcggcctgttatcgctgacctttgccgccgtttacagtttcaataacgtcatcaacaacaatatcgaactggggctggcgtcggcgccgatgttcttcctcgctaccctgttctacttcattccgttttgcctgattatcgccgagttcgtgtcactgaataaaaactccgaggccggggtttacgcttgggtgaagagttcgctcggcggccgttgggcgtttatcaccgcctatacctactggttcgtaaacctgtttttcttcacctcgctgctgccgcgcgtgatcgcctatgcctcttacgccttcctcggctaa

SEQ ID NO: 2221 - DNA, 327 bp, Klebsiella pneumoniae
tgttgcgcttcatcatctcttccaccgcactcagatcctccaccacgttacgcggcggcatctcgttgctgccgtgcgcgtaggtggcggcctccacctcctcgtcggagattggcggcagccccagctcgcggaaaaccgcctggatcgcccgcgccgctttctggcgaatggcaatggtttccgcctcggtcaccggacgcaggccgccgtcaaccatcaggtcacgctgcaggatgttgtaatcatcaaaatcttccgcatcgaagttcgagccggcgaacatgttgtcgtagttcggcaccgcgctgtagccggagaaaataa

SEQ ID NO: 2222 - DNA, 588 bp, Klebsiella pneumoniae
cagtggggttctatgcactatttacaacgtgatgcgcgacgggaagggattatgcaggccgccatgcgcctggcgctgcgcggcggctttgccgccatgaccgtgcggcagatcgcccgcgaagcccaggtggccgccgggcagctgcaccaccacttcacctccatcggcgagctgaaagcgcaggttttcatccgcctgatccgcgagatgctcgacatgccgctggtggctgaggacgccagctggcgcgagcgcttgttctcgatgatcggcagcgaggatggccgactggaaccctatatccgcctgtggcgcgaaggccaggtgctggccgacagcgatccggacatcaaagcggcctacctgctgaccatgaatatgtggcatgccgagaccgtcgccatcatcgagcagggcctcgccagcggcgaatttcggtcggctgagcctgcggcggatatcgcctggcgctttatcgccctggtgtgcggcctcgacgggatttatgcgctggacgcgcaggccctggatgaggcggcgtttagccgctatgtaaataagatgattacgctggagttgttttag

SEQ ID NO: 2223 - DNA, 378 bp, Klebsiella pneumoniae
accaaaatctcaaagataagcatcaataatacgttacaggaacaggtaaataagatgagaaaaatatttttgtgctgcgctgccggcatgtcaacgagcatggtaatgaataaaatgaaacaagcggccgcggcgcaaggcattgctgtcgatattattgctgtttcaatggatgattttgatcgcacgttaccaaattacgattgctgtcttttagggccgcagattaaatataaattcgaagaatttaacaaaaaggccgctgcggtgggcaagagagtcgccgttatcgatagcatggattacggcatgatgcgtggcgataaaattcttgctgcggcgctggcgctgctggatgaaccttcacttaacaagtag

SEQ ID NO: 2224 - DNA, 843 bp, Klebsiella pneumoniae
cgagcagtctccccagcgccaggcgctaacgcaacaggggatcgaagtgagctgggacgggatggcaatcacccttcaggataccgcatgctgatcactgacacgctgtcgccgcaggcctttgaagaggctctgcgggctaaaggcgccttctaccatattcaccacccttaccacatcgccatgcataacggcgacgcgacccgcgagcaaattcagggttgggtggcgaaccggttttattaccagaccactattccgctgaaagacgcggcgattatggccaactgcccggatgcgcaaacccggcgcaaatgggtgcagcggatcctcgaccacgacggcagccacggcgaggacggcgggattgaagcctggctgcggctgggggaagcggtcggtttgagccgcgacgatctgctcagcgagcgtcacgtgctgcccggcgtgcgcttcgcagtggatgcctatctcaatttcgctcgtcgcgcctgctggcaggaggcggcctgcagctccctgaccgagctgttcgccccgcagatccatcagtcgcgcctcgacagctggccgcagcactatccatggatcaaagaggaaggctacttttacttccgcagtcgtctgagccaggctaaccgcgacgttgagcatggcctggcgctggcgaaggcctactgtgacagcgctgaaaaacagaaccggatgctggagatcctgcagtttaagctcgacattctgtggtcgatgctcgatgccatgaccatggcctatgccctgcagcgcccgccctatcacacggtcaccgacaaggcggcctggcacacgacccgactggtgtaa

SEQ ID NO: 2225 - DNA, 645 bp, Klebsiella pneumoniae
aaatcgcactcagggggccgcccgatgaaagagtatctgcctgaaaccgcctcgcagacggcgggaccctatgttcatatcggcctggcgccggacgccgcaggctttcatatttttgagaaaaattttggcccggtcctcactaccgccgataccgtcggggagcgcatcaccattgaaggccgggttatcgacggctccgggacgccggtccgcgatgtgctgctggagatctggcaggccaacgccgcgggtcgctataaccatcctgacgatcgtcaacagcagaaagccgtcgacccggccttccgcggctgggggcgtacctgctctgatttcacctccggcatttggcgctttgaaaccatcaagccgggcccggtggtcggtcgcgatggccgcctgatggcgccgcacgtcaacctgtgggtggtggcgcgtgggatcaatattggcctgaatacgcggatgtactttgccgatgaacacgcggccaacgccagcgacccggtgctgaatctcatcgagtgggaggtgagacgcaaaaccttaatcgccgagcgcgaggttcgcggtacggaagtggtctatcgttttgacattcatctgcagggcgagaacgaaaccgtctttttcgatatttag

SEQ ID NO: 2226 - DNA, 1347 bp, Klebsiella pneumoniae
gaggatagctcaatgagtacgctaatcacggataaggtcgataacgcagcggtccaaaaagaaaaactggacaccagtgcgtatttaccccataccccctggctgcaatttttactggtctgttgcctgtttgcgctatgggggatggcgggcaacctgaatgatattttgatcgcccagtttaaaaagggcttcgatttaacggatacccagacagcgctggtgcagtcgatttttttcctcggctacttttttgtcgccctgcccgcggcggcgctgattaagcgtttttcctataaagcggcgattattattgggctgtgcctgtacgccctcggctgcttcctgttcgttccggccgcacagatcatgacctacggcgcattcctcgcctgcctcggagtgatcgcctgcggactctcttttctggaaacgtcggcaaacacctactccagcctgctgggtccgattcaatcctccacccagcgtattaacttttcgcagatcttcaactcgctgggcgtgatctccggcgtattaattggccagctgatggtctttggcgaaaacgatccgagtcatgaacaactgctggcgatgcccgccgccgctgcagacgttgcacgccatcagatggttggtcaggtggtcgggccctatctgattatcggctccgtactggtggtgctggcgctggtgttcgtgtttattaaattcccgtcgtgcaagggcgcgcccgctcaacagcaacaactcccgacggaaagcatggggccaacgctgaaacgcctgtttgctatcccgcgctttcgcctcgggatcctgtcgcagtttttgtacgtcggcgcccaggttggcgtatggagcttcacgattcgctttgtgcagctcgtgcagcaaggcaccagcgagcactccgcgacttactggctgctggcttctctggtgatttacgccgtgggaaaaaccgtggccacctggttgatgaaccgtctgaatccggcgatgctgctcggaacgtttgccctggccgccaccgccctgttactgattgccgttttcagcggttcaatgctggcggtctatgcgctcattctggtcagcttctgtatggcgccatgctggccgacgaactttggtctggtgatcaaagggatggggaaagatacccagaccgcaggctcgatcgtggtgatgtcgattatcggcggggccgtaattcctctggtgatgggcattatctcggatatgaacggcggcaatatgcaaatcgcctttatcgctccgctcctgtgctttgtgtatgtcgctttctacggcttctggtgcgtgcgtaagggggtataa

SEQ ID NO: 2227 - DNA, 963 bp, Klebsiella pneumoniae
cgttggcgattccaactcgcaaacgccggaatacaaggcgttcctggtcaacatcgagaaagcgtaaggagcgattcaatggcgatggaaacccaagacattattaaacgctccgcgaccaacccgatcacccccgcgccgcgcgcgcgggactataaagcggaagtcgccaagcttatcgatgtctcctcctgcgtgggctgtaaagcctgccaggtggcctgttccgagtggaatgacatccgcgatgacgtggggcactgcgtcggggtgtacgacaacccggcggatctcagcgccaaatcctggacggtaatgcgttttagcgagaccgaacagaacggcaaactggagtggcttatccgcaaggatggctgtatgcactgcgcagagccgggctgcctgaaggcctgcccgtccgccggggcgattattcagtacgccaacggcatcgtcgatttccagcaggaaaactgcatcggctgcggctactgcattgcggggtgtccgtttaacgtcccgcgcctcaataaagaggataaccgggtctataaatgcaccctgtgcgtggatcgggtcagcgtcggccaggagccggcctgcgtgaaaacctgtcctaccggcgcgatccacttcggtacgaagaaagagatgctggaggtggccgaggagcgggtggctaagcttaaaaaacgcggttatgccaacgccgggatttacaacccgccgggcgtcggcggaacccacgtgatgtacgtcctgcatcatgccgaccagccggagctgtatcacaagctgccgaaggaaccgcagatcgataccagtatcagtctgtggaagggggcgctgaaaccgctggcggcggcgggctttatcgccaccttcgccgggctgatttaccactacatcggtatcgggccgaacaaggaagttgacgacgacgaggagaagcatgatgagtaa

SEQ ID NO: 2228 - DNA, 498 bp, Klebsiella pneumoniae
aaaaggagctcacctatgtacaccatcaccgacatcgccccttctgacgccgaatttatcgccctgattgccgccctcgacgcctggcaggagaccctctacccggcggagagcaaccacctgctggaccttagccagctgccgccgcagacggtcatcgccctggcgatccgcagcccgcagggcgaggccgttggctgcggggctattgttctcagtgaggaaggctttggcgagatgaagcgggtctatatcgatccccagcaccgcggccagcagctgggagaaaagctgctggcggcgctggaagcgaaagcgcgtcagcgcgactgccataccctgcgcctggagaccggtatccatcagcatgcggccatcgccctctacacgcgcaacggctaccagacccgctgcgcgtttgcgccgtataaacccgatccgctcagcgtgtttatggagaaaccactgtttgccgatcttcgttcagcagcgctataa

SEQ ID NO: 2229 - DNA, 618 bp, Klebsiella pneumoniae
tcaatgccatcaataatcattaaaaccgccgacgaactcgcccggcagcgccatgccggccagctgctggcgtcagtgtttgatatgctggatacttttatcgttcccggcgtaacgacgatggcgattaacgatcgagtggaagattttatcgtcaaccagctgcacgcccgcccggccagcaaggggcaatacgattttccctatgtgttgaacacttccattaacgatgtggtgtgccacgggatccccaaagcgaccgaacatctgcgctccgggatgattgttaacgtcgatatcacactcgagaaagcgggcatgattgccgactccagtaagatgtacctgataggcgatgtctccccgctggcccgccggctggtaaagactacctatgaagcgatgtggaaaggcattgaggtggtgaagcctggcgcgacgctgggcgatattggccacgctattcagcgctgggtggaggaacatggctatagcgtggtcagagaatattgcggtcacggcgtcggtcaggaaatgcatgaggaaccgcaggtgctgcattacggccgccccggcagaaggcgccgtgctgcaggaaggcatggtgttcaccattga

SEQ ID NO: 2230 - DNA, 1194 bp, Klebsiella pneumoniae
accctattgtcaatggcacagacccccgttatggatgtgggtacaaaaagttatatatctcatcaggaacagaaaatgactgccaccgtagagcaaatcgagagctggattgtggatgtcccgaccatccggccgcataaattgtcgatgaccaccatgggctgccagtcgctggtgatcgtgcgccttacccgttccgacggcatctgcggcatcggcgaagccaccaccatcggcggcttgagctatggcgttgagagccccgaggccatctcgtcggcgatcacccattatctgacgccgctgttgaaagggcagccggccgataacctgaatgcgctgaccgcccgcatgaacggcgccattaaaggcaacacctttgcgaagtccgccatcgaaaccgcgctgctcgacgctcagggcaaagccttaggtctgccgatatcagccctgctcggcggcgcgttgcaaacggcgttgccggtgctgtggaccttagccagcggcgataccgcgaaagatatcgctgaaggagaaaaactgttggccgaaggccgccaccgggcgttcaaactgaagatcggcgcgcgtgaactcgccaccgacctgcgtcatacccgcgccatcgttgaagcgttaggcgaccgcgccagcatccgtgtcgacgtcaaccaggcctgggacgccgccaccggcgcgaaaggctgccgcgaactggcggcgatgggcgtcgatcttatcgaacagccggtcagcgcccacgataatgccgccctggtgcggttaagccagcaaattgaaaccgcgatcctcgcggatgaagcggtcgcgaccgcttacgatggttatcagctggcgcagcagggctttaccggcgcttacgcgctgaaaatcgccaaagccggggggccgaacagcgtgctggcgctggcccgcgtcgcgcaggcggcagggattggcctgtacggcggcaccatgctggaaggcaccgtagggaccgtggcttctctgcacgcctggtcgacgctgccgctgcagtggggtaccgagatgttcggcccgctgttgctgaaagacgatattgtcagcgtgccgctcacctttgccgacggtcaggtggcgctgccgcaaacgccgggccttggcgtcgagctggatgaagacaaactgcatttttatacccgccagccgtag

SEQ ID NO: 2231 - DNA, 990 bp, Klebsiella pneumoniae
cgaccgtcgtccacgtctgctatactcgcccaccgaattttgatggtgggcaaggagccgcgtgtggcgacggttatcaataatgcaatgctggaagccattctggcagaaatcaggccgctgattggccgcggaaaagtggcggattatattccggcgctggccagcgtcagcggcgacaagcttggtatcgcgatcagtacggtgaacggtcagcactttgccgctggcgatgcccatgaacgtttttccatccagtcaatctccaaggtattgagcctggtggtggccatgaaccactatcaggaggaggagatctggcagcgggtggggaaagatccttccggccagccctttaactcgcttctgcaactggagatcgagcagggcaaaccgcgcaacccgtttatcaacgccggggcactggtggtctgcgacatgctgcagagccggctcagcgccccgcgtcagcggatgctggaaattgtccgccgtctgagcggcgtggccgatatcgcctacgatccggtggtggctcgctcagagtttgagcattcggcgcgcaacgccgccatcgcctggctgatgaaatcctttggtaacttccataacgacgtcgccaccgtgctgcagaactatttccactactgttcgctggagatgagctgcgttgagctggcgcgaacctttctgtttctcgccgaccgcggcattgccccgcatctcgacgcgccggttattgcgcccatccagtcccgccaggttaatgccctgatgatgaccagcggcatgtaccagaacgccggtgaattcgcctggcgcgttggcctgccggcgaaatcgggcgtcggcggcgggatcgtggcgattgtcccgcaggagatggcgatcgccgtgtggagcccggagcttgacgacgccgggaactcgctggccggcgtggcgatgctggaaaaactgactcagcggatggggaggtcggtgttctga

SEQ ID NO: 2232 - DNA, 321 bp, Klebsiella pneumoniae
tttttaccgtcgagccaagaccaatgtcgctcccgatgcggtagactttgccggccacggcgtccagcaccggcgcgaggcgggcaaaggcggcatcgctcccggaggccatcaccgtcatgtcgccggcggccgctttcacggcgccgcccgataccggcgcgtcgagcatcaatagctggtactccgccagcgcctcggcaatggcctgagcatcggcggaggcgatggtggacgacaccatcacgacggtgcccggcttcagatgggcggcgaggccgctctcgccgaacaggatcccccgcacctgggcggcattga

SEQ ID NO: 2233 - DNA, 261 bp, Klebsiella pneumoniae
atctcccagtcgctctttgcctcccaggccgggtcgacggcggcggagagcgggtggataaacgggtgcatgtccgaggtgttcatatcgtctttttcataccaggtggcggtcggcaggacaatatcggagaagagacaggtactggacatgcggaaatccagcgtcaccagcaggtcgagtttgccctcaatcgccgcggtctgccactcgacttcctcaggttttacctcatcgctggcgcccagttcatcaccctga

SEQ ID NO: 2234 - DNA, 204 bp, Klebsiella pneumoniae
acaatctggtcggctaacagctcggcttcacgtcggtcatgggtgacatacagggcggtgatgccgagctgtcgcagcaggcggctcatttcgccacacagcgattcgcgtagttcgctgtccaggttggagagcggttcatcaaacagcagcacccgcggcgcggcgacgatcgcccgcgccagcgccacccgctgctgctga

SEQ ID NO: 2235 - DNA, 627 bp, Klebsiella pneumoniae
accaatcggtctactacagtgtgcagcatgaacagacacagcgattgcgatacccgagaacatatcctggccaccggcgagcagctttgcatgcatcgcggttttaccggaatgggcttgagcgaacttctaaagacagcggaggtgcccaagggctctttctaccactactttcgctctaaggaagccttcggcgtcgcgctgcttgaacatcactacaccggatatctgcagcgcctggtcgaccacttcgatcatggcgacggtaactatcgcgatcgcctgctggcctactatcagcacacgctgaatcagttctgccagcaggggattattagcgggtgtcttactgtcaagctatccgcggaggtttgcgatctgtcggaagatatgcgcgccgccatggatcgcggagccagccagattatcgccctgctgggcgacgcgctggagaaaggacgtcaggaaggcagtctcgcatttgacggcgaggccatgaccctgtcgcaggtgctgtattccctgtggctcggggccaacctgcaggccaaaattacgcgtagcgcaacgccgctggaaagcgcccttgcccacgccaaacagattattgcagcgcctgcggtataa

SEQ ID NO: 2236 - DNA, 258 bp, Klebsiella pneumoniae
cgggcatttcccctccggaaaggcgttcctggtttacacttaacagggagacagccatccggaggtgttatgcaacgatgtattctcgcgatcttatccctcgcattttgcgctggcgcacaggccgttagtgaagatgtgcaacttaatctcgtgaccacccagggcgtcggtcagaccatcggcagcgtcaaaatcaccgaaacccgaccgcggactcgagttcgcccccactctgcgggcgctaccgccgggtaa

SEQ ID NO: 2237 - DNA, 969 bp, Klebsiella pneumoniae
tggatctctccctgttcgcgctcgcggtctgtctggccctggtattgctcattgcctggtgatctccctgttatgaaaagattaaaatatctgtcaacgctgctggtcgcggccgtcgccctgattgccgcatggttgttatggaatttctacactcagtcaccctggacccgcgacggcaaagtgcgcgccgagcaggttgggatcacccctcaggtctccggcagtattctgcagttgaacgtaaccgataaccaacgggtcaaagccggggaagtattgtttaccatcgacgacaccccctatcgcatcgcggtgctgaacgcccaggcgcagctggcgaaagcccaggcggaggtggcgaaagcccaggcggagcaaagcaaggccgccagcgaggctcgccgtcgccgaagcctgtcgcaaaatgccatctcggctgaagaccttgagaacgtcaataccgccctgaataccgccaccaccaccctggctgccgccagagcgggggtcggcgtaaccgaagcggcgctgaaacatgcgcggtggcagctcagccagacggttgtcaaagcgccggtggatggctgggtgaccaacctttccacccgcgtcggcgattacgctaccaccggccatccggtctttgccctggtggacagccactcgttttacgtgctgggctatttcgaagaaaccaaactgcgccacattcgcatcggcgatccggcacaaattattctctatagcaatcagcagacgctaaagggccatgtcgccagcatcggccgcgcgattgtcgaccagagcgtggaacagggaaccgggctggtggccaacatcaaaccaaatatcccctgggttcgtctcgcccaacgcgttccggtgcgaattgcctttgatacgctgccggccgatgtcaccctggtctccggcaccacctgcactgtctcaattggcgggcagtaa

SEQ ID NO: 2238 - DNA, 831 bp, Klebsiella pneumoniae
ggctctactccgggtggttccagtttcgatatgataatggcaggggctaaatctgaaatgccaggtagtatagataaagcgccaagacatgatgaagccacaggctggtccagtactgcgataagctatcaacgcggcgaggcagatcctccccatcatcatgttgaggggcagctactcttcgccaccagaggggttatgctggtgcaaacagagagcgaccgttgggtgatccctcctcagcgggcattatggctaccgcctctgcatatccatagttatcatctgctttcacaaaccgatctcagggcgatctatttcagcagtagccttatcgcagaatgtacgagctttaccaagagtcagcaggtacacgtgatcacggctacgccgttagtcaaagagcttatcgctgggctgttcagtgaggactacgccagaccgagtcaacggaagatagcgttgttgcttctggaaattctcagcgaggctccacctttaacgatggcgcttcccatgccgaatgatgagcgattattcagcgcggccagatcgctactggtcaatcagcgctgggaagcatcgctgagcgagctggcttttatgtcggccatgtcggaacggaccttttcccgattgtttatgaaggatacaggctttagttttagaacatggaagcagagagccagaatttgcgcttcgttggatcttctcgcgaacggcgttccaatcaaacaggtcgcttaccagcttggtttctcatgcccggcggcctttaccgctgcttttcgctgcattttgggggcaacgccacgcgattttgtgccttaa

SEQ ID NO: 2239 - DNA, 1059 bp, Klebsiella pneumoniae
cccgtccgtcctactctgactccagcgataatcgataaggagttaattatggtaaaggtcggtattaacggttttggccggatcggacgcaatgtactgcgcgcagcactgaataatccggatattcaaattgtggcaatcaacgatttgacggacagcaaaacgctggcgcatctgctgaaatacgactcgcttctcggtaagctggatgcagaggtcaccgcgggtgaaggggggcttgttgttgatggtaaacccattaccgtattcagtgaacgcaacccggccagtattccgtggcgtcagtgtgaagtcgacatcgttattgaggctacaggattattcacggaccgtgaaaaggctgctgtacatatccacagcggtggcgccaagcgcgtgattatctctgccccgggtaaaaacgatgatttaaccattgtgatgggcgttaatgagagcctttactccccggataaacactacgtgatcagcaacggaagctgcaccaccaatggtcttgcacctgctgcacaggtcctgcaccagcatttcggtattaagcatggtctgatgaacaccacccatgcctacaccaacagccaggcgctgcacgatcagccggaaaaagatctgcgcggggctcgcgccgccgcattgtcgattgtgccttactccagcggcgcagcgaaggctctgggtaaagttattcctgagctggatgggcgtttaacgggatactcgctacgcgtccctgtgccagtggtgtccattgttgacctcaccgtcacgcttgagcgagatgtgacggtcgaagaggtgaacaatgcttttcgcgaagccgccgcagcgggacctctgaaagggatcctgggttatagcgatgaaccgctcgtctccagcgattaccagggagacccacgctcgtcgattatcgacggtctatcaacgctggtgattggcggtaatatggtcaaaattctggcgtggtacgacaatgaatggggattctctaatcgtctcgttgatctggcattgatgatggcaaagcgtgaaagctaa

SEQ ID NO: 2240 - DNA, 1218 bp, Klebsiella pneumoniae
atcaccagtccagagcttatgactacgaatacggtctcacgcaaggtagcgtggctacgtgtcgtgacgttggccatcgccgcgtttatttttaacaccacagagtttgccccggtcggtctgttgtcggatattgccgacagcttcggcatggaaaccgcccaggtgggcatgatgctgaccatctacgcatgggtggtggcgttaatgtcgctgccgtttatgctgctgaccagcaaagtggagcgccggcgcctgcttatcggcctgtttattctgtttatcgccagccacgtcctgtcgttttttgcctggaattttgacgtgctggtgatcagccgcattggtatcgcctttgcgcatgcagtgttctggtcgataacgtcggcactggccatccgcatggccccgccgggcaaacgggcgcaggcgctgagcctgatcgccaccggtaccgcgctggcgatggtgtttggtattccgatcgggcgcattatcggccagtactttggctggcggatgaccttcctggcgatcggcctcggcgcgttagccaccctggcctgcctcgtaaaactgctgccgaccctgccgagcgaacattctggctcgctgaaaagcctgccggtgctgttccgccgcccggcgctggtcagcgtgtacattctgaccgtggtggtggtgaccgctcattataccgcctacagctatatcgagccctttgtccagacggtagcgggcctgagcggcaactttgccaccgtactgctgctgatccttggcggggccggtattatcggcagcattctgttcggtaagctcggtaaccagcacgcgtcggggctgataagcctggcgattgccctgctgctcgcctgcctgctgctgctgctgccggcctcgcataacccgcagcacctgatgctgctcagcatcttctggggggtggcgatcatgattatcggtctcggcatgcaggtgaaagtgctggcctccgctccggatgccaccgacgtcgccatgtctctgttctcgggcatctttaatatcggcataggcgccggggcgctggtcggcagccaggtgagtctgcatctttccatggcctccgttggctacgtcggcgccattccggcgctggtcgcgctggtctggtcgctgatgatattccgtcgctggccggtatcgctggaagaccatcagccgcaccactcctga

SEQ ID NO: 2241 - DNA, 675 bp, Klebsiella pneumoniae
ttaactatgttcgatttgtttaaagcaatagggctcggcctggcggtgcttttaccgctggcgaatccactcacaaccgtggcgctgttccttggcctggccggtaatatgaacaacgccgagcgtaataaacaggcgttaatggcatcggtgtatgtcttcgccatcctgatggtgtcgtggtatgccggtcaggtggtgatgaatacattcggcatatcaatacctgggctgcgtatcgccggcggattgattgtggcctttatcggtttccgcatgctgtttccccagcaaaaagcccacgattcgatggaagcgaagatcaaatcggaagaactgcaggatgaaccgaccgccaatatcgcctttgtgccgctggcgatgccaagcaccgccggtccgggcaccatcgcgatgattattagctccgcctcgaccgttaagcacggcgtggacttcccggagtgggtggtgctggcggcgccgccgatcatctttttgctgttaggggtgattctgtgggcttgtctgcgcagttccggcgcgattatgcgtctggttggcaaaggcggcatcgaggccatctcgcgactgatgggctttctgctggtctgcatgggcgtgcagtttattattaacggcgtgctggagatcatttcgacctggcatccctga

SEQ ID NO: 2242 - DNA, 750 bp, Klebsiella pneumoniae
gccataatgttcgatttacacacgatctctttcctgttgatctttattgccgccgggctggtcaaaggggtgaccggcatgggattgcccaccgtggcgatgggcctgcttggcctgctgatgccgccgcaggccgcagcggcgctgctggtccttccctcgctgctcaccaatctctggcagttactggcaggcccggcgctggcgcagattgtacgccgtctctggcttatgatgaccgggattattattggcacgttggccggatcctcactgctgatcggcctcaatcctcggtggtcggcgctggcgcttggcgccgcattgatagtctatgccgggtatgcgctctgcagtccggtgtttcaggtttccggccgcgtggagaagtggctgtcgccgctcatgggcgggctgaccggcgttatcaccggggcgaccggggtatttgttattccggccgttccctggctacaggcgctgggctttcgtcgcgacgagctggtgcaggccctggggttgtcgttcaccctttccaccctggcgttggcggctggcctcgccctgcacgatggctggcatgatgatgcatggctattgtcggcgctggcgctgttgccggcgctgctcggcatgtggctgggacagcggatccgctcgcgtctcagcccgcagcgctttcgtcagggctttctgttgttcctgctggcgctggggatagagctgatcgcccggggatggctggtctga

SEQ ID NO: 2243 - DNA, 1200 bp, Klebsiella pneumoniae
cctcttatccctatgagcacttccgtcagcactacacaactcaatttgcgcattatttcgatcgttgtttttacctgtatctgctatctctccattggtctgccgctggccgtactgccgggctatattcactatcagctgggctacagcacctttgtggccggaattgtgatcagtctgcagtacatatcgacgctggtaagccggccgcacgccgggcgctataccgatatctgggggccgaaaaaagtggtcagccttgggatcgtctgctgcctgctcagtggcgccttcacgctactggcggtagtcctgcaggcaacgccgatgctggccattgccgcgctgctggcgggccgggtgtttctcggcgtcggcgagagctttaccgccaccggcgccaccctgtgggggatcaaaaccgtcggcgcgatccacacgtcacgggttatctcctggaacggcgtggcgacctatgtggcgatggcggtcggggcgccgctgggagttaccctcaatcactattttggcatcagcggctttgctacagtggtagtactggtcgcggccatcggtctgctgttcgctcgtacccgccaggacgtcaaggtgaccgccggcgccagagcgccctttcacgcggtggtgcgaaaaatctggccttacggcctggggctggcctttggcaccgtcggtttcggcgttatcgccacctttatcaccctctacttcgccgcgcacagctggcagggcgccgcgtttaccctttcgctgttcagcgtcggctttatctgcgttcgcctggtgctgggaaataccattacccgctttggcggagtcccggtctccctggcctgcttcatcatcgaaagtctcggcctgctgcttatctggctggcgccatcagcatggatggccggcgtcggcgcctttctcaccggttcgggtttctcgctggtctttccggctttaggagttgaggcggtaaaacaggtggaagagcaaaatcagggaaccgccctcggcacctactcggcgtttcttgatctggcgctgggcctgaccgggccgctggccggctgggtcgccgggttctacgatctcgccacgctgtatctgctggcggcgatcgtggtggcgctcgcattcctgctgattttccgcgtacatcggcaacagcggcttgtcgccagagagtag

SEQ ID NO: 2244 - DNA, 1056 bp, Klebsiella pneumoniae
cttattaccccgttttcggagaacacaatgaacgcgaccaccctgccgattctcgacctggcccgctacgcggaccccgcggataaagcggccttcctggccgacctgcgtcatgccgcccgcgacatcggcttcttctatttgatcaaccacggtgtcgacgacgcgcttcaatatgaagttcagcgccagtcccagcgcttttttgctctcgatgaggcgcaaaaacagcaggtggcgatgatccactccccccattttcgcggctataaccgcgcggcctctgagctgacgcgcggccagcctgactggcgagaacagtttgatatcggcgccgaacgtccggcgctgaccctcagcgacgacgccccgcgctggcagcgcctgcagggtccgaatctgtggcctgccgccctgccgtcgcttaaaccggtattacttcactggcaacagcaaatgacccaggtgggcatccgcctgctgcgcgcttttgccgaagccctgcagctcccggagaatgcctttgaccggctctacggcgagaaacccaacgagcatatcaaactgatccgctatcccggccagcaggagacccaaagcagccagggcgtcggcgcccataaagattccggtttcctcagcttcctgctgcaggacgagcagaaaggactgcaggtagaggtcgcgcctggggaatggatcgacgccgtgccgctggccggcagctttgtggtcaatattggcgaactgctggagctggcgaccaacgggtatttgcgcgataccgtccatcgcgtggtgtcgccgccggcgcagcagcagcgcctctccatcgccttcttcctcggcgcccagcttgacgcggtggtgccggtttacaccctgccgcccgagttggcgcgtgaagcgcgagggccggacagcgacccgcacaatccgctgctgcgcgatgtcggctggaattatctcaagggccgtctgcgttcccatccggacgtggcggaacgctactatcaggacgtgtttcgcgaacgcgccgagcaattgatcgtttaa

SEQ ID NO: 2245 - DNA, 1206 bp, Klebsiella pneumoniae
agaatgaaccccagaattattatttcaggtgttatctcatgttttctgcctgcgaccttatgccatgcggccaatctaagcgacgacggcagcttccagttaaatggatatggcatggtggctggagattttcagagcgaactaaaccgtcccaaaaacatgtcgttgcataccgatcccaccggacctaatcaggatcctcgtggcaaaatgggcgatttgggaaacagtttctggcacgattactggacatcgctggctatcactaaaaaatggcaggggctggcttctcccgagcaatgggctgattacacctatgaaatggtgggttacggcgataaaacggtagaaacggcacagaattatgggcgctttggtgggctctcttttcttcccgagggcgcaaacatttgggctgggcgtcgttatctcgatcaacgtattaatatcttcgcttacaataccaaagaagtacatattgattccggcctcggttataacagtaagaattttgatttgaacgttggtaccgaccagatcgactggtccagcgataccgcgccgcaggcgatagaaggctcgcggcgcatcgttgatatggcttatcgtatcgatcagacagagctgggtatgacctatgttaaagaaattgatgacccattgggcactggcaagcagaaagcaattagtttttccgcgaaatacagcatgccgtctttttggggagtggcaaagggacaatcgacagtcaaattacagtatggtaaaggggttattgctccttatctgaacaccagtcgtattaccgtccttagcgaagagggcgattgttcaatgcgtttttccaccgacggaaacttgacgttatttgatgattttgccgtctcgccggctttcatctatgaatataccaagcgtgaaaaaactgctgaccgaaccacctttatacctgatacaggttattcagggggggacatgacctatggttccgcaaatgaaaccgggatctttaccggcgtaaacgttaaacaaaatattcatcaccaaaatctctccatgttgtatgaagtcatggtgaataacactatcaataaaaatggcgtcgaaggttccagcggcgtcggctaccaaattgccgccgggcccggccctgcaactggatgttttaccgtatgtcgcgccgattctcattttgacggttactaa

SEQ ID NO: 2246 - DNA, 981 bp, Klebsiella pneumoniae
tcgctccgcccgccgttcgcgcgggcaccttcattcattacccggtccgtcttcatgttcattaaagtcctcggttccgccgccggcggcggtttcccgcaatggaactgcaactgcgccaactgtcagggtctgcgcgatggcatcattcaggctgccccccgcacccagtcgtcaattatcgtcagcgacaacggtaaagagtgggtgctgtgcaacgcctcgccggatatcagccagcagattgcccatacccccgagttaaataaagccggcgtactgcgcggaacgcatatcggcggcattattctcaccgacagccagatcgaccacaccaccgggttgctgagcctgcgggaaggctgcccacatcaggtctggtgcaccccggaggttcatgaggatctctccaccggcttcccggtgtttaccatgctgcggcactggaacggcggcctggtgcatcatcccatcgctccgcagcagccttttaccgttgacgcctgtcctgatttgcagtttaccgcggtgcctatcgccagcaacgcgccgccctattcgccgtatcgcgaccggccgctgccgggtcataacgtggcgctgtttatcgaaaaccgccgcaacgggcagacgctgttctatgccccggggctgggtgagccggatgaaacccttctgccgtggctgcaaaaagcggactgtctgctgatcgatggcaccgtctggcaggatgacgagctgcaggccgccggcgtcgggcgcaataccgggcgcgatatgggccacctggcgctcggcgacgagcacgggatgatggccctgctggcctctctgccggcaaaacgcaaaattctcattcatattaataacaccaacccgatccttaacgagcagtctccccagcgccaggcgctaacgcaacaggggatcgaagtgagctgggacgggatggcaatcacccttcaggataccgcatgctga

SEQ ID NO: 2247 - DNA, 429 bp, Klebsiella pneumoniae
cccgccataccgatcaggcggaggcgttgctcaacggtgtccgtaccttttgcgcgctggtggcgattggcgcatgggggatcagtacccagtggaccagctgcgccggcggccctgaacctggcctccatctgctgcgtgctctactcggtatccgcctcgccgtttcgctcgctgacattgctgatgcagactctggttctgctgtcgctattcattttcgtggtgaagttcggcctgatggtgcaagtaaccgacctgtggcagtttctgctgtttcctgttcccggctcctggacaccatgcagttactcaaactgcagtggcccaaatacgccgggcttgtgggaacagcttatcgtctttatgggctcgttaatcgccgtcaccaacccgccggtgtacgattatgcggccttttttcaatga

SEQ ID NO: 2248 - DNA, 1017 bp, Klebsiella pneumoniae
aagttaatacctgctctcacagggagactgcaggtgaagtctccctctgtattattgccggggataaatcacatgaatggactaaatcataacgcgcttacatgcagtgccgtccccataccgccctgggagcgttctcttcagaccgtggaggcccagccgtacttcagcgtttcacaggcgtcgctcgtgctcgaagggatcgtgttcgatcggaacaataacctgctgtttgttgatgtggcgacggggcgcgtgtttaagctaaccccggagcggcagctttccattgtccttaaggagaatacgttcggtgcttccggcctggcggtacacaaagatggacggatctttatcgcctcggtgggcgatatgcagcgaggttctgttcgggctatcgaacccgacggcacccgtgagcagatgattgttgcccctgatactggatttcttgtcaacgatctggtctttgataatcagggcggattttatttcactgacagccggggaaattcagccgatccacagggtggggtgttctacgttagtcccaatgtcgggtcaattcatgccatcctgcctggactcgcggtcgggaacggcatagcgattgaccccgccggctctcagatatgggccacagaacacgctaaaaacaggcttcatcgcgtaagactgtcagacgccaccacggtcgccccgtttggttcagttgttacctatcagttcaccgggccggcgccagacggggcccgtgtcgacagcgaaggcaatgtatatgtggccatctcaggccagggccgcgtcatggtcttcaaccgcaacggactgcctattgggcaaattgtgctgcctgaccgcgacaaaggccgtaaccttaaatcgacaagcctggcgatccgccccgggcatcgcgagttgtttattgtcgctaacagcgggaccgaacctggtggagcgatgatttttcgatcgggcgcattcgcgccggcaccgtttcccttttcacatcagtga

SEQ ID NO: 2249 - DNA, 597 bp, Klebsiella pneumoniae
tcgccgtcaccaacccgccggtgtacgattatgcggccttttttcaatgataatttgagcaagattgtcggggtaggctttgcctggctggcctttgcggtactgagtccgggctcggacgcccgcaaagggcgacgccatatcagagcgttacggcgtcactttgtcgatcagctcagccgtcatcctcagcacagtgagcatgaatttgaatcgctggtctatcaccacgtcagtcagctcagccagagtaaggatgccctggcgcgccgctggctgttgcgttggggcgtcgtgctgctcaattgctcgcacgtcgtctggcagcttcgcgaatgggaaacccgctccgatcctctcgcccaggtgcgcgacctgtgcatcaacctgttacgcgatgtgatgagcgagcgcggcgtgcagcagcgtccgctggcctccaccctgcaggagctgcagcggatctgcgacgccctgaaccaccatcatcagccggcggcgcgggaactggccgccgcgatttggcgactgtactgcgccctgtcgcagctggaacaggccccggtggccggcacaattggcgaaggaactacttaa

SEQ ID NO: 2250 - DNA, 1713 bp, Klebsiella pneumoniae
ttgatcccgtttctccggcgctggccgccggaggaccctcagcttcaggaaccggttgtgaaacaaacattcctttccggcgcgacccttgccgccctggtgatgctggtcgcgttaccgttagtgtttattctgctgcaggcgatttttccccattttagcgccggttcgctcggggacgcctttggcggtatcccggcgctgctggccgatcctcagctgccggcgatgctcggcggtacgctgtggatcgccgccggcgtggcgctggtcagcgtaatgattggcctgccgctcggcatcctgcgcggtatgttttcgctgccgctgccccggctgtgggatctcctgtttttgatcccctttctgacgccgccctatatctcggcgctctcctggatgctggccctgcaaagccagggctatctgcagcagctgaccggctggcagctgaacgatctgctgttcagccgcagcgggatcgtgctggtgatgacctttaacatatttccggtggtctactttgccgtctcccgcagcctgctggcgagcgggacccggctggcggtggtcgcccgcgtccatggcgccagcgcctggcgcgccttctggcacgtgacgctaccgatgctctccccggcgctggcggcgggcacgctgctggcgtttaccctcgctatcgaggagtttggcgtaccggcggcgctgggcagccgggcgggagtggtgatgctgacggtcggtattgagaaaaagctggccgactggccggtggatctccctggcgccgcgctattgtcgctgctgctgatggcggtggcgttattcgcctggtggctgcaaaggcggctggtgggggagaaagaggtcaccagcgtcaccggtaagccgggggagaaccacggggcatcgctgggctggatgatgctgcccgccgtgctggcgatggcggccgtcggcggcctggcggtcggcgtccccgccgtctcgatgatgctcactagcgtgatgggcacgctctccggtggcgtgagtgttgagaatgtcacgctgcgtcatttcgcggcgctgtttgaccagcagggagatgccctgtcggccctcggcaccagcctgtcgctggccctgggttcggcgctaatcgtcggcgcgctgggcctgctggccgcctggctggtgatggtgcagaagattaaagggcgcgggatggtggacgcgctgtcgctgatgccggcggcgctgccgggcgtggtggtgggggtcggtttgatcctgctgtggaatcagcccttctggccgcgctcgccctataacacgctgtggatgctgctgctctcctattgctgcctgctgttgccctggccggtgcgctatgtcggcagcgcgctgcgccagctgggcccgaaccttgagcccgccgccagggtgcacggggcgtcgccactgcaggcgctgcggttgattgtcctgccgctggtctttccggcgctgctggcggcgatgctgatggtgttcgcggtggcctcccgggagctggtgacctcgctgctgctctctccggccggtacgcaaaccgtggcggtgtttatctggcgccagttcgaacagggttccgtcggtcagggcatggcgatggccagcctgacgttgttgaccggtctggtcctgatgctgacggcgctggcgctgatgcagcgccgcacgtgcggttaa

SEQ ID NO: 2251 - DNA, 1158 bp, Klebsiella pneumoniae
cgccgaaaaccggctgatgttctgcgggtacgacccgcgcggcttcaagctgctggtatggacgctgtcggcggtgctctgcggtctggcgggggcgttatatgtcccgcaggtggggatcatcaaccccagcgaaatgtcgccgaccaactccatcgaggccgccatctgggtagcgctcggcgggcgcggtaccctgattggcccggtgcttggcgccggattggtcaacggtgcgaaaagcattttcaccgtggcgatgccagagtactggcagctgtttctcggcctcatcttcatcattgtgaccctgtttttaccccgcggggtgatgggcctgctgcgtcgaggagaccgctaatgcaaccggatgaaggactgtttacccgccagctgcccggcgatcgctttcgcgaacaaaccgatccggtgctgcagctggagaacatcaacgtcagctttgacggtttccgggcgctgacggatctgtcgctggcgataggcgtcggcgaactgcgctgcgtgatcggccccaacggggcgggcaagaccaccctgatggacgtgatcaccggcaagacccggccgcaaagcggcaaagcgctctatgaccagtcggtggatctgaccactcttgacccggtggccatcgcccgccagggcatcgggcgcaagtttcagaagccgacggtcttcgaagcgctgacggtggcggaaaatctcgccctggcgatgaagggggataaatcggtgtgggccagcctgcgcgcccggatgagcagcgaacaggacgatcggctgaatgaggtgctgcgcctgctgcgtcttgacggcgagcgctaccgccaggccggtctgctgtcccatggtcagaaacagtttcttgagatcggcatgctgctggtgcaggagccgcatctgctgctgcttgatgagccggcggccggcatgaccgatgcggaaacggagtatacggcggagctgtttcgcacgctggccggacagcactccctgatggtggtggagcacgacatgggatttgtcgagaccatcgccgaccgggtgacggtcctgcatcagggccaggtgctggcggagggatcgctgcgggaggtgcaggccaatgagcaggtcattgaagtttatctgggacgttaa

SEQ ID NO: 2252 - DNA, 1008 bp, Klebsiella pneumoniae
tcctctgaacctaatctcaaagcgtgtatttcagttttcatagctgctaagttgataacctcaaaagaggtcaaaagtgtggggcattacagaatgattcctgacaaatcggttgaaatactgctgggtgagctatcgagggatattgcacagcgcacacccggcaccggcgatttccctaccgccgtagaagggctcgaattgtttcgccgaaacgaacccgctcccccggtaaactgcctggtccctcccagtatcgttctggtggccgatggcgcgaagatcatgtgggttgggggtgaaccttatgaatataatgcggaaaaattcctgattacctctcttgacctgccggccagttcggaaatattgcaggcttcgacatcccagccctgcgtcggcgtagcctataagcttgaccagcgcgtgctaatggaattaattgcccagggaagcctgccgccggtcaaaaaacgagacgcgggaacgagtgtcgggataggtactattaccgatgctttgctggagcctttctgccgtctgctttctttgcttgacgaacctgaagccattcctgttctcgggccgctgatccaaagagagatacactaccggcttttgatgagcgatcagtccgatcatctcagacagattgcagcagtcgacggccatggctaccgtatcggtaaagctatcgactggttaaagaccaatattgcatcacctttacgcgtcgaggaactggcaagtcgggtgcaaatgagcacgccctctttccaccaccatttcaggcagcttgcggggatgagcccgctacggtatcagaaatggctgcgcctcaatgaagccaggcgactgatgctgaatgaacattacgatgtcaccacagcagcctatgcggtcggttacgaaagcctgtcccatttcagccgggaatatacgcggatgttcggggaatcgcccaagagggatattactgaactgagaaagtcagcgggtaagctttaa

SEQ ID NO: 2253 - DNA, 915 bp, Klebsiella pneumoniae
aggtccgcttttattaagacgcgaatcaggacagacaagatgagtacattaccaaaggtcgcggtgctgggactcggcgccatgggacacgcttttgccagtaacctgctgaaaaacggctttaccgttgccggctggaaccgttcgccagcccgcggcgaagatttacaggcgcatgggttatctctgcacgccacgccgcagcaggcggtggccgatgccgaggtgatcatcagtatgctcgccgacggcgaggccaccctcgaggtactggcgcaaatcgcgcccgcctgtcagccgcaggcgatctattgccagatgggcaccattggcctgccggagacccggcaggccatcgcgttgttgcgggaacttcagccagcgatgacctatatcgatgccccggtgtcggggaccaaagcccccgcggagaaggcacagatcctggtgctcgccagcggcgatagggaaaagggcgccgctgccgaaccggtgtttgcggctatctcccgcgggacgcagtggtttggcgaggcgggcaacagccagaaaatgaagctggtcctcaatgcctggctgatttcgatgatgcagggcatcgcggagagcgcccagctggcgaagacgctgggcttcacccccgaccagctgtggagcgccctggaaggcggcccgctggcggcgccctatgtcaaagtgaaactagacgccatcgccagcgagcagtttaccccgcagatgcagctggcgcatgccctgaaagatgcccggctggcgctttccctggccgagccgcacaccatgccggggctggaaaacatcgccgaactgtggcagcaggcggcggacgcgggatatgccggagaggatttgtctgcggtatatcagtggctgtcgccgtcgtcaaaagcgtag

SEQ ID NO: 2254 - DNA, 1695 bp, Klebsiella pneumoniae
tgcgttttgccacgaccgagccacagagagcgctgtaccatgagtaacgatcacctgacggatattgcctatcgccactttattgaaagcgttaaagattatgccatctatatgctgagcgccgacggcacggtcattagctggaatgagggcgcccgccgggcaaaagggtacctgagcgacgagatcatcggtcgctacttcggtctcttctatagcgaagctgagcaactctccggtgtacccgcaaaaaacctggaaatcgccctgcgtagcgggcagtttgaaggggaaggctggcggtatcgcaaagacgggtcccgattctgggcgcatgtcatgatcgataccatccgcgatgagcagaacaccctgctgggttttgccaaaattacccgcgacattagtgaacagaaggcgattaacgaccgcatcgcctggatggcgcgctacgatgcgttaaccggtttacccaatcgggtggagttttttgaacgggtggagaagctgatcactggaaatgatgcccgccgctttgccattttcacgatcgatttagacaaatttaaagagattaacgatctgcagggccatctgattggtgaccagctgctgcagcgcgtggcgggcgccgtgctcaaaacgctgcagaaggaggagatggtcgcccgcttcggcggcgatgagtttgtggccgttaaacctttttccgatgagggtgaagtggatgcctttgctgcgcgcctgtggcactgcttcagcggtaagcagacgtttgccgcgacggaagtggttctctccgccagcattggcatctcagtctacccggaggacggcacggatattaatacgatactgagcaattccgatctggctatgtatcgggcaaaaagcagcctcgaccataagatttgctggtatgaacgtgaaatggatgacaagacgcggcagcgtaatatgatggccgccgatatccggcgcggtattcacgccggggagttttcgctccactatcaggctatccgcaacatcaaagatcgtagcatcaccggttacgaggcgctgctgcgctggcagcatccgcagctggggacgatcccgccggacgtgtttattcccatcgccgaagagagcggcgccatcgtgcccttaggttactgggtgctcgagcaggtgtgtaacgaatcgctggaaaatggtttgaacagaaaagtttcggtcaatatctctccggtgcagttgcgtcatcgtagctttatcgaaaaagtccgcgagatcctgatgcgtaccgcctacccggtcagtctgctggagtttgaggtcaccgaaacggcgtttgtgatcaataaacagctggcgttcagcgttctgcatcatctgcaaaaaatggggatcagtattgcgctggatgactttggcaccggttactcctccctgagcatgctgcgcgattttcatttcgacgtcatcaaactcgaccgcagctttatgacagatgtggagagcaaccctcaggtacgctcattcgtgcgagccattatttcgctgggcaattcgatcaatacgccgcttatcgccgagggggttgaaacggctggacaactgcagatcctcgaagaggagggatgtgacgagatgcagggatttctgttcggcgagccggtcgatatcaaacatctgcccgaccggcgctga

SEQ ID NO: 2255 - DNA, 1059 bp, Klebsiella pneumoniae
aaaaccatgccgatatcgcgctgctccgggggcaatccccatcctgcgcgggcgaccagcctgtcgccaaagcggatttcgccgctggccggcacgctcagcccggccagcagacgcagcagcgtgcttttgccgcagccggaagggcccagtagcgccacgatgcggccgggttcgatatgcaacgtgaagcggtcaagaatgggggtctctgcgaaggcgaaagagacctcctgcagggtgataggggtcagcgtgcgcatcatcgccctccctttcgggacagcgagaccagcccggcggtcgacatccgacggggcacgctcacctgggatagcatcaggggagccaacatattgtgatcctctttgggacttagtgctggcgactatagtcagacgagatgacgtattgattacattttcattgcggcttaacgtgttacctgccaaccgacccattattcaaggaacgcctatgagccgctttcgccacgttgaactgcagtacgccagccgcctgctcaaccacggcccaaccattttgatcaccagctacgatgccccgtccgaccggcgcaacgttatggccgccgcctggtcaatgccggtggaattcgccccgccgcgggtggctatcgtggtggataaaagcacctggacgcgggagatcatcgagcgcaatggcacctttggcattgtggttcccggcgtcgcagccgccagctggacctacgccgtcggcagcgtcagcggccgcgatgaggacaaatttaatgcctgggggatcccggtagtaaccggcccggagctggggctgccgctgatcgaggagaaatgtctggcatggatggagtgccggttgctgccggcgacggcggcccagacccagtacgataccctgttcggggaggtggtctctgccgccgccgatgagcgcgcgttcgtcaccggacgctggcaattcgacgacgataagctcaataccctgcatcatcttggcaccggcaattttgtcgccagcggccgtcatgtgcgggcaaactccctcgacgaataa

SEQ ID NO: 2256 - DNA, 1152 bp, Klebsiella pneumoniae
gagggtgtgccgggcgccgctgtgctactgtggcagccttctatttccagggccggacgcataatgattcagtacattcgtattcaaaattttcgctcagtgaaggatatcgcgcttgagctcgggccgctgaacattgtcttcggccctaacggctgcggtaaatccaatatttataacgccatccacctgctgaccgctgccgctgagggcaggctttcggggtttatcagcgaagagggcggtctggagaatatgatgtggtccggggagcgttcgcccctcgatcgtcacccccgccggctgcaaatcgcctgccggaccgacagcttcgattatgagctgcagataggcttccctgaaaaattgccctatccgacgcaattcatgctcgatcctatcgttaaagaagagaatatctggctggccggctactcccgccggccttcctcccgcgtactgcagcgcaagaatcaggcggcgtttctcgtcgatgtcaccggggagaaaagtactttcaccgagagtatttatgaaaatgagtcggtgttcggtcagcttggcgagccgcaccgttttcccgaagtatcgcgagtgcgggagacgctgcgccgttggcggttttatcatgaattcgcgattggccgtcattcgccgctgcgtcagccggccgtgggttaccgttcgccagtcctcgacagcgatggccagaatctcgccgccgcttttcagaccattgtcgagatcggcgcggaggagattttgcatgaaatccttgccgacgcctttcccggctgccagttttattgtgaaaacgagcactcgcgtttcgctctgaaaatgcgtcgcgaagggatccgccgcccgctgctggcggcggagatgtccgacggtacgctgcgctttttgtgcctcgccgtcgcgctgctcagtccgcgcccgccggcgtttctggcgatcaatgaaccagagaacagcctgcatcgcgacatgttgcccgcgctggcccggctgattatcgaggcctcgcgctacagccagatctggctgaccagccactcggcggagctggcggagcttatcgccgccggggcgccttgtcagcgctatgcgctggagaatcgcggcggggagacgcggattgtcgagtga

SEQ ID NO: 2257 - DNA, 900 bp, Klebsiella pneumoniae
atattaccgccgggctgccgtttatccgtacctccgcggatcatggcactgcgtttgatattgcctggacaggtaaagcgaagtctgagagcatggcaacctccattgagctcgccatgcacatcgcgcaggaataacatgaagggatataaccggttagagcagattatggacttcctgaaaagccataatctggtgacagtcgaccagctggtggcggcgaccaacgcctcgccggccaccattcgccgcgacctgatcaaactcgatcaggaaggggtgatcagccgaacgcacggcggggtgacgctgaaccggtttattccttcccagccgacgacgctggagaaagcccagcgtagtccgcttgagaagcaggctatcgccagtgcggcggcagcgctggtgaaagccggcgacgccattgtgcttgacgccggcaccaccatgattgagctggcgcggcagatcacccatctgccgctgcgggtgatcaccagcgatttacatatcgcgctgttcctatcggaatttaagcagatcgaagtgacgattatcggcgggcgcatcgatgacagcagccagtcgtgcatcggcgatcacggccgccgcctgctgcagaccatctggcccgatctcgccttcgtcagctgcaacggctgggaccttgagaaggggatcaccgccccgacggaggaaaaggccgccctgaagcgcgatctgatggccaatgcccggcggcgtatcctgctggcggacagctccaaatacggcgcctggtcactgttcaacatcgctccgctggcgtcgttgaccgatatcgtgaccgacgcccacctgccggataaaacccgcgaggcgctggagaccctttccccgcagctgatcattgccgactga

SEQ ID NO: 2258 - DNA, 1134 bp, Klebsiella pneumoniae
agaggaccgcctgatggtcgagacccagcgtccggaacggttgccgctggatctgaccctggaggcgcatattccggcggaccgcagctctatcgcctaccggcgcgggctgaagaagatgggttttggcgatttctttctggtatgagtggaggtcatatgcgcgacatactcccggtggtggtcgatggcctgtggcgccagggcgcgaaaaacctggccgttcgtctggtgagcgccgaggggcaaccgctgccagcgtggacgcccggcgcccatatcgatctccatcttccctgcgggctgatccgtcagtactccctgaccggcagcccggccgaacgggatcgctatctgctctgcatcgcccgcgagtcgcagtctcgcggtggctcccgttatattcatgacaccctgcgcccgggacagccattgatgatctctgccccgcgcaaccactttccgctgcacgagggcggccatgtggtgcttctcgccgccgggatcggcattacgccgctgctggcgatggcccacgcccgggcggcgtccggcgccagctttacgctgcactattacgttagccgtgcgcaggaggccgccttcgccaccgagatcgcccgccagctgagcgggggaaactgccagatccactgctcagacgaggggcagagtccgcgccagcggctggcgcaggatctgggggctccggacgccgacacccgggtctacttttgcggtccgcccggatttatggcccgggttcgcgataccgcgcgggcggccggatgggaggaggcgcaattgcacagcgaagcgttccagccgcccgccccgacggcggcgtcggcggcggacggaaccttcaccatcaccctcgcctccaccggggagcgctggccggtgccgggggacaaaaccatcgcccaggtgctgcaggagcatggcgtcgcggtgccgctctcctgcgagatggggatctgcggcgcctgcctgacgccggtacgcgagggaaccgtcgaccaccgggataccgtgcagtcggaggcggaaaaacaggccgcagagcagcatattgcgctgtgctgctcccgcagcctgtcggccaatttagttatcgatctcgcgggataa

SEQ ID NO: 2259 - DNA, 1362 bp, Klebsiella pneumoniae
agctgcacgcccgcctgcagcaagggctgcaggcgctatagcagagccggctggcggctagctctgcggctgcccccagcggctgcgcaaatagttaaccgcctgccgggtttgcggctgattgaggttgttttcgcggaacaggatggtgccctggatctgcggcagagtctcattgagatcgagctgctttttcagctccggcacgccgccatccaccgtccagtcaggctcgtttttggacggttcacccaccttgtacagcgccacgccgatatacagccgggtatgcgtcggtttaaccacctcggcccaccagttggccagcacatcatagcgcgcggcatcgcgggcaaacggccagtagatctgcggcgcgatgtagtcgagcagtccctgctgcacccagctgcgggtatcggcataggattcatcataggcggccgcgccccgggtatcggaccccgccggatcgtgggagcggttgcgccacaccccggccgggctcacgccaaactcgacgttcggattgagctttttgatggtggtggaaacctgggctatgagctgctgggtgttatgccgccgccagtcgcccttcgaggcatagccctgcccgtaacggcggaaagtctcgttgtcgttaagcggggaagaggcggtttcggtatagaaatagtcatcgaactgcacgccgtcaatcgggtagttctgcaccacttcagcgacgatgctggtgatccagtcacgcgcttcgggaatgcccgggtcgagaacaaagcgatcgctggcggtgcggatccagttacggtgcaggacgaacacgctggccggtacctgagtaagggtgttgttcagctcggcaatcgtcgacggtttggtgttgaccgagacgcggtagggattaaaccacgcgtgaaccttcatgccgcgcttgtgcgcttcatccagcataaactgcagcggatcgtagccagggtattcgccgattttgccggtcagcatatcggaccacggcagaatatccgaccgccagagcgccgtaccgtccggtttcacctggaaaaagacggtgttgatccccaggcgctgcaggttatcgagtttagcgatcagcgccagcttctgctgcgtgatgcggctctccggcgtgctggcgataatcgacccgaccggcggccagtcaaggcgcgaaacggtggtgagccacacgccgcgcaccggctcccggtgcgcctgcccggctttgacggcggcagcgttcggcggcgtgacaagggatttaggggctttactggtgcagctgaacagcatgccagcggcgatgagcgccgcgcctgccagcgccactttgctggctaa

SEQ ID NO: 2260 - DNA, 879 bp, Klebsiella pneumoniae
ttatcgacgcccttgacgcggcggggcttcccgccgggcgtggtgaactatcttacctgtgcgcctgaagatgcgccggcgctggtggaatcgctgatcgcccaccctgcggtgcggcgcgttaactttaccggctccacaccggtgggacgcattatcgcccgcacctgcggacagtatctgaaaccagcggtgctcgagctcggtggaaaagcgcccctgctggtgctggacgatgctgatattgagcaagcggcagcgggcgctgtttttggcgccttcgccaacgccgggcagatctgcatgtccaccgagcgcattattgtcgacaatgccgtagcggaggcgtttatcccgctgctggccaggcgtgccgccgccctgcctgccgccctcactggcccggttgtcgatatgaacaccatcgcccgctgcaacgcgctcattgaggatgcgttagcgaaaggcgctcgcctgctgaccggtggcaaagccaacgatacccatatgagcccgaccctgctggacggcgtgacccgcgagatgcggctgtggcgtgaagagtccttcggtccggtgaaagcgattattcgcgttcatagcgaagaggaggcgctggcggtggccaacgacagtgagtacggtctttccgctgcggtctacagccgcgacagcgccagagcgtggaacgtagcgcaacgtctgcataccgggatttgccatatcaatggcccaacggtgcatgatgaggcgcaaatgccgtttggcggctgcaaagcctccggctatggccgctttggcggccgggccgggatcgcggaattcaccgagctgcgctggataacgatccagacccagccccgcgagcttcccttctga

SEQ ID NO: 2261 - DNA, 1053 bp, Klebsiella pneumoniae
cgatacgcgttgcctcgcagcaatcgtggtctccatcacactattctgcacaccatctcgtctgcctcgcctcacagcgttagtctggtcacagaacatcgccaacaaggagctgctatggcactgccgattatgattgattgcgatccgggacatgatgacgcgatcgccctggtcctcgccctcgcctcgccggagctggaggtgaaagccgtcaccgcttctgcaggcaaccagaccccggagaagaccctgcgcaacgtgctgcgtatgttgacgctgctgaaccggccggacattccggttgccggcggcgcgtggaagccgttgatgcgcgatctgatcatcgccgataacgtgcacggcgagagcggactggatggcccgagcctgcctgagccggcctttgcgccgcagaactgcaccgccgtcgagctgatggccagcgtgctgcgggaaagccaggagccggtgaccctggtggccaccgggccgcagactaacgtggcgttgctgctcgccagccatccggagctgcacgcgaagatcgcccgcatcgtgatcatggggggcgccatggggctgggcaactggcagccggcggcggagtttaatatttacgttgatccgcaggccgcggaaatggtctttcagtcggggatcccggtggtcatggcggggctggatgttacgcatcgggcgcaaatccttcccgccgatatcgagcgattccgccagattggcaacccggtgtcgaccatcgtcgccgaactgctcgacttctttatggcctaccacaaagatgaaaagtggggcttcgacggcgcgccgctgcacgatccctgcaccatcgcctggctcctcaagccggagatctttaccacgatcgaacgctgggttggcgtagaaacggaaggcaaatatacccaggggatgacggtggtcgattactaccatctgaccggcaatcggcccaataccaccctgatgctggatgtggaccgcgaagcctttgtcgatctgctcgcccagcggttagccttctacgcctga

SEQ ID NO: 2262 - DNA, 1617 bp, Klebsiella pneumoniae
cgtcctgcgcccgggactgtcggtgatcgtcaccgtgaacgaaaagagccctcgatgagcaccgttcaggcgctgtccgccccgcagggtctgtcgatgccgacggcgaagaagatcttcgccttcgccagcatgtgcgtggggatgtttattgcccttatcgacatccagatcgtctccgcctcgctgcgggatattggcggcggcctgtcggcgggcgacgatgaaaccgtctgggtacaaaccagctacctgatcgccgagatcattattatcccgctttccggctggctggcccgggtcatgtcgacccgctggctgtttgccgcttccgcggcgggcttcacgctgatgagcctgctgtgcggctgggcgtggaacatccagagtatgatcgccttccgcgccctgcagggactggcgggcgggtcgatgatccccctggtgttcaccaccgctttcgccttttttcagggcaaacagcgggtcatcgccgcggcgacgatcggcggcctggcctccctcgcccctacgctgggtccaacggtgggcggctggatcaccgaaaactacaactggcactggctgttctttatcaacgttgttccggggatttacatcgcggtggcagtgccgctgctggtaaaagtagacagcgccgaccccactctgctgcgcggcgccgactatctcagtattctgctgctggccttgtccctcggctgcctggaatataccctcgaagaaggtccgcgctggggctggtttgatgacgcgaccctgacgaccaccgcctgggtcgccctgctctgcggcgtggcctttgttatccgcaccctgcgccatccgcagccggtgatggatctccgcgccctgcaggatcgaaccttcagcctcggctgctatttctcgtttatggccggcgtcggcatcttcgccaccatctatttaaccccgctgtatctggggagcgtgcgcggtttcagtgcgctggagatcggcctggcggtattttccaccggtctgttccaggtcatgtctattccgttttattcgtggctcgccaaccgcgtcgatctgcgctggctgctgatggccgggctgatcggctttgcggtgtcaatgtacagctttgttccgatcacccacgactggggggcggaccagttgctgctcccgcaggcctttcgcggactggcgcagcagtttgccgtcgcgccaacggtgaccctgacgctgggcagcctgccgcccgcgcgcctgaagctggcctccgggctgtttaatctgatgcgcaacctcgggggcgccatcggcatcgccctgtgcggcacggtgcttaacgacagaaccaatctgcactatagccgcctggcggaccatctgaataacgccaacctggcaatgagcgattttgttcagcgcagcgcggcaaacttcaccgtccaggggatctcgccggatgccgcgcagacggcggcgctgaaaaatctttccgcgctggcgctacgggaggcgcgaacccaggcattttccgatgctttctacctcatcatgatgggttttttacttgccgcgctgctggttcccttgatgaaaaagccgccggcacactaa

SEQ ID NO: 2263 - DNA, 351 bp, Klebsiella pneumoniae
gccatcgcgccgggaagccgcggtgcgccacgccgccagcgcgcccgcggcgtttcgccgctttcaggtaggcagcgccgacgcgctggcgggcgatctcgctgcgctgcaggccgccttaggcgattttcaccgcacccattacgtcgcccggcgaatgcagctctggctgcaggggccgcagtcgctggaggcgctcggcgagctggcggcccgtttcgccgccggacttgccgcaggcgaggcgccgccgccggcgccgccgctgcgcctgggcgagttcactgcactgcagctagcggtctccagccagcccgcgctgtggcgctgcccgctgatcgctttaagtga

SEQ ID NO: 2264 - DNA, 1590 bp, Klebsiella pneumoniae
tctgataagcctattcatcaggtgatgacagcggtctgcaaagacgagaggacaaccatgattggagtgaaaaagcttcaggacttttccaaggcgatgatcgggccggtgctgtatctgccagctatcggcctgttgatcgccctgttcagcatgacgaccaaccggctgtgggtggatgaaagcagcgggctctacctggtggggaaatttgtctccagtatgctctgggcgctgatgaaccatcttgggtttctgttctgccttgggctggccagcggtctggcgaaaacccgcaaggccgaagcggccttcgtggcggccatgacctggctgatgtatctggcggcgaataatagctggctaaccctcacccatcgcctggcgaccggaaccaccaacgcgcaactgtacggcagcggacaaacctttatcttcggttttcaggttatcgatatgggcgtattccttgggattatccttggctgcgctgtcgcctttgtccataatcgcgtggttgggattgagtttcgcggcgcgctgtcgatctacggcaacagtaagctggtgctgatcgtgatgctgccgctggttggcatgttcgccatcgccaccgtctatctctggccggtagtggagctgggcatctcggcgctgaccggctttatgaaatcctttggcgccatcggggtcttcctgtacggctttctcaaccggttcctgatccccaccgggctgcatcatctgatctggtcgccgttcgtttttacctctatcggcggtcagctgctgatcgatggtcagaccgtcattggcgctaagcctattttcctggccgaaatcgcccgccaccccgttgacgcgctcagtgattccgcccgtttcctcacctatgggatggtgaagatttttggcaccgccggcatggcgctcgccttctaccgtacggcgaaaccggagaataagcagcggttgaaagtcacgctgatccccttgattgttacctccgtcctggtggggatcaccgaaccttttgagtttctctttatcttcaccgccccattgctgtggcttatctactccctgctggacggttttttccagatgctggcctggctgcttcacgtcagggtctgcgccactaacggtctcatcgatttcgtcgtctataacctcccggcgggagtcagcgcgacgcgctggccggtgtttgtcgccctcggtctgctggaaaccgcgaccatgtacctggtcggcaccttctgtattacccgtctgcggctgctcaccccgggccgcgaaaccgcagccgaagatgagcattcgcaacaggctaatagcgagcatccggataaaggcgcgctggtgattgccgggctgggagggaaagagaatgtctgtgcggtgggcaactgttttacccgtctgcgggttgatgtgcgggaccccgcccttatccagcagacgctgttgaaagagagcggcgggagcagcgtgctgattaaaggaaaccatgtccaggttatctatggcctgggagttaacaaaattcgaacggcggtcaacgccagtctgggtgttattgaataa

SEQ ID NO: 2265 - DNA, 414 bp, Klebsiella pneumoniae
gcgccacggccgacggggcgggagcgtcgcgcccgtcggccgctgaccagaggagaacgacatgaacgcattgcgtctcgtgagtgtgttggcgctattgctgaccttgctgccatggcgggcgcaggccgcggaggcggacgacttcgttgccgccagtcgcagccagcaggcgcagctgttgacccagtgggcggcagcgccgcaggcggatcgtctgccgctgctgcgggcgttgaccaccgagagcctggtgatggacgacggaaaacatgctttccgcacccgacagggcggattacagccattgggcgctgtcgccgcgccgcagggcgaaacccggccggtccgtctgaccaaccggctgcgcaatctggctgccggcgcgctggccagccaccttattttaagtga

SEQ ID NO: 2266 - DNA, 315 bp, Klebsiella pneumoniae
gacaccgggccgctggggatccgtatgcacatgccaattccaatcggcatgccgacccttggcgcatcgctggcaacgcagtccggactgctgttcttcgccggcacccaggatttctacctgcgcgcctttgataccgcgaacggcaaagagatctggaaatcgcgtctgccggtcggcagccagtccggcccgatgacctacgtctcaccgaaaaccggtaagcagtacatcattatcaatgccggcggcgcccgtcagtcaccggatcgcggcgattacatcatcgcctacgcgctcccagaccatcactga

SEQ ID NO: 2267 - DNA, 543 bp, Klebsiella pneumoniae
cagggagcttttatgaccacatccttttcactgcgcacgctctcgcgtgacgatattctccatcacctcccggcattaagcgagatcctggcaagctgcgtcaacggcggcgcctcggtgagctttatgctgcctttcgcgccgcaaacggcgataacgttctggcaacgcactgccgacagcgtggcggccggggagcgcattgtgctggccgccttcgacgcggaggaacgtcccgttggcaccgtgcaacttatcaccagtcaaccggaaaaccagccccatcgagcggatgtcgccaaattattggttcaccaaaatgtccgccgccaggggatcgcccaggcgttgatgagcgagctggagcgcattgcccggcgggaaaggaagacggtgctggtgctggacacggcgaccggcagcggggcggaacagttctatgcccgctgcggctgggaaaaagtgggggaaattccgcgctatgcgctgatgcccgacggcgaaatgactgccacctcactattctataagtttctgccctga

SEQ ID NO: 2268 - DNA, 714 bp, Klebsiella pneumoniae
tttttggctttctgttttctggaggaaggcgcgatggtatttccttatatgacacatttactcgcggcaatgttgttgggggcgctgatcggcgcggaaagacagtggcgacaacgtatggccggtttacgcaccaatgccctggtggccaccggcgcggcggtgtttattctcagcgcgatgtcggcctcgccggacagcccggggcgtattgcagcgcagatcgtctccggtatcggcttccttggggcaggggtgattatgcgtgatggcatgaacgtccgcggcctcaataccgccgccacgctgtggtgttcggccggtatcggcgtactctgcggcctgggacagttctggaacgcgacggcggctacgctgattattctgtgcgccaatatcctgctgcgcgaggcggcgcagcgcattcatgccttgccgggggccggtgacgaagagaaacgctatgtcttacgcgtcacctgtctgcgcgaacatgaaaatgccgtgcgtcagctgttgctgaatattgcgcagcagcagcggtttaccctgcagggattgcagtcggcggcggcggacaccgcggaccatctggagatttgcgcacagctgattagccataagcagcaccaaaaaacgctggcgcaaattatggcgcaaatgggcgttcagcagaacgtcacatcggtgcactggcgtgtcggagaggcgtag

SEQ ID NO: 2269 - DNA, 1140 bp, Klebsiella pneumoniae
cactactttactgacgcccatcaccctgatctgccgataaccatgacagaaaacgctaacatcctgacaacaccttctgtgacactgtcacgtcatcaggtggtcgccctcgcctacgatggcctgtgcacctttgagtttggcgtagccgtggagatcttcggcctgccgcgcccggaaatgggcgacaactggtaccagttcgccgtcgccgccgtcgatgaagggccgctgtgcgccaccggcggcatccgcctgatgaccgacggcggtcctgaacttctcgcccaggcggatacgattgtggtccccggctggcgcggcgtcgacgccccggtccccgaggcgctgtgcgccgcgctggcttccgcccacgcccgcggatgtcggattatttctatctgttccggggtgttcgttctcgccgccgccgggctgctcaatggccgccaggcgacaacccactggcgttacaccgcggcgctgcagtcccgttttccgcagatccaggtggtggaggacgtcctttacgtgggcgatactttgctgatgacttccgccggcagcgcggcggggatcgacctttgtctgcatctggtgcgtgaagatttcggcagcgaagccgccaacgtcgtcgcccgccgcctggtcgtctctccccatcgcgacggcggtcaggcgcagcaggtcctgcgcccggtagcccgcagccgggagagcctgcgcctcggtcagctgtttgactatctgcaccagcatcttgccgccagccataccgtcgcttccctcgcccagcgcgccggcatggggacgcgcacctttttgcgccgctttgaggaggccaccggtaaaacgcccgcccgctggctgctggaggaacgactgctgcgcgcccgccagcacctgacggagagcacgatgggcatcgatcagatcgctgagcgctgcgggtttgccagcgccggcaccctgcgccaccattttcgccagcacttcgcgctcagcccgctgcagtaccgtaaacagtttacgccttctccgattgcaaaatcgtcgcagccacggacaatagacggccacagtaaaccggtcgccaggagggtcgatgatgaagaaagagtgtcgggtagtgatctataa

SEQ ID NO: 2270 - DNA, 936 bp, Klebsiella pneumoniae
catcatcttactatggaaaaaaatggtctcttcagtcagcgcattcgcttgcgccatctacacaccttcgtggccgtcgctcaacagggaacgctggggcgcgcggctgaaacattaaatctgagccagccagcactctcgaaaacgcttaacgagctagaacagctgaccggtacccggctgttcgagcggggtcgtcttggggcgcagctaaccctggtcggcgaacagtttctgacgcatgccgttaaggtgcttgacgcccttaattcggccggccaggcgctgaaccgcaaagagggcctgaataacgacatcgtgcgcatcggcgcgctgcccaccgccgcgctggggatcctgccgacggtgatcggccagtttcacaagcagcaaaaagatatcacgctgcaggtcgccactatgaacaacaccatgctgctcgccggcttaaaatccggggagatcgacatcggcattggacgtatgtccgacccggagctgatgagcgggctgcattacgaactgttgttccttgaatccctgaagctggtggttcgcccgggacatcccctgcttcaggagacagtgacccttagtcgggtgatggagtggccggtggtggtctcacctaaaggcaccgtgccgcggcaaaacgccgaagcgctgctccagagccagggctgtaagatgcccgccggctgcatcgagaccctttccgcctccctgtcgcgccagctgacggtggattttgactatgtctggtttgtcccttccggggcggtaaaagacgatcttcgccgtggcgtgctaaccgccctgccgatcgccacccagggcgccggagagcccatcggcattttaacccgcgtcgatgcgacactgaccccgggtacgcagacgctgctcagcgctatccgtaagtccatgcctgcctga

SEQ ID NO: 2271 - DNA, 672 bp, Klebsiella pneumoniae
tcgattactacacgcgcccgcgcgtatatggccaccgttgagagagcaatgatgttaaaaacgatgcgtaaacacggcgtcacgctggcgctgtttgccgccggttccaccgggctgacggcggcgatcaatgagctgaccaaaagcaccatcgaccagcaggcggccatgcagcaaaaggcgttattcgaccaggttttacctgccgaccgctataataacgatctgcttaagagctgctatctggtcagcgccccggcgctgggcaaaggccagcataaagtgtggatcgccaaaaataacgatcgaccgatcggcgcggtgatggaagccaccgcgccggacggctactccggagcaatacagctgctggttgccgccgattttagcggcacggtcctcggcacccgcgtaactgagcatcatgaaacgccgggcctgggtgataaaatcgaacttcgcctgtcggactggattacccattttgccgggaaagtcatccacggccagggcgatagccactgggcggtcaaaaaggatggcggcgattttgaccagttcaccggcgccaccatcaccccccgggcggtggtcaatgccgttaagcgcgcagggttatatgcacaaacgctgcctgcgcaacttcctgaattcaccgcctgtggagaataa

SEQ ID NO: 2272 - DNA, 558 bp, Klebsiella pneumoniae
tattgtactactatagtgtacgaaaaattgaggtttgctatgtccattcgccctgccattaaagacgactgcgcggcgatcgccgagatctataaccatgccgtcgtccataccgccgccatctggaatgataaaactgtggataccgacaaccgcatcgcctggtttgaagcccgccagctggctggatttccggtactggtgagcgaggaagacggcgtcattaccggttattcctcgtttggcgactggcgggcgtttgacggctttcgccataccgtggagcattcggtgtacgttcatcccgaacatcaggggaaagggctgggccgcaagctgctggtcgccttgatcgccgaagcgcgacggctgaataaacatgtgatggtcgccggcatcgagtcgcagaatcacgcttcgctgcatctgcatgaaacgctgggctttatcaccaccgggcagatgccgcaggtgggcaccaaatttggccgctggctggatctgacctttatgcagctgcagctggatgcgcgtcaggacccggacggcaaagcatga

SEQ ID NO: 2273 - DNA, 717 bp, Klebsiella pneumoniae
tttaccactacatcggtatcgggccgaacaaggaagttgacgacgacgaggagaagcatgatgagtaaatcgaagatgattgtgcgcacgacgtttatcgatcgcgcctgtcactggacggtggttatctgtttcttcctcgtggcgctgtcgggaatatcgttcttctttccgacgctacagtggctaacggaaaccttcggcacgccgcagatggggcgtattctgcacccgttctttggggtgctgatttttgtcgcgctgatgtttatgttcgtgcgctttgtccaccacaacatccctgataaacaggatattccgtggctgaaaggcatcgtcgaggtgctgaaaggcaacgagcataaggtggcgcgcgtcggtaagtataacgccgggcagaagatgatgttctggaccatcatgagcatgatatttgtgctgctggtgaccggggtgattatctggcgcccatattttgcggaatatttcccgatgcaggtgattcgctatagcctgctgattcatgcgacgtcggccatcattctgatccacgccatccttatccatatgtatatggcgttctgggtgaaggggtcgattaagggaatgattgaaggcaaggtgagccgccgctgggcgaagaaacaccacccgcgctggtatcgcgatgtcgaacgcctggaggcgatgaaagagagtcgtgaagggatgaagtaa

SEQ ID NO: 2274 - DNA, 1278 bp, Klebsiella pneumoniae
ttcgtggagtttaacatgcttcattttcttatttatgatgtgctaggaacaccggcgatactggttggtttattttcactgatcggtctgctgttgcaaaaaaaaggaatttcagacgttatttcaggcacgctgaaaaccatcatgggttttgtcatattgaccgccggcgccggtattatagcctatacgttaaccatctttagccagttatttgaacattctttccatattcagggcgtggtgcccaacactgatgccatggccgctctggcgcagaagaattacggcacggaaaccgccaccattatggtattgggcatgctgatcaatatcgccctggcgcgtctaacgccattaaagtacatctttctgaccggacatcatacgctttatatggctgcgatgctggcggttatcctgtctgtagggggcttgtcagggggatgggtggtggccatcggggcggttattctcggtgcgatgatggtcatctccccggctatcttgcagccgtttacctgtaaaataaccaacaccgacgatctggcgctcgggcattttggatctattggctacctgctgtccgcgctggtgggcaaaattattggtaaaggtagtccctcgattgaagagatcaaagtacctaagtcgctcaatttccttcgcgactcatcggtggccatctctctcaccatgatgattctgtttctggtgctggtgctcgttgcgggcaaatcctttgtcgaggagaccctgagcgctggtcagaactttattatcttcgccattattcagtccctcacgtttgctgcgggggtttatatcatcctcgccggtgtgcgtatggtgattgccgaaattgtgccagcgtttaaaggtattgcagacaaattagtgaaagatgcgaagccggcgctggactgtccgacggtgtttcccttcgctccgaatgccgtcatcgtcggcttcctcgcaagctttgtcgcagggctggtcagtatgttcctctgcccgctgttcggcttgagcgtcatcgtcccgggcctggttccccactttttctgcggggccacggcgggggtttacggcaacattaccggcggacgtcgcggggcggtggtaggggcttttgctcacggtctgctcatttcgttcctgcctgccattctcttgcccatgatgggggatatgggactgggctccacaacctttggagacgcagactttggcgttgtcggcatcgtgctgggtcatatcatcgcaatgtttaactaa

SEQ ID NO: 2275 - DNA, 1053 bp, Klebsiella pneumoniae
caagaggagtttgctatgacagatcaaccgcaacgccatcgccgctgggtactggcttcccgcccccatggtgaaccgacggcagagaatttccgcctggaagagagcgaagtgccgacgccaggcccgggtcaagtgctgctgcgtaccgtttatttatcgctcgacccgtatatgcgtgggcgcatgagcgacgcgccttcttattcgccaccggtggccattggcgcggtgatggtaggaggcaccgtgagtcgcgtggtcagctcaaatcatgccgattatcaacccggcgactgggtactgggctacagcggctggcaggattatgaactctccgacggcagcggactggtgaagctgggtgacaatccgcaacacccgtcctggtcgctgggagttctggggatgcccggcttcaccgcctacatgggtttgctggacatcggccagccaaaggcgggcgaaacgctggtggtcgccgcggcgaccgggccggttggcgccacggttggacagatcggcaaaattaagggctgccgcaccgtcggcatcgctggcggcgcggaaaaatgccgctatgcggttgagacgttaggctttgatctctgccttgaccatcgtgcggatgattttgccgaacagctggcccaggcctgcccgcagggtattgacgtttattatgaaaacgtcggcggcaaggtttttgacgcggtgctgccgctgttgaataccgcagcgcgggtacccgtctgcgggctggtgagcggctataacgccaccgggctgccggacgggccagatcgtctgccgctgctgatggcgaccatcctcaaaaagcgcatccggatgcagggctttattatcggccaggattacgggcatcggatcgccgaattccagcagcagatggggcgctgggtgcaggaggggaaaattaaatatcgcgaacagcttatcgacggtctggaccaggcgccgcaggcgctgatcggcctgttaaaaggtgagaacttcggtaaggtagtgatccgcgtcgcggcggacgactag

SEQ ID NO: 2276 - DNA, 819 bp, Klebsiella pneumoniae
attaacaatacatttacacacactgcttctggcgacattacaacaatatgcccctctaccgtctacacggagtaccctatgaacgacaaatggtccccacgtgaggttgtccatcgcgattacagtagccacccgcccgcttacgcgccgggctataaaaccagcgtcctgcgctcgccaaaaaacgccctcatctctctgcagaactcgctgtcagagatcaccggcccggtatttagccgcgacgacctcggccctctggataatgacctaatcctgaactatgccaaagaaggcctgccgatcggcgagcgaatcatcgtccacggttacgtgcgcgatggattcggccgaccgatgaaaaatacgctggtggaagtctggcaagccaatgcaggcggtcgctaccggcataaaaaagatcagtatctggcgccgattgacccgaactttggcggttgcggccgggtgcttaccgatgaaaacggctattactgttttcgcaccatcaaacccggcccctacccctggcgcaaccaggccagcgactggcgtccggcgcatatccatttttctctctcgggcgacgcctgggcccagcgcctgatcacccagatgtattttgaaggcgacccgctgattaagcagtgcccgatcgtcaggactattaataatgacgacgccgtgcgcacgctgatcgccgagctggacatgcacgccgccgtaccgctggattgtctggcctaccgcttcgaccttgttctgcgcggccaccgcgccacgctgtttgaaaatcgcactcagggggccgcccgatga

SEQ ID NO: 2277 - DNA, 1458 bp, Klebsiella pneumoniae
gcgttattcactatccccttgtattcagctgttgaccttatttatttactcctttccgggcaagtagagggcaatatgtcggcgcagaatgataaagataatcattaccttttgaacaactggcggcctgaaaacaaggcgttctgggaaaataaaggccaagccattgcgcgaagaaatctatggatatcagtggcctgcctgctgcttgctttctgcgtatggatgttattcagcgccgtagcggtgaatctcaataaggtcggttttcatttcaccaccgaccagctttttttattaaccgccctgccttcactttccggcgcgatattacgggtcccctactcctttatggtacccctttttggcgggcgctactggaccgtattaagtaccgttatcctgatcgtgccttgtatttggttaggggtggcaatccagaatattactactccgttctgggtatttattattattgcgctgctgtgcggttttgccggagcgaattttgcttccagcatgggaaatatcagtttctttttccccaaagcgaaacagggcagcgcgctgggagtcaacggcggccttggcaatctgggcgtaagcgtgatgcagatggtcgccccggcggtcatcttcctgccgctcttcacctttctcggcgtccatggcgtcacccagcccgatggttcgacaatcaccctgagtaatgcggcgctcgtctgggtaccgctgctgctgctcgccaccgtcgcggcatggttcggcatgaacgatatcgccggttcaaaggcctcgattcgcgatcagcttcccgtgctcaagcgaccgcatatgtggctgttaagcctgctctatctggcgacgtttggctcgttcatcggcttttccgccggctttgccatgctggcgaaaacccagtttcccgcggtcgatatcctcaagctcgccttctttggaccgttcatcggcgcgctggcgcgctcgttcggcgggatcatctccgaccgtctcggcggcgtgcgggtgacgctggttaacttcgtcctgatggcgctgtttaccggcctgctgtttctgaccctgccaggcagcggctccggcagctttctcgctttctacgtggtgtttatggggctctttttaaccgccggtctgggaagcggctccaccttccagatgatcgccgtcatcttccgccagctcaccatcgacagcgtaaaacagcgcggcggcagcgatgaagaagcgcagcacgaggcggtcaccgataccgctgccgcgctgggctttatctcggcgatcggcgccatcggcggcttctttattccgaaagccttcggcacctcgctggcgatgaccggctcaccggttggcgcgatgaaagtcttttttgtcttctatgtggtttgcgtgctggtgacctggctggtctacggccgccgtaaacccgcttaa

SEQ ID NO: 2278 - DNA, 1233 bp, Klebsiella pneumoniae
ccgtcattcaccagcgcgagcccgacctcccctcggcgcggaaagtggcatggctcagcgaccgcacccggcctttcgccctggtgctggtgcaaagtgacgatccggccgatacgccgctgggaccgttcggccatctcggcgtcgcctgcgccacccaggccgagatcgatgagaaagtggccctcgcacggcgggaaggtgttttacgccgggagccggagcagctgggcgatccggtgggctatttcgctttctttgccgacccggacggtaacaccctggagctgtcgtgggggcagcgggtgggactggaagtcatcctggcgggaaaacccggcgaataattttccaccgcctcgccgggggaggattacacttcaaagggatacctcggcaacacggagcatggcgatgggcaacaagaaaagcggtaatccggtcgacacggcggcaaaaatcgcgccgctcgacaacaaagcgtacgagaaagcgctgcgcaaactccacgttgagctggtgaaactgcagcgctgggtagtgcacaaaggactgaaagtgtgcattgtctttgaaggccgggacggcgccgggaaaggcggcaccattaaggccatcaccgagcgcgtcagcccgcgtatctttcgggtcgtcgccttaccctcgcccaccgagcgcgaaaaaagccagctctactttcagcgctatatcaagcatctcccggcggccggcgaaatcgtgattttcgatcgcagctggtataaccgcgccggcgtcgaacgggtgatgggcttttgtacgccggaggaggtgcagaagttcctcgacggcgcgccgatggtggagcgcggcatggtcgaatcgggcattattctgctcaagtactggctggaggtctctccgcaggagcaggagcgccgtctgcgggatcgcatcgacgacgggcgtaaaatctggaagctctcgccgatggacattaagtctttcaaccgctgggatgaatatactgctgcccgcgacgccatgttcgccgccaccgataccgcctgggcgccgtggttcgtcgcccgctcggaggataaaaagcgcgtgcgtctgaatatcatcacccatctgctgtcgcagatcccctatgaagctttaccggtggagcctgtgacgctgccgaagcgaaaaattggcaaaatgaaacagactaattttcctttccgcttcattccagagaagttttga

SEQ ID NO: 2279 - DNA, 234 bp, Klebsiella pneumoniae
tgcataaacaccacgcggtcgcccacttcgcgggcaaaattcatttcatgggtgacgaggatcagcgtcataccttccgccgccagttgctccagcaccttcagcacttcacccaccagttccgggtcgagcgccgaggtgatttcgtcacagagtaaaactttcggcgacatggccagcgcccgggcaatagccacgcgctgctgttggccgccggagagattggctggatag

SEQ ID NO: 2280 - DNA, 1143 bp, Klebsiella pneumoniae
gatgcgcgcacttttattgctgtggagaggctgttgatgcgtaaagccttctggctattattcgcgctggcactgccggcgctggcgcaggatccggtgctacccgccgtgacggcgatccatacggcgcccaccctcggtgagctgccgccgccggagtcgctgcgaccgtgctgcgcttttggttacgacctgcacgtgcgcgcggcgggcattccgatcccgatgtaccagatcggtaatgtgttgactctgggtacgctgggtaagcaccattacaacgacagcgcgttcggtgcggtgaaaaatctgctggggctcagcgaggagcagaacgggcttatctatacccgccgcggcgggtttattgatatcgcccatgtgcgcgatacggcggacaacaccttttatctgttcaatcgtattgcgccgacgctgggccaggcggggcggatcttctacagtgaagaactgggcgtgcgccgcgtgcagctgaatgcctttacgccgccggcgggcgtcaggcagcgctatcagctggcggcctggctcgccgggcatctggccttcgaaatcgcccagtggcatgagatcgcccagtggtatggcttccagtcggtccccgggttttccgaagagatttccgctttttcgcccgaggatctctactccaatttactgggcgcgaggctggcgattaatgtcatcctcagcggccacggcggttcgctggaggattataaccaggccatggatgcggcgctgaaacaagtgctgacccggctgctggtggcgacgcgcggagagacggaagcgatgtttcagcagatcgacggcgactggtggaacagtcaccggcgggtgccggataagtttctggtactgaagcgtaactacgatctacaggaaaaccggctgccgacgccggtcccattcgaaaccatgccgccgtatcgcctgaccatgccggagcaggtcgggggattccgcttacgcgacctcggcgaactgcagatctatccagggcacgatatgcaggcgctgccggttcccgcgcaatactatggcgccggagcgttccaggggctggcggatcgcgcccatgaggcggataaaacccagctggcgcggacagaaaaatag

SEQ ID NO: 2281 - DNA, 198 bp, Klebsiella pneumoniae
ggctggcggtttacccgcttagtagcgaaaaaacgctactgtcccgactattttttgctttatgagctgggcatttattgtatggactctcgcagagagacattcttcctggtagaaagcctggctactacacacgggaagccttaccgccccatattaagctcatgccgcggtactggcccggactttgagcactga

SEQ ID NO: 2282 - DNA, 243 bp, Klebsiella pneumoniae
atgtgcggcaccagggcggtgcaaatgaattatcgcggtgcgctttgcctgctaactggcgtaggagacatcgtatatcctggactggcgctagacggacttcagtgcaaagccgcccgggcgggtcgaggctacgaaatcaccgcctggggcggctggcaagataaacgggaaatgaggctggcggtttacccgcttagtagcgaaaaaacgctactgtcccgactattttttgctttatga

SEQ ID NO: 2283 - DNA, 207 bp, Klebsiella pneumoniae
agtcggttaacttcatccaaagtaaaaatgccggtgcatgatccgtcatcagaatcctttgattgggaaactatctttgaaagcagtgatcgctgtggtaagactgtagcgcggacatgtctatttggtcagagacggacatctcaatttagctactacaacatgtgtcaaggctcaattgaaatgtccgttatccagctcaattaa

SEQ ID NO: 2284 - DNA, 1089 bp, Klebsiella pneumoniae
cggttactaaccaggcggggacaaagaggtcacgttattgccggaagactcggagtggcgagtcgggtatcgaatggaagtctggttctgaatcattactacatcactacaggatattaccctatgaacaaacacgtcgctgctatgctgacgatgcttattattccgtctgcttttgcgcaaacacctttaacagacagcaaaactatcgttattaaacctagcgctctggccgtcgagatggtgcctgatattgcctattcatttacgcaaaatatcatgggacgaccgctccagttaacgatggatttgctcaagccttatgctgataaaccgttacccgcagtagtatttattaccggcggcggctttctcgatgcgcccaaatcaaaatttatcggtcagcgggtcgatattgcccgggccggttacgtcgtcgccagcattacctatcgggtcgtacccaatgtgactttcccgggcatggttgaagatgcgaaaacggcggtcagatttttacgcgccaatgctgaaaaattaggcatcgatcccaaccatatcgctgtgatgggcgagtcggcgggtgggtatttagccgccatggtgggtaccaccagcggccataaggaattcgaccagggagagtattcaaatcaaagcagcgatgtgcaggcggtggttgatctctatggcctgtccgatctgacgaaagtcggggctgacttttctgcggacattcaaaaagcgcatcagtcaccggccataccagaggcgatgctggttaatggtattccctggcaaggcggtggcgcgatctccgcctatcccgaaaaggcgaaacgggctaatcccatcacctggatttcgaataaaacgccgccttttctgctaatgaacggcgatgccgacaatgtggtttcacccagccagtcaacgcttttacacgaggcgctggtagcgaaaaaaataccgtccacccattacgtggtgaaaggggcggatcacgcaggtttgatgtggtatcagcctgaagtatcaaaaattattattaattttttagaccaaaatctcaaagataagcatcaataa

SEQ ID NO: 2285 - DNA, 1200 bp, Klebsiella pneumoniae
agatcaccaactgtttgctggcgccttccgccagcgagatgggcgaaccgcaggaagagaaaggctgcattcgctgcagcgcctgcgctgacgcctgcccggccgatctgctgccgcagcagctgtactggttcagcaaaggtcagcagcacgataaagccactgcccataatctggcggactgcatcgagtgcggtgcctgcgcgtgggtatgtccaagtaatattccgctggtgcagtacttccgtcaggaaaatgccgagatcgcggcgattcgtcaggaagagcagcgcgctgcggaagacaaagcccgattcgaggcccgacaggcgcgcctgggatcgtgagaaagccgcgcgcgccgaacggcataaaaaagccgccgttcagcctgccgccaaagatcaggaggcgattagcgccgccctggcccgggtacgggataaacagcgcgatgccgcgcagccgatcgtgatccaagccggcgccaaacctgacaacagcgaggcgattgccgcccgcgaagcgcgtaaggctgaggcccgggcgcgcaaagcgcagcagcaggccgcgccggtggacgccccggccgccgaaccggtcgatccgcgcaaggcggcggtggaagccgctatcgcccgcgccaaagcgcgtaaagccgaacagcaggccgcgccgatggaagccccggccgccgaaccggtcgacccgcgcaaggcggcggtggaagccgctatcgcccgcgccaaagcgcgtaaagccgaacagcaggccgcgccggtggacgccccggccgccgaaccggtcgatccgcgcaaggcggcggtggaagccgctatcgcccgcgctaaagcgcgtaaagccgaacagcaggccgcgccggtggaagctccggccgtcgaaccggtcgacccgcgcaaggcggcggtggaagccgctatcgcccgcgccaaagcgcgtaaagccgaacagcaggccgcgccggtggaagccccggccgtcgaaccggtcgacccgcgcaaggcggcggtggaagccgccatcgcccgcgccaaagcgcgtaaagccgaacagcaggccacacaacaggatctcgcgtcagccgcagccaatgacgacccgcgcaaagcggccgtcgccgcggctatcgcccgcgttcaggcgcgtaaagcaacacagcaggcagttaacgaggaataa

SEQ ID NO: 2286 - DNA, 2460 bp, Klebsiella pneumoniae
cacggaccaacggtagcaagtcttgctccaacatttggtcgcggtgcgatgaccaaccactgggtggatatcaaaaacgccaacgtcgtggtggtgatgggcggtaacgccgccgaagcccatccggtgggtttccgctgggcgatggaagcgaaaaacaataacgacgccacgctgatcgtcgtcgacccgcgctttacgcgcaccgcgtcggtggccgatatctatgcgccgattcgttccggtaccgacattaccttcctgtcgggcgtgctgctgtacctgatcgaaaacaataagatcaatgccgagtacgttaagcattacaccaatgccagcctgctggtgcgggatgattttgccttcgaagaggggctgttcagcggctacgatgcggaaaaacgccagtacgataaatcgtcctggaactaccagttcgatgaaaacggctacgccaaacgcgatgaaacgctcacccacccgcgctgcgtgtggaatctgctgaagcagcacgtttcccgttacacgcccgaggtggtcgaaaacatctgcggtacgccgaaagcggacttccttaaagtgtgcgacgtgctggcctcaaccagcgccgcggaccgcaccaccaccttcctgtatgccctgggctggacgcagcacaccgtcggcgcgcagaacatccgcaccatggcgatgatccagctgctgctcggcaatatggggatggccggcggcggcgtcaacgccctgcgcggccactctaatattcaggggctgaccgatttgggcctgctgtcgaccagtctgccgggctatttgacgctgccatcggacaaacagaccgatctgcaaagctacctcagcgccaacacgccgaaggcgaccctgcccgagcaggtgaactactggagcaactacccgaaattcttcgttagcctgatgaaatccttctacggcgaggcggcgcaaaaagagaacgactggggctttgagtggttaccgaagtgggaccaggcttacgacgttatcaaatacttcaacatgatggataacggcaacgtcaccggctatatctgccagggctttaacccggttgcctccttcccggacaaaaacaaagtggttcgcagcctcagcaagctgaaatatatggtggttatcgacccgctggtgaccgaaacctcgaccttctggcagaaccacggtgagtctaatgatgtcgacccgtcggcgattcagaccgaagtcttccgtctgccgtcgacctgctttgccgaagaggacggttcgatcgccaactccggccgctggctgcagtggcactggaaaggtcaggatgccccaggtgaagcgcgcaatgatggcgaaatccttgccgggatttaccatcgcctgcgcgaactgtaccgcaccgaaggcgggaagggcgcggaacccctgctgaagatgagctggcgctacaagcagccggaccatccggaatcggaagaagtggcaaaagagaacaacggctacgcgctggcggatctctacgatcaaaatggcactctgctggcgaaaaaaggccaactgctcaatagcttcgcgctgctgcgcgatgacggcagcaccgcgtcgtcttgctggatctataccggcagctggaccgagcagggtaaccagatggcgaatcgtgataacgccgatccttcgggcctgggtaatacgctgggatgggcctgggcgtggccgctcaatcgtcgggtgctgtacaaccgcgcttcggccgatatcaacggcaagccctgggatgcgaagcggatgctgatccagtggaacggcagcaagtgggtcgggaatgatatcccagacttcaataccgcgccgccagggagcaacaccgggccgtttatcatgcagcaggaggggctgggtcgcctgtttgcgctcgataaactggcggaagggccgttcccggagcactacgagccgatggaaaccccgcttggcactaacccgctgcacccgaaggtggtctccagcccggtggtgcggttgtatgaagaggacgccattcgcttaggtaagaaggataaattcccgtatgtcgggaccacctatcgtctgaccgagcatttccacacctggaccaagcatgcgttgctcaattccatcgcgcagccggaacagtttgtcgaaatcagcgaagggctggcgaaaagcaaaggtatcgctaacggcgattgggtgaaagtcagcagcaagcgcggcttcattcgcgcggttgccgtggtgacccgccgactgcgcacgctgaacgtcaacggccagcaggtggagaccgtcgggatcccgctgcactggggttttgaaggcgtggcccgtaaaggctacatcgccaacaccctgacgcctaacgttggcgattccaactcgcaaacgccggaatacaaggcgttcctggtcaacatcgagaaagcgtaa

SEQ ID NO: 2287 - DNA, 540 bp, Klebsiella pneumoniae
acaggaacaacagcgttacgaccagtccattacccagcgcgtggaggtggcctgatgcttaacctcgaacaggttcgccagtttctttactacgaagcccgtctgctggacgatcgtcagtgggacgaatggctcagctgctacagcccgcaggtggtctactggatgccggcgtggggcgacgatgaccagctgacccgcgacccgcaaaaagagatttcgcttatctactaccccaaccgcgaagggctggaggatcgcgtctaccgcattaaaaccgagcgctccggggccagcacgccagagccgcgcaccacccatatcatcagcaacgttgagctgatgggcgaaagcgatgaggggcttgaggtgcgttacagctgggttacgtggagccatcgctatcagcacacggatgcctattatggctctacctgctgcacgctaattgagcaggacggcaggccgcagatcgttcgtaaaacggtacgcctgaataacgactatatccgtcaggtgattgacgtttaccacatttaa

SEQ ID NO: 2288 - DNA, 258 bp, Klebsiella pneumoniae
caggcggcaaccggatgtcatctgcctcatcaccgtctgcaggtcgggcgctccgggggcattcagccgctggtgcagttcgcggaagaagtgatgaaaatggacccgccgcctggcggcgagcggcaggctggcgaaaaagtggtcgaggataaagcttttccctcgcccggtacgtccccagacgtacatcccctgcggcctgcctgtcgtggacaccaactgctgaccgagggcgtcaaggcgggcgatgagtga

SEQ ID NO: 2289 - DNA, 579 bp, Klebsiella pneumoniae
atcagcaaaacgccgggttattcttatttgtcgcttctttactcgcctttatcggccctcactcaaggatgtattgtggttatgcgttatattcgcctgtgtattatctccctgttagccaccctgccgctggcggtacacgccagcccgcagccgcttgagcaaattaaactaagcgaaagccagctgtcgggccgcgtaggcatgatagaaatggatctggccagcggccgcacgctgaccgcctggcgcgccgatgaacgctttcccatgatgagcacctttaaagtagtgctctgcggcgcagtgctggcgcgggtggatgccggtgacgaacagctggagcgaaagatccactatcgccagcaggatctggtggactactcgccggtcagcgaaaaacaccttgccgacggcatgacggtcggcgaactctgcgccgccgccattaccatgagcgataacagcgccgccaatctgctgctggccaccgtcggcgggccccgcaggattgactggcctttttgcgccagatcggcgacaacgtcacccgccttgaccgctgggaaacggaactga

SEQ ID NO: 2290 - DNA, 2025 bp, Klebsiella pneumoniae
actggaagaactgaaatgacggacaggtccatgctgcaacgcctgcggcaaatcagtatcagtagcagtctgcgcggggcatttctaacgggggcgctgcttacgctgattgtcagcagcgtaagcctctattcctggcatgaacaaagttcgcagatccgctattcgctggatgagtattttccgcgcatccatgcggcttttctgattgaagggaatctcaacctggtggtcgatcagctcaatgaatttctgctggcgccaaataccacggtacgactgcagctgcgcaaccagattatccagcatctggacaaaatagaacggctaagtcaggggttgtcgccggcagaacgccagcagttgggggtgatattgcaggacagccgcgcgctgctggcggaactggatcgcgtgctctacaacatgtttctggttcgtgaaaaggtgggagagcttgcggcgcggatcgactggctgcacgatgatttcaccaccgagctgaattcgctggtgcaggattttacctggcaacagggaacgctgctcgatcagattgaagcccgacagggggatgcgaggcagtatctgaaacgcgcccgggaagtgcagaacgaacagcagcaggtctataccctggctcgtattgaaaatcagatcgttgacgacctgcgcgacaggctcaatgaactgaaatccgggaatgatgacggcatgctggtggagacgcatatccgctatcttgaaaacctgaaaaaaacggcggatgaaaatatccgtgcgctggatgactggccgagcaccattaccctgcgacaaacgattgatgagctgctggaaattggcatggtgaaaaataatatgccggataccatgcgcgactatgttagcgcgcaaaaagcgctcgtggaagccagccggtccagagaagcgacgctggggcgcttcagaacgctgctggaagcccagcttggcagcagtcaccagcagatgcagatgtttaatcagcgtatggcgcagattgtccgggtcagcggcgggttaatcctggtggcgaccttgctggcgctgctgctggcatgggggctaaaccattattttattcgctcgcggctggtgaaacgctttaccgcgctgaatcaggcggtggtgcagattggtctgggccggaccgaggcgaccattccggtttacgggcgcgacgagctgggacgtattgccggtttgcttcgtcataccctgggtcagcttaatgcgcaaaaacagcagctggaacaggagattggcgagcgaaaagcgattgaggccgatctgcgcgccacgcaggacgagctgatccagaccgctaaactggcggtggtgggacagacgatgaccaccctggcgcatgagattaatcagccgctgaacgcgctgtcgatgtatctttttacggcgggaagggcgatcgaacagggacaggcggagcaggcgcggacgacgttaagcaaagcagaagggctgatcaaccgcattgacgcgattatccgctccctgcgccagtttacccgccgcgcagaactggaaacgccgctgcatccggtcgatttgcgtcagacgtttaccgtggcgtgggaactgctggcgatgcgtcataagcctcagcaggggacgctggtgataccggatgacactgtctggatccagggggacgaagtgcgcgtccatcaggtgctggtgaacgtgctgtccaatgccctcgacgcctgcccgcacgccgcgcaaatcaccgtgagctggcaaatccagggcggaaggctgtgcgtgttgattgccgataacggccctggctggcctgcggccttactcccttcgctgttaaagccgttcactaccagtaaaaccgtggggctcggaatagggctttcgatatgtgtttcgctgatgacgcaaatggaaggggcgttgcgcctggcgtcgacctttacacgcagtgcctgcgtggtgctggaattcaatttgacggatgtaaaagatgttgagtaa

SEQ ID NO: 2291 - DNA, 987 bp, Klebsiella pneumoniae
ttctggagaacggcggcggggatggggtggtggccggaccgacggcgcgcgccatcctggaccatatttttgtcccgcagcaggcatcttcggcggcagccgatgtgccgcagcgtgacagcgccgatgcccagtaagcgacaggacttattccgcaggcgcatcgtccatagtaattggttatttgtcccatcgtcttcccggcggcatagtgttttacgggaacatgacccggagcgaggaggaaaggtgacacgtaaccgattactgctggtccagaccggcacgccgccgacggccattcgccaggcgcatggcgatctgccgcgctggtttcgcacgctgctggcgccgtggcagacgcagctcaccacggtgcgggtgtttgaagatgaaccgctgccgacgccggataaccagaccatagcggtgctaaccggctcgtgggcgatggtaaccgatcgtctggcgtggagcgaacggaccgccgactggatccggcaggcggtggctatcgacatgccgctgttcggcgtttgttatggtcatcagctgatggcccatgccctggggggcgaggtggcgtatcatcctggcgggcgggaaagcggcagccaaaccattacgctgtcgccatggggtgtcgatgatccgctgctgagcggcctgccggctacatttcctgcgcatctgagccatttgcaaaccgtgactcgtctgccggaaggggccacggtgctggccgcgtccgcccacgatccccaccagattgtgcgctatgggccgcacgcggtctctacgcaatttcacccggaatttaccgcgccgatagcccgttcgctgatccgccaccgggaggcggtgctgcaggcggaaggtattgacgcgcagcggttacacgacgaggtgcaggagagcccgcagggcgcggcgatccttacgcgcttcgtcagcgcctttctgaccccggatgcccccggccattaa

SEQ ID NO: 2292 - DNA, 738 bp, Klebsiella pneumoniae
ttgccgttgactggcgccactccatcgagacatctaaaagtgatttataaaaagattgccactgaactgaggacccgcatcaacagcgacgactatgccgtcggcgatatgctgcccagcgaaaaagcgctcgccgcggagctgaaggtctcggtgatgacgctgcgcaaagcgctggcgctactggaggaagaaaagctgatcgcgcggcggcacggcagcggaacctgcattgtgcgtaaaagtaactatcatggcggggaactggagggctttaattaccagatgcaggtggtgggcgtcaccaactaccgtaacaaagttattgaatttacgctgcttgatgccccgccagccattgcccagcagttaaagatccagccgggggagaaagtgtattacgtcagacggctgcggctgatcgatgaggtcccaatcctggtggaaaacagctatatccccttcgccaccttcccctggctcagcgtgggtaacctcgagcagtctaagttcaactatttcaaaaaagagtgccatatcaccatcatcgagagccaccgcagctataccccggtgctggcgacccgtgagcaggcggagctgctgcaggtggcgccaaacagcctcctgctgcgggtgcagtcgatcagctacgcccagaaccgggcgatcgtcgatttctcagagatctaccagaacaccagtaagtacaatgtgaagcacattacccgccgctag

SEQ ID NO: 2293 - DNA, 1272 bp, Klebsiella pneumoniae
atgcatgtgacaaatattagcgtttcacaagccacaatgcactccctacactctgcggcatcgtacctgtacaccaactatgagaacgttatgtcacaacccgggaaaggatttttagtctggctggccggcctgagcgtgctgggctttctggccaccgatatgtacctgccggcgtttgccgccatgcagcaggatctcaacacctccgccgcctccatcagcgccagtctgagcctgttcctcgccggcttcgcgctgggccagctgttctggggaccgctgtcggaccgctatggacgtaaaccggtgctgctgagcggcctggcgattttcgcggccggctgtctggggatgctgtgggtgcacaacgccaccctgatgctggcgctgcgctttctgcaggcgattggcgtctgtgccgcggccgttacctggcaggcgatggtcgccgattactatcctgcccagcgcacgaaccgcatcttcgccaccattatgccgctggtaggactgtcgccggcgctggccccgctgctgggcagctggctgctggtgcacttcgagtggcaagccatcttcgccaccctgttcgccatcactctgctgctgatgctgcctgccctgcgcctgaaggcagccgcgaagtcagtagtagtgacgcagcaaaagatcacctttctcgcgctgctgcgctcccgggaatacagcggcaacgtcctgatctacgccgcctgttccgccagcttcttcgcctggcttaccggttcaccttttatcctgcatgaaatgggctatggcccaaccgctatcggcctgagctatattccgcagactatcgcctttctggtgggaggctatggctgtcgcgcgctgctgcagaaatggtccggtcaacagatgctgccgtggctgctggtgatttttgccgtcagcgtagccgccacctggctggtgggcctgcaaacccatgcctcgctggtggcgttaatgatcccgttctgcatgatggcggtggtcaacggcgggatctaccccatcgtggttgctcaggcgttgaagccttttccgcaggcgaccggccgcgcggcggcgctgcaaaataccctgcagcttggcctgtgcttcctgaccagtctgctggtatccgcgctgatcgccacgccgctgctgaccaccaccagcgtaatgctggtttcgattggcttagccggaataggctatcgcctgcagcagacgccggagctgacaccccactcttcccacgcgtaa

SEQ ID NO: 2294 - DNA, 1035 bp, Klebsiella pneumoniae
tcattaccgaccgccgcgatatcgttaaacggcaaggcaatggcttttatattgttaagcataaactcagtttgtcagtttattcttcccgctcacaaagggagagaaataatgacacaacataattttgaaaatgataataaatatcatgagcgttcggtgcaggcgcgaaagagtacccttgttagcgtggtggttaatattttcctttctgccttacaggtagtcgtgggaatattttccggctctcagggattaattgccgacggaatgcactctttttccgatctggtcgccgatggcgtggtattgatggcgaataaaaagagccgtcgaccgtctgaccacgatcaccagtatggccactggcgctatgagaacggcgcctccctaatcatcggcgcgatgctgctgctcgtcgggggtggcatgctatggtccgcggcgggccatctcgcgcaaccgcaaactattccgccggtgcacagcgcggcgctgtggatggcgctggtggcgctggccgccaaggaggggctgtttcgctatatgctggcggccgccaggcggctgaattcgtcactgcttatcgccaatgcctggcatgcccgctctgacgccgcatcctccctggtggtggccctggggattatcggtaatctggccgggttcgcctggttcgacccgctcgccgcgctggcggtggggctgctgattgcgcgcatgggctatcgtttcgccgccagcgcgctgcatgatttaatggaccgtgcggttgatgaagagatgcagcaggcgattgccgatacgctgcgagcaacgccgggcgtggcgggcctccacgatctgaaaacccgtaaggcgggggatctggtgctggtggatgtccatctcgaggtggctggcgagatgtcggtagccgaaggacatcagattgcccgtcacgcgcgggagcgagtgctggcgcagcatccggtgcttaatgtgatggtgcatctcgatccctgcgaagcgcaggggttgaagaaagcggtctga

SEQ ID NO: 2295 - DNA, 1599 bp, Klebsiella pneumoniae
actataccgacaggcggaggagcgcagcaaacgacgttgcggtctgctgtaaaatcagtaccctgctggcatcagccttacagggagcaggttatgcaacatccgtcgaaaccgttggcgaaaacccgtcagggaacgctggccgggagcgcagaacaggggattcatatctggcgcggcattccgtacgccgcgccgcccgtgggcccgctgcgctggcgcgcgccgcagccagccgcccgctggcagggggtacgtccagccgagaccttttccgccgccagctggcaggacattgactactgccgcgagctcggcggcggcgatcctggcgccttcagcgaagactgcttatatctcaacgtctgggccccggccagcgcagcgcagccgctgccggtgatggtctggctgcacggcggcgggtttaccatcggcgccggcagcctgccgccttacgatggcaaagcgcttgccagccgcgacgtggtggtggtgacagttaactaccggctgggccatctcggttttttcgcccatccggcgctggaagaagaggcgggcgaacgtctctataatttcgcgttgctcgatcagattgccgctctgcagtgggttcaggagaatatccacgcctttggcggggatgccgccaacgtcacgctgtttggcgaatccgccggggcgcgcagcgtgctgtcgctaatggcctccccgaaagcgaaagggctgtttcataaagcgattattcagagcgggtatacgctacccgatctgccgcgggaaaaagcgctggaaaaagggcgcctgctggcggaacacttcgccttaccgcaagccagcgctgaggaattgcgggcgatcccggcggaggccttctggtcgctcaccgcgcctctgaataccgggccagcgcctattgtcggagacgcggtgctgccgcagccgatgctggagaccttctttgccggccgccagcatccgataccggtgatgatcggctccaatagcgatgaagccagcgtgatggccgtgttcggcgtcgatattgccgggcagatccagaagctgcgccgagagcgccgtctggggctggggctgatcaaactcctctatcccggcgtgaagggcgatgaagcgctggggcgggaagtatgccgcgacatggccttcaccacccttggttatgtagtgatgcaggcgcaacagcgcgtgggtcagccgtgctggcgctactggtttgattatgtcgcggaagcggagcatgacgcctacccgcatggggcctggcatggcaacgaggtgccctacgtgtttgataacctgcggttgaccgacccggtgcggcagtacgccagcgaagcggatctggccttcgccgctcaggtcgctgactactggacgcagtttgcacgcctcgccagcggcgagcagacgctttccggcgcagtgcgctggccggcgtgcctgcgcgggcgggatcgcctgttgcgcattggcttgcataagcgcgccgggtttaaagtggagaaccgctttatgcgcgccagactggcgctgtttcgccgggtgatgaagcatcacgtgacgctggaataa

SEQ ID NO: 2296 - DNA, 360 bp, Klebsiella pneumoniae
ggaagcacgacaatgagctcgactttagaaaagatccaacgccaaatcgctgaaaacccgatcctgttgtacatgaaagggtcgccgaagctgccaagctgcggtttctctgcccaggccgttcaggcgctgtccgcctgtggcgaacgttttgcttacgttgatattctgcagaacccggatatccgcgccgagctgcctaaatacgccaactggccgactttcccgcagctgtgggtagacggtgaactggtgggcggctgcgatatcgtcatcgaaatgtaccagcgcggtgaactgcagcagctgatcaaagagacggcggcaaagtaccataccgacgagccaaaagcggagtaa

SEQ ID NO: 2297 - DNA, 621 bp, Klebsiella pneumoniae
aaaaatcagacaaatggcggtatactttgcgcagtaaaaacaggaggaaggatgaatattgcgcaacatctggcggcaacgcttaaaaccctgcgccagcagcgaggctggagcctgtcgcgactggcggaagagaccggggtgtcgaaagccatgctcgggcagattgagcggaatgaatcaagtccaacggtggcgacgctgtggaagattgccaccgggctgaacgtaccgttttcggcgttcatcgtcccggacgccagcgccgcgccctccgcgtttgatccgcagcagcaggcgatggtggtgacgccagtattcccgtgggatcccgagctgcgctttgaccatttttcgataacccttgcccccggcgcgctgagcgaatcaacgccgcatgagaaaggggtgattgagcatgtggtagtgataagtggtacgctggatttgtgcttacaaggggagtggcactcgctgcaggcgggtgagggtaggcgtttcgccggcgacgcgacgcatgcgtatcgtaaccgcggcgcccaggcggcccatttccattctcttatccattatccaaaagaaaaaaccgcgagcgaacccgcggccagacaagatgactga

SEQ ID NO: 2298 - DNA, 306 bp, Klebsiella pneumoniae
acaaaatttgcgtcggcgcggggaaacgtcttcaatgaaaggagacgaggggacaggaggcgtgtggtggcagagcagttagaatttttcccggtgcagagcccgtgccggggaatatgtcagaccgatgagcgcggctactgtcgcggctgtttccgcagccgtgaggaacgttttaactggcaaacgatgagcgatgcgcagaaacaggaggttttgcgtctttgccgccaacggctgctgcgcaaaatacgtgcgaacaggccggagccggcggaagaaccgcagcaaccctcactgttttaa

SEQ ID NO: 2299 - DNA, 1791 bp, Klebsiella pneumoniae
agaccttctgctctatactctgcccgctgctttccacccgcccttcgcttatcgccgcgccgggactgtggtcatgatcaaggagttagtgcgatgcaatttacccataagaaaaaccgttccctgtacatcccctacgcgggtcccgttctgcttgaattccccctgctcaacaagggaagcgccttcagtatggaagagcgcagcaatttcaacctgctcggcctgctgccggaagtggttgaaactatcgaagagcaagcggaacgcgcctggatccagtatcagggattcaaaactgaaatcgacaaacatatttatctgcgtaacatccaggacaccaacgaaaccctgttttatcgcctgatcggcaaccaccttgaagagatgatgccggttatctataccccgacggtaggcgcggcctgcgaacggttctccgagatctatcgtcgcgcccgcggcgtctttatctcctaccagaatcgccataaccttgacgacatcctgcagaacgtcccgaaccacaacgtgaaagtgattgtggtcaccgatggcgagcgcattctcggcctcggcgaccaggggatcggcggaatggggatcccgatcggtaaactgtcgctgtacaccacctgcggcggcatcagcccggcttacaccctgcctatcgtgctggacgtcggaacaaacaaccagcagctgctcgacgatccgctgtatatgggctggcgccatccacgcattaccgacgacgagtactatcagttcgttgacgacgtgatccaggcgattaaggcccgttggccggacgtgctgctgcagtttgaagattttgcgcaaaagaacgccatgccgctgctcaaccgctaccgcaatgaaatctgctcgtttaacgacgatattcagggcaccgcggcggtgaccgtcgggacgctgatcgccgccagccgcggcgccggtagccagctgagcgagcaaaaaatcgtctttctcggcgcgggttcggccggctgcggtatcgctgaacagattatcgcccagatcgtccgcgaaggactcagtgaagaagaggcccgccagcgcgtgtttatggttgaccgcttcggcctgttaaccgacggcatgcataatctgctaccgttccagaacaagctggtgcaaaagcgtgagcagctgcagagctgggataccaccagcgaggcgctgtccctgctggacgtagtgcgcaacgtgaagccgaacatcctgatcggcgtctcgggtcagccgggactgttcacggaagagattatccgcgagatgcacaagcactgccggcggccgatcgtgatgccgctctccaatccaacctcacgggtggaagcgacgccgcagaatatcctgagctggaccgacggcgaggcgctggtcgccaccggcagtccattctccccggttaccgtgaaaggcaagcagtatcccatcgcccagtgcaataactcctatatcttcccgggtattggactgggggtgatcgcctccggcgcgtcgcgggtcacagacgagatgctgatggctgccagcgaaaccctggcgcagcactcgccgctggtcaacaacggcgaaggtccggtgctgccggagctgaaggatatccagaccgtctcacgggcgattgccttcgcggtcggcaaggtggcccaggagcaaggcgtggcggtgaaaacctccgccgaagcgctgctgcaagcgatcagcgataatttctggttaccggaatatcgcaattatcgccgcacctcgatttaa

SEQ ID NO: 2300 - DNA, 1038 bp, Klebsiella pneumoniae
aggttatctgcagaaggagtcccgctaatgggtatcgaattatcggtgatctggttcgtgattatcgtctttgccacgctgatgtacatcgtcatggatggctttgatctgggcatcggcctgctgttcagcacggtgcggggcggcggggatcgcgacgtaatggtcaacagcgtcgcgccggtatgggatggcaatgaaacctggctggtgctcggcggcgccggcctgtttggcgcctttcctctcgcctacgcggtgatcatcgacgccctgtcgatccccctgaccctgatgctgatcggcctgatttttcgcggcgtcgcctttgagtttcgcttccaggccacgccatcgcaccggccattctgggatcgcgccttttttggcggctccctgctggcaaccttcagccagggcgtggtggtcggggcggtgatcaacggtttcaccgtcagcggtcgcgccttcagcggcggcatgtttgactggctgaccccgttcagcctgttctgcggactcggactgtgcgtggcctatgcgctgctcggcgccacctggctggtgatgaaaagtgaaggcgcgctgcagcagagaatgcgcagcgcatcgcggcagttgctgggtgccctgctggcggtgtttgccgtcatcagcctgtggactccgctggcgcacccggcgattgctgcccgctggttcagcctgccgaatctctatttcctgctgccggtaccgctgctggtgatcctcgttagcggctggctgtggcgcacgctgcatcagcgcgaccgccatgtttcgcccttcacgctgacgctgggcctggtctttctcggcttcagcggactggggatcagcatctggccgcatattatcccgccggccatcacgctgtggcaggctgccgctcccccgcaaagccagggctttatgctggtgggcgccctgctgattattccggtcattcttggctacacctgctggagctattacgtgttccgcggcaaagttcagcctggggagggatatcactga

SEQ ID NO: 2301 - DNA, 555 bp, Klebsiella pneumoniae
cgtcgccctgcgtcaccaacgacacgaaaaccaggggaacgtgagggccagaggctgcaaaaagacgcagcttcggcatcacgcactatactttttgttcgacatcactacaggaggaatcaaatggcgattcataagaaagggctagcgcactgggaaggcgacctgaagcatggcaaaggcaccgtgtcgacagaaagcggggcgctgagccagcagccctacggatttaacacccgttttgagggggtgaagggcaccaaccctgaggagctgatcggcgctgcacatgccgcctgcttttcgatggccctgtcgctgatgctcagcgaagagggatataccgcaacgtccattgatactaccgcagtggtcaccctcaataaaaccgacggcggctttgcgattaccgatatcgcgctgcaaagccagatcgtcctgccggacgtgtctccggcggcgttcgatgagatcatccagaaagcgaaagcaggctgcccggtatcgcaggtgctgaaggccaacattaccctcgattaccagctgaatccgtaa

SEQ ID NO: 2302 - DNA, 1089 bp, Klebsiella pneumoniae
cctaccgctgcccgctgcagtgtccctactgttccaatccgctgggacttcgcccggcaggataaggaactgaccaccgaacaatggatcgaggtctttcgccaggcgcgggcgatgggcagcgttcagctgggcttttccggcggcgagccgttgacccgtaaagatctgccggagctgatccgcgccgcgcgcgacctcgggttctataccaacctgatcacctccgggatagggctgacggagagcaaactggacgccttcagcgaggccgggctggaccatatccagattagcttccaggccagcgatgaagtgctcaacgccgcgctggccggcaacaaaaaagccttccagcagaagctgaccatggccaaagccgtgaaagcgcgcgactacccgatggtgctcaacttcgttctccaccggcacaacatcgaccagctcgataaaattatcgagctgtgcattgagctggaagccgatgacgttgagctggccacctgccagttctacgggtgggcgtttcttaatcgcgaagggctgctgccgacccgggaacagatcgcccgcgccgagcaggtggtcgctgactaccggcagaaaatggccgccagcggcaacctcaccaacctgctgttcgtcaccccggactattacgaagagcggccgaaaggctgcatgggcggctggggatcgattttcctcagcgtcaccccggaaggcaccgccctgccttgccacagcgcgcgccagctgccggtggcgtttccgtcggtgctggagcagagtctggaatcgatctggtatgactcattcggcttcaatcgctaccgcgggtatgactggatgccggagccgtgccgctcctgtgatgaaaaagagaaggacttcggcggctgccgctgccaggcctttatgctgaccggcagcgccgataacgccgacccggtgtgcagcaaatccccgcatcatcacaaaatcctcgaggcccggcgcgaagcggcctgcagcgacataaaagtcagccagctgcagttccgcaaccgtacccgctcgcagctgatcttccaaacccgggacctgtaa

SEQ ID NO: 2303 - DNA, 1392 bp, Klebsiella pneumoniae
ctacacgctgcaggcgccggagacagtgcgcggtcgggtcgccttcggcgcccttccctggctgatgcacgatcgcccctttgtgcaggggctgacggccagcgccgagattggcagcgcaatggcccgcgccgtgtcgcagcaggccgccggccgacggcgccgtctctggtatatcgaatagcggagcgcttaagcgcaatatccgaatactgggggggtgaacaggcgtgctataaacagcaactgtccgtcccctgcacgaccacgtttaacatttacgaggtattcatgagtcatctttttagcgcgacgcgaattggtcaactcacccttgataaccgtatcgttatcgccccgatgtgtcagtactccgccgacgagggtaaggcgacctcctggcaccggatccatcttggccaactggctttctccggcgccggcctgttaattctggaagccacggcggtagagcctgcggggcgtatctccccgggggatctggggctgtgggatgatgaaaccgaaaacgccctgcgcggcgtagtcgaagatattcgggcctggtcgccgatccgtctggggatccagctgggtcatgccggacgcaaggcatcctgcgccgccccgtggctgggaggccatcagctggcgctcaacgatggtggctggcagaccgtcgccccttccgccgtggcgtttcacgatggcgatcgcgcccccgctgaactgagccatgccgatatggcgcgcatcaaagcggccttcgtcgccagcgcgctgcgcgcccagcggctgggctttgagctgattgaactgcacgccgcccacggctatctgctgcaccagtttctctcgccgctcagcaaccagcgccgcgacgagtacggcggttcgctggagaaccgaatgcgctatccgctggaagtctttaaggcgatccgcgaggcagtgggcaacaccatggcggtgggcgtcaggctgtcggctaccgactgggtcgaaggcggctgggactgcgagcagtccattaagtttagccagcagctggaaacgctgggcagtgactatattcacgtctccagcggcggtttgtcgccgcagcaggcgatcaccgttgggccgggataccagttgcctttcgcccgcgacattcgccagcaggtagccatcccggtgattggcgtggggctgatcaccgacccgcagcaggcggaagcggcgctggagaatggcgatgccgacctgatcgccctcgcccgcgcggtactctacgatccgcactggccgtggcacgcagcggccagccttggcgcccaggtccgtgtgccgtcgcagtatttgcgctcggagccgcacggcctgaaaggcaccctgctgccaaaccgttga

SEQ ID NO: 2304 - DNA, 198 bp, Klebsiella pneumoniae
cgacgggctgccggaatagtagatcccgaacagcgaagccttcctccacgcgtcgagcacaaacaatccgccgtaggagtggccccagatagcgcgctggtggggatctattttcaggttagcttccgtctggggaaccatcgtttcggtcagcagctggcgaaaaacatcattgccgccggttttacgcggcggtag

SEQ ID NO: 2305 - DNA, 201 bp, Klebsiella pneumoniae
ggcaaggatgcggatgtggagagcgtaatccataacaatattgagggttttctgctgttgttattaagcatgtggccgattctgctggtggtattcattggtgtcgcaatttcattctataccatgctgttacgtaagacggcgctggcctgcctgcttttcgccctcgccatcggcgccgcaggctggagtctcgcttag

SEQ ID NO: 2306 - DNA, 1551 bp, Klebsiella pneumoniae
gcgacctgtgcaccggctgcaatttgtgcgtcgccccctgcccgacccagtgcatttcactcgttccggtggccaccaccccggagacctggaaatgggatctgcatacgatcccggtgcgaaatattcctgtggaacaacatgtttaagctattttccgctttccgaaaagacaaggtctgggatttcaacggcggtattcacccgcctgaaatgaaaacccagtctaacggcaccccgctgcgtcaggtttccctgccgcagcgctttgttatcccgttgaagcagcacattggcgccgagggcgaactgtgcgttaaagtgggcgaccgggtgctgcgcggccagccgctgacccgcggctggggaagaatgctgcccgttcacgccccgacttccggcaccattgccgccatcgctccgcacactaccgcgcacccgtcggcgctggcggagatgagcgtgatcattgatgccgacggcgaagaccgctggatcgagcgcgatggctggagcgactatcagacccgcacgcgtgaagcgctgatcgagcgtatccaccagtttggcgttgctggcctcggcggcgcaggcttccccaccggcagtaaactgcgcggtggcggagataaaattaaaacgctgatcattaacgccgccgagtgcgagccctatatcacggcggatgaccgcctgatgcaggactgcgcggcgcagattgtcgagggtatccgcatcctcgctcatatactgcagcctgaagaagtgctgatcggcattgaagacaataagccgcaggccatctcaatgctgcgggcggtgctctgcgacgcccatggcatttcgctgcgcgtgatccccaccaaatatccctccggtggcgccaagcagctcacccaaattctcaccggcaaacaggtaccgcacggcggtcgttcatcggacattggcgtgctgatgcagaacgtcggtacggcttatgcggtgaaacgcgcggtgattgacggtgagccgttaaccgagcgcgtggtcaccctcaccggcgaagcggtaaccagaccgggcaatgtctgggcgcgtcttggcacgccggtgcgccatctattgaacgatgccggcttctgccccagcgccgagccaatggtgatcatgggcggcccgctgatgggctttaccctgccgtggctcgacgtcccggtggtgaagatcaccaactgtttgctggcgccttccgccagcgagatgggcgaaccgcaggaagagaaaggctgcattcgctgcagcgcctgcgctgacgcctgcccggccgatctgctgccgcagcagctgtactggttcagcaaaggtcagcagcacgataaagccactgcccataatctggcggactgcatcgagtgcggtgcctgcgcgtgggtatgtccaagtaatattccgctggtgcagtacttccgtcaggaaaatgccgagatcgcggcgattcgtcaggaagagcagcgcgctgcggaagacaaagcccgattcgaggcccgacaggcgcgcctgggatcgtga

SEQ ID NO: 2307 - DNA, 561 bp, Klebsiella pneumoniae
gcgcgaagtgctggcgaaaatggtggcgcagggtgccggcgctggcaaacccgcagcgctcagcgatctgatcgatgcccatcgtgctctccgtcaggtgctggcgggcgcgcagcagtcgttcctccagcagccagcgggcgggcgttttaccggtggcctcctcaaagcggcgcaaaaaggtgcgcgtccccatgccggcgcgctgggcgagggaagcgacggtatggctggcggcaagatgctggtgcagatagtcaaacagctgaccgaggcgcaggctctcccggctgcgggctaccgggcgcaggacctgctgcgcctgaccgccgtcgcgatggggagagacgaccaggcggcgggcgacgacgttggcggcttcgctgccgaaatcttcacgcaccagatgcagacaaaggtcgatccccgccgcgctgccggcggaagtcatcagcaaagtatcgcccacgtaaaggacgtcctccaccacctggatctgcggaaaacgggactgcagcgccgcggtgtaacgccagtgggttgtcgcctggcggccattga

SEQ ID NO: 2308 - DNA, 1017 bp, Klebsiella pneumoniae
aaaaagagtgcgaccatgattgattcctcattgccattaaccgacattcatcgtcatcttgacggtaacatccgggcccaaaccatcctcgatcttggccgcgaatttaatatcgctcttcccgcaaccaccctcgacacgctgcgtcctcatgtccaggtcaccagccttgagcccgatctggttagtttcctcgccaagctcgactggggggtaaaggtcctggcctcgctggaagcctgtcgccgcgtggcgtatgagaacgtcgaagacgcggcacgaaatggcctgcactacgttgagctgcgcttctctccccgctatatggcgatgacccaccggctgccggtcgacggcgtggtagaggcggtaattgccggggttcaagagggatgccgcgatttccaggtcgacgcccggctgatcggtattctgagccgcaccttcggcgaagccgcctgtcaggaagagctggcggcgctgctcgcccaccgcgagggcatcactgccctcgacctcgccggcgatgagctcggcttcccgggtacgttgttccgcaaccattttaaccaggcccgcgacgccgggtggcatatcaccgtccacgcgggcgaagcggccggcccggaaagtatctggcaggccattcgtgagctgggcgcggagcgcatcggccatggggttaaagcggtagaggatccagccctgatggactacctggccgagcaccgcatcgggattgaatcctgcctgacctcgaacgtgcaaaccagcaccgtggcctccctggcccagcatccgctgaagcagttccttgagcacggcgtgctggcgagcctcaacactgacgatccggcggtccagggtgtggacatcattcacgagtataccgtggcggcgccggcggcagggctgagccgggagcagatccgtcaggcgcagatcaacggcctgaccctggcgttcctcggcgaacaggaaaaagccgccctcattcagcgggttgccaaaggctga

SEQ ID NO: 2309 - DNA, 1191 bp, Klebsiella pneumoniae
gccgctggtgccgaccacgttgatattcatctctgtttctccccggttaccagactctgcctggcgatactcttggatcatctttcgggctgccgtacccccggtcatgccgcgccagcgaatgtcggttcacctggcgctggcgttttttgggcctactacaatacctgccctgcacagaggaataaatcatccgccataaccattctgctccactgcgtccggccatcaggctggcacaatcctcaggccgggcatacactctgcgtacctgtgagcagtattcatcaatccggaaagattatgctaaaagagaacgtaaacgatctgctctcctttatggtggtggcgcgtgaacgcagctttacccgcgcggcggcccagcttggcgtgtcgcagtcggcgctcagccatgccatgcgccatctcgaaacgcggctcgatgtccggctgttgacccgcaccacccgcagcgtggtgccgaccgaagcgggcgagcgactgattcagcgcctcggtccgcatctggaagagatcgagcaggccctggctgcattgcgcgacacccgagaacgcccggcgggcaacctgcgcattaccgccggggagcatgccgccagcgcggtactctggccggcgctaaagccatttatgctgcaatatcctgatattaacatcgaaatcactgttgataatgggctcacggatatcgtgggtgaccgcttcgacgccggggtgcgtctcggcgaacaggtggcaaaagacatgattgccgtgcgcatcgccccggatatgcggatggcggtggtgggttcgccggcctatctgcagcgggccggtacgccgcaaacgccctgggatcttgcccaacatcgctgcatcaatctgcgcctgccgacacgagggggactttacgcctgggaatttgcccgcgatggccgggagattcaggtgcgggtggagggacagctgatcctcaacagcctgccgcagcgcatcgacgcggcggaggcgggcctcgggctggcctacgttccggatgactgcgtggcggaggccttagccagcggccggctggtgcgggtgctggcggagtggacccccgccttccccggctaccatctctattaccccagccggcgccagcataccagcgctttcacgctgttactggaaactctgcgacgctga

SEQ ID NO: 2310 - DNA, 1233 bp, Klebsiella pneumoniae
gcacgattcgcgcaaatttccatcgcgcctggtgctaacttttccccgataaccgctatctttcttcacgttagcggccaacaggggagagccgttcgggctgtcccgccacgctctccagggaattcattcaggagtcatgccatgcaagtgaaagcagccgtcacgctgggctaccagcagccttttgtcatcaaagacgtcgaggtcgccctgccggggaaggacgagatattagtgaaaattgtcgccaccggcgtctgccataccgacgccgtgatgcgcgacaaccccggggtggtgcctatgccggcgatcctcggccatgaaggcgccgggatcgttgccagcgtcggcgaggcggttagcggcatcagggtaggagaccacgtggtgctcagctacgccgcctgccaccactgcgaaaattgtttaagcaaccacccttcggcttgcgaagattttaatacgcttaattttggcggccgacgcgaggatggcaccaccccctaccggctgggagaccaggatctgtccctgttctttggccagtcgtctttcagccagtatgtggtcacccgcgccagccacgcggtcgtggtcgacccggacgttgatctcaccctgctcggcccgctgggctgcggtatccagaccggtagcggaacggtgctcaatcgcctgaaaccggtggtcggcgaatcgctggtggtgtttggctgcggcgcggtggggctcagcgccatcatggcagcgaaattaaccggctgttcacagattatcgcggtggatatccatgccagccgcctcgccctggcgggcgaactgggcgccacccatcagatcaacggcaaggaacaggatgccgtcgccgtgattaaacaaatcaccggtaaaggcgcccactacgcggtggaaacgaccggcgtctccgctatcgttctgcaggccgtacacgcggtgaaaccgctgggaacggtggcgattgtgggctttaccggagatatcacccttaacgtgcagaacgacctgatggcggagggaaaatcgctggtcggggtgattgaaggcgacgccgtgccggcgctgtttattccgctgttggtgcaactctataaacagggaaaattccctatcgataagcttatcgcccgctatccgttggccgatatcaaccaggccttcgccgattcggcgtccggcaaggtgatcaagccggtggtggtcatgtga

SEQ ID NO: 2311 - DNA, 645 bp, Klebsiella pneumoniae
cctgttgtcgctggtatcgttttattcgataataagcggctttttttcgtttcaggtcgcatgatggctgattatttactgctctttattggtacagtcctggtcaataacttcgttctggtgaagtttcttggtctgtgcccgtttatgggggtttccaaaaagctggaaaccgcaatggggatggggctcgctaccaccttcgtgatgaccctggcctctatttgcgcctggctgattgatacctggatccttatcccgctaaatttggtttatttgcgtaccctggcctttattctggttatcgccgtggtggttcagtttactgagatggtggtgcgtaaaaccagcccggcgctctatcgcctgctggggatctttctaccgctgatcaccaccaactgtgccgtactcggggtagcgctgctgaatattaatctgggccacaatttcctgcagtcggcgctgtacggctttgccgccgccgtcggcttctcgctggtaatggtgctgttcgcggcgatccgtgaacgcctggtggtggccgatgtccccgcgccgtttcgcggtaatgccatcgcgctgattaccgccggtttaatgtctctggccttcatgggctttagtggtttggtgaagttgtaa

SEQ ID NO: 2312 - DNA, 1215 bp, Klebsiella pneumoniae
cgcaacgccgctggaaagcgcccttgcccacgccaaacagattattgcagcgcctgcggtataacaggcgtttttatttcatcagttactagacgaccggtctactcaggagtcactatgtcggaagcaaaattattcagcccactgaaagtcggtgcggtcaccgtccctaatcgcgtatttatggcgccgttgacgcgtctgcgcagcattgagccgggcgatatccctactccgctgatgggcgaatactaccgccagcgcgccagttccgggctgatcatcaccgaagcgacgcagatctccgcgcaggccaaaggctacgccggcgcgcctgggctgcacagcccggagcagattgccgcctggcagaaaatcaccgccggcgttcatgccgaaaacggtcatatcgccgtccagctgtggcacaccgggcgtatttcccatagcagcctgcagcctggcggcgccgccccggtagcgccttccgcgctgagcgcgggcacccgtacctcactgcgtgacgaaaacggccacgccattcgcgtcgacacctcaatgccccgcgccctggaaaccgcagagatcccagggatcgtcaacgatttccgtcaggcggtcggcaatgcccgtgacgccggcttcgatctggttgagctgcactcagcccacggctatctgctgcaccagttcctctcgccatcggcgaaccagcgtaccgatcagtacggcggcagcgtggagaaccgtgcccgtctggtgctggaagtggttgacgccgtgagtcaagagtggagcgccgagcgcattggcatccgcgtgtcgccgattggcagcttccagaatgtggataatggcccgaacgaagaagaagacgcgctgtatctgattagcgagctggcgaaacgcggtatcgcctatctgcacatgtccgagccggactgggcgggcggcaaaccttacagtgaagctttccgtcagaaagtccgcgaccgcttcccgggggtgatcattggcgctggcgcttacacagtagaaaaagccaacgatcttatcaataaagggctgattgatgccgtggcctttggccgcgattacatcgccaacccggatctggtggctcgcctgcagaaaaaagcgccgcttaacccgcaacgcccggaatccttctacggcggcggcgcggaaggctacaccgattacccgactctgtaa

SEQ ID NO: 2313 - DNA, 822 bp, Klebsiella pneumoniae
gccagcgccgcgacgcgcgtaacgagctgtaaaaaagagagaggcagaatgtttgcagaagaaagacaggagaagttactcggtattctcagggaaaaacgcaaagttgctgtttctgagatgtgtgacgtctttaatgtatctggcgctaccattcgtgccgatctccgccagctggaagaggaagggttgctgacccgaacgcatggcggagccgttcttcgtacccgagcgagcttcgaacaagcatcggacgcccgcgaaattgtcaatctcagcgcgaaagaacggatcggccatcgcgcggcggcgctggttgaggatggcgatataatcgtgctggataccggtaccacgacgctgcatatcgcgcgcaatattcgtgacagacagaacgtcacggtggttaccaatgattaccaaatcgcccgggagcttgaggccagtccctcgattcaaacgattctgctcggggggatcgttaagaagggataccactgcgtggtggcgatcaacggacgttccattctcgacacgctaaacgtcgataaagcatttatgggcaccaattcgctgtcgctgaaacacggcgcctgcgtggccgatatcatgctggcagaaacgaaacgaggcatggtggaacacgccagtcaggtgattattgtctgcgactacagcaagctgaataacacctcgcttgcccaatttaccgccgcagatcgaattgacacggtggtggtggatcgtctgcctgatgatgttcaggcgtatcgtaatgccggcattcaggtgatctcgctggatgaagaggagtatctttag

SEQ ID NO: 2314 - DNA, 1044 bp, Klebsiella pneumoniae
tgggcggccgctaaggatcggaggcaaacaatgacgtacgcggtcgagttccagaatgtatcgcgcctgtatggcgatgtgcgggcggtggatggggttagcattggcatacgcgatggagaatttttctcgatgctgggtccgtccggctcgggtaaaaccacctgcctgcggctgattgccggttttgagcagctctccggcggaaccatccatatctttggtcagccggccagcgaactgccgccctggcagcgggatgtgaataccgtgttccaggactacgcgctatttccccacatgtcgatccttgacaacgtcgcctacggcctgatggtcaaaggcatggcgaagaaagcgcgccatgcccgcgcccaggaggcgctggagaaggtggcccttggctttgctcatcatcgcaagccctcccagctctccggcggccagcggcagcgggtcgcgattgcccgggcgctggtgaaccagccgcgggtgctgctgctcgatgagccgctgggcgccctggatttgaaactacgcgagcagatgcaggtggagctgaaaaagctgcagcagtcgctggggatcaccttcatcttcgtgacccacgaccagagcgaagcgctgtcgatgtcggatcgcgtggcggtgtttaacaacgggcgcattgagcaggtggatgccccgcaggatctctatctgcaccccaggaccgcatttgtggccggttttgtcggcaccgccaacgtttttgcagccgaggcggcccgacgattgtgcgggatggcgggcagctggtcgctgcgtccggagcatgttcgcctgcagggcggcggcgaggtgcaggtgcagggtgtggtgcaggcggtgcagtatcagggggcggcgacgcggatcgagctccgcctcgcggatggcgacaaactactggtcagccaggccaacatcgatggcgcggcggcggccagcgttccgcgaaccgggcaaatagtacaggcgtcatggtcgcgctcggcgatgaccccgctggaaagcggaggctga

SEQ ID NO: 2315 - DNA, 237 bp, Klebsiella pneumoniae
aggcaggccgccttcctgttcatgaaaatggtgctgggcaatccatgcgctgtcgaagcccaaacgctccgcgtggcggatctgttcggccgccagccggtagcgcgtttgcgcggagccctgatcgagcagacgggtaaaaaaaccgaggcgttttggcattatgcgttctccgtgtgggcctgtgctaagcgggaggaaacctggggaatggcggcgatcagttcgcgggtgtag

SEQ ID NO: 2316 - DNA, 723 bp, Klebsiella pneumoniae
ctgcgctacgctgcgaaaatgcgggttttcgttgccgccaaagtaggggaagcccaccgacaccacgctgtcgcgaatatccagcagcgacagcttaagctcgacatctttgccgtctgcccgttgttcgagattccatttgcctttttcgccccagcgaaagccgatggagccgttcggcgccaccagttcgccgtcgctgttataggccacggttttccattccgggttattagtttctccgagaccgtcaagcaggtcggaagcacgcagcatacggcccggcgtatagctgccgtcgtcgcgcggctcgagtatcaccagcatcggcatgtcggtgtaggtccggcagtagttgagaaagtaatcgctcgggttatcgaggtggaaggctttgaggatcacatggcccatggccatcgccagcgcgctgtcggtgccttgcttcggcgccagccactggtcgcagagcttagcgacttccgaatagtccggcgtgatggcgatagttttggtgcccttgtagcgcacttcggtaaagaagtgggcgtccggggttcgggtctgcggcacgttggagccccaggcaataatgtagctggagttgtaccagtcggcggattccggcacgtcggtctgttcgccccaggtcatcggcgaggcggggggcagatcgcagtaccagtcataaaagctcaggcaggtgccgccaatcaacgataa

SEQ ID NO: 2317 - DNA, 264 bp, Klebsiella pneumoniae
tatgtccacgccattgttccgtcgagaaaaggtatgttaaagagaagcataagcgccctgctgttgctgtgcgcattattttccgggcatctgttggcccatcgtcagggacacgagtactttccggtgcaaagtctcgaacagcagctgctgcacgaagcggatagcgatgagcttcgcagccagcacgaggaggccgccgcagacctgcgcgaacatcaccgctggcaggacgaccgtaaaccgcgggcatcctgccaatag

SEQ ID NO: 2318 - DNA, 1044 bp, Klebsiella pneumoniae
aaatcatgcgctctggctggtaggccagggcggaacactcatctaacggagccgtttatgaactatacgcatcttggccgcaccggcctgaaagtcagccgcctttgtctcggaaccatgaattttggtgacgtcaccgacgagaagaccagcgcccgcattctggatgaggcgcttgaggcgggtatcaatttcattgatacagcagacgtgtatggcactgaacaatctcccgatatccagcaaggctcggggctgtccgaggaaattattggtcgctggcttcagcagggtggccgccgtgaacgcatcgttctggcgacaaaagtctatcagcctatggggccaggtccgaacgatcgccggctttctgcgtatcatattcgcaaggcctgcgaggacagtttgcgacggcttaataccgaccatattgacgtctatcagatgcatcacatcgatcgccatacgccgtgggaagagatctggcaggccatggaactgcttgttcagcagggaaaggttctttatatcggtagcagcaatttcgcgggctgggacattgcgactgcgcagtcagtcgccacggcccgtcatttcctgggcctggtcgccgagcaaagtctttataatctgacagcccgcaccattgagctggaggtcattcccgcatgccgccattttggactggggttgatcccctggagcccgcttgccggagggctgcttggcggcgtactgaaaaagatggcaagcgggcgccgtgccaggcccgcgtttgcccgtctaatcgaacagtatcgtccgcagctggaagcctacgagggattatgtgaggacctcggcgaaaccccctccgatgtggccctggcgtggctcctgcagaatcctgtcgttaccgctccactgattgggcctcgtacggtcgaacaactccagcaagcgcttcacgcaacgacaatcacgctatcagacgacaccatgagctgtctcgacgaaatctggcccggccccgggggagaagcgccccaggcttatgcctggtaa

SEQ ID NO: 2319 - DNA, 537 bp, Klebsiella pneumoniae
gcggctcgcgcaggccctgcgggagggcaatgcccgctacgaagcccgctttggccgggtgtttttaatccgcgccaaagggcgcagcggcgaagagatgttgcaggcgctgacgcgccggctgcagcataccgccgacgaagaagtggccgaggcgcttgcccagctgcgagagattacgatgttaagactggaaggagtgattggcgaatgagtaccctgagcacccatattctggatatttccaccggtacgccggcggaaggcgtaacggtcagcctgagtagggagggcgagacgctggcgaacctggtgaccaacgcccaggggcgtatcgccacctttagcgccgcgccgctgccggcggggcgctattgcttaacagcggaaaccggggcgtggtttgcccgcgccgggcgcgagagcgtctttacccgggcgcagattgattttgttatcggcgaggcggcagaggaccatttccatctgccgtttctcatcgccccgggcgggtggtcgacctaccgcggcagctaa

SEQ ID NO: 2320 - DNA, 390 bp, Klebsiella pneumoniae
gacctcagcgcgacgaaaccggaaaacggtggtcgcgctccgcatgccgccgggccaggcccggcgactcaccctctgttacaaacgcctattggcctgacaaaccagatggttatacacttaaccctttcccgccacgtgcgggcagtggtaatcagtggagataaaatgaaaaagccattcatggtgatttgcgccggcgcgatgctggcgctgctggccggttgttcgtcaaactacgttatgaccacgaagagcggtcaaactatcgttacccacggcaagccgcagctggataaagaaacggggatgaccagctatatcgatgagtcaggtaataagcgggaaattaacagcagcgatgtgtcgcagctggttgaagataattaa

SEQ ID NO: 2321 - DNA, 1077 bp, Klebsiella pneumoniae
cgaggcggcgcctgccgccccgctgtcagccttacctgcaataagccgataatgtccttatcggctttttttatttctttccgcaacgctaatgctctcttcgcagggcccgttgacccctgcctctcgcgatgccacagtactatcccgaaaataacaacgttcaggataaacgtcctgaaaatggggataatgatggagaaacgcttaccagggctggatctcgacgccctgcgcagctttgtgaccggcatggagtgcggcagtttcgcccaggcagcgctgcgcctgtcgcgttccacctccgcggtcagcgcccagcttaaaaagctggagagccagtgcggtgcggcgctggtgaccaaacaggggcggcatctggtgctcaccgcggaaggcgaaaagctgatgagctacgccagacgcctgctggcgctcaatgatgaaaccctgcgcgcgctgcagggtgagcggctcaccggcgagatccaccttggtatgcaggaagattttggcgaatcgctgatgccggggatcctcgggcaatttaaacggcatcatccgcaggtgcagatagtcgccagggtggatcgcaatggtccgctgcaccaggcgctggcggaagaggcgctggatctggcgctgctgtggcaaaacgaagatcagggttccgggctgggcctctgcccgctggcgtggattgcgcatcctgacctggatattcgcgctctgctggtctccggcgagccgctgccgctggtgatgttcgacagcccgtgcctgatgcgctcccgcgccattgcctgtctcgatgccgcggggatcccctggcaggtggtgttcgtcagccacagcctgagcggcatctgggcggcggtgcaggccgggctgggcctgacgatacgcacccgcatcggcatgccaggcaacctgcgccctgcaggaggactgctgccagcgccaggaagtctggccgtcagcctgcgacaaaccccgcgtgaggaacaccattccgccgccgtggcgctgctcggcgaactgatgaccgaggccctgcagggatggctcgacaggtga

SEQ ID NO: 2322 - DNA, 927 bp, Klebsiella pneumoniae
ggtgggggcgctggcgatcacaaatccgcacatcgggcgcgtgccgagggccggaatagattatcgtgctcctgcgccataggttgttcaggatttgctgtaatgatgacactgaccgttgagtattatttcacccatccccaggataagctcggcatgtacgccagtgacccggaggataatagccaggagcatggccatgaatttgccgaactggtgatcgtcgaggaggggcatgggttacacgttattaatggtcgcccgctgtatatccaacagggagacgtattttacgtccagcctggcgatgtgcattattatgatgagctggggacgctgaagctgattaatgtcttaattaatccggcggtggcctttggctatttacagcagatggagggattgctgcagcaattatccgcgcagcgcgccgcctgctatggctggctagcgccggagactcgcagctattgccgggaactggtggaaaagatattttccccggcgctgagggcggcggataataccccgctacgggagtctctctttttccagctggtgaccaccattctcacagccgagtcggaagccgaatatagcagcactcgctataaactgcataaattactcacctggcttcaggagcactgtttcgaagaacataactggcagcagctggcggagcaatttcatctcaccacccgcaccgcgtttcgccatattaaagaggccaccggattaaccccggataattatctgaaacgtctgcggctagtctccgcgcgggtcaaattacgcgaaacggagatgaccattaccgaagtggcttatctgtgcggcttcgccaacagcaaccactttaccaccctgtataaaaaagtgtttggcctgacccccagcgccgatcgccgccgcccaccgggttaa

SEQ ID NO: 2323 - DNA, 444 bp, Klebsiella pneumoniae
gcctttacagctatttttctgtccgcgccagctgggttttatccgcctcatgggcgcgatccgccagcccctggaacgctccggcgccatagtattgcgcgggaaccggcagcgcctgcatatcgtgccctggatagatctgcagttcgccgaggtcgcgtaagcggaatcccccgacctgctccggcatggtcaggcgatacggcggcatggtttcgaatgggaccggcgtcggcagccggttttcctgtagatcgtagttacgcttcagtaccagaaacttatccggcacccgccggtgactgttccaccagtcgccgtcgatctgctgaaacatcgcttccgtctctccgcgcgtcgccaccagcagccgggtcagcacttgtttcagcgccgcatccatggcctggttataatcctccagcgaaccgccgtggccgctga

SEQ ID NO: 2324 - DNA, 627 bp, Klebsiella pneumoniae
cctgtaacagccggtcagtggctcctctgcatacggctttttagtgccaaatcgttccgaacagcaggagaattatggccgaagcgcttgaacaaatatctgcgcaggaaaataatgacctcaactcatatctcctgccaatattcgcaggctaatgcattcatctgtaaggaaactctcatggtcatcgatatccgggaagtacggccccacgacaaagccgaatggcttcagctttggcaaggctacactcgtttttacggtagcccgcagccggaagaggtgaccgaatgcacctggcagcggatgctggatgtaaactcgtctgtattgggtaaagtcgcggtggtggatgatgcggtggtcggcttcgctatctgtgttcttcatgagggaacctgggttaccacgccgatctgctatctggaggatctgtttgtcgatcccgccttccgtggacagggtattgccagaaccatgattaagtcgctgcaaagcgaaggggcggacaaaggctggtcgcggctgtactggcatacgcgccgtgataatcccgcccgtcatctgtatgatgagtttaccctggctgacgattacgtacgctacaggatcacgcttgagtcctga

SEQ ID NO: 2325 - DNA, 888 bp, Klebsiella pneumoniae
tcccgcgcagcagagaaacgccagcgccagcgaagcgactttgtgttcaccgaaggcaaagatcagcagcagcgtcacggcaatgaccccgtcggtcatggccgcaatgcgcagcgggctgtagcgcccggaaattttgccgctgaacagattgccgaccaccattcccagccccgccagcatcataatcagcatcatcttgctttcagcaaagccggagacgttgagcataaagggcttgatatagctgaaccatgcaaacacgccggcgttaccgaacatggtggcggcgaaaatcagccacggcgccggggaggccagaaaacggaactgctcgcgcagccgcgtgctggcccggtcataaagcgtgggcacccagcagaagatcgccagaaataccgccacgttaaataccgcgataagcgcaaaggtatagcgccagctgaagtgatgcccaagccaggtgccacccgggacgcccaccaggttagcgatcgtcatgccgccaatcatccccgccaccgcggcggtcaccttccccggcggcgcgattttcgacaggataatcgcgccgacgccaaagaacgccccgtggggaaacccggaaaccagccggccaagcgccagcatggcgtagctactggagaaggtaaacagggtattgccgagaatacacaggccagccaggaacagcatcaccgatttcagggaaaaccggctggagagcagcgccatgatcggcgcgccgatcaccacgccgaaggcataccaggcaatcatattgccggcggcgggtatggatattccgacatcgtgcgccatatccggcagcacgcccataatgccaaactccgccatgccaagtccaaaggtgcccagcgccagtga

SEQ ID NO: 2326 - DNA, 636 bp, Klebsiella pneumoniae
agaggtaaagcttatctgtctgcgaaaaatgcaaaacacaatctatccatgcaagcattgatttaccgccagtcatatggcggttttttttgccccttccaccctgtaccgactgcttcaatccggctttccatctggcatatcctgccgcggcatgctagatctcccttccgggagacgacgggagacaaggtcatgatggtgattgagggtaaagaggcgatcgcgcgggtggactggcagcgagtgcgaacgatcatcgccgaggccgggctgaatgagcgtgatgttcagcaactggagcaggcgttccgccagagtaccttctgctggtttggctatgagaacggtcagctgattgccgtggcgcgagccatcagcgactgtacctggagcagctatctggcggatgtggcgatcgtccccgctcgtcagggacagggctacgggcaacagctgatgctggccatccgggagcaactcctgccctttggcaaaatatttatctatgcggtggccgataaaattacgttttatcagcgttttggatttgccatgttgactaccggcatggtctgcgccagcgaggaaggcatgcagaaaatgcaggagcagggctatatccgtcagccctga

SEQ ID NO: 2327 - DNA, 885 bp, Klebsiella pneumoniae
atgaggaaagctattagcggcgtactcaccgccattgtcactccctttaccgccgagggagcgcttaacctgccggcgctacgccagcaggtgcagcggcagctcgccgcaggcaacggtattttctgcggcggcaccaacggcgagttttttgtcctcaatgaggaagagaagatcgccgtcgccagaacctgcgtggaagaggcggccggtcgcgcgccggtggtggcccatattggggaggtttccacccgggagacgcgccggctgggccagcagatcgcccgcctcggagttgacgcggtatcggccattaccccgtggttcgtgcccttgaagcaggaagagctgattaaccactatacggcgatcgccgacgcgctgagcgtcccgctctttctttacaacattcccgcccgcaccgggaacactattgccccggagaccgcgcgccagctggcccgccacgagaatatcgtcggcattaaggatagcgccggcagctacgacagcctgaaaggctttctcgacgcggtgcgcgatatcgacggtttcgacgttctgaacgggccggactcgcttatccatcagggatttgtcgacggctgctcggcctgcatctcggggcttgccaacgtcgcccccgctgaaattaacgccatctggtcgcgctttcacgccggggatatcgccggatcgcgccaggcccaggagcaggtaacgggcctgcgcaccgatctgtataaagtggcgttctcgcctgcggcggtgaagaaagccctgcagctaatgggtcacgaggtgggcgacagccgctacgcggtgcagtttagtgaccaccagctgcagcagattaaaaatatcattaacacctaccttcactaa

SEQ ID NO: 2328 - DNA, 366 bp, Klebsiella pneumoniae
cggcaggaagccgcaggttgtagggcacagaaacgatgctgtgccgcgcagtgtcacccgttatcaaggaagattgctatgtctccattccgtctcgctctgatatgtctgtgcctggcgccgctggcgtcgtctgctgcgctttccggccaggttcatttttcaggacgggtcatcaatccggcctgtgttatcgccccccggcacgatcgtatcgatgtctcgtgtcagcaccattcaccggaacaggtcgccttgacaaacaaccgtcctcgctacgccatgccggacaatcgcggtgaggtcagtattcactggcgaaatgcgcagcatagtgaagcggatgtcattattcgctatcgctaa

SEQ ID NO: 2329 - DNA, 954 bp, Klebsiella pneumoniae
cagcttctggccaccgtgcggcatttcgctgaccagcataaagtgggtattgacccaggtgcagccgtactgcagcctggcgctaagacgatgggcgcgaccgacatctttcgtccataccgaggaggccagaccatactgagagtcattcgcccagctcagggcctgcgcttcatcgctgaaaggcgtcacgctgactaccggaccaaacacttcgcgctggacaatagcgtcttcctgccgggcgccggcgagcagcgtcggctggaagtaatagcccgcgccgtcagcccgactgccgccggtgaccaccttaatgtgcggcagcgcccttgcggcttccaccgccgcgctaacgcgctcaagatgggccagcgagctcagcggacccagttcggtggcagcgtcctccggcgcccccattttcaggctggccaccgccgccccaagtttctccaccagctggtcatagataccctgctgggcgtagatccggcaggcggccgtgcagtcctggccggcgttgtaaaaaccgaaggtccgcaccccatccaccaccgcatcgatgtccgcatcgtcaaaaacgatcactggcgccttaccgcccagctccatgtgggtgcgtttaatcgacgaggcggtatggccaatgatatgggctccggtggcaatcgatccggtcagggagaccattcgcactttaacgtgggcggtcaaggggtcgcccaccgttttaccgcggccaaacagcacgttgataaccccctccgggaagatatcttttgccagctccgccagcttcagcgccgtcagcggggtgatctccgagggttttatcactacgcagttgcccgccgccagcgccggggccagcttccaggccgccatcatcagcggatagttccacggcgcgatggaggccaccacgcccaccggatcgcggcggatcattga

SEQ ID NO: 2330 - DNA, 612 bp, Klebsiella pneumoniae
cgccagctggcatgcggctgtcaggttgctgtcgggccgttgtcgggtcgctgtcgtggtggctggcggcccggttcaccatactccatcacaggtttacatccgcagaacgttatggagcatacgaatatgaacagcaacaatcaggtcaaacaattacggctgcagcgcgcctggtcccaggagcagctggccgaaatggcgggtctcagcgtccgtacgatccagcgcattgagaatggcgaacgcccggggctggagaccctcagcgccctcgccgcggtctttgaggtgacggtggccgagatcggcggcgaagcccggcgggaagacgcgccgggccaggaagcctcactggatttgcgcatagaggaagccaaagcgcgggtgcatcaggagagccgctttttccgttcgctgtcggtggcgctggtggtttgcgtgctgctggcggtgcttaaccgcttcactaatccacagtactactggtccggctgggtcgccctgatctggggcgccctgctggtggtgagaggattacgcctgttcgtgttcggcgaatggattaaaaactggcgccaggcgcgcctgcagcggctgctgcgcaaatag

SEQ ID NO: 2331 - DNA, 1350 bp, Klebsiella pneumoniae
cacatcatggcgaacaccatcacggctgatgagattcgggagcacttttcgcaggccatgtcggccatgtaccagcaggaagttccgcagtacggaacgctgctggagctggtggctgacgtcaacctggcggtactggaaaataatccgcagctgcatgaacagctcgctaacgctgacgagctggcgcgcttaaacgtggagcgccacggcgcgattcgcgtgggcacagcggaagaactggcgacgctccgtcgcatgtttgccatcatggggatgtatcccgttagctattacgatctctcgcaggccggcgtgccggtccactccacggcgtttcgtcccatcgacgatgccgcgctggcgcgcaatccatttcggattttcacctcgctgctgcgcctggagctgattgaaaatcgcgccctgcgcgagcgggccgaggcgatcctcgcgcggcgcaaaatcttcaccccccgctgcctggcgctgattgcgcagtatgaagcagagggcgaattcacctctgccgacgcgcgcgagtttgtccaggaggcgctggagacgttccgctggcaccggcaagccaccgtcgatgaggagacttaccatgctctgcatcgcgagcaccgcctgattgccgatgtggtctgtttcccggggtgtcatatcaaccatctcacgccgcggacgctggatattgaccgcgtccagtccctgatgccggagtgcggtattgaacccaaagcgttgattgaagggccaccgcgccgggaggtcccgatcctcctgcggcagaccagctttaaggcgcttgaggagccggtgatgttcgccggagaacaccgaggcacccatagcgcccgctttggcgaaattgagcagcggggcgtggcgctgacgccgaaagggcgcgcgctgtacgatcggctgctgcaggcggcaggaaccgggaaagacaatctcagccaccagcagcatctacaggaggtgtttagcgaatttcccgacagcgaatttctgctccgtcagcaggggctggcctggtttcgctaccgcctgacgcccacgggtgaggcacatcgccaggcgtttcgcccgggcgacgatccgcagccgctgattgagcgcgggtgggtggtcgcccagccgattatttatgaagattttttaccggtcagcgcggcgggcatttttcagtccaatctgggcaacgaaacccaggcgcgcagccacgggaacgccagtcgcgaggcgtttgaggcagctctgggctgcctggtgcaggatgagtttgaactataccgacaggcggaggagcgcagcaaacgacgttgcggtctgctgtaa

SEQ ID NO: 2332 - DNA, 1032 bp, Klebsiella pneumoniae
gatgtaatggcaactattaaagatgtagcgaaacgcgcaaacgtttccactacaactgtgtcacatgtaattaacaaaacccgtttcgttgccgaagagacgcgtaatgcggtatgggcggcgatcaaagagctgcactactcgccgagcgccgtggcgcgcagcctgaaagtcaatcacaccaaatcgattggcctgctggcgaccagtagcgaagccgcctatttcgctgaaattattgagtccgttgaaaagagctgcttccagaagggctatactctgatcctcggtaacgcgtggaacgatctggaaaaacagcgcgcctatctgtcgatgatggcgcaaaagcgcgtagacggtctgctggtgatgtgttccgagtatccggattcggtattgagcatgctggaagagtaccgccatatcccgatggtggtgatggactggggcgaggcgaaagccgacttcaccgatgcggtgatcgataacgccttccagggcggctatatcgccggacgctacctgattgaacgcggccatcgcgaaatcggcgtgatcccgggcccgctggagcgcaacaccggcgcggggcgactggccggcttcatgcaggcgatgaaagaggcgcatatcagcgtgccggaaaactggattgtgcagggcgacttcgagccggagtccggctaccgcgcaatgcagcagatcctaaaccagcagcaccgcccgacggcggtcttctgcggcggcgatatcatggcgatgggcgctatctgcgcggcggatgaaatgggactgcgggtgccgcaggacatttcgctgatcggttatgataatgtgcgcaacgcccgctatttcagcccggcgttaaccaccattcatcagccgaaagattccctgggcgaggccgcatttaacatgctgttggatcgtatcgtcaacaagcgtgaagagtcgcagtctatcgaagtgcaccctcgtctggttgagcgccgctcggtagcggatggcccgtttgtcgattatcgtcgttaa

SEQ ID NO: 2333 - DNA, 1329 bp, Klebsiella pneumoniae
ctggtaatggcgacgcttaccacctggatgaacaatgtgcgcgtgggaaccttaacccgccaggctaacggggcgcacagttttcgctatgacgaagagtggctgcgcagcccgcgcgccagaccgctctccctctcactgccgctgcagtatggcaatatcactgccgacgcggtgtatcactattttgataacctgctgcccgacagcccgcaggtccgcgaccggatcgtcaggcgctatcaagcgcgctcgaagcagccgttcgatctgctggccgaagtcgggcgggatagcgtaggggcggtgaccctcctgccgccgggggaagaggcgcacctggaaggattacgctggcagacgctggacgaggcgcagctcaccgccttgctgaccgcttaccagtcggatatccccctcgggatgattaccggccaggacgatttccgtatctcggtggccggcgcccaggagaaaacggcgctgctgcggatgggcgagcagtggtgtattccgcagggcgccacgccgaccacgcatatcattaagctgcccatcggcgagataaagcagcccaatgcgacgctggatctgcgtgaaagcgtggataatgagtatctgtgcctggcgctggccagagaactgggcctggcggtgccggaagcggagatcatcgccaccccgcggatccgcgccctggcggtaacccgcttcgaccggcgctgggcgcaggagggacgggtgctgctgcgtctgccgcaggaggatctgtgtcaggcttttggtcttccttcagcgatgaaatatgagtctgacggcgggccgggtatcgccgcgatcatgacctttctgctgggctcgagtgaagcgctgaaagatcgctatgactttatgaagttcatggtcttccagtggctgacgggggcgacggacggtcacgcaaaaaacttctcaatttacctgttgcccggcggcagctaccgcttaacaccgttctacgacattatttcggcgtttccggtgctgggcggcacgggactgcatctgcgcgatctgaagctgtcgatggggctcaatgccacaaaagggcgtaaaacagagattaacgccatctatccgcgtcattttctggcgacggccaaagcggtgaactttccccgggagcagatgctggcgatcctccaggagtttgccgggcatgtgccgcaggcaatcgaaagcgctcgccggacgctgccggcggacttttccagccacgtctggcaggccattacagagaacatgctgaagctgcacgcccgcctgcagcaagggctgcaggcgctatag

SEQ ID NO: 2334 - DNA, 249 bp, Klebsiella pneumoniae
atttccccggctgtcagtgaaataaaatccgccctgattatcaaagaccagatcgttgacaagaaatccagtatcaggggcaacaatcatctgctcacgggtgccgtcgggttcgatagcccgaacagaacctcgctgcatatcgcccaccgaggcgataaagatccgtccatctttgtgtaccgccaggccggaagcaccgaacgtattctccttaaggacaatggaaagctgccgctccggggttag

SEQ ID NO: 2335 - DNA, 882 bp, Klebsiella pneumoniae
tccaagccggcgccaaacctgacaacagcgaggcgattgccgcccgcgaagcgcgtaaggctgaggcccgggcgcgcaaagcgcagcagcaggccgcgccggtggacgccccggccgccgaaccggtcgatccgcgcaaggcggcggtggaagccgctatcgcccgcgccaaagcgcgtaaagccgaacagcaggccgcgccgatggaagccccggccgccgaaccggtcgacccgcgcaaggcggcggtggaagccgctatcgcccgcgccaaagcgcgtaaagccgaacagcaggccgcgccggtggacgccccggccgccgaaccggtcgatccgcgcaaggcggcggtggaagccgctatcgcccgcgctaaagcgcgtaaagccgaacagcaggccgcgccggtggaagctccggccgtcgaaccggtcgacccgcgcaaggcggcggtggaagccgctatcgcccgcgccaaagcgcgtaaagccgaacagcaggccgcgccggtggaagccccggccgtcgaaccggtcgacccgcgcaaggcggcggtggaagccgccatcgcccgcgccaaagcgcgtaaagccgaacagcaggccacacaacaggatctcgcgtcagccgcagccaatgacgacccgcgcaaagcggccgtcgccgcggctatcgcccgcgttcaggcgcgtaaagcaacacagcaggcagttaacgaggaataaatggttttcagaatcgcaagctccccctatacccataaccagcggcagacctcgcgtattatgctgctggtgctgctcgccgctgtgcctggcattgtggtccagacctggtttttcggctggggcaccgtactgcagattgtcctcgccgccctga

SEQ ID NO: 2336 - DNA, 1188 bp, Klebsiella pneumoniae
tgccggccggctctcaatacccctataagatgtatgaaaaaaacgattttttcactggcgctgggcacctttggacttggcatggcggagtttggcattatgggcgtgctgccggatatggcgcacgatgtcggaatatccatacccgccgccggcaatatgattgcctggtatgccttcggcgtggtgatcggcgcgccgatcatggcgctgctctccagccggttttccctgaaatcggtgatgctgttcctggctggcctgtgtattctcggcaataccctgtttaccttctccagtagctacgccatgctggcgcttggccggctggtttccgggtttccccacggggcgttctttggcgtcggcgcgattatcctgtcgaaaatcgcgccgccggggaaggtgaccgccgcggtggcggggatgattggcggcatgacgatcgctaacctggtgggcgtcccgggtggcacctggcttgggcatcacttcagctggcgctatacctttgcgcttatcgcggtatttaacgtggcggtatttctggcgatcttctgctgggtgcccacgctttatgaccgggccagcacgcggctgcgcgagcagttccgttttctggcctccccggcgccgtggctgattttcgccgccaccatgttcggtaacgccggcgtgtttgcatggttcagctatatcaagccctttatgctcaacgtctccggctttgctgaaagcaagatgatgctgattatgatgctggcggggctgggaatggtggtcggcaatctgttcagcggcaaaatttccgggcgctacagcccgctgcgcattgcggccatgaccgacggggtcattgccgtgacgctgctgctgatctttgccttcggtgaacacaaagtcgcttcgctggcgctggcgtttctctgctgcgcgggactattcgccctgtcagcgccgctgcagattctgctgctgcagaacgccaaaggcggcgagatgctgggggcggccgggggacagatcgcctttaacctcggcagtgccatcggcgccttctgcggcggaatgatgatcgcccagggctttggctggaacagcgtggcgctccccgccgccgcgctgtcgtttctggcgatgagcgccttgctcatctatggctgtcatcagcggcgacaagcttactaa

SEQ ID NO: 2337 - DNA, 1389 bp, Klebsiella pneumoniae
caccaggcggcgcgcatcatgctgtcgcgacgccgcggagtaaacacgactatgacaacaatcaatcacacacctgccggtgaacaacgtggcaaaaagcggctgatacatcgcttctcctgggtttcgcttctggtttgctggctaatctgggtgcttaacgcctacgatcgcgagatgatcctgcgccttggcccggtcatctctaaggagttctcgctctcgccggaacagtggggcaatatcgtcgccctgatcatggtagcccttgcggtgctggatattcccggctccatctggagcgatcgctacgggtctggctggaaacgagcgcgctttcaggtaccgctggtgctgggctataccgcgctgtcttttatttccgggattaaagcgatcagccacgggctgacggcctttgtgctgctgcgcgtgggcgtcaaccttggggccggctggggcgaacccgtcggcgtcagcaacaccgcggagtggtggccgaaagagaagcgtggttttgcgctgggggtgcatcataccggctatccgattggcgcgctgctgagcggcgtggtggcaagcctggtgcttgccacgtttggcgaaggcagctggcgctactgcttcctgctggcgctgctcgtcgccatcccgctaatgatcttctgggcaaaatattctaccgcggaccgcatcaacacgctttatcagcatatcgacagccaggggttgacgcgcccggcgacgcaggaaagcagccatgtcgccaaaggcgaagggatgaagacctttttacgcaccctgcgcaaccgcaatatttcgctgacggcgggcaataccctgctgacgcaaatcgtctatatgggcattaacgttgtactgcccccgtatctttatcacgtctccggcctgtcgctggcggcgtccgccgggctgagtattatcttcacgcttaccggtaccctgggtcaggtaatctggccctggctgtcggatagctttggccgtaaacgaaccctgatcgtctgcggtctgtggatgagtatcggcattgcgctattctatttcgccaccaatatgccgcgccttatcgccattcagctattttttggcctggtggccaatgccgtgtggcctatctactacgccatggcgtcggactccgccgaagaacgcgccacctctaccgctaacggaattatcaccacggcgatgtttatcggcggcggcatttcgccattgcttatgggctggctcattcagtttggcggcggctgggaaaatccagcgggttatatctacgccttctttaccatggcgggatgtgcgctgctggggatgttattacagctcatgaccaccgataaaacgccgcgcaaagcgcattaa

SEQ ID NO: 2338 - DNA, 309 bp, Klebsiella pneumoniae
atatttcaggctgttacttccctctggaagctgtctcgcaaaataaatattaaacttactgctggtatttattttttagtgggtaaagtaaataatcacagaaccaaccgcaaggagcctatgatgaaaagtaatacgctacgtaaaagacccactgacgtacccgtccagaaggcgtcagaacagccaggtaaggatttacgagaagcggataaacagcgacagcacaaggaattcattgccgcaatgaatgaatttattgcaaaaggaggcactcttactgatgatgaatttttcagggtgctatga

SEQ ID NO: 2339 - DNA, 1656 bp, Klebsiella pneumoniae
cagggacgggcagaacgcgaggtgagagtgatgcaacgggaagagtggtttcacagagcggtcatctatcaggttgacagttcgctcttttatgatgccaatggcgatggttttggcgatctcgcgggcattcgccaaaagctacactacattcgcagcctcggagcgacggtgctctggctgactccgttctatctcactcctctgcaggatgatggctatgatatcagcgatcatctgcagcccgatccgcggttcggcactatcgctgacgtgattgagctgattgcccgcgcccgcgagctgggactgcgggtgatcgttgagctggtgatccagcacacctctgcgcagcacccgtggttccaggcggcgcgacgcgatccccggtcgccgtggcggccgtattatctgtgggccgatcggccgccggaaaacgacgatcctcccatgtttcccggcgttgaggagagcgtctggcgctgggacgaacaggccgggcaatattatcgccacatgttttatcaccacgagcccgacctgaatctcgcccatccgccggtgatcgctgaaatcgaaaacattatcaccttctggctgcaggctggggtgtctggctttcgtctcgatgccgcgtcacatctggtcaagcaggccggaaagggcgacgagacgcgcggctacccgctgctgacccatctccggcaggttgtacagcgcctcaatcccgatgcgatactcctgggtgaagtggacgtcgcggtagaagattaccgtcattatttcggccagggcgatcggctgcagatggtgcttaatttctggcttaacaaatacctctacctcagcctggcgcagcagcgcgccgcgccggtggtgaaggccctgcaggcgatggtgaccccgccggacgggtgctgcttcgtcaactggctgcgcaaccatgatgaactggatcttgaggggattggcgagcgcaacaagcgccaggttatccgcacctttgcccctgataaatcgatgtccgtttaccagcgcggcgtacgccgaagactggcgccgatgctggacggcgatacccgacgcatagcgttagcccatgctatcctgctggcgctgcccggcgtgccggtgatgcgctatggcgacgagattggcatgggtgatgatctctccttaccggagcgctacgcggtcagaacgccgatgcagtggtcggccgcggccaatgccggcttttcccgggcggcgcgggatgatttgccggtaaaaccggtggccagcgggcggttccgctatcaacggatcaatgtcgaaacggcgctgcgccatcccaggtcgctgctgcatcgggtacgcaatatggtattggcgcgcacggaatatactgaaccgggatccctcccttttactctccttactctaaagcccgacgcggtgctgggcttgctctatcgcagcgaatcgcgggaggtactgatgctggccaactgcagccagcaggcggtagaggtcctgctcccgccgctggccgagggctactggagcccaattctggaagataagctctatcaggatggcctgcacggcgggaaagatgcgcggctggcactctccgggtatggttaccgttggttcagccgcagcctgagttag

SEQ ID NO: 2340 - DNA, 435 bp, Klebsiella pneumoniae
ccacccagggcgtcggtcagaccatcggcagcgtcaaaatcaccgaaacccgaccgcggactcgagttcgcccccactctgcgggcgctaccgccgggtaagcacgggtttcatattcatgccgaaggcagctgccagccggcgatgaaagaaggtaaagccgtggccgccggggcggcgggcggacattacgatccgcagcataccggcaaacacgaagggccgttgggggccgggcatcttggcgacctgcccctgctggtggtcaacgatgcgggcgtagccgaccagccgattattgctccgcgcctgaaaacgctggcggaggtgaaagggaaagcgctgatggtccacgtaggcggggataacatggccgacagcccgcagccgctgggcggcggcggcgaacggtttgcctgcggggtgattaagtag

SEQ ID NO: 2341 - DNA, 981 bp, Klebsiella pneumoniae
agcgcgagggccggacagcgacccgcacaatccgctgctgcgcgatgtcggctggaattatctcaagggccgtctgcgttcccatccggacgtggcggaacgctactatcaggacgtgtttcgcgaacgcgccgagcaattgatcgtttaaccataactaaaaaggaacacatcatgaaatatgccgcttttaaactggcaggagtcgcactgtctctttctctggcatggacgtctgcccaggctgccgcgctgcgcgtcgccgcggacccggttccccacgcggagatcctcaactacatcaaaaaaatcgatcccagcctcgatctgaaggtggtggagctgaccagcggggtcaacgccaatgaactgctggccagtggcgatgtggatgccaactacttccagcatgtcccctacctgaaggatcaggagaaagcgttgggtaaaacctttaccgtcgcggccacggtgcatattgagccgctggggatctattcgcataagcataaagatttctcatcactgccggaaaacgccacggtggcggtgccgaataacaccaccaacctgagccgggcgctgttcctgctgcaggcgcagaagcttatcaagctggaccccaaatttaccgacccggccaccaccctggcgacgccgaaggatattgtcgagaacccgaaacacctgaagattctggagattgaatcgccgcagatcccgcgctccctcgacgatgtcgacctggcggtgattaacggtaactacgcgctggaagccggcctggtgccagcgaaggatgccctggggctggaaagcgccgagcataacccgtacgccaatattctggtgaccaccccagccctggcgaatgacccgcgcattaaggcgctggcgaaagacctgacctcgccgcaggtggcggagtttatccgtaaaacctacaacggctcggtgatcccggtggcccctcagtcatga

SEQ ID NO: 2342 - DNA, 186 bp, Klebsiella pneumoniae
tttttgcatttcacattccattgtgagggggtgagaaacaactattttgcacagcaaagggcgtgcggcaaatgctatctgttttctatttttacgatgaatgtatataggcggaaaaaacgtttctgtggcgggaggtattattctgacgttattaataaccgggccgatatgtcgacccggtga

SEQ ID NO: 2343 - DNA, 189 bp, Klebsiella pneumoniae
ttaggcaatttgttagtgtccgcacaagccggacataaaatcagcgcaaaattaattgcgcaaaatctcactcatgccagatgcgtcaaaaacaacccgtccctgcattattttgagtcaattttgactcatttcgtcgatttgaattttttagccgcttatttcacccttcggggtaattactcctga

SEQ ID NO: 2344 - DNA, 705 bp, Klebsiella pneumoniae
ctaactatttatcggaggtggtttatgagcgctaaattttcaccgtcactgatgtgcatggatttaacgcagttcaaagagcagatcgcggcaatgaataaaaaagcggatttttaccatgttgatataatggatggcaattacgtccgcaatatcacactgtctcccttttttattgagaatctgaaaaaaattactactgtgcccattgatgttcatctgatggtaaatcatccggaagatatcattcccatgtgtctcgaggccggcgccgatatcatcagctttcatcccgagacggcgaataacaaaatattccgcctgctgaatcagatcaaggatgcgggcaaaaagtgcggggtggtgctgaacccggcgacaccggcagaaagcattgccgaatatgcgcatctgctggataaagtgacggtcatgtcggttgaccctggctatgccggacaaaagtttattcctgagtcgctgaacaagattagaaagctcatcaacatgcgcaaaaataatggctatcactatctgacggaaattgatggctcttgcaatgagaaaaccttcggtcagattgctgaatccggggtagatgtctttatcgtcggcacatcgggtttgttttcgctccatgaggatgtcagccaggcgtgggacagaatgatcgagatcttccagcgggaaactgtcgctgcataa

SEQ ID NO: 2345 - DNA, 312 bp, Klebsiella pneumoniae
ttcaatatttatcgaaattgttctgctcagacaaataaaaccctgccatattatatgatcgtgcagaatgattattatgcagacctggccacgagagtcattattcctttaatgcgaccacaacagttaccacgctggcatcagcatgtcgtaccaaggataaatatagaatttgacagctttttactttgtacgccaatgatcagtaacttaaataataaacggatcccgccacaggatttcgtctgcaatctgagtcatgcgcgccagggcgttatcgattcaatcgatactcttatcacgaactgctga

SEQ ID NO: 2346 - DNA, 453 bp, Klebsiella pneumoniae
gatcaacattattatcgtattgagaagaaaaatatgaaccacagcacactcgagatcttcattcaggtggcagacacgcagagcgtcacccaggcagcaaaacggctgggccgcgcacagtccaatatcacgacccgcattcagcagctggaagaggagcttgccgttgagctcttcgttcgcggcaacaaaaaaatggtgttgtccccggcaggcgtgcagtttctcagctatgcccggcggatcctgagcctggcggaagaggccaaagcaggctctgcatccgacaaccccaggcggcagtctgcgtctgggcgcgatggaggcgaccgccgccagccggctgccgccgctgcttacccgcttccaacagcagtgcccacaggtggatatcaccctcatcacccaaccgacccgccagttaacggagggggtgttaaccgccgcccttga

SEQ ID NO: 2347 - DNA, 459 bp, Klebsiella pneumoniae
caagctaattataaggagatgaaattggaatcgccacttggttctgatctggcacgtttagttcgcgtttggcgcgcgctaatcgaccatcgcctgaaacctctggagttaacgcagacccactgggtcacgctgcataacatccaccagctgccgcctgagcagtcgcagatccagctggcgaaagctatcggtattgaacagccgtcgctggtgcgcacgctcgatcagctggaggagaaagggctcatttctcgccagacctgcgcaagcgatcggcgggccaaacgcatcaagctgacggaaaaagccgaaccgctgatcaacgagatggaagaggtgataggtaagacccgtgatgaaatcctctcaggggtctcgaagcaggaagtggaaaccttgctccacttaatccgtaaacttgaacaaaatatcctcgatctccaggctaaagattaa

SEQ ID NO: 2348 - DNA, 1257 bp, Klebsiella pneumoniae
ccacaaaattatctttcatttaccacctcgttattcaataacacccagactggcgttgaccgccgttcgaattttgttaactcccaggccatagataacctggacatggtttcctttaatcagcacgctgctcccgccgctctctttcaacagcgtctgctggataagggcggggtcccgcacatcaacccgcagacgggtaaaacagttgcccaccgcacagacattctctttccctcccagcccggcaatcaccagcgcgcctttatccggatgctcgctattagcctgttgcgaatgctcatcttcggctgcggtttcgcggcccggggtgagcagccgcagacgggtaatacagaaggtgccgaccaggtacatggtcgcggtttccagcagaccgagggcgacaaacaccggccagcgcgtcgcgctgactcccgccgggaggttatagacgacgaaatcgatgagaccgttagtggcgcagaccctgacgtgaagcagccaggccagcatctggaaaaaaccgtccagcagggagtagataagccacagcaatggggcggtgaagataaagagaaactcaaaaggttcggtgatccccaccaggacggaggtaacaatcaaggggatcagcgtgactttcaaccgctgcttattctccggtttcgccgtacggtagaaggcgagcgccatgccggcggtgccaaaaatcttcaccatcccataggtgaggaaacgggcggaatcactgagcgcgtcaacggggtggcgggcgatttcggccaggaaaataggcttagcgccaatgacggtctgaccatcgatcagcagctgaccgccgatagaggtaaaaacgaacggcgaccagatcagatgatgcagcccggtggggatcaggaaccggttgagaaagccgtacaggaagaccccgatggcgccaaaggatttcataaagccggtcagcgccgagatgcccagctccactaccggccagagatagacggtggcgatggcgaacatgccaaccagcggcagcatcacgatcagcaccagcttactgttgccgtagatcgacagcgcgccgcgaaactcaatcccaaccacgcgattatggacaaaggcgacagcgcagccaaggataatcccaaggaatacgcccatatcgataacctgaaaaccgaagataaaggtttgtccgctgccgtacagttgcgcgttggtggttccggtcgccaggcgatgggtgagggttag

SEQ ID NO: 2349 - DNA, 945 bp, Klebsiella pneumoniae
gccaaaaattacgtatactcagagcacttttttattgaggaagcggttatggttcagcgtattgctatggctccccaggggccggaattttcacgttttgtgatgggctactggcgtctgatggactggaaaatgtcgcctggcgagctggtcagctttattgagcagcatctcgatttaggcgtaaccaccgtcgatcacgccgatatctatggcgattatcagtgtgaggctgcctttggcgaagcgctgaagcgagcgccgcatctgcgtagccggatggaaatcgtcagcaaatgcggtatcgccacccgggcgcgcgctgagaacaccattggccactacattaccgaccgcgatcacatcgtgctcagcgccgagcaatcgctgcgtaatctggcgacggaccatctcgacttgctgctgatccaccggccggacccactgatggacgccgacgaggtatccgaagcttttctcgcgctgcatcatagcggtaaagtgcgccattttggcgtctcgaactttacccccgcccagttcaccttgctgcagtcacgtctgccgtttaccctggccaccaaccaggtcgaaatttcaccggtgcatcagccgctgctgctcgacggtactctcgatcagctgcagcaactgcgtattcgtccgatggcgtggtcttgtcttggcggtggtcgcctgtttaacgaagagggcttccaggcgctgcgcgatgagctggcgcaggtggcgcacgagcttaacgccgacagcatcgaacaggtagtttatgcctgggtgctgcgtctgccgtcgcagcctctgccgattattggctcgggcaaaatcgagcgcgtgcgctcggcgattgtggctgaaaaactcagcatgacccgtcagcagtggttccgcatccgtaaagccgcgctcgggtacgacgtaccgtaa

SEQ ID NO: 2350 - DNA, 861 bp, Klebsiella pneumoniae
aacgaaagttacaggggcgctatgcaacaactcgatgaacgactgaaagggcaatacgcctcgctgtcgccgcaggagcagcgggtggcggatttcatctttgaccactttgacgacctgataagctacaacagcgccgagctggcgcagctgagcggcgtgtcgaaagccaccgtcagccggctgtttaagcgcctcggttacgacaaatataaggatatgcgcgatgaactgcgcactctgcgtcagagcgggatgccgctcaccgaccagcgcgacgcggtgcagggtaacacgctgctggcgcgccattataagcaggagatggcaaacctcacccagtgggtcaacgccctcgacgcccgccagttcgctgaggcgctgacggcgatggtggccgcccgccgcattgtggtgattggcatgcgcaacgcctatccggcggcgctgcatctgcgccagcagctgctgcaggcacgcggccaggtgctggtgctgccccagccgggtcagagtctcagcgaagagctggtcgatctgaccgccgatgatctggtggtaatgatggcgtttcgccgccggccgcgaatagtacgcccgctgctgcagcagctgcagcgcgacggggtgccggtcctgttaatgtgcgagccgcaggcccacagcctgtttccgctctcccgctggcagctctgcgcgccgctggacagcgtctccgcctacgatagctatgcctcggtcaacagcctgattaatctgctggccaatgcctttctccatgaaacgctcgacagcggccgtccgcgcatccacgatatcgccacgctttaccagcagctggacgagctggaacaacgctga

SEQ ID NO: 2351 - DNA, 555 bp, Klebsiella pneumoniae
ttcattgtctattttttaatttgtatgacaaatatagccgccagcagtaatttccccaggatgacgacgatggcaaaaacagatgaggtggtgagcgcgaaaatgatcccggtggtgcaggggattgttgactggatcgaagcacatattttcgacaccctgtcggtgagcgcgattgcgaaaaagtccggctactcacactggtacttccagcgacaattcgccatggtaacgggctgcacgctggcgagctacgtcagccgacgaaagatgacgattgcgacaatctatttaacgcagacgcaggcgtcgatacagagtatttctcagtgcctgggatacgagggacaagccgctttctgccggacctttcaccgtcactttggcatgtcgccgacccgctatcgtcgtgatacgccgggcaaagagagcaatatgcaatatcccttgcgggtggggatggagatcgagcaggagaggcggtctgccgccgcagcggcagaccgggatcagcgaatggttttcggcgtcatgacgcgacgagcgccgacataa

SEQ ID NO: 2352 - DNA, 255 bp, Klebsiella pneumoniae
aaaggggcctacaaaatggcctacagccagcaggagaatgcgctgtgggtcgccacatcacagagtcgttcgctggacaaaggccgggtggtttaccgtcttgaacccaccaccctcgacgtgacgcacattattcccaacgatctgaagccgttcggcgccactattcaccatgcccaccggcaccctggtggtttggcaataacgtcaacagcacttgtcaccgctattgaaccccaaaaacgggcacggtga

SEQ ID NO: 2353 - DNA, 777 bp, Klebsiella pneumoniae
ggcgcagttctggcagatgggcctcaacgccgcggcggagacccgggcgtgacggcgccgggtattgaggtccgtggcctgagcctgcatgtcggcgaccgtcggctgttcgacaacctgtcgtttacggtccccggcgggcagtgggtgtcgctgctcggcgccagcggcaccggcaaaaccagcctgctgcgggtgatggccggtctggcgcccgccacccgcggagaagtggtcgccagcgatgggcaaccgattcagggtcgtctggcgtggatggggcagaaagatctgctctacccctggctgagcgttcgggacaacgtcgccctcggcgcgcggctgcgcggtgaaaaagtcgatcgtgcccgggtcgccgccctgcttgaacaggttgagctttcatcctgcgccgacgcccgcccggcgactctctccggcggcatgcgtcagcgcgccgcgctggcgcgcacgctgtatgaggatcgccccatcgtgctgatggatgagcctttctcggcgctggataccctcacccgtacgcggattcagaccctggcggccaccctgctggctggtcgcacggtggtgcttatcacccacgatccgcaggaggcctgccggttgagccaccgcctgctggtcctctcggcggccgacggcgacattgatgatagccatcacctcgccggcacacctccgcgcgcgccggacgcgcccgatctcctgatcggccaggccgccctgctgcagcagctgatgagggcccaaccatga

SEQ ID NO: 2354 - DNA, 189 bp, Klebsiella pneumoniae
catcaattatacagaattgtggtgtatgttattattcagttaacaaacgcagtacctacgctttcccatcgtactatccttgagaaacagcattcttttcaggtgacgccatgcgattcacgcttcgtcgccggggttgttgtacgcctttttcggctagcgacagccagaacagagcagcaggagtaa

SEQ ID NO: 2355 - DNA, 1110 bp, Klebsiella pneumoniae
tttatgtctctaaaacaaatatggcaagcagcaaatcctaaaggacatctgctgaccgctatctcgtttctgatccccattgtctgtggttctgggtttattatcgccatcggtatggggcttggcggaacggtgcaggacacgttaactccgggacaatttgatgtatggcaggcgatggccaccctgggcgccaaggcgcttgggctgttgccggtggtgattgccgtgggaatatccggctcgattgctggcaagccgggcatcgcaccaggatttgttgtcgggctggcggcgaacaccatcagcgcaggctttatcggcgggatgatcggtggctacattgccggctatatcgcgctggcgatcattaaaaacgtcaaggtgcctgactgggctcgcggtttgatgccaacgttgatcgtgcccttttttgcctccattatcagctgcctgattatggtctatatcattggtacgcctatcggtatctttacggaagcgctgacatctttcctgagaagtatgggcacgtcatcgaatcttgtgttgggcgcagtgataggcgctctgtgtattgttgactttggcggcccgcttaataagacatgctttgccttcgttctcacgctgcaggcgcagggaataaatgagccgattaccgcgcttcagttagttaacaccgcaacgcctattggtttcggcctggctttctttattgccaaactgctgcgtaaaaatatctataaccgtgaagaagtggaaaccttaaaatcagcggttccgatggggattgtgaatatcgttgagggttctatcccgatcgtcatgaatgatattgtgcgcggtatcgcggcggcggctatcggcggcgcgtgcggcggggcggtcaccatggtctatggtgcggatgcgacggttccttttggcggagtactgatgatccccacgatgtcacatccgatggcaggcatcatggccctgctggtgaatatcgttgttaccgccacggtctatgccgtcatcaaaaaagatatccctcgcgacgtgattgttgataatgattacgaagaagaggatatcgacctggatgatattaaagtgagctaa

SEQ ID NO: 2356 - DNA, 1113 bp, Klebsiella pneumoniae
gtccctcaatatccaatgaaaggttttaatatcatgacgctaatatcttcgacgcgcttttttaatggcgcactccttgccggggcgatggctctgatttcaacagaagttgcggtggcccagcctgcaccaggcacagcagattcttcaggccgtctggttcagacgtgggataaaactttcccaaggagcgaaaaagtggatcatcaaaaagttacttttaaaaaccgttacggcattacgctggccgcagatgtgtatcttccaaaagatcgcgggaacaagaagcttgctgcgcttgttatttccgggccttttggcgcggtaaaagagcaggcctcgggtctctatgctcagactttagcagagcgcggattcgtgacgctggcatttgatccgtcttataccggtgaaagcagtggtgaaccccgcaatattgcttcacccgatatcaataccgaagactttatggctgcagtcgattttatgggactacaaccttatgtggatcgtgaacgtatcggtgtcatcggtatctgcggcatgggggggattgccctgaacgctgttgccgtggataagcgcgtaaaagcggtcgttgccagcaccatgtatgatatgagccgcgtaatgtcaaaaggctacaatgacagcgtaacaccggagcaacgcgagcaggcgctggagaagatgagtcttcaacgctgggaagatgcagcaaacggcaaaccggcataccagccagcctataataaactgaagggcggtgaagcacagttcctcgtggactatgcggactactacatgactaaacgcggctatcatccccgagccgtcaactctggcaattcatggtccgtgacaacaccgatggcctttatgaatttcccgctcatgacctatattaaggaaatttctccgcgcccgatcctgttcatccatggtgaaaaggcgcattcgctttacttctccaaaacggcttatgaagcggcaaatcagccaaaagagctgctgattgtaaaaaatgctacccatgttgatttatatgatcgtatggacaagatcccgttcgataacatcattgcatttttcaacaaaaatcttaataaataa

SEQ ID NO: 2357 - DNA, 1449 bp, Klebsiella pneumoniae
ctacttgaatataaaaaattattttatatggcacgtttaatgctcttcgcttgtataccgcaatgtggacaagaacgtatgccatatggccacaacaggtcgccagtctgcggtcgcaaccttcccctttctgtgaggcatccagggtggatgcgtttcacggaagcctgcttactgaaaacggagaacaacatgacgacactcagcgaaccgttggttaccccgaaatatggcaaatggcgccagctggtgctgggcctgatctgtatggccgccatctccagtccgcaatatgtctggacgctgttgacaaaacccctggccgccaaacttggcgtcggtctgccagaattgcaggtcaccttctcgctactgatcatcctgcagaccttcttttccccttttcaggggcggttagtggaaaaatttggcccacggcggctgatcgctattggcacggtgatggcgggaatgagctgggtgctttccgcgcaggtgaatggcctggcaacgctctggctggtttatggctgcatgggcggcctcgggaccgggatcgtctacatcggcgttgtcggcctgatggtcaaatggttcccacagcagcggggattcgccgccggcgcggtggcggcgggctacgggatgggggccatcataaccaccttccccatctccctgtcgctgaccactaacggccttgaacacacgatgacgactttcgggatccttttcgccctcgtcggcttcctcgccagtcaggggctgaagctgccgccgcccgctgtctcccagcccgtcagtcagacggtggtgcagagcagcagatcgtttacttcccgggaaatgctgcgccagccgctgttctggctgatgttcgccatgatggcgatgatgtcgacttccgggctgatggtcacttcgcagatggcggtgttcgccgaggatttcggcattagccaggcggtggtgtttggcatggcggcgctgccgctggcgttaacgatagaccgctttaccaacggcttaacccggccgctgtttggctttatttccgaccgcttcggccgcgagcaaaccatgtttatcgcctttgcgctggagggggtagcgatgatgctctggctggcgtgccgggaggatccgctgctgtttgtcctgctctccggggtggtgttctttggctggggggagatcttctccctcttcccgtcgacgctcaccgatacgttcggcagcgagcatgccgccagcaactatggctggctgtatatttcgcagggcatcgggtcaatctttggcggtccgctggcggcactgctctatcagcacactcacggctggcatgtggtcttcagctgcgcgattggccttgattttgtcaccgccgccctcgcgctgtgggtgctaaaaccgtggcgcgcgcgctttatccgccagcatagctaa

SEQ ID NO: 2358 - DNA, 213 bp, Klebsiella pneumoniae
cgacctgaatattcttcgcagcaatcttttaataagattcatcatagttatcggatcatcctggtaatgatgtctgtaataccctcattcgatgcctgtcctgctgtaaccgtctcagacttcagaaataatgcctatcagaaagtacatcattcacagcttatgtgtataaaggtccgaataatacgccagttcagaaacataaggacatga

SEQ ID NO: 2359 - DNA, 1401 bp, Klebsiella pneumoniae
agcatgactcttcaacacttcaccatcgccgagatccagcgtgcgctgcacgatggcgaactgagcgcccgggagatcgcccgccagacgctggacgatatcgcccgcgtgaatccgcagatcaacgcctggaccgaggtcaccgcccagcgcatgctggcggaggccgacagcatcgacgccctgcgccgggaaaagcgccccttgccgccgctggcagggattccttacgcagtgaaaaatctttttgatgtcgccgggcacaccaccctcgccggcgccgaactgctgagcgatcggccgccggcagccagcgacagctgggcggtgcgccagctgcacagcgccggcgccctgctcagcgggatgctcaatatggacgcctacgcctacggctttaccaccgaaaacagccactatggcgcgacgcgcaacccgcacgatctgtcgcggatcgccggcggttcttccggcggttcggccgcggcggtggcggccgggctggtccatttcagcctcggcagcgacaccaacggctcgatccgtgtccccgcgtcgctgtgcgggatctttggcctgaaacccactttcggtcgcctgtcgcgctctggcagccatccgtttgtcgccagtctggatcatattggtccttttgcccgccgggtggccgacctcgccgcggtgtatgacgccctgcaggggcgcgacccggccgatgactttcaggctgataaagccagcgagcgcaccggcaacctgctggatcgcggactggaggggctgcgctgcgcgcggctggggggctatttcaccacctggtgcgatgacgacgcccgggcggccgtggatcgggtcgcccacgcgctgggcgccgacagcgagctacagttcgcggatgccgccctggcccgctcggcggcctttatcatcagcgccagcgaaggcggcaatcagtacctgacggatcttcgccactcgcccgagcgctttgaacctcactcccgcgagcggctgctggccggcgcgatgatcccctccgcgtggtatctgcaggctcagcgttttcgccgtcatgctcgccaggcaatgaaatccctgttcagccaggccgacgtgctgatcgccccggccaccccatgcagcgccacgccaataggcgcggaggagatggtgattaacggccagccgctgccggtgcgcgccagcatgggaatgctgacgcagccgatctccttcctcggcctgccggtggtgaccgtgcccctgcgtaccgccagcggcaagccgattggcctgcagctgattgccgcgccgtttaacgaacaagcctgtcttcgcgccgcgcgggcgctggaagcgatgggcattaccgatgcccgagtggcggagagtgcagcatga

SEQ ID NO: 2360 - DNA, 519 bp, Klebsiella pneumoniae
tcagaggtgtatatgacggatattgaaaattatcacaactggcttcgcgatgcgcatgccatggaaaaacaggctgagtcgctgctggtggccaccatcagacgcctcgataatgaaccgcagttacgcacccgccttgaacaacatctctatgaaacccgacggcaattgtccgccctgcaggatatcatcgcccgcaaccatatttcccgctccgcgctgaaggatgcgatgagccgggtggcggcgttaggacagaccattggcatcatgctgcccggtgatgaggttattaaagtgattatcactgcctacgtttttgcccattttgaggtcgcctgctataccgctttattaacggcggcgaaaagagtaggcgaccacagcgcgatgcatacactggagggtatcctggctgaagagagaggaatggctgattggctgctccattatctgccagcgctgaccgggcaatatcttatggataccgatatgcctggcgttgaggccgggcattaa

SEQ ID NO: 2361 - DNA, 1455 bp, Klebsiella pneumoniae
atgccaattcaatttcttacaccaattattcaaccagcgttcaaccgcaatgctggttgtgggagtgatatgatgacggataaagtccgtattgatactttacgtgccgatttattagacgcaaacaacgaaacctttttggcccgtcaggccgaattcgaatcgaatgtcaggagttacccgcgtaagctgccgctggctatcactaaagccgaaggcgtgtggctgacggatgcggataacaaacagtacctggactgcctcgcgggcgccggtactctcgctctgggccataaccaccctgatgtattgcagagcatccaaagtgtcattaccagcggcttgccgttacatactctcgatcttaccaccccgttaaaagatcgcttctccgaatacctgctctcttgcctgccgggcgaagggaaagaatattgcctgcagttcaccggcccgtccggcgctgacgccgtggaagccgcgctgaagctggcgaaaaaatacaccggtcgtaccgcggtgatcagcttctccggcggctatcacgggatgacccacggcgcgctgtccgtcaccggcaacctgtcgccgaaagcggcggttaatggcatgatgccggaagtccagttcatgccttacccgcacctgtatcgttgcccgctgggcatcggcggcgaagccggcgtgaaagccctgacctactacttcgaaaacctgatcaacgacgtggagagcggcgtccgtaaaccggcggcggtgatccttgaagccgttcagggcgaaggcggtgtgaacccggcgccggtcgagtggctgcagcgcatccgcaaagtgaccgaagagcacggcattctgctgatcgtcgatgaagtgcaggccggctttgcccgtaccggtaaattcttcgccttcgagcacgccggtattcagccggacatcatcgtgatgtcgaaagcggttggcggcgggctgccgctggcggtgctgggcattaaaaagcagttcgacgcctgggaaccgggtcaccacaccggcaccttccgcggcaaccagctggcgatggccaccggcctgaccaccctgcgtcatctgcgcgacaacaagatcgccgacaaagtcgccgcccagggcgagtggctgaaaggtaaactggccgagctgcagaaacgctacccggtgattggccacgttcgcggtctcggtctgatgatcggtatcgaaatcgtcaagccgaacgaagcgcaggatcacatgggctgctacccggctgacggcgaactctctgccctgctgcagaagaaatgcttcgaagcgggcctgatcctcgagcgtggcggtcgtcacggctgcgtgctgcgcctgctgccgtccctgctgatcagcgacgcggagctggacgtgttcctcgacaaatttgaacaggccctgctggccgccggcgtaaaaccggtctga

SEQ ID NO: 2362 - DNA, 387 bp, Klebsiella pneumoniae
cgctctgttcatgacggcagcaccctggataaaaactgccgggtacgcggatgctgcggatggttgagcacctcgtcgctgctgccctgctcgacgatcctgccgtcgaccataaacaccacctggtcggccacctcgcgggcaaagccaatctcatgggtgaccaccaccagggtggtgcccgatcgcgccagcttcttgatgacatccagcacctcgcccaccagctccggatccagcgccgaagtgggctcatcaaacaggatcacccgcgggttcagcgccagcgcccgggcaatggcgatacgctgctgctggccgccggagagatgccgcgaccaggcgtcggctttattgcgcagtccgacgacgtccagcagttcatag

SEQ ID NO: 2363 - DNA, 1311 bp, Klebsiella pneumoniae
gttttgtctcaacgcggtttttacggtatttcaatatttatgaacgggatcacaaacatatttcttcgtggggtcaggatagtgagcaaaatgctcgcgctgctgctgctgaccgcatggctgagaccctgtgcggcgcaaggcaatgagctggtgatggcgacgacattttctcccagcgccaccgtgtggattatcgatcgctggcagcaagagccggggtcggtgatgataaggacgctcaaccgcaccagcgcctcgctggaacagttgcttgatacggcaaatgccgaaaatgtcgatctgatcctgacttcgtcgccgatgctgctgcagcatcttcaggagcatcaaaaactggcgccgttcagcggtgcgccggcaggcagccaacatctggtgccggaatccattcgctccacctccgtggccgtggcgatctccgggttcggtttgctgatgaatcgctcagcgctgatgacccggcatctgcctgcgccagcggactgggatgacctgaccgatccccgttatcagggggcgctgctgatgagcagtccgtcgcgttcggataccaaccatctgatggtggagtcgctgctgcaacaaaaaggctggattaaaggatgggaaacgctgttgacgacggcgggaaacctcgtgaccatttcatcccgcagctttggggtggcagataagattaaaagcggcctgggcgtggctggtccggtgattgataattacgccaatctgctgctgaacgatccgcacctggcttttacctatttcccccagtcggcggtttcgccgacctatgtcgcagtgcttaaaaacagccagcacgccagcgaagcgcggcggtttattcgctatctgttaagtccggagggccagacgatcctcgccgacgctaataccgggaagtatccggtaacaccgctggcgccaggcaatccacgggcggcgcagcaggcgatgctgatgaatcaaccgccattaaactatcgattgatcctcaaacgtcagcgtttggttcagcggatgtttgatacggcgattagctttcgtcttgcccagctcaaagacgcctggcgagcgctgcatagcgcggaggtccgtcttaagcgtccgctgcccgagatacgggcgctgctcacccgtgtcccggtagatccggccagcagcgaggatgaagcctggctggctcagttcgacaacaaaagttttgcggaacagcagatgatggagtggcagctctggtttctcaacaaccagcggcaggcgattactaaactggaagaactgaaatga

SEQ ID NO: 2364 - DNA, 423 bp, Klebsiella pneumoniae
gcaactgctcaagaaggtcctgccgtaaaaataagaagaggtaagatgatgtccagacgtaataatgacgccatcactatccatagtattttgtcgtggatcgaggataacctggaatcgcccctgtcgctggaaaaagtgtctgagcgctccggttactctaagtggcacctgcaacgtatgtttaagaaagagaccggccattccctcggccagtacatccgcagccgcaagctgacggagattgcgcagaagctcaagcagagcaatgagccaatcctgtacctggcggaacgctatggtttcgagtcgcagcagaccctgacgcgaacgttcaagaactatttcgatgttccgccccacaagtatcgcataacgaatgtacctggcgaatcccgctatctacatccgctaaataactga

SEQ ID NO: 2365 - DNA, 294 bp, Klebsiella pneumoniae
acgcaatatcagcgagacgtgggtgaacggcgagcgggtgtggtgtcaggattgacccctcagccagtcccacttcctgaaaagaacgagaaaacgcaccataccttgtttgccaccttaacgcaggctaacccactacaggcggggcttattcaggcggcgccatctctactgcgccgtcgctcagagcagtcaaaaggcatgcgcgtcacccgattacgcccgtcattttttgccgcatacagcgctttatcgacgcgggaaaacagttgttcaaccgtttcgccgtcatga

SEQ ID NO: 2366 - DNA, 732 bp, Klebsiella pneumoniae
aggaaggatctaattatgtattataggaatttcatcattacctcaatcgaggcggagcgtattctggccatgaaatttgatgaagcatttgctggagtaaaaaagaatgttattgatacactgaatcaaatgggaaatggtataacccgtgcttcgtattatacttcctgcttaatggataattatcaggatgtttgttctaagttaaagcaagaggacacaagatttattgcagggctggcgcagttagttaatagccgtgatatcattttccaaatgattaaaatatatatagaaacctactttcaaaataaaaaagaagaaaaagctcaatatattctcaagaagcttgtcggcgcgggagtttacatatcatcttcaggattaactaatcgtattttaataatggcagtagcaaccatgatttgccagacttccaggtttaatactgttgtatatgggcgtatcaacagggcaaggtcattagtccttaaagggagtgtaactgctaccgcagtggtattaaacgtgtatggattgattcaggatgccgctaatagcgctgacaatttgaaaatgcataattcattttattacaatgcgttatacgctaaccatctggagatgatgtactttctcatcgaacctgtcatcacaggcgttccttatttaaatccgatgattatttctgatgatgaacttgctgaattacttattaaattaatgaggtga

SEQ ID NO: 2367 - DNA, 651 bp, Klebsiella pneumoniae
cgaccggatcatgaaataaccctgagtcacccgacgcccgcaggcagtccctgcgggccagaagagagcgctatgaccgcagatatcccagcagtacctgagtcgatcccggtaaccgacgcgctgacgctaatcgccattgatgagcgctacgttagcgacctgcaccagctggtggtcaaaaaccagcgctggctacagcagtcgctcagttggcccgccgaggtgcgtaacgaagacgagacccgccgtcatgtgcagggcaacgtgatgctgcatcagcgggattacgccaaaatgtttttgctgtttctcgataagcagctaatcggggtcctgtcgttcaatcagatcgagccgcagaataaaacggcctatattggctactggatcgatgaagagcaccaggggcaagggctgctttcccgttcattacaggcctttatccgccattatgccgccagcgggctggtgcgccggtttgtgatcaaatgccgggtggcgaacacccgcagcaaccaggtagcgttgcgcaacgggtttgttctggaaggctgtctccgacaagccgagtatctgaacggtagctatgacgatcagaatatctacgcccgcattattgaccgcgatgaggcattaaagcgcgcctaa

SEQ ID NO: 2368 - DNA, 294 bp, Klebsiella pneumoniae
acgaatcgtcaccggcggcgttttcgtgctttacccatcattaccccgggctataatgtgcccacttttattcaggagtcatacgttggacagtcacccttattgcgattttccggcaagctaacgcgatcatttcgctgcttgccgtcccggcgggcagcaatctctcagttccggattgcctccctcaataatttatgcgccattgagcgcgagaggcagcgttatgtttatgttttccagacccttatttcctccaccatcatccaccggctaaccgcccggcgcggctga

SEQ ID NO: 2369 - DNA, 1434 bp, Klebsiella pneumoniae
gacgtaggtcatcgggccggactggctgccgaccggcagacgcgatttccagatctctttgccgttcgcggtatcaaaggcgcgcaggtagaaatcctgggtgccggcgaagaacagcagtccggactgcgttgccagcgatgcgccaagggtcggcatgccgattggaattggcatgtgcatacggatccccagcggcccggtgtcttatacggtgccaaccggcacctgccacaccagtttcccggttttcagatctaccgcggacatggtgccgaacggcggcttctggcacggaatgcccagcggcgacaggaaacgttcgcgcatcgcgccaaacggcgtgccttccatcggcacgatgcccatctcgatcccgctggcgtctttcgccaccttcgcgcgcggcaccatatagttggccaggcccagacgcatatcgttgacaaacatcaggctgttgtttggatccagcgaaacactgccccagttcatgccgccgagcgagcccgggaactgcagggaacggtcttcacctggcggggtaaagacgccctgatggcgcatctctttgaactgaatgcggcacagcagcaggtcgatcggtgtcgctccccacatatcggactcggtcaacgtctggttgccgatcatcggcatccctaccgagtaaggttgcgtcggcgagtagcgttcacctttgacgttgcccgccggcaccggacgctcttccactttggccaccggctcgccggtctcgcggttgagcataaagatcatgccctgcttgctggtctgcaccagcaccggggtggtgccgcccttgccgtcaggcagatcgtacagcagcggctgagacggcaggtcaaagtcccacagatcgtggtgtgtggtctggaagtgccagcgcacctggccggtggtggcatccacagccacgatagaggagctgtatttatcgtccagcgcggtacgttcgccgccaaagaaatctggcgtggcgttgccggtgggcagatagatcagattcagcttcgcgtcgtaggacatcgccgaccagacgtttggcgtaccgcgcgtgtaggtctgaccttccggcggaacaccggtcagcgctggattgcccggatcccacgcccatgccagtttgccggtgtggacatcaaacgcgcggaccacgcccggcggttcgccagtggagtagttatccgcgacgcggccgcccaccaccaccacattgcccgccaccagcggggtggaggtctgctgatagtaacccgctttcacttcacccatgccgacgctgaggtcgacaataccgccatcgccgaagttttcgcacagtttgccggtatcggcatcaatggcgatcaggcgggcgtcgatggtcggcaggaacagacgacgggaacaggcggccggctgcgtgcctga

SEQ ID NO: 2370 - DNA, 1197 bp, Klebsiella pneumoniae
agggagttccagtttatgagcaagatgatgcatgaccagccttctgctgccgtacccgcttcccgggaccggcgcaattttctgatcgccggcgccggtctggcgttggccgcaaccacccttggcaggagcggcgccgtgatggcgaaaccggctggtcaggacacgcctaacgccccttcggaagctgttccggtccagaaggaaaccttaaccacgcgtaaactcggctcgctggaggtttccggcatgggactcgggtgcctgccgatggtgggttattacggcggaggtccgcgcgatcgtaaagccatggtttcgcttatccgggcagccttcgaacaaggtatcacgttctttgatactgccgaggtctacggcccccatctcagtgaagaatttgtcggggaagcactggcccctgttcgcgatcgtgtggtgattgccaccaagttcggcttcggcgtggaggaggggaagcccacttcccttaacagccaccctgaccatatccgccgtgccgtagagggctcgctaaagcgtctgaaaacggaccacatcgatcttctttatcagcatcgccccgacccgaatgtgccgatcgaggatgtggcggaaaccgtgaaggcgttgatccaggagggtaaagtgaaacactggggactgtcggaagcgagtgccaggacaattcgccgcgcacatgcggtactccctgtgactgcagtgcagagtgagtatgccatgtggtggcgggaaccagagacgcggatatttccaacgctcgaagagctgggtatcggtttcgtaccttactgcccgactgcccgcagcttccttgccggagcagtcaatccaagccagcggttcgacagcaccgatcggcggcataacctgccacgcttccagcccgatgccctggccaaaaacatggtgctgcttgaattcgcgcagtcgtgggcccgtcgcaaaaacaccactccggttcagttcgcgctggcctgggtgatggcgcagcggccctggattgtccctatcccgggtacgacgcaatatccgcacctgatagaaaacagcggtgcaccgcaagtccggttgacggacagcgagctacgcgaaatcgatgcggcgcttgccaaaatcccattgcagggcggtcgcgccgatccgtttaccgaaagtcagtttgataaaagttaa

SEQ ID NO: 2371 - DNA, 333 bp, Klebsiella pneumoniae
tcaagcatccagttcagcgccggtgaggcatcgttctgctgccacgtcaggcagcaggcggcatccgggaacggattttccagcgccagcgcagtccactcgccgcgatctatccatggacgggcgaaatggctcggcaccatgccgacgcagagtcctgccgacaaacaggttgctgatgattcccagtcagggacgactaccctcttctggttatccagcaaccatgttgtccgtttaggcaacgagcgcgaggtatcctcccgcaccagcgacggccagttacgcaggacgtcgtcgctcaggggtccatccatctttgccagcggatga

SEQ ID NO: 2372 - DNA, 252 bp, Klebsiella pneumoniae
actacaacccatgttttttttgtaatttttcacagcgttacctctggtttctccattattagcaaacagcacgccttgcagactccctgcggcttcctgcaactgagcattctgaataagcgacggggcgataaagccgataacgcatcgttcagtatggaggcactatttcacaaccccagcggcctggcctcctgtatgaactcaatcagaaggcgaagcccggtcggcaattgccggcggcttgaataa

SEQ ID NO: 2373 - DNA, 1143 bp, Klebsiella pneumoniae
cgacgatgccagcagcgcgatggtggagcgccggagagtggtgatcatgatttccttgcctgtcatgttgttataattttatgtcttcgatcacaaataacacggccattacgccttgtacaggtcatcgcggtcgacgggcgcacttccgggcctgccaaaaataatgatctatcccggcggccgctttttcgctactttgattttgttcacaaaaattccaataacgacagaggcaggggtatgacgaggaaagatggactactggcgctgctggtagtggtggtgtgggggcttaactttgtggtgattaagctggggttgcacaatatgccgccgctgatgctggcggggctgcgctttatgctggtcgccttcccggcgctgctgtttgtcgcccggccagctattccgctgcgcctgctgctgggctatggcctgaccataagtttcggtcagttcgcctttctgttctgcgctatcggcctgggtatgccggccgggctggcctcccttgtgctgcaggcgcaagccttcttcaccatcatccttggcgccttcgtctttggcgaacgtctgcagggcaagcagctggcggggatcgccctggcgatctttggcgtgctggtgctggtggagggcagccttggcggggagcatgtgccgctggtgggctttatgctgaccctcgcggcggcgctcagctgggcctgcggcaatattttcaacaagaaaatcatgtcccaggcgagccggccgccaatcatgtcactggtggtctggagcgcgctgatcccggtgctgccgtttatgctggcctcattgttgatcgatggcccgcagaccatgctggcgagtctgcaacacatcgatctgctaacgatactgtcgctgctttatctggcgtttatcgccactatcgtcggctatggcatctggggatcgctgctggggcggtatgaaacctggcgggtggcgccgctgtcgctgctggtgccggtggtgggaatggccagcgctgcgctgctgctcggggagacgctgagcggactgcagctcaccggggcggtgctgattatggccgggctctacattaatgtctttggcttacgtttggtgcggcctggcatggcgcgcggataa

SEQ ID NO: 2374 - DNA, 792 bp, Klebsiella pneumoniae
cgcccccgccagaccgcagagcaccgccgacagcgtccataccagcagcttgaagccgcgcgggtcgtacccgcagaacatcagccggttttcggcgtcacgtaccgcggtgaggatccggccaaacttactctgcgccagcgccgagcccagccacagggtcagcaacagcagcaaaaccgtggccataaacagggtggcgcgggtgccggtggcggtgaccggaaaacccagcagcgtggtaaaaccggtgaagccgttattcccgccaaacccggtctcgttgcgaaagaacagcagcataccggcataggtcagggcctgggtcatgatcgagaaatagacccctttgatcttcgagcgaaaggcaaaccagccgaacaccagggccagcagaccgggaaccagcaccaccagcgccatcgcccaggcgaaatgctgcgtgccccaccagaaccagggcagctcgctccaggagagaaaagacataaacgccggcagaccgtcgcccgccgcctggcgcatcaggtacattcccatggcgtacccgccgagggcaaagaagatcccgtgccccagcgacagcatgcccgcatagccccagaccagatccagcgccaccgccacaatggcgtagcagaggattttgccgctcagcgtcagcagccagctcggcaccgccagcggatgggaggccggcagcagcgccaggaatggcatactcagcagccccagcaccagcaggatccccagccagcgcagaggccgcggcgcgcgctgcgccagcgttaa

SEQ ID NO: 2375 - DNA, 1326 bp, Klebsiella pneumoniae
tgcaacatacagaaacttttgattcataaaaaggcaaccaatacctcacattgcaccgatgcggtgcgtcatgagccatcgctgtgcctcaggcaggcggttttcctccctccggcgaactggtacgcaaattgctgtagtcagtcacaacatcgggagaaggagaaaaaaatgaaagcaatcgtgattggcgccggcatcggcggtttaagcgcggcagtggcgctcaaacagtcggggatcgactgcgacgtctatgaagcggtgaaagagatcaaaccggtcggcgcagcgatttccgtgtggcccaacggcgtgaagtgcatggcccacctcggcatgggcgacatcatggagaccttcggcgggccgctgcgccggatggcgtatcgtgatttccgcagcggcgagaacatgacccagttcagtctcgccccgctgatcgaacgcaccggcagccgcccctgcccggtctcccgggcagaactgcagcgggaaatgctggattactggggacgggacagcgtgcagttcggcaaacgcgtcacccgctgtgaagaagacgccgacggcgtgacggtatggtttaccgacggcagcagcgccagcggcgatctgctgattgccgccgacggcagccattccgcactgcgtccgtgggtgctgggctttaccccgcagcgccgctacgccggctacgtcaactggaacggcctggtggagatagatgaagcgctggcgcccggcgatcagtggaccacctttgtcggcgaaggcaagcgcgtctcgctgatgccggtctccgccggccggttctactttttcttcgatgtgccgctgccggcgggtctggcggaggatcgtgacaccctgcgcgctgacctcagccgctactttgccggctgggcgccgccggtgcagaagctgatcgccgccctcgacccgcagactaccaaccgcattgaaatccatgatatcgaacctttcagccgcctggtgcgcggccgcgtcgcgctgctcggcgatgccggacacagcaccaccccggatattggccagggaggctgcgcggcgatggaagatgcagtggtgctgggcgccgttttccgccagacccgagatattgcggccgccctgcgcgagtatgaagcccagcgctgcgaccgggttcgtgacctggtgctgaaggcgcgcaagcggtgcgatattacccacgggaaggatatgcagctcaccgaagcctggtaccaggagctgcgtgaggagaccggggagcgcattatcaacggcatgtgcgacaccatcctcagcgggccgctgggctga

SEQ ID NO: 2376 - DNA, 2208 bp, Klebsiella pneumoniae
cggcattcacaaaagcaaacggagcctgatatgagcacgtctaacgacccatccaacaatgcatccgccgggaagtgccctttccacgccgagacgccaaaacagagcgccggcagcggcaccgccaaccgcgactggtggccgaaccagctgcgtgtcgatctgttaaaccagcactccaatcgctccaacccgttgggtgagaattttaactacagggaagagtttaaaaagctcgattactccgcgctgaaggctgatctcagagcgctgctgaccgattcgcaagagtggtggccggcagactggggtagctatattggcttgtttattcgtatggcctggcacggcgccggcacctaccgcaccgttgacggtcgcggcggcgcaggtcgtggacagcagcgctttgcccccctgaactcctggcctgacaacgtcagcctcgataaggcccgccgtctgctgtggccggtgaaacagaaatatggccagaaaatctcctgggccgacctttacatgctggcgggtaacgtcgctctggaaaacgccggcttccgcacctttggctttggcgccggtcgcgaagacgtctgggaaccggatctcgacgtcgactggggcgatgagaaagagtggctggcccaccgtcatccggaaagcctggcgaaacaggccatcggcgccaccgaaatgggtctgatttatgtaaacccggaaggtccgaacgccagcggcgagccgctgtccgccgcggcggccattcgcgccaccttcggcaatatggcgatggacgatgaagagatcgtcgcgctgatcgccggcggccatacgctgggcaaaacccacggcgccgcagaaaccagccacgtcggcgccgagccggaagccgcgccgctggaagcgcagggtctgggctggcactccagctacggcagcggcgcaggcgcggacgccatcacctccggtctggaagtggtctggacgcagacgcccacccagtggagcaactactttttcgaaaacctgttcaaatacgaatgggtgcagacccgcagcccggctggcgcgatccagttcgaagccaaagacgcgccggagattatcccggatccgtttaacccggagaaaaagcgcaaaccgaccatgctggtcaccgacctgaccctgcgcttcgacccggagtttgaaaaaatctcccgccgcttcctcaacgatccgcaggcctttaacgaggcgttcgcccgggcgtggttcaagctgacccaccgtgatatggggccaaaatcccgttacctcgggccggaagtgccgaaagaagatctgatttggcaggatccgctgccggcagcgacccatcagccgagcgcggaagatatcgccagcctgaaaaccgccatcgccggcgccggcctgtcggtcagtgagctggtctcggtcgcctgggcgtccgcctccaccttccgcggcggcgataaacgcggcggcgctaacggcgcgcgtctggcgctggccccgcagaaagactggccggttaacgccatcgccagccgggtgctgccgaccctgcaggcgatccagcgcgcctccggcaaagcgtcgctggccgatattatcgtgctggccggcgtggtcggcgttgagcaggcggccgctgccgccggcgtcagcgtcaatgtgccgtttaccccaggccgcgtcgacgctctgcctgagcagaccgacgtcgagtcgtttgatctgctgcagccgctggcggatggcttccgcaactatcgccgtatcgaaggcggtgtctcgacggaaaccctgctgatcgataaagcgcagcagctgacgctaaccgccccggaaatgaccgtgctggtcggtggcttgcgcgtactgggcgcgaactacgacggcagcaaacacggggtgtttaccgatcgcgtcggcgtgctcagcaatgacttcttcgttaatctgcttgatatggctaccgtctggaaagcggccgatgataacgcggagctgtttaccggcagcgaccgtaaaaccggcgaagcgaagtacagcgccacccgcgtggatctggtgtttggctccaactcggtactgcgcgccctggcggaagtgtacgcctgcgccgacgggcagcagaagctggtgcatgacttcgttgccgcctggaccaaagtgatgaacctcgaccgcttcgatctgtaa

SEQ ID NO: 2377 - DNA, 333 bp, Klebsiella pneumoniae
cccttaccacaggacaccatcatgcagagctggagcagtaaagatttcaccgccgaccgcgcgtggggcgcgctggatattgccaatttttccggcaccaccgtgcgtctacactggaccgaccaaccctatatctggcacatcaatgatggtcaggaggtgtttgccgtgatggatggtcaggtggcgatgcatgtgaaagtcgacggcgaggagcagatcatcatgctaaacgccggcgatatcttctacgccggggtgggatgcgagcatgtcgctcacccgcagggggcggcgcgtattctggtgattgagaaagaagggtcggtctga

SEQ ID NO: 2378 - DNA, 1566 bp, Klebsiella pneumoniae
gcaattacacaaagaagaaaatcatttaattcagttagatacgacaacacaggcgtgataaatcctgactggggagatgtatttttatcttgtgtcgttcaacaaaataaagggactaccatgtcatttataacaaacctgaaccagcaacagagaaaacgacttcatcagatcaccttagtggccaccttcggcggcctgcttttcggttacgacaccggcgttatcaacggcgccttttcctcactgaagcagtacatggcgctgaccccaaccaccgaagggctggtaatgagcgttctgctggtcggcgccgcgctgggcagcgtgtttggcggcaaatttgccgattacttcggccggcgtaaatatttactctttctctcctttgtttttctcatcggcgcgttgctttccgccgcggcccccgatatcactaccctgctgattgcccgcgccctgctgggctatgccgtcggcggcgcttcggtcaccgcccccacttttatttcagaagtggcgcctaccgagatgcgcggcaagctgaccggcctgaatgaagtcgccatcgtcattggccagctggcggcgtttgccatcaacgcgatcattggcatcatctggggccatctgccggacgtctggcgctatatgctgctggtacaagcgattccggccatctgcctgttcgttggcatgtggcgcgcgccggaaagcccgcgctggctgatcagcaaaaatcgtcatgatgaagcgctgcatatcctcaaacaaatccgcccggcggaacgcgcgcagaaggagtacgatgacatctctaccctgatcaaaattgaagctggtaataagtacagcgcccagagcacctttgcgacgattgtcaaaacaccctggatcctcaaaattttgctggtcggcattacctgggccgcactgcagcaaaccaccggcgttaacgtcattatgtattacggtacggaaatcctgagtgccgccggtttctcagagcgtacttcgctgatctgcaacgtgctgaacggtgttttctccgtgggcggtatgctgatcggggtactgttccttgtcgaccgcttcaaacgtaagacaatcatcatctacggtttcgccattatggcaaccctgcatctgattatcgccgctgtcgattacaccctggtgggtgacctgaaagctaccgccatctggctgctgggcgcgctgttcgtcggcgtgatgcagggctccatgggctttattacctgggtggtattagccgaactgttcccgctgaaattccgcggactgtcgatggggatctcggtatttttcatgtggatcatgaacgcggtggtcagctatctgttcccgctactgcaggcaaaactgggccttgggccagtcttctttatcttcgccgccattaactatttagccattcttttcgtggtctttgccctgcccgagacctccaataaatcgcttgagcagttagaagcagagctgtcagcaaaccatgaagataaaaaatccactcgtctcaccagggaggttggttatgatcgataa

SEQ ID NO: 2379 - DNA, 936 bp, Klebsiella pneumoniae
caaacgacacaaggaatcatcatgccttatctgttactgacgctggcggctctgttctggggcgggaattatgttgtcgggcacgtgctggtgcagggcgtggatccgatcctgatgaccgaagcgcgctgggcgctgacggcgctgctgctgggcctcctctaccgacggcaaatcgccggcagtcgccacctgctgcgggcaaacgcgccagcggtggtggtgctaaccctctgcggccaggtcagtttcccgctcacgctctatattggcctgcaaaccacctccgcgctcaacgccgccatctatatgtccgccacgccgagcatggtactgttgattaaccgactatttttccgcgatccggtatcagggcgtaactggctcggagtggcttttagcaccctcggcgtgatgatcctcttatttcagggaaatccgctgcacgccgcctctctgcacacctttgccatcggcgacctgtgggcgatggggtcggcgctgagctgggcgctctactgttcgctgttacgtctgaaggaccgccgtatcccggcgaatggctttgtcgccgtcagctcgctgctcggcgccctgatcctggtgccaatcgtcatcttctggctgatgcgccacccggcgcaggactgggcagcctggcgcgagccgtttttcctcagcggcctggcgtatctggtaattttcccatcgtggctggcatacctgttctggaacaaaggtatcgccaccattggcgccacgcggggcgaaatttacacccacatcatccccctctccggcggggtgttgagcatcctgttcctgcatactcaaccgcaggcctggcatctgtttagcgcgctgttcatcatggtggggattgggatctgctcgctggagaaacgccaggcggcgtctatttgtctgcgtgactaa

SEQ ID NO: 2380 - DNA, 1020 bp, Klebsiella pneumoniae
aagccaaaacataatgaggtcactatgtctgtgatggttattaccggtggaaccgcgggagcgggcaaagctaccgcgctgcgtttcgcccgcgctggatatcacgtggcgctgatcgcccgagacgaaacgggtttacaggagacgcgacaggcctgtgaacggtttggcattaaaacgctggctattagcgccgatgtcgtcgatgccggggcgctgcagcgcgccgccgccgaggtggaaaccaccctcggggcaatcgacgtctggatcaacaacgccatgaccaccgtgctggcgccctttcgtcagatgagcgaggaggagtttcgccgggtgacggaggtgacctatctcgggtacgtgaacggcacccgcgcggcgctggaggtcatgatcccccgggatcggggggtgattattcaggccggctcggcgctggcctggcgttcaatcccactgcagtcggcttactgcggagcgaaagcggcgatccgcggctttaccgatgccgtgcgaaccgaactgatgcatgagaaaagccacatccagttgaccatggtgcaactgccggggatgaacaccgcccagtttggctgggcgcgaaacaaaatggatcaggccatgcagccggtgcccccggtctatcagccggaagtcgccgccgaggctatttacagcgtcatccagcgcccggtcaacgagctgtgggtcgggaaaagcaccatccagtcgatcctcggccaggtcttcttccctcgcctgctcgatcggctgatggtgaaaaaagcgtgggagggacagtttaccggtcagccaaagtcgtcagaccaacaggacgacctgttcacgccggtgcgcggcaatcatccgggccacggcccctttaacgatggcgcacggcgtaaagcagtcaccatcagcgccgatctcccgggtaaagtcgccgccggcgtcggggtagcggtggcgacgatggcgctgcgggcgttgttccgtcgttccggaaaacggcgctaa

SEQ ID NO: 2381 - DNA, 1053 bp, Klebsiella pneumoniae
aagaaggaacaccgaatgaagtatgtgaatctgggtcgtagcgggttgaaagtctcccgtctttgtctcggttgtatgagttatggcgaacctgaacgtttgcctcaaccctggtccctggatgaaaaggcgtcacgaccgctcattcgtcaggcgcttgaagccggcattaatttttttgataccgcgaatatctactcgggcggtagttcagaagaaattacaggaaaagcgctgagagagatggccagacgcgacgagatcgttgtagcgacaaagaccttctttccgtggcgcaactcacccaataccgggtttctttcccgcaaggccatttttcagtctattgacgatagcctgatgcgcttaggcatggattatgtggatctctttcagattcatcgctttgactactccacgcctgttgaagagaccatggaggctctgcatgacgtcgttaaagcaggaaaagcgcgttatatcggcgcatcttctatggaagcctggcgctttgcaaaaatgcagcataccgctgagcgtaacggttggacccgatttatcacgatgcaaccgcaatacaacctgctttaccgggaagaagagcgcgagatgctgcccctgtgtgaagaccagggcgttggggtgatcccctggagtccgatggcacgcggcaggctcacgcgcgactggagtgtcacgtcccgacgaacgcaaaacgatgcctttgcgttaaaaatgtatgagaacgcagcccttctggataagcccgtgattgatgttgttgccagcattgccgaaaagcacgcggtgccaagagctcatgttgcaattgcctggctgttatcaaaatccgtcatcacagcaccgatcattggcgcaacgaaaccagaacatctttccacggctatcagcgcgctggacttttcacttagcgatgccgaaatcacggaactggaagctcgctatctgccgcaccccgttgacgggatcattcccccgcttccggatacgccgccttccctcacgccgccttcagcgatccagaactattaa

SEQ ID NO: 2382 - DNA, 1068 bp, Klebsiella pneumoniae
tatcagttgcataagcgaggcggtaagatgagcgatgcgatccgggtggggctggtggggttcggttacgccagcaaaacgtttcatgcgccgttgatcggcggcacgccgggtatggcgctgaaggcggtcgccagcagcgacgccgataaggtccatgccgattggcctggcgtgaaggtaatgagtgcgccgggggatctgctggacgacccggatatcgatctggtggtcatcgccaccccgaacgacacccactttccgctggcgaaagcggcgctggaggcgggaaagcatgttgtggtggataaaccctttaccgtgacactgtcacaagctcgcgagctggaaagcctggcgaagcactgcggtcggatactttcggtgtttcataaccggcgctgggacagcgatttcttaacggtcagcgcgttaatcaacgaaggtcagctgggggaggtgtgttacttcgagtcgcatttcgatcgcttccggccacaggtgcgccggcgctggcgtgagcaggcgggtcctggcagcggcatatggtatgacctcgcgccgcatctgctcgaccaggtcgtggtgctgtttggcctgccggtaagcatcacggtggacctcgcgcagcttcggcccggcgcgcaatccaccgactattttcacgccgtgctggcctatccgcagcggcgggtggtactgcatggtacgttactcgccgccgcggagagcgcgcgctttatcgtccacggctcgcgggccagctatattaagtacggccttgacccgcaggaggagcggctaaaaaacggtgaacggctgccgcaggaggactggggatatgatatgcgcgacggtaccctgacccgcgcggaaggggatgaacgtagtcaggagaaatggctgacgctaccgggtaattatcccgcttactatgccgctatccgcgacgcgcttaacggcgtaggggaaaacccggtcccggccagcgaggcgattcagataatgaccctgattgagttgggtatcgagtcggccagacatcgcgccacgctcagcctggtctga

SEQ ID NO: 2383 - DNA, 258 bp, Klebsiella pneumoniae
aaccggttgcacagttgcgaggcgggtcactgttttaacgcggagctacttcgtgtgcaccacatccgctggcggtggggactgatagttatctatatggtgtgcgataaccaaaagcagtgccgaaataccaaaaacaatccagccaataagttctacaatacgggtaaaaacagttgtcataacacttcaatatcctttgaacacagcgtgaaatgttactcgatggtcagcagatcacaaggggtatctgtctga

SEQ ID NO: 2384 - DNA, 762 bp, Klebsiella pneumoniae
ttgccacttttccaagggcagcgtcctcctgcccttattctcttcctcgtgaccggatcctcaattatgcagtgttataaagcggcttttatcctgagccttctcttttgcccgttcctggcgtctgccgccggggttgccattgccggcactcgtgtcatttataatgaacaaagccatgaggcagacatcacggtaaaaaacaccaatcctcacgatccggtgcttattcagagctgggtagacgatctggctgataataataaatcaccgtttatcgtcaccccgccattgttccgtctggatgccggagacagcaacgatctgcgcgtgttattaacctcggcgcaactgccaaacgatcgggaaagtttgttcaccctgaatatcaaagtgatccctgccaataccgcgccggctggcgagaacattctgcaatttgctattaagaatcaactgaaactcatttatcgcccggcagggctccctggttcggcgctcgacgcggcgcagcacctgcgctggcgggtcagcggcaaccacctgcaggcggagaatgcctccccctattatgtgactatcaccacgctcagctgcgcgggccagaaccagaaaacgccgcttgagcgcagcgtgattgctcctcacagccgtgaagagtattccctccccggcgaggcctgcgcccgcgaggtgagctggcgcattctggatgactttggcgctgtgcagacgtttagcgcccccgtttcggcgcactaa

SEQ ID NO: 2385 - DNA, 1107 bp, Klebsiella pneumoniae
tgcgattcgcagatatactttcgttatattttatttttcaaacggttggtgattttggtgaagagtttcgacgcggacggtagcccgaaagaaaaacgacgtaaaggaacgggtaagataaccctgaccgaggtggctgagtttgtcggtgtgagcgccatgaccgtctcgcgagcgctgagaatgcctgaaaaagtgaatcctgagcttcgcgatcgcatcgatgcggccgtcagtcaactcggctatgtccctaatctgcaggcacgtaatctggcctcggtccattccgatcttattctcgccgtcgttcccaccttctcttcgccgggttttttgccggtctctgaagcgctgcaaaaagtgctgaccgaacgcggatataccatgatgtttatggaatccgggcatgacggtcaaagtgaacaaaagacgtttgaaaaaatgctcgcctataacccggcggccattattcagttcaatatcgataccattgagagctgcacccagttgctggccaacgtggatgttcctattctggaaattggcgcgctaaatacccaccctgtgggtatgtgcatcggcgtggattacggtaaggccgtaaaacagctcgtgactcatctggccgacgcctcattaaaaaacatcgcactgctctgtaccccggctaataacacaatgtttcgccagttgctgagcggttggaatacggcgatgctcgctctgaaccgctccccgcaccgggtggtaaccacgcatttgccatccaccatcgccacaggcgtcaatatattcaaggatatgatgattacctggggcgatctggatgcgttaatttgcacgtcggatgaaatggcctgtggatgtatgatggcctgccacagtgccggcatcaaggtgcccaataccgtagccattgcgagtttaggcggaggagtgttatcgacagtctgttcccctgccctgacaaccgttgagtttccctggcatgacattggggtgaaagccggtaaagcccttctcgaactgcttaacgataagcctggtgaaaagttcattgaaattccgtcagtgctcaaagtccgggccagtaccgcggcatga

SEQ ID NO: 2386 - DNA, 1467 bp, Klebsiella pneumoniae
cccgcctcgcaactgtgcaaccggtttcagaaaccggttgcacatatgttcgcgcttttattacactccctttatcatcagacagggagctttttcatggccgcttttccgcacaatttcttatggggtgccgctaccgcagcgtatcaggttgagggaggacacgacgccgacggtaaaggaccgtcaatctgggatatctactctcatctgccgggtaccacctttgaaggcaccaccggcgatattgccgtcgaccactatcaccgttttcgcgaagacgtggcgttaatggccgagatgggcctgcaaagctatcgattctccatctcctggccccgcctgctgcccgccgggcgcggtaaggtgaatgaagcgggagtccagttttacagcgatctgatcgacgaactgctggcgcacaatattgagccgatgatcaccctctatcactgggatctgccgcaggccctgcaggatgagggcggctgggaagcgcgcactaccgccgaggccttcgccgagtacgcccgcctgtgctatgcgcgctttggttcacgggtgaagctgtgggctaccttcaacgaaaccattgtcttcattgggcacggctacattaacggcctccatcccccggcggtccgcgatccggcgcgcgccattcaggcctgccaccacgtgtttatcgcccatgcgctggcggtgaaggcctttcgcgagatggctgtggccggcgagattggcttcgtcaacgtactgcaaccgcataccccgctcaccgacagcgaggcggacattaaggccaccgaactggctgacgccatccatactcactggctgtacgatccggtgctgaaaggcacctatcctgccgacctgctggcgcagacccaggcgctgtggggggtacctcgctttgctccaggcgacgacgcgctgctccgtgacaaccgctgcgactttatcggtctgaattactatcgccgggaaacggtatctgcccagccgcctgagatcgctaccggcggcgagcctggcgtggagggattattctatttcgtgcgtaatccccagagtacatataccgaatggggctgggaaatctggccgcaggggctaactgacggcattatgatgattaaggcgcgctatggcgatattccgatatatatcaccgagaatggcctcggcgcgaaggacccgattattgacggggaagtggtcgacgacccgcggattgattatctcagcagccatattggcgccctcgaaaaagcgctggcgctgggggcagatgtgcgcggctattacccctggtcatttatcgatctgctgagctggctcaacggctatcaaaagcaatatggttttgtctatgtcgatcaccagcaaaatctggcgcggaaacgaaagaagagtttttattggtacaaatctgttattgccagtcacagcgaacagcgttaa

SEQ ID NO: 2387 - DNA, 819 bp, Klebsiella pneumoniae
atcaacccgcacgtcaagcgcagccgcaggaggccgttcatgcccagctctcataatggccatatctctatcaccggggtcagcaaatactatggccgccacaaggcgctggacgatgtgtcgctggagatccccccgggcacggtgacggtgatcctcggcccttccggctcgggcaagtccacgctgctgcgcaccataaatcacctcgaacgggtcgatgagggatttattcagattgatggcgactatatcggttatcgccgcaaaggcgacaagctgtatgagatgaaagaaaaggaaattcttcgccagcggatcaacgtcggctacgtgttccagaactttaacctgtttccgcacctgacggtgctggagaacctgattgaggcgccgatcgcccaccagcaggtcacgcgcaaagaggccattgcccgtgcctatgaactgctggacgtcgtcggactgcgcaataaagccgacgcctggtcgcggcatctctccggcggccagcagcagcgtatcgccattgcccgggcgctggcgctgaacccgcgggtgatcctgtttgatgagcccacttcggcgctggatccggagctggtgggcgaggtgctggatgtcatcaagaagctggcgcgatcgggcaccaccctggtggtggtcacccatgagattggctttgcccgcgaggtggccgaccaggtggtgtttatggtcgacggcaggatcgtcgagcagggcagcagcgacgaggtgctcaaccatccgcagcatccgcgtacccggcagtttttatccagggtgctgccgtcatga

SEQ ID NO: 2388 - DNA, 348 bp, Klebsiella pneumoniae
gccagcccgcaccatgatgcgccggacagtttctttgccaagaaacagtccgtggagttcttcgagcttttcacgcgccagagtcggaccgaaatcagcataacgcgtcttgatcagttccagagcctgatctgcgagcccgggtggcaactggcggttaccacgcatgccacatcgtctgctggccataccaagcggtccgccttcacggtaacgggcaagaagtctgcggcattgcctgtcgctgataccgaggtgctcggccgcacggcgcgttgtgatgcgacgttcaatgacgtcctgtataatcttgatccggttgatctctttcaaagtaaacactcctga

SEQ ID NO: 2389 - DNA, 651 bp, Klebsiella pneumoniae
cagggaaagcataatatgaacaaagccaaacgcctggcgatccttaccaggctgcgggaaaacgatccccaccccaccaccgaactgcatttcagttcgccattcgagctgctgattgccgtcctgctttctgcacaggccaccgacgtaagcgtcaacaaagcgacagccaaactctatccggtggccaatacgcccgcagcgatgctggccctgggggtggatggggtgaaatcgtatatcaagactatcggcctgtttaacagcaaagcggaaaacgtcatcaaaacctgccgcatcctgttggagcagcacaatggcgaggtgccggaagacagagcggcgctggaggcgctgcccggcgtgggccgtaaaaccgccaacgtggtgctgaataccgcctttggctggccgaccatcgccgtggacacgcacatcttccgcgtctgcaatcggacgcaattcgcccctggcaagaacgttgagcaggtggaagagaagcttctaaaggtggtccccgccgagtttaaggtcgactgtcatcactggctgatcctgcatggacgttatacctgcattgcccgcaagccgcgctgcggctcctgcctgattgaagatctttgcgaatacaaagataaagtctacgcctga

SEQ ID NO: 2390 - DNA, 726 bp, Klebsiella pneumoniae
ctccagaagcaacaaaacagggggacagacgaggtgaagttgagttcagggagcatcacaacaggtcgtacgagcgggctgctgacgctggcgattggcgcactcttctacagcagcggcagtattgcccggccggatcttcagccgctggggccgaacattgcggataaagggtcggcgttttaccactttacgcaacgccagtatgactctgccgatggcgaacgtcactaccgggtatggaccgcagtaccggacaaagccccgcccgccgccggctatccggtactgtatatgttggatggcaacgcggtgatggataaactcgacgacgcgtttctgcagcagctcttcgccggctccccgccggtaatcgtcgctatcggctaccagaccgcgctgccctttgataccgcagcccgcgcctgggattacaccccaccgctaaagacgcatgagcctcgcgccgggaaacccgcgctaccgccgcgtaaaaccggcggcaatgatgtttttcgccagctgctgaccgaaacgatggttccccagacggaagctaacctgaaaatagatccccaccagcgcgctatctggggccactcctacggcggattgtttgtgctcgacgcgtggaggaaggcttcgctgttcgggatctactattccggcagcccgtcgctaggtcaggcccctgcaatcgcctttgcaggcaagccaaagtcttga

SEQ ID NO: 2391 - DNA, 381 bp, Klebsiella pneumoniae
tgcgcagagcagccagatctgctggctggtgaggctcagggcatgtccaagggcgatcccctccgcggagataaatatccccagccccaccccggcatacagcaacggcgccccgtgatgatgccccatatgttccagcagccacagcgaacctgcaatcagcgttatcgcgctcagcgcgccggcgacggcgcgcagcgtaataatggtccacggcgagctcacccaggccagcagcgccaggctggcgatggtcaacccggcggagataatgctcagtcgggtggcggccccaggctgcacccgcgccagcagcaacgcgccgaccagatagccagcgtaattggccgacgcagcgagattgccttcgtgcagggttaa

SEQ ID NO: 2392 - DNA, 222 bp, Klebsiella pneumoniae
agggaatggcaaacaagaattaaatatatcgaaagcaggataggtaatttatatcaaagcggtatgtcgcatctgacgggcgatgaaacggcggacaaagaaccgcccgccacggggtcagaccgacccttctttctcaatcaccagaatacgcgccgccccctgcgggtgagcgacatgctcgcatcccaccccggcgtagaagatatcgccggcgtttag

SEQ ID NO: 2393 - DNA, 1629 bp, Klebsiella pneumoniae
gccattcggcaatttcctctcctgaatttccccagactactcctactcaatacgcgatatcaggagagacacatgaacagcacctccgccgacttccagaatctgtaccaggccctgagccacagcgccgcccgcagcccggatgccctggcgctggcgtttgaggatcggcgctatctgtaccgcgattttcatctgcgggtacagcgggcgatggcgcagcttgatcgcggctggtcgctgcgcaaaggcgaccgtattctgctggcctggggcaatcaccccgctttttgcgaagtcctttttgccgcgctgggtttgggcatcgaagtggtgcctttcagcaccaagcttaagcaggccgaaagcgaggcgctggtaggccatatcgctccccgggttgtcctgttcgatgcgaccgtgcaggactggctgaaaaacacccccgacgcgcgtgcggtttcactcagcgaatggcaggcgctctgccttcccgaaccgctgacccgcccgccggtcccggttaaccgcgacgatacggcggtgatgatgttcacctccggcaccaccggagagcctaaaggggcgattatcacccacaataacctgctctgcgcgattgacgcctatacgcaaaaactgaatctcaccgccgcggatagcaccatcctggcggtacctatctatcacatcaccggcctgtcggcgctgctggcgctgtttattagcctcggcgcgagcatctggctgcagcatcggttcaatgccccgcaggtgatcaccaccctgcgcgagcagaacattacctttctgcacggctcgcccaccatttttatccttctttgccaggctgcgcgtgagcagagcgccaaccatcccagcgattttccggcattgcgcacgattgcctgcggcgctggccacctgagcgatggactgatcaaggagttaaaaaccctgttcccgcataccgcgattcagccaatctacggcctcaccgaaacgacctcgcctgcgacgatttttccgggcgacgtctggggcagcgataaatgcggcagttcaggtcaggcgatcccgggtctcgccattaccatccgcaacgatcgccagcagcccctccccgccggacaaatcggccatatctggctaaaaggcgatgtggtgatccgcgaatactggcagcacagcgagcgacgcccgagctgcgatgcgcagggctggttttgtaccggcgatctgggctatctcgacgacgaaggctggctgtacatcaaagaccgcagcaaggacatgatcaatcgcggcggcgagaaaatttactcactggagctggaaaacattctctctacctatcggggagtacgggaagttgccgtcatcccgacccccagcccggtctacggcgaagagcccgtggcgtttatcgtgccggatggccagcatcacctgaccagcgaagagatcctcgactggctgaaggtcaaaatcgcccgctttaagctaccggcgcgcattattttcacccgtgctttaccgcgtacccacaacggcaaagtgagcaaacagcagctcaaaacgcgtctcgcagaatccatcatcacgctatcaacggaggataaaaagtga

SEQ ID NO: 2394 - DNA, 195 bp, Klebsiella pneumoniae
atcaggcggcatctcctggttagtttcggcagatcctacatacttcggcgaaggcgttctataatttgtaggatccctgacaaccagcgaggaggaaaaatgttaatgttgaacgttgttaacggtgaaaaagaagaggatgacgccactcgcgctccggaatcaggtgataaacaaccggagcgtgataaatag

SEQ ID NO: 2395 - DNA, 636 bp, Klebsiella pneumoniae
ctttatattaaattgacaaggaagtgcgatggctgggttgaggctgcgcaggttaagatggccccgccattgcccgtctcattgagaagaagagaagagatgaaattacccctgaccacgccccggctgctgctgcgccggttcagaacggaagatctgccgtctttcagccattatcgcaatctgccggaggtggcccgctttcagagctggacccactacggcatgacagaggcgacagccttctatgaacaacagcgttcgcaggcctttgctgaggatgagagctggttccagcttgccgtagagatccaggccaacggtgcgctggcgggagatgtggggatccacttcttagatcacggcagacaggccgagctggggatgaccttttcccctgcgtatcagcatcaggggtatgcccgggaagccatgcgggcggtgatggccttactctttgaacagttagcctaccaccggctgacagcggtggtagacacccgcaataccggcgcgatcaaactcctggaagggctgggctttcgtcgcgaggcgcattaccggcagaatatcttttttaaaggcgagtggggcgatgagtacctgtacgcgctgttgcgcagcgaatatcagtga

SEQ ID NO: 2396 - DNA, 672 bp, Klebsiella pneumoniae
caatcaattaacattagcaggcaaaccattcttcctgaggaacacaacaccatgtctaccacccaggttctcggcgaaacgccctatgcttcgccaggacaaccgcacgccagcttaaccggacgcattgatgcgctgcccgcctcatttgggttatggtcgtttattaccctgctctcacttggcggcttctttgagctctacgatctcttccagaccgggtatatcagcgcgggcctgctggcggagggcattttccacaccggacaggcgggcatcttcggcatcgccgaccaggcggccttcgcctccgccacctttatgggactgtttatcggcgccagtctgctggcgccgctggcggacaaactgggccgccgactgacctttatggtggcgctcgcctggtacggtcttttttcgctgctgatggcgacgcagagtagcgcggaaggggtgatcttcttccgctttctggtggggatcggcctcggcattgagctggtgaccattgatacctatctcagcgaatgggtgccaacccatctgcgcaataaagcctttgcctttgccttcttcatccagttcctctcggttccggcggtggcgctgatgtcctggatgctggtgccgaccaccctgttcggccctcacccgctggcgcttgggtga

SEQ ID NO: 2397 - DNA, 366 bp, Klebsiella pneumoniae
gaaagtactaaataccgcactctgtcgggcgtcgctgtttgccgatcaccacgcccgccggtccctgcggttcgccaacgctatatgccatcccgggaggaactggtgcacccgataattaaggtcatgctggtgggcggtaaggcggacgggctgttggtcagcgtcgccgatgacgcgaccgaggtctcggtgacgcctgcgcagtacggtgcgctatccgggcaaccgttgagctaccgaattgttagccaaaccattgacgatgaacgctatttttttggcgttttcagcgacgcccatcaggatagcgataagctgacgcgggtcgccctgacccgtggaatgaaaaaaatgttctgttaa

SEQ ID NO: 2398 - DNA, 204 bp, Klebsiella pneumoniae
tgcgcgcataaaccgcacaagggtttatcctttaccttcttgcatcagcttactcttcattgcctttatcccaccttagcgatagcgaataatgacatccgcttcactatgctgcgcatttcgccagtgaatactgacctcaccgcgattgtccggcatggcgtagcgaggacggttgtttgtcaaggcgacctgttccggtga

SEQ ID NO: 2399 - DNA, 189 bp, Klebsiella pneumoniae
ggatggaataatcctaatttaacgtcagcaataataacgcaacgctatcccccgaaatacgccaaggatcagtcggttaaggcataccgttacgcctacgattggccattgactgcgatgttgcgagtcatccagggtctgtcgccaggagaagctgacctattcttagagctggcccgttctgtctga

SEQ ID NO: 2400 - DNA, 1983 bp, Klebsiella pneumoniae
cgctgcgataaggctatgcttcccggccgttacgccgttggcttttccagtgattcaggtgatgtaccgctaatgccccttttgagagatgaaattcgcgaccactccgcggaagagatgctgtttatccgccgggccgcaattgcttttctgctggtggtggtctgctttggcgtgctgatcgttaacctctaccatctgcaggtggagcagcacgatttttaccagacccggtcaaaccagaacgacatcaaaatgctgcccatcgcccccagccgcgggctgatattcgatcgcaacggcattccgctggtgcagaatatcaccctgtatcgcctgcaggtgatcccgagcaaaattcccgatatggccgcgctgttgcagcagctgacgcctatcgtcgacctgacgccggatgacatcgccagctttcgcgacgatatgcaccacaccagccgctacaaagcggtcaccctcaagtcagacctcagcgatgtggaggtggcccgcttcgcggtcaacgaattccgtttccccggcgtgacggtggagagctaccaacaacgggaatacccctacggcgcagagctggcgcacgtggtgggctatgtgtcgaaaatcaacgacagcgatctgcagcggctggcgaaaaacggcgaagaggagaactacgccgccgaccgcaatatcggtaagcagggcatcgagggctattatgaaaaagcgctccacggcaccaccggctatcaggaagtggaggtggataaccacggccgggtggtgcgtctactgaaagaggtgccgccggtggccggaaaaaacatctatctgactctcgaccttcatctccagcagtatattgagtcggtgctgaagggacagcgggcggcggtggtggtggtcgacccgcgggatggcggcgtgctggcgatggtctccagtcccagctacgatcctaatccgttcgtcaaaggtatcggctatcaggcctataaatcgctgctggagaatccggaccggccgctgatcaaccgcgtcacccaggggctatatcctccggcttcgacggtcaaaccctatatggcgctgtcggcgctctccgctggggtcatcaccccgaacaccaccttcttcggggcgccgacgtggacgctgccgggcacgcaacgccgctaccgcgactggctgaaaaccggccacggcatgctcaacgtgactaaagccatcgaagagtcagcggacacctttttctatcaggtcgccttcgagatgggcattgaccggatccatgcatggctgagcaagttcggctacggccagtccaccggcatcgaccttaatgaggagtacgccggggtgctgcccagccgggagtggaaacagcgggtgcataaaaagccctggtatcagggggacaccatctcggtcggcatcggccaggggtactggatcgccaccccgatccagatggtgaaggcgcttaccactctgctgaacaatggtaaggtacaggatccgcatctgctctattcgatgaagcagggcaaccatgtggaacgttatcagcagccggcgaacctgccgcaggtgggtgacccgaaatccccgtactggggcattgtgcgcaacggcatgtatgggatggcgaatcagcccaacggcaccggctataagctgtttcatactgcgccgtatcagatcgcggcgaagtccgggacctcgcaggtctttagcctgaagcaaaaccagacctataacgccaaaatgatcccggtgcgtctgcgcgaccatatcttctacaccctgtttgccccttatcagcatccgaaggtggcgatggcgctgattctggagaacggcggcggggatggggtggtggccggaccgacggcgcgcgccatcctggaccatatttttgtcccgcagcaggcatcttcggcggcagccgatgtgccgcagcgtgacagcgccgatgcccagtaa

SEQ ID NO: 2401 - DNA, 1329 bp, Klebsiella pneumoniae
atgaaagataattttgtggtcaccattgccggcggcggcagtacttatacccctgggattgtgatgatgttactggaaaatatgtcgcgctttcccctgcgggagatccgtctgtatgacaaccatcaccagcgtcagaagactatcggcgacgcctgcgccatcctggtggctgaacgcttcccacaggtgaagttcagctataccaccgatccgcaggcggcctttaccgacgtcgatttcgtgatggcgcatattcgcgttggcctgtatgagatgcgggaaaaggatgaaaagatcccgctgaaatatggcgtgccgggccaggagacctgtggcccgggtgggattgcctacggtatgcgctcgattgccggggtgctggagctggtcgattatatgcagcagtacgctccaggggcctggatgctcaactactccaacccggcggctattgtcgcggaagcgacccgtcgcctgcggcccgacgcgcgcatcatcaacatctgcgatatgccggtggctatcgagggtctgttcgccgacatcctcggcctgccgtcgcgcaaagcgctgaacgttcgttactatggcctgaaccacttcggctggtggaccagcatcaccgataaagccggtaacgatttgatgccggcgctgaagcgtcacgtggcggagcagggatacagcagcccaaaagaagactttcagcataaggcgccgagttggatcgagacctttaaaaaggtgaaggatgtgtttgccctcgatccgacgacgctgcctaacacctatctgaaatactatctctacccggactatgaagtggcgcattccgacccggagtttacgcgggccaacgaggtgatggccggacgcgaaaaagaggtctttgatatggcccgggagatcacccgtcgcggcacggcggaaggcgcgcatttccatgccggggcccatgccacctttatcgtcgacctcgcctgcgccatcgcctttaacacccaggagcggatgctgttgatcgtcgagaacaacggagccatcgccaacttcgatgagacggcgatggtggaagtcccctgcctggtgggcgttaatggtccggaaccgctggcgatggggaaaatcccgtcattccagaaagggttgatggagcagcaggtggcagttgagaaactggtggttgacgcctggattgagggcagttaccagaaactgtggcaggccatcgccctgtcgaaaacggtgcccagcgcttcggtggcgaaagccatcctcgatgaactgatcgtcgccaacgaaggctactggcccgcactgcactga

SEQ ID NO: 2402 - DNA, 1641 bp, Klebsiella pneumoniae
cctctggataaattaaggatttttatgcgtatctctgtgattagcgcagcggtttgctgcgccctttttccgctcatcagcgtcagcgccgccggcttgagcgtggagcaacggctggcgcagctggaagcgcgcctcaatctcgctgaacagcaggccagcgaggccagccgccgcgcgcagcgggcagaacagcaaactgccgccgccgagcagcgcgccgcggcggcggagcagcaggtgcaggcgctcagccagcagaccacggctcgcgaacaaaaacagcaggccactaatcagcaactgagcgagcagctggcgaagcgcgccccggacgatgggtttacctttaacgcctacgcccgttccgggatgttagtcaacagccatggtaaaggcgcccgcggcgggccgggcgtctccccggccagttcgctcaacggcgatgcccatgtcggtcgtctcggtaacgaaaaagataattacgctgagctgagctttggcaaaaagctcaccttcaacgatggctcatgggcgcgcttcaagaccatgctcgccgacggggccaccaacccggatccgtgggttcaggataacgacagccaccatctgaacattcgtcagctgtacgtcgagatgggtaactttgccgaattcaccggtccgttaaaacgcgcctcaatttgggccggcaagcgcttcgatcgggataacttcgatatccactttaccgatagcgacatcatgttcctcggcggtaccggcggcgggatcaatgatgtcgactggggaagcggcctgcgcggcgactattcggtgtatgcacgtaacttcggcgaccttggcagcgataattacgcggataatgacatccagaatctgctgttcaccgccaaccatttttacggcaactggcaactgatgaccacggtgatgaccgcccagggcaacgatgacctgaaagataatacctcgaccaccgggagctatgccctgcgcagcgataacaccgccaaaaacggctactacgcgatgctggccctccacgacaaacagcagttctacggcctggcgccgggggtgtctgaaagcgccctgcaatacggcgtcgggctgggcgccgaagcgcgtcagccggggagcgatggcgatctgaccgagaacgcggcctccctgcgctttgcgtcgtatggcatcctgccgttggggaaaaactggcagctggcgccgtcggtgatagcccagcatagcgaagaccgctatcgcgacggcgaccgctacgactgggcgacgtttaacctgcgggtatcacaggggatctccgctcacttcgccctgctgtatgaggcctcgtggcagtatatggatctcaatccgaacgggcgcagctatcgctataatgacaacgtttatcagtatcaggcggtgcgcggtgatttctacaagctgaccttcgcccccacctttaaagtgggcgatgtgctggatatcaaggcgcggccggaaatccgcttctttgccacctggatgaactgggataaagcgctggatcgctacgcgataaatgacgatttcggcagcaaaggctttaccgccggtgggacatggaacttcggcgtgcagacggagatttggttttaa

SEQ ID NO: 2403 - DNA, 1104 bp, Klebsiella pneumoniae
atcatgcgtaacacagataatggggtgattggaagcgaccagaccgcggtgatggccaggctggcgctggatgagttaattgaccagcttctgcacagcaacgcgctgtcgctgaagctgacggccaacccgctggtggccgacagagcctggcatctcactgagaatacctgcatccgcgccttctccgctgacgatccacaggccaaaaagcgtgcgcaccacgcgctgttcattctctatcagtcctggcttgccgacccgctctcgccagcggctgccaatcagtttcatccgctgctttccgggatcagaaattacatcgagtctgagtggctgcgggcggaaagcaaacgcttccaccaccagagaccaatgcttaacgccggcaatatcgtcaacgaactgcgcgccttatgccagcagcacccggcgtctcatcatccgctgttcgatttccttgccagcgaggcctctgcggcgcaaatcgactatttcttcaaaagcgacagcgccctcaatctgcttttcttcgatctggtggcgatggggctggtgggctcgctgccggaaactcgcgctgagattgcgcaaaatctgtgggatgagataggccagggcagcaccgagatcacccacgttaatctgtataaggatttactgaagcggcgaaatatcgccttaccggacaatcattttgcccatttgtacgagtggcaggggctggccgggtataacgcctttatgctgggcggcgtaaaccgtcagcattactacaaatcgctgggcgtgatggcgatgaccgagctgctcgacccgccgcagtatgaaaaactggtggcgggctgtcggcggattgggctttccgagcgcgacgtgcattactatgccgaacatatcacggtcgacatcggtcatgcggatggctggctgaacaatgtgattgtgccgattggtaaaaaacatccggcggcgatggaggaggtcttctttggcgccgcgctgcgtctgcaaacctgcaacgattactatgatggtctgctggcggccctgcagtcgctgggcggcagcttatcatctcacagcgtaccgccttctgagtaa

SEQ ID NO: 2404 - DNA, 1734 bp, Klebsiella pneumoniae
ctcttgagtaagttgactatgagtacattactaattgcccatgcgctccacgtggagacggcttttgggccgctgtttaactccctctccttcaccctgaagaaaggcgaccggatcggtctcatcggccataacggttgcggcaaaagcaccctgctgcaagtgctggacggcaccctcgcgcccacctcgggcagcgtctcgctcgccggtcagtgtctgatggcccgcgttgaacagcatctgccggaggcgctgcatacgcagtcgctgctgcaggcggtgctggccccattacccgccgacgcgcgggaagcacagcgctggctggccgagcgcctgctggcgcagatgggctttaccccggcggtgatggagcagcagaccgccaccctgagcggcggccagcacacgcgtctgctgctggcccgggcgctgatccgccagcctgatctgctcttgttggatgagcctggcaaccatctcgatctgcccaccctgctgtggctggaaagcttcctgcaaacctggcaggggagcttcgtactggtgtcacacgacaacaccttactggatgctgtaactaatgcgagctggatcctccgcaaccagacgctacattgcttcgccttgccctgcagcgctgcccgtcaggcactgcaggagcaggatgaaagcgccgcgttacgtcataaggcggagcaaaaagagatcgaccgggtcagcgccagcgcccggcggttggccacctggggtcgggtctatgacaatgaagatctcgcccgcaaagccaaacagatggagaagcaggtcgcccgcctgaaagacgagcagaccgagctcagcgtcggcccgccgtggcgcctggtgttacagggggacgccctgccggccgaccgccttttggagatggacacccttcccgtctcgcccgcgccgggcctgccatccctcttcaccaccggcgtggcgcgcctgcgcagcggcgatcgcgtggccatcatggggcgcaatggcggcggcaaatcgtccctgctgcgcctgctgtggcagcagatgaacgacgcatcacctctcccggggctgcgcctgcatccccggctgcaccccggctactatgaccagacgctggcgcagttgccggacgaggccagcctgctcgaggccctgacgccgtttgccccgtcggcggactcccgtaaacgggcgctgatcgccgccgggtttggctgggcgagacatagccagaaggtcagcaccctcagcggcggcgagcgatcgcggctgctgttcgttggcctgtcgctggcgcgctacagtctgctgctgctggatgaacccaccaaccatcttgatatggagggtaaagcggcgctggcgcagacgctgcgcgattaccccggcggcgtgctgctggtcagtcatgaccgccagctgattagcgaaagctgtaaccgcttctggctgattgacagcgccgggctaacggagtggcgcagcctggaggaggtctatgcccgtctgcaggccgtggcgcccgccccggacagtcggctcgctttgcagagtacacccgccggggctgacgatgatgaggaggcgctgctggcgcggctgattgacctggagcagtggctggctgacgacatggcccgcaagccaaaacatcaaaagccgtcactgcaggcacagtggcaagaggagattgcccgcctgcttaaccaactgacgtaa

SEQ ID NO: 2405 - DNA, 942 bp, Klebsiella pneumoniae
cattctggtaacctgtgcgcggccccgggggtgaacggcggggttcaaacgggaaagagaatggatattaagcaactcaagtatttgatcgcgctcgatcagacgcgccattttggccaggcggcggcggcctgtcatattacccagccgacgctctccatgcgcattcgtaacctggaagaggagctgaacctgacgctgatccagcgcggccagcgctttgaggggtttaccccggagggagagcggatcctggcctgggcgcgggcggtgctggccgctcatgacggcctggcggcagaggcggccatctgtcgcgggcagatggtcggccagctgcgggtcggtatggtgccgctggcgagcctcaatccgatgcagttgattaaacccctggcggagaaatatccggcgctgcagttcagcctgttgtcgatgacctcggagcagattatcgatggcgtcagccgtaatcagctggatctggggatctgttatctgcagcatctggatgaaggtcagttcaagattgctcgcttgccgcaaacccggatgggactgctgcacgataaacgccatttcgacttcagcgccgggacgccgggatgggagacgctggcgacgctgcccctcggctttctgaccaaggggatgtattaccgggaatcgattgaaatcagctttaaggccaaagggctaacgccaaggtatgtctttgaaagtgattcgacgtttcagattatccaggcggtgcaggcggggatctgctgcgccattatgccgcttaacaacggcctcgaagcgctaagcgataatcttgaaattctgccgatcgccgaaacccatgttgattcacagctggcgctgattatgcgccagcaggaaccagtctcgaccctggcggaaaaatgcttcgccgaggcgcaggggatatttggctga

SEQ ID NO: 2406 - DNA, 783 bp, Klebsiella pneumoniae
aaaaatggtaaggggagagcggtgattccaatagaacgacatcagcgtattttagccctggtggagcagcgtggggcggtaagcattaacgagctgacggagatcctcggcgtgtcccatatgaccatccgtcgggacgttagtaaactggaggagcaggggctgctggtcagcgtctcgggcggcgtacgcgccgtcagccggctggctgcggaacccagtcatctggtgaaaagcacgctgcagagtgaggagaaacaggcgatcggcgcgctggcggcgagtcatatcgccaaaaacagttgcatctatctggatgccgggactaccaccctggcgctggcgcgggcgatcctcgaccggaacgatctccaggtggtcaccaatgattttgagataacccagctgctgatcgatgccagtcagtgcggcgtgatccacaccggcggcactctgtgccgggagaaccgctcctgcgtgggcgaatcggcggcgcgtacgttacgccacctggctatcgatacggcctttatctccgccagcggctgggacagtcgcgggatattcacccctgatgagaacaaggttaccgtcaaggagaccgtcagccaggtcagcgcgagaagcatcctgctgtgcgacagttcgaaatacaatcaggtggccacgtttatggcgttacctctgacccggttcaccaccatcattaccgaccggcatctctccgatgccgccgccagtcatatcgcccggcacgcctgcgaggtgctacgagccggataa

SEQ ID NO: 2407 - DNA, 876 bp, Klebsiella pneumoniae
ggttgtggtaagaaaatgaagaacatcctcgccattcagtctcacgttgtgtttggccatgccggcaacagtgccgccgaatttccgatgcgccgtctgggcgccaatgtctggcccctgaataccgtacagttctctaaccatacgcagtacggcaaatggaccggctgcgtcatgccgccttcgcatttgacggagatcgttcaggggattgccgatatcgacaagctgcagacctgcgatgcggtactgagcggctatcttggctccgctgagcagggagagcatatcctcggtatcgtgcgtcaggttaaggcggccaatccggcggcgaaatatttttgcgatccggtgatgggtcacccggagaagggctgcatcgtcgcgccgggcgtggcggagttccacgtgcgctatgcgctgccggccagcgatattattgccccgaatctggttgagctggagatcctgtgcggtcatccggtcgccagcgtcagcgaggcagtggccgccgcgcgggagctgattgcccaggggccggaagtggtattagttaagcatcttgcccgtgcgggtctgagtatggatcgttttgagatgctgctggtgacggccgaagaagcctggcatattagtcggccgctggtggatttcggcctgcgtcagccggtgggcgtcggcgatgtgaccagcggtctgctgttggttaaattgctgcagggggcaagtctgcgcgatgcgctggaacacgtcaccgccgcggtgtacgagattatgctcgccaccaaaaatatgcaggaatacgaactgcaggtagtagcggcgcaggatcgcatcgccgtaccggagcactgcttcagcgccacccggctttaa

SEQ ID NO: 2408 - DNA, 966 bp, Klebsiella pneumoniae
cgcgagatcctgttgtgtggcctgctgttcggctttacgcgctttggcgcgggcgatggcggcttccaccgccgccttgcgcgggtcgaccggttcgacggccggggcttccaccggcgcggcctgctgttcggctttacgcgctttggcgcgggcgatagcggcttccaccgccgccttgcgcgggtcgaccggttcgacggccggagcttccaccggcgcggcctgctgttcggctttacgcgctttagcgcgggcgatagcggcttccaccgccgccttgcgcggatcgaccggttcggcggccggggcgtccaccggcgcggcctgctgttcggctttacgcgctttggcgcgggcgatagcggcttccaccgccgccttgcgcgggtcgaccggttcggcggccggggcttccatcggcgcggcctgctgttcggctttacgcgctttggcgcgggcgatagcggcttccaccgccgccttgcgcggatcgaccggttcggcggccggggcgtccaccggcgcggcctgctgctgcgctttgcgcgcccgggcctcagccttacgcgcttcgcgggcggcaatcgcctcgctgttgtcaggtttggcgccggcttggatcacgatcggctgcgcggcatcgcgctgtttatcccgtacccgggccagggcggcgctaatcgcctcctgatctttggcggcaggctgaacggcggcttttttatgccgttcggcgcgcgcggctttctcacgatcccaggcgcgcctgtcgggcctcgaatcgggctttgtcttccgcagcgcgctgctcttcctgacgaatcgccgcgatctcggcattttcctgacggaagtactgcaccagcggaatattacttggacatacccacgcgcaggcaccgcactcgatgcagtccgccagattatgggcagtggctttatcgtgctgctgacctttgctga

SEQ ID NO: 2409 - DNA, 1167 bp, Klebsiella pneumoniae
atgaaaatcaactttcctttacttgcgctggcgatcggcgcctttggcatcggtaccaccgagttctccccgatgggattgctgccggtgattgcgaaaggtgtggacgtctcgataccggtagcgggaatgctgatcagtgcgtatgccatcggcgtcatggtcggcgcaccgctgatgacgctgctattgtcgcatcgcgcacggcgcaatgcgctgatttttctgatggggatcttcaccgtcggcaacctgttgtcatccatcgcgccggattacaccacgctgctgctgtcgcgcattattaccagcctcaaccacggcgcttttttcggcctgggatcggtggtggcggccagcgtcgtgccaaagcataagcaggccagcgcggtagccactatgtttatgggcctgaccatcgccaacattggcggcgtgccggcggccacctggcttggcgaaaccatcggttggcggatgtccttccttgctactgcgggattaggcctgctggcgatggttagcctgtggttctccctgcccaagggcagcgcgggggaacgtcctgatgtcaaaaaagagctttctgtcctgctgcgcccgcaggtgctatccgcgttgctgaccaccgtgctgggcgccggggcgatgtttacgctatatacctacatttcgccagtgctcaatacgctgacccacgcttcatcgctgtttataaccgcgatgctggtgctgattggcgtcggtttttcgctaggcaactatctgggcggcaaatttgctgaccggtcggtttccggcacgctgaagggctttctgctgctgctgatggcgatcatgctggcgatcccgctgctggcgcaatcccaggctggggcggccatcagcatgattgtctggggcgcagcaacctttgcggtggttccgccgctgcagatgcgggttatgcgcgtagcgcatgaggcgccggggctctcttcttcggtgaatatcggcgcgttcaacctcggcaacgcgctgggcgccgccgccggtggggcggtgatctctggtggactgggctatgcgtttgtgccggtgatgggcgcgattatcgctggtctggcgctgctgctggtctggtttagcgggcgagcgcagccggaagaggctttcgccagccagtaa

SEQ ID NO: 2410 - DNA, 264 bp, Klebsiella pneumoniae
ggcagtgtcctgaaatcagggttcaccgcgagcaaatttaacccgttcaggtttaagccattttttaactgccacgacggcatcgctgcgcttgagaagtggtttgaagaaattggtacgccaacacgtcttgaacagctgaacatcaaggaagcagatctgcccgctatcgttgagaacgtccagatcaatgtcaaagcgtttggtatcgccagtgattaccggccgaaagttgtaactgaaatactcatgcatgttgtctga

SEQ ID NO: 2411 - DNA, 981 bp, Klebsiella pneumoniae
tgcatacccaaacgttcgctccagttaggtacttttatgttacaccatgatattcatgaaaagctactggcttataccgatagagaactcgaactgcttcgcgctaactatcaactgtgtcataaattcaaaagccatatggagcgaaggtttttcaaagacaactacattcatattgaaaagcagacccgatttactaaaattccgttgcattctcatggctttatcgagcttatttatatatatcagggtaaaatgcatcagaagattaatgaagaaagtctcactttaggtaagggtgagatcctgcttatcaaccagtttgccagacacgaaattgaagccgcagggcagaatgatattatcatcaattttattattaagaccgaatttttcggtcgactcatgtcactttttgacgaaaataacatcatttcccgttttatcctttcagcaattaatggcagaaaaaaacatggagagcatattcactttaaagtgggggaaatcgacgcaattcaaaacattatgcatgtcatcattagcgagatctacagtaataaccacttaaaagagatacgcgtcaatttcctggtgggactgttgatgaccgaactgctctcgaatgtgcaagccagcgattaccatatcaacggcagttacaatgaatcacttgctatggccgtgttgagatatattgataccgattataaaactgccagcctgaaagagatctcctgtcgtttaaatcagcctaattataaggtgagtaaactgataaaagacttcactggtaagaactttagcgatttgttggttgaaaaacgcctggatgtgttgatccatctccttaagcatactaatcactctattattgatgttattaatatgacgggttatgaaaacgcctcgcattgttataaggtatttaaagagaaatataatatgagtattaaggagtatcgtgatctgaactcctga

SEQ ID NO: 2412 - DNA, 1227 bp, Klebsiella pneumoniae
aattataacaacatgacaggcaaggaaatcatgatcaccactctccggcgctccaccatcgcgctgctggcatcgtcgttactgttgactatcggccgcggggccacactgccgtttatgaccatctatctcacccgacgctttcagctggaagtggatgtgattggctatgccctgtcgctggcgctggtggttggggtgttgttcagcatgggttttggcatcctcgctgacaggttcgataaaaagcgctatatggtgtgctcagtgctggtgtttattctcggcttcagcgcaataccgctggtcaataacgcccccctggtggtgatcttctttgcgctgatcaactgcgcctactcggtcttttccaccgtcctgaaagcctggttcgccgaccggctgacagcagagaaaaaagcgcgcatcttctcgctgaactacaccatcctcaacatcggctggaccgttgggccgcccatcggcaccctgctggtaatgcacagtatcaatttgccgttctggctggcggccgcctgcgccgcctttccgctggtgtttattcagctgtttcttcagcgggatggcgccgccgcggcccagccgggcgcagcgccctggtcgccttcggtgttgctgcgcgaccgggcgctgctgtggtttacctgctccgggctgctggcctccttcgtcggtggcgccttcgcctcctgtctctcgcagtatgtgctggtggtcgccagcagcgatttcgccgagaaagtggtggccgtggtgctgccggtcaacgccgcggtggtggttgctctgcagtacgcggttggccggcggctgagcgcgagaaatatccgcccgctaatgaccttcggcaccgtctgctttgtgatcggccttgtgggctttatgttctctggcgccagcctgtgggcgtgggggatctcggcggcgatcttcaccctcggggaagtgatttatgcccccggggagtatatgctgattgaccatattgccccgccggggatgaaggccagctacttctccgcccagtcgctggggtggctgggggcggcattcaacccgatgctgacggggttgatcctcacccatctgccgcactggtcgctttttgtcattcttatcgtggcgattgtcgccgcctggctgatgattttccgcgggatcaatgcccgcccctggcaaccggattctccgctggccaacgcctga

SEQ ID NO: 2413 - DNA, 1278 bp, Klebsiella pneumoniae
ccattgaacaagagcgcgacccgcgccatgccgcaggcagcctgcaggcggtcacggaaagtctgcgctatctgcgcgacgtcggattctgacaggaggcacgacatgattaacggtttaaaacctctcgaccgcaccctgcgctggggcatggtcggcggcggcggcagcagccagatcggctatattcaccgctctgcagcgctgcgcgataacaccttcacgctgctggccggcgcctttgatattgatgccgagcgcggacgccagttcggccaacagctgggggtggatcccgaccgctgttacgccgactatcaaagcctgttccgcagcgaggctgcccggcctgacggcattcaggcggtgtcagttgccacgccaaataacacccactatgccatctgccgggccgcgctggaggccgggctgcacgtggtgtgcgaaaagccgctgtgcttcagcagcgaggaagctgacgagctggtggcgctcagccagcggcggcgcaagattatcggggtgacctacggctatgccggccaccagctgatcctgcaggcccggcagatgatcgccgacgggctgctgggtgatatccgtatcgttaatatgcagtttgcccacggttttcacgcccagccggtggaacaggaaaacgccagtacccgctggcgggtcgatccccgcttcgtcggccccagctatgtgctgggcgacctggccacccatccgctgtttctggtcgaaaccatggccccgcagctgaagatcacccggctgatgtgcgccagacaaagcttcgtcaaaagccgcgcgccgctggaagataacgcccatgtactgatggagtatgacaacggggccatcggctcactgtggagctccgccgtcaactgcggttcgatgcacgggcaaaaggtgcgaatcatcggtgaaaaagccagtctcgaatggtgggatgaacagcccaaccagctacgctacgaaatccagggcgaacccgtgcgcatcctcgagcgcggtatggactatctcgatccgctggcgcgtcaggatgatcgcatcggcggcggccatcccgagggcctgtttgaggcatggtcgaatctctatcgccgcttcgccatcgccatggatgccgccgaccgtcgcgacgaggcgctgctggccgacttctggtacccggacgcccgcgccggggcgttcggcgtccgctgggtggaaaactgcgtgcgttctgccgacaacggcgcctgctgggtcgacttccgctaa

SEQ ID NO: 2414 - DNA, 864 bp, Klebsiella pneumoniae
gcgctacgcaaatgggaagcagtacgcgaccggtataagctgctcgctcattttcaggtcggggatactctcttgaatgagatcgttattattgcgctggcaggctttactaccggcattaccacggtgctgttcggcttcggcggcggctttgtggtggtgccctttgtctatcaactgatgctccggcagccggcgattgcgggcaacgccatgcatgtcgcggtggctacctcaacggcggtgatgatatttaacgccggctgggtcagctatcgaaactggcgggcgggcaggcttgccgcgcagacgctgtttccgttgttatggtttattgccattggggcggtggtaggctcctgtctggcggggatattgagcgagaatatcgttcgcgcgctgtttattctctatatgctggcaaccatcagcgattgtttgttgcgcaagggttttttcacgggcagcgctcggcgtcgcctgtccctgccagtggtcaccggcggcggtgtgattatcggtacgatcgccgcattgctgggcgtgggcggcagcgtcatgacggtgcccctgctacggcgacacgggtatgcaatgcaggagtgcgttagcgcatccaacccgctttctttacccgtggcgctatgcggggctgtgacctatgccgtcattggctggcacagcattccgctgagcggatttctggggtttatcagcctgaaaattttaggcctgctcgtcctgaccggctgggccgggatagtgtttagccgccgggcaatccctgcggtacctgatgtatggtatgcgcgcatctatgtgctgctgctgtgcctggtactcctcgccatgcttattcaataa

SEQ ID NO: 2415 - DNA, 1434 bp, Klebsiella pneumoniae
actgcgcgcaaagtcaccctcagagggctttactgggcgcataaccgactatacttggcgcgctcgcgcgtaattgcggtttctcggtgtctattttgctttcactttaaaccagcgttggggctgcacagcgttaagtgccgttccgcgccggcagtgggtcggtttggggcctgtatgttattaaaagagctggctgtttttgaggtcttaagcaccccgatatgggtagttcatccttttaacgaaagggtggtctatgccaatcaggcttcccggacattgagcggcgagatgtcgctcaatgagatgcgtaacggtatttattccacctgtccggaaacgcaactgcagcactaccttcgctatctcgacaccatgagcgagatattcgaagtctggacgttacccaccgccaatgggttgcagtcggtgtattgcaaaaccaccctgattgataccgaagactgtggttgcttgctgctgtttgaagccgtgaagctgctggcgcaaaatcagtcgattcataccggctcccgccgctaccagcggcgtaacaatggctttttcgctcgcttttttatgaccaataccgcgccgatgctgttgatcgaccctcataaagatggccggattgtcgatgccaatattgccgcgctacgtttttatcattattccgatgaggaaatgcgcaccaaacatacctggcaaataaataccctgggccgggacgttatccccattatgaataatattgccagtctgcctggcggtcataaaccgcttaattttacgcatattctggctgacggctcgctacgccatgtccaaacttatgccgggccggtggtgctgtataatattcgactgatgctatgcatcattcacgatatcaccgaagaagtgcatctgaaaaaagagctggaattttccgccgcccacgatccgttaaccggcttgcttaatcgccgggagtttcaccgtctggttgaggcgccaacttttatcccccggggttattgtctgctgttaatcgatatcgatcatttcaagagcattaatgatattcacggccatcaaaaaggcgatgaggtcctgctggtgctctctcgtattctggaaacgtcggtcgaccgcgaagataaaatttatcgctggggtggagaagagtttctgctttttttgccccattcgccgatcggccgcgcgctgatactggcggaggggatccgccaggcggttagcgaataccagacgctgtcggtgaccgtcagcatcggcgtagctgaacatcatgacggcgaaacggttgaacaactgttttcccgcgtcgataaagcgctgtatgcggcaaaaaatgacgggcgtaatcgggtgacgcgcatgccttttgactgctctgagcgacggcgcagtagagatggcgccgcctga

SEQ ID NO: 2416 - DNA, 1341 bp, Klebsiella pneumoniae
caaaagagcaactttctatacaaacaatttacacaagcggtgaccccagctcgctctgctggacgccgcgcacactcccggcaatgccgtcgggatagggatgacaagatgcacggctggacctcacgacagcgtaatgcggcgatagccagttttttaagctggacgctcgatgctttcgactttttcctgttagtttttttactgagcgatatcgcccactcgtttcatgtcgaccttgaggaggtcaccctggcgattctgctgactctggccgtgcggcccgtcggcgcgctaattttcggcagggcggcggagaagtttggtcgcaaaccaatcctgatgctcaacattgtgttcttctcggcttttgagctgctctccgccgccgcgccgtcgttgatgctgtttttcctgctgcgggtgctgtacggcgtggcgatgggcgggatctggggcgtggcctcttcgctggcgatggagacgatccccgaccgctcgcgcggcctgatgtccggcctgttccaggcgggataccccttcggctatttgctggcggccgtcgcctacgggctgctgtttgaacaactcggctggcgcgggatgtttgtcattggcgccgcgccggtgctgctgctgccgtttatctatttctgcgtcgaggagtctccggtttggcaggcggccaggcagaataaagagagtacggccctgctgccggtactgcgtagccactggaagctgtgcctgtacctggtggtgctgatggcggctttcaacttcttctctcacgggacgcaggatctttacccggtctttttgaaagttcagcacggcttcgagcctaaaacggtcagcatcatcgcggtctgctataacatcgcctcgatcattggtggagtgttcttcggttcgctgtcggagaagattggccgacgcaaagcgattatgatcgccgccctgctggcgctgccggtcattccactgtgggctttcgccagcggctcgctggcgctgggggcgggggcgttcctgatgcagtttatggtccagggggcctggggggtgatccccacctggctcaatgaactggtcccggccaacacccgggcggtgctgcccggcttcgtctaccagctgggtaatttgctggcttcggtgaatgccactctccaggcatcaatcgcccagcatcatgggcataactacggcctggcaatggccctggtggccgggacggtggcgattgtcattaccgtcctgaccttttttggtcgcgaaggccgggtgatccaatccgcaggagcgggacatcaccagccgctctccaccagccgttaa

SEQ ID NO: 2417 - DNA, 1221 bp, Klebsiella pneumoniae
ccaccgataaaacgccgcgcaaagcgcattaacgcaggagaacgtatgaagattgttatcgcgctggattcgtttaaaggtagctgcagcgcgcaggccgcttgcgcagcggtagcccagggattgcgccgggttgaccaaacgctggagctggtcgaaatgcccgtgtccgacggcggagagggactgctgtcgactctggcggatagtccgttgcttaagggggcggtgtggcaacagcagcgctgtacctcgccttacggtctctccgtgcaggcggatttcctgatcctgcccggcgagcgggccattatcgagatggcgcaaagctgtgggctcgaactcacgccgccagcgcagcgggatgtgcgtcaggccagcagctacgggctgggcgaacaggtaaaggcggcgctggacgccgggtgtcggcacttgattatcggcctgggcggcagcgcgaccaacgatggcggcatcggttttgcccaggcgctcggcgcacgattctggcgtaaggacggcaccctgctgccggctcccgcggcaggtcaggacctggcgcatattcagcgcatcgatttgagcggtctggacccgcgtctacagcaaagcgaaatacaggcctcctgcgatgtcactaaccctctgcttggcgagcatggcgccacctgggtgtatggcgcgcagaaaggcgcggacgaggcggcgctcagcgagctggaggcgggaatggcgcattatagccagctgcttacgcaaaccctcggattcgacgtcagcgagcggcccggcgccggggccgcgggcggtatgggggctgcgcttatcgcctataccggcgccacgctgcgtccgggcattgacctggtgctggagctgcttaacgccgacggccatcttcgcgatgctgcgctgacgatcgtgggtgaaggatggctcgatcggcagagcgcctttggtaaggccccggtgggcgtggcaggcaaagccgcacgccatggcgtgccggttgtggccctttgcggcgggcgtgatgagagcagccggcaattatatcaacaccatattgacgcaatgtggtctatttgccagcgccctatggcgctggcagagtcgatgaacacatgcgaaccgctcctcgccgacgccgcggagaatgttctacgaacctttctgagcgggtggcgcggagaggcacataagcggataactgtatga

SEQ ID NO: 2418 - DNA, 249 bp, Klebsiella pneumoniae
agtgggtcaaaacctctaccggctgggcgcccaccggcgccacggtggaaaaagtcagcatcatcgccgaccagcttaaaggcccgaatcgatatcaaaggcgccgggggcattcgcgatctgtccacggtgcgtgcgctgtaccagcttggcgtgcgccgctttggcatgagccatggcgcggtaaccaaggtgctggctgaactggagcagcacccggaacgttttcccgagctgaacgccaattaa

SEQ ID NO: 2419 - DNA, 966 bp, Klebsiella pneumoniae
  unsure (882): Identity of nucleotide at the above locations are unknown.
tcaattccaaaaataataaaagagaatcacgctatgcagaaaacaacactcttgctggccgtcgcgttggcatttagcgcctcatcgtggggtcaggacgtcaagatcaatggcaccggagtgagcctggaggccaacaaaacgccgattcatacagcgaaaaatccgcaggccattgccctgttgccgcaagctctgcatctggcggtgccggggaaattctccgtcgcggtggcggccctgaactctccgccgctgacggtctttgccgatgacaacaaaaccctgctcggcagcgaggcggatatcgcccggctggtggcggagagcctcgggctggaagtaaacgtggttcccacttcatgggaagactggccgctgggggtcacctccggcaaatatgatgccgcgatcagcaatattaccgtcaccaaagagcggaaagagaagttcgatttcgccacctaccgcaaagactcgctgggcttctacgtcaaaagcaccagcccgctgagcaagattgacaaagcggaagatatcgccgggctaaagattattgtcggctccggcaccaaccatgatgcgatcctgctggcgtggaacgcggacaacgtcaagaaagggctgaagccgtttatcccggtctacaccaaggatgatgccgcccagacgttgccctggcagaccggacgatcagacgccttcttcggccccaacgtgattggcgcgtggaaggcggcgctgaccggcaaaaccaaactggtgggcagcgtcgatggcggctggccaaaagcggcgcacatcgcggtaacgctgaaaaaagacagcgggctggtgaatgccgtccaggcggcgctgaacggggctatcgccagcggggantacgccaaagtgcttaaccgctggggcgaaggggtggaaagcattccgcaatcggaaatcaatccgcccggactgggcgactga

SEQ ID NO: 2420 - DNA, 672 bp, Klebsiella pneumoniae
gcgcgtaaaaagggactcatcagggcctccagctgtaggtgtccgacatttatagcctatttttccgcgccgaccgtcttttttgtgcgcttaacgttaaccgcacgtgcggcgctgcatcagcgccagcgccgtcagcatcaggaccagaccggtcaacaacgtcaggctggccatcgccatgccctgaccgacggaaccctgttcgaactggcgccagataaacaccgccacggtttgcgtaccggccggagagagcagcagcgaggtcaccagctcccgggaggccaccgcgaacaccatcagcatcgccgccagcagcgccggaaagaccagcggcaggacaatcaaccgcagcgcctgcagtggcgacgccccgtgcaccctggcggcgggctcaaggttcgggcccagctggcgcagcgcgctgccgacatagcgcaccggccagggcaacagcaggcagcaataggagagcagcagcatccacagcgtgttatagggcgagcgcggccagaagggctgattccacagcaggatcaaaccgacccccaccaccacgcccggcagcgccgccggcatcagcgacagcgcgtccaccatcccgcgccctttaatcttctgcaccatcaccagccaggcggccagcaggcccagcgcgccgacgattag

SEQ ID NO: 2421 - DNA, 1215 bp, Klebsiella pneumoniae
gtggtgaaaaatgcctgccacggtaacggatttatctcccggggcaagcataaattcacatgcccgcaacaattgccaacctcggctttgtatcacacagtatctcgcggcgcagcgctgacattaagagataaaaatggccccggtcgggcacatggcggatacaaatttccgctttactggtcacgtactctcttgatgacgataaaaggtgagaaaacgatgaacagattatccctgatccgctataccagcgccgtggcgctggggttatccaccctgtggtccgccgccgtttgcgccgctgaagacgcgggggcgttcgacaagatccagcagatccgcgccggcgacctgaatattggctacgtggatatcggcccgcgcgacggccagccggtgatcctgctgcacggctggccctacgatattcagagctatgcccaggtggcgccggctctagcgcagaagggttaccgggtgatcgtgccgtatctgcgtggctacggcacgacccgtttcctctccgccagcacgccgcgtaacggtcagccgtcggcgatggcggccgatattgtccatctgatggacgcccttaacatcaggcaggcggatctggccggttttgactggggcgcgcgcacggcggatatcgtcgccgcgctgtggccgcagcgggtgaaatccctggtctcggtgagcgggtatctgatcagcagtcagcagattggcgaaaaaccgctgccaccgcaggctgagctgtcgtggtggtatcaattctattttgccactctgcgtggggaggccggttaccggcaaaacacccacgactttgcgaaatttatctggcatcaggcgtcgccgcagtggcaattcagcgacgcgacctttgccaaaaccgcccgggctctggataacccggaccatgtggcgatcactatcagcaactaccgctggcgcctggggctggagaaaggggaagcgaagtatgccggctatgaacaacggctggcggcgctaccgccgataaccgtgcccaccatcaccctggaaggggcgaataacggcgcgccgcatccggctcccgccagctaccgtgccaaatttaccggtaaatatgagcaccgggatctgccgggagcggtgggccataacccgccgcaggaggatccgacggcgtttgtgcaggcggtggtggacgccgatcgtttgtaa

SEQ ID NO: 2422 - DNA, 639 bp, Klebsiella pneumoniae
catacagaaaactgcagccacgaggagtcacgcatgaaactgttctacaaacccggcgcctgttcccttgcctcgcatattgccctgcgcgaaagcggtctggattttaccctgcagagcgtggatctggcccaaaaacggctggaaaacggggaagactatctgctgatcaacccgaaaggtcaggtgccggcgctgctgctggatgatgatatcctgctcactgagggcgtagccatcatgcagtacatcgcagaccaggtgccggatcgtcatctgctggcgccggtgggctcgattgcgcgctatcagactctcgaatggctgaactatgtggccaccgagctgcataaaagctttaccccgctgttccgcccggataccccggaggactataagcctgtcgcgcgggggctgctggagaaaaagctgcaatacgttgatgcagcgctggcagacaaacagtggctgaccggccatcgcttcaccattgccgatggttatctgtttacggtgctgcgctgggcctatgctataaaactggatatggctgcctatggtcatatcggcagctggatgacgcaggtggcagcgcgtccggcggtggcggccgcactggcggctgaaggcttaaaataa

SEQ ID NO: 2423 - DNA, 918 bp, Klebsiella pneumoniae
actacggaaaaaccgaagggaaaggagggcctgatgcgactggatctggccgatctgcggctatttatcgctatcgtggataccggtagtatcaccggcggagcggcgaatgcccatctggccctggcgtccgccagtgagaggctgcgcaagatggaggccgagatcggcgtgccgctgttgcaccgtcatgcccgcggggtgacgatgacagaggccggggaggtactggcgcgccatgcccgcccgcttcttgcgcagcagcagcgtctgcgccaggcgatgcacgccttcgcctgcggtcagcgggggacgctgcgcctgttcgccaacacctcggcgatgtcggcctttctgccggggaagctcgccgcctggatggcagcgcacccggcggtgcagatcgaaaccgaagaacgcaccagcgcggatatcgtcagctgtatcctggcgggcgtggcgcaggccggagtggtgtccgatgcggtcgaccccgggccgctgcgcctcgatcccgtcgctgacgacccgctggtgctgatcgtgccgccagctcgccctctggccgaaaaagaggaagtggcgtttgcggcggtgctcaacgagccgttggtcgccctctatcagaccagtgcgctacagcagcatatcgaacagcacgcagctgaactcggccaggcgctaaacgttcgggtcaggatgagccattttgcagggctttgcgagatggtggcgcacggcgccggcggggcgatcctgccgcgcgttattgccgagcgttaccggcagcgctattcgtttgccgtcatcgggttacaggaccgctgggcgcagcgccgtttgtgcctgtgctaccaggatgacgccagcctgtcgccagcgatgcgccgcttactggaatggcttcgtcagccttga

SEQ ID NO: 2424 - DNA, 282 bp, Klebsiella pneumoniae
ctgaaggaaaacagaatgaaaaaagtgcttatcgtgtgcggtaatggtttaggcagcagcttcatcgttgaaatgaatgtcaaaaagatccttgccgaaatgaataaagaagctgaagtcgcacataccgacctgacgtcggcaaaaagcgaaactgccgatcttattcttagcgccaaagacattgcagaacatcttagcagtcactctgcaaaggtcgttggattaagtaatttacttgataacaataaaattaaagaaattttagcagaaaacatttaa

SEQ ID NO: 2425 - DNA, 255 bp, Klebsiella pneumoniae
attaagcgaaaggagaacaggatggcacatctggatgaggttatcgtcaaagtcgatgacgccctggccgagggcgttatcgcgcatatgaatgagctgctaatcgccctgagtgatgatgcgcaactcagtcgtgaggaacgctatatccaacagcagcgtctgcgcaccgccatcgcccatcatgggcgacagcatcaggaagagcaggacgcgcgccgcgagcagttgaccaaaggcggcgcgatcctctga

SEQ ID NO: 2426 - DNA, 288 bp, Klebsiella pneumoniae
gtcaggcccctgcaatcgcctttgcaggcaagccaaagtcttgatgccgtccgctttcgcgggaaatcgctgtacctactcgagggtgacggtaaagtccgtggagagccgtccgggcacgaggcctcgcttgaggtgttgcgtcaaacccaacagcagcttgccagtaaagggttgaccgtagccttctggcgctaccccggcctgacacacggtcagatgttcgaggtctcgctgcgctcggcgctgctgcatctttccgggcaggcagcgcttgcgcatcagtaa

SEQ ID NO: 2427 - DNA, 192 bp, Klebsiella pneumoniae
caaatgatgaaggaaaaaagaggaattgtgaatcagcaaaacgccgggttattcttatttgtcgcttctttactcgcctttatcggccctcactcaaggatgtattgtggttatgcgttatattcgcctgtgtattatctccctgttagccaccctgccgctggcggtacacgccagcccgcagccgcttga

SEQ ID NO: 2428 - DNA, 708 bp, Klebsiella pneumoniae
cgtctgccgaaaaaaaactgcatttacagggatctctctatgcgtactcgcgttttactgaaagtcgccgctctggcgggaatattggcgttgaccggctgtgcggcgaaagtggcgcaaccgaatcagtattcgggcttcttaaaagattattccagtttgaaagaaacgacctctgcctccggcaagccggagctgcgctggatcgatccgaacttcaatccggccaactatgacaatatcgtttatcacccggtgacctactatccggtaccgaagccgaccacccaggtaggagagaaggcgctgcaggatattcttaactacaccaacaaagagctgaaacaggctatttccgagcgtaaaccgctggccactaccgccggcaagcgcagcctcatcttccgcggggcgatcaccggggtggactccagcaaagaggggctgcagttctatgaagtgatcccggtcgctatgattgtcgccggcacccaggccgccaccggccatcgtaccatggacaccgatctgtactttgaggcggaggtcattgacgccagcaccaataagccggtcatcaaggtcgttcgtaaaggggaaggcaaaaccctggcgaatgagaatacaccgctgaccgtcgataccctgaagcaggttatcgatgatatggcggtcgacgccgttaaattcgatccctctcagcgttaa

SEQ ID NO: 2429 - DNA, 1539 bp, Klebsiella pneumoniae
gcgccgacgaagagcagcgcgggatccgcgtgcgcgccaaagagtaagcggcattatcggccccgggcacgctactgcccgggccagatattgcactcgaaaacgaagaattcaccctgtttctttcatcctgaatcctgcaggagggaccgactcatgcaaaaaacgctctcgacgctcaaagacaaaatcaataatgccttagttgtcgaccgtgaaaatcatatttaccgttgccaccgctctatatttaccgacccgcagctgtttgaatttgaaatgaagcatattttcgaaggtaactgggtatttctcgctcatgaaagtcaaattccccagccgggtgattattataccctgacgctgggccgccagccggtcattattacccgtgataaaaagaatgaattgcatgcattaattaacagctgcgcccaccgcggcgccatgttatgccgacgcaaaaccgggaataaaaattcgtttacctgtccgtttcacggctggaccttcagtaataacggcaaattattaaaagccaaagatgagagcaccggcggctatccgccgagctttaaacaagacggctcccacgacctgcaaaaattgccgcgttttcagtcttaccgcggtttcttattcggtagcctcaaagccgacgtgcagccgctggaggcctatctcggggaaacctgcaagattatcgacctgatcgtcgaccaggcgccggaggggctcgaggtactcaagggttcgtcgagctatgtatatgagggcaactggaaactgggcgcggaaaacggcgccgatggctatcacgtcagcgtggtgcactggaactacgcctcaaccatgtcacgccgcaattatgaagcggaagggacgcacgcggtggatgccaacggttggtcaaaaagcctcggcggcggctatggatttgataacggccatatgctgttgtggacccgggcgctcaacccggaagtgcgcccggtctatgcccaccgcgaacggctgcaggcggaatttggcgaacgccgtgccgaccagatggtcaacgaaacccgcaacctgtgcctgtaccccaatgtctacctgatggatcagttctcgacgcaaatccgcgtgatccgccccattgcggtggataaaaccgaagtcaccatctggtgctttgcgccgaaaggggaatccgaccaggccagagcgctgcgaatccgccagtacgaggatttctttaacgtcagtggaatggggacgccggacgacctcgaagagttcagcgcctgccagcgcggctttctcggcgaaaatctgccatggagcgatctcagccgcggcgcgctgcgctgggtcgatggcgcggatgagcatgcgcaacatgccggcttttcgccgcggttaagcggggtgaaatcggaggacgaagcgctgtacatcgcccatcaccaccactggcagacgctgatgctggcggccattgaacaggaacaacagcgttacgaccagtccattacccagcgcgtggaggtggcctga

SEQ ID NO: 2430 - DNA, 1590 bp, Klebsiella pneumoniae
ccagaggagaacgacatgaacgcattgcgtctcgtgagtgtgttggcgctattgctgaccttgctgccatggcgggcgcaggccgcggaggcggacgacttcgttgccgccagtcgcagccagcaggcgcagctgttgacccagtgggcggcagcgccgcaggcggatcgtctgccgctgctgcgggcgttgaccaccgagagcctggtgatggacgacggaaaacatgctttccgcacccgacagggcggattacagccattgggcgctgtcgccgcgccgcagggcgaaacccggccggtccgtctgaccaaccggctgcgcaatctggctgccggcgcgctggccagccaccttattttaagtgacaacgtcacggagagagcttccgccgcacgaacgctacagcgggaagcgactccggccatggccgcgctgctgcaacagcggctgcaggcggaaaccgatgataatgtgcggggtctgctggaggtggcgctggcgcgcctgcagctcactcagcctgaggccagcgcgcggctggccgccgtgacgctgctcggccattccgcggacccggaaacccaggcgctgctgatcccctttaccgatgcccagcatgagccggatgcggcggtgcgcgaggcggccagcgatagcctgcaaaagatcaaacatcgtctgctgctcggcgatctgctgggccaggcctttatggggctgtcgctgggctcggtgctgctgctggccgcgctggggctggcgatcacctatggcctgctgggggtgattaacatggcccatggcgagatgttaatgatcggcgcctacagctgctggctggtacagcaggcgctggcgcagctcgcgccgcaatggctggccttttatccgctggtcgcgctgccggtggcgtttctggtgaccgccgggatcggcatggcgctggagcgcaccattattcgtcatctgtatggtcggccgctggaaacgctgctcgccacctgggggatcagcctgatgcttatccagctggtgaggatgttgtttggcgcgcagaacgtggaggtggcaaacccggcctggctctccggcggcgtgcaggtcctgccgaacctgatcctgccgtggaaccggctggcggtactggcgttcgtcctgctggtgctgtgctttacctggctcatcctgaaccgcacccgtctggggatgaacgtccgcgccgtgacgcagaaccgggcgatggccgcctgctgcggcgtgcctaccgggcgggtggatatgctggcctttggcctcggctccggtattgccgggctgggcggcgtggcgctgtcgcagcttggcaacgtcgggcctgaactgggtcagggatacatcatcgactcgtttctggtggtggtgctgggcggcgtcggccagctggccggcagcgtggcggcggcctttgggctgggcattttcaacaaaattctcgaaccgcaaatgggcgcggtgctgggcaagatcctgatcctggtgatgattattctgtttattcagaaacgcccacagggtctgttcgcgctgaaagggagggttatcgactaa

SEQ ID NO: 2431 - DNA, 954 bp, Klebsiella pneumoniae
ccccgctggaaagcggaggctgagatgaccatggcaataattcctgcgcagaccgggcgcatatcggggatcttctggcgccgaccggcgctgggcctgtttttactgctgctcgggccgctgatgtggtttggcatcgtctatctgggatcgctgctgaccctgctgtggcagagcatttatacctttgacgacttcaccatgtcggtgaccagcgacttcacgctagctaacctgcgggcgctgttcaaccctgccaactacgacattattgtgcggaccctggtgatggcgctgtgcgtcacgctggccagcgcgctgctggcgctgccgatggcctggtatatggcgcgctacaccagcggcaaaatgaaggccttcttttatatcgcggtcatgctgccaatgtgggccagctatatcgtcaaagcctatgcgtgggtgctgctgctggcgaaagatggcgtggcgcagtggttcctcggtcatcttggactggagggggcgctgaacgcgctgttgagcgtcccggcggtcggtggcaataccttgtccacctccggccttggacgctttctggtgttcgtctacatctggctgccgtttatgatcctgccggtgcaggcggcgctggagcgtattccgggatcgttgctacaggcctcggccgatctcggcgcggccccgcggcagacctttcgctacgtggtgctgccgctggccattcccggcatcgccgctgggtcgatcttcaccttttcgctgacgctaggcgactttattgtgccgcagctggtgggcccgccgggatactttatcggcaatatggtttactcgcagcagggggcgatcggcaatatgccgatggcggcggcgtttaccctggtgcctatagtcttcattgccctctatctggcgttcgtgaaacgtctgggagccttcgatgcactctga

SEQ ID NO: 2432 - DNA, 288 bp, Klebsiella pneumoniae
gcctggcggaagaggccaaagcaggctctgcatccgacaaccccaggcggcagtctgcgtctgggcgcgatggaggcgaccgccgccagccggctgccgccgctgcttacccgcttccaacagcagtgcccacaggtggatatcaccctcatcacccaaccgacccgccagttaacggagggggtgttaaccgccgcccttgatgccgcgctgttctgtttcccgccaggggccgatgggcaaccggcctgtcccgccgaggtggcattcaaccccggtgttttatga

SEQ ID NO: 2433 - DNA, 753 bp, Klebsiella pneumoniae
ctcataaggaacgttgctatgaaacttgccagtaaaaccgccattgtcaccggcgccgcacgcggtatcggctttggcattgcccaggtgcttgcgcgggaaggcgcgcgagtgattatcgccgatcgtgatgcacacggcgaagccgccgccgcttccctgcgcgaatcgggcgcacaggcgctgtttatcagctgcaatatcgctgaaaaaacgcaggtcgaagccctgttttcccaggccgaagaggcgtttggcccggtagacattctggtgaataacgccggaatcaaccgcgacgccatgctgcacaaattaacggaagcggactgggacacggttatcgacgttaatctgaaaggcactttcctctgtatgcagcaggccgctatccgcatgcgcgagcgcggtgcgggccgcattatcaatatcgcttccgccagctggcttggcaacgtcgggcaaaccaactattcggcgtcaaaagccggcgtggtgggaatgaccaaaaccgcctgccgcgaactggcgaaaaaaggtgtcacggtgaatgccatctgcccgggctttatcgataccgacatgacgcgcggcgtaccggaaaacgtctggcaaatcatgatcagcaaaattcccgcgggttacgccggcgaggcgaaagacgtcggcgagtgtgtggcgtttctggcgtccgatggcgcgcgctatatcaatggtgaagtgattaacgtcggcggcggcatggtgctgtaa

SEQ ID NO: 2434 - DNA, 996 bp, Klebsiella pneumoniae
catacaaggaaaaatagcatgcaacctaaccgcgtcgcccgcattctgggtattgaaaaaccggtggtccaggggcccctctcctggctaaccgatgctcgtctggtggcggccgtcggcaacgccggtgggcttggcgtgctgggcccgaacgccggactgacggcggcaaccgccgtctccaccccggaggccaccgccgagaaaatgcgcgaagagatccgcaaaaccaaacagctgacggagaaaccctttggcgtcaacctgatcccgacggcggaaaatgacatctggacgccggcgatcctcccggtgattaaagaggaaggggttaaggtggtggtctacaccggctacggcgacggttcgttaaaaccggcgctgttcgacgaactgaaagccgccgggatcaccattatctatcgtgacatcaacccgacgccggagaacagccgccgcgcggagcaggccggagccgatattattgtcgccaccggctttgacgaaggcggcacgctgccgggtaccgccctcgggaccttcaccatcgtcccgctgatcgttgacgcggtacagcgggttccggtgatggccgccggagggatcaccgacgcccggggcgcgcgcgccgttcatgccctgggggcggagggcgtcttcgccggttcggtatttatcagcaccatcgaaagccgggttcccgactcggtgaaagcgaaaattgtggccgccaacggcctggatctgcgcctgttccgtaccctgccggactactaccgcgcgctgcccggcaaactgagcgacacactggtggccatggaccgggccggcgcctcaaaagccgagctggcccaggcgatgggcgggctgcgcgggatgcggctgggcatgctggaggggaatactgatgagggatatatctcggtgggcgcggggatcggcaacatccatgccatcacctccgtcgccgaggtggtcaaccagctggcggtgtaa

SEQ ID NO: 2435 - DNA, 1122 bp, Klebsiella pneumoniae
atgtcctttgaacaacaactgattagctggcggcgcgagctgcaccagaacccggagctctccctgcaggaggtggccaccaccgcgcggatccgcgactggctgcagagcggcgggctgaccctgctgccctacgatctgaaaaccgggctggtcgccgaagtcggcagcggcgacaaggtgattgccctgcgggcggacatcgacgcgttgcccatcgaggaggcgaccggtctgccttaccgctcgcagaatcaaggggtaatgcatgcctgcggccacgatattcacaccagcgtgatgctgggggcggcgctgctgctgaaggagcgggaagcggaactcccggggcgggtgcggatcctgtttcagccggcggaggaaaattttggtggggcgaaaaccctgatccgcgccggggcgctggaggaggtgtcggcgatcttcggcatgcacaatgagcccggcctgccggtgggcgaatttgccacccgcggcggcgcgttctacgccaacgtcgaccgcttcgtcttcaaagtgaccgggaagggggcgcatgccgcccgcccacatgaaggaagggatgcgatcctgctggccagccagctggtgacggtgctgcagagcgtggccagccgggaggtgaacaccctcgactcggtggtgctcagcgtgacgcggatccagggaggcaatacctggaacgtgctgccggagagcgtcgagctggaggggacgctgcgtacccacagcagtgaagtgcagcagcgggtcaaggcccgggtcagcgagattgccgccggtttcgccagcgcctttggcgcgcagattgacgtcttctggtacgccggcccgacggcgctggtcaacgacgcccgctgggccgatttcgccagcgaggtggcagcccaggccgggtatcgcactcaccatgccgatctgcatctcggtggcgaagattttgcggtctatcttcagcatattcccggggcgttcgtcagcatcggcagcgccagcgaatatggtttgcaccatccggcatttaatccggatgaacggctgattgcgcccgcggcgcactatttcgcccgtctcgcggaagaagcgttacaacacatttaa

SEQ ID NO: 2436 - DNA, 285 bp, Klebsiella pneumoniae
gtattatctgacgcgaaggcaaatgatatttgttgtcatttagcgctatttctggctcttatccgtgatgacggagatgaagaggttatgttacaacggcttgccatcgccatttatcttcttacgatgacggcccgcgcgatatattgcgcctgtggcgaaggcggcgatccttttccccttgccgacggcgaaatattttccttattagcgaaattaactcccctgaacagaaagtatttcacggctagagataagcttttaatatttacggttatcgcatga

SEQ ID NO: 2437 - DNA, 636 bp, Klebsiella pneumoniae
gttatgcctgaattcgcttcattaatggcctttgccgcggtggcgctggggttggtgttaaccccaggccccaacatgatgtatctcacttcgcgttcgatttgccagggaaaacgcgctggctttatctcccttgccggcgtggccgtggggtttttcttctatatgttgtgtgccgctttcggcatcaccgcgttggttttcgcggtcccatacgcctacgatgccttgcgtttatgcggggtcgcttatttgctctatctggcgtggcaggcgatcaaaccgggagggcggccgatatttgcggtgcgcgacttacccgcggacagtgggcgtaagctgtttctgatgggattcctcaccagcctggcgaaccccaaagttgccatcctgtatctgtccctgctgccgcagtttatcacccctggactcggcagcgtgctcagtcagtcgttaatattaggctgtacccaggtgatcatcagcgtggcggtgaacggcatgattatcttgctggccgggcaggtggcgttatttcttggtcggcggccgggctggcaacaatttcaacgctggctgatggcgacggtactggcgggaatggcggttaagatcgcttttgaggccagaaaataa

SEQ ID NO: 2438 - DNA, 1218 bp, Klebsiella pneumoniae
cggttcactgacttcaacgtcgagatggtctttgcctaccttcagaacttcacctaccggcaggccgataaatttcggcgaatcaaaggcgccgatatcgcctttgcgggcattaacaaagtagtcagtgctgccgcggtggaaggttttatccgtggacgggataaagaaatgctcagtgcgtccagccgaggcgcgcgccaggtcgccgcgatcttcgataatggcatccagcatttgacggtagtgcgcagtgatgtttttcacataactcatgtctttgtaacgaccttcaattttgaaggagcgtacgccagcgtcgatcagcgccgccaggttggcggtctgatcgttatccttcatcgacaggagatgtttctcataggccaccacccgcccctgatcgtccttcagggtatacggcaagcggcaagcctgcgagcagtcgccgcggttggcgctgcgtccggtctgggcgtgcgaaatgtaacactgcccggaataggccacgcacagcgcgccatggataaagaattcgatggtggcgtcagtgtggtcgtaaatggctttgatttgactgaggttcagttcgcgcgccagcacgatctgactgaagccggcgtcggagagaaacttcgctttttccacactgcgaatatcgcactgggtgctggcgtgcagctcaatcggcggcagatccagctccatgatccccatatcttgcacgatcagcgcatcgacgcctgcgtcgtagagatcggtaatcagccgctgcgccggctccagttcatcgtcatgcagaatggtgttcagcgtcacaaatacctttgcgccaaagcgatgagcgaaaggcaccagcccggcgatatcgctcagactgttgctggcgttgtggcgggcaccaaagccaggtccaccgatgtaaacggcatcggcgccgtgaaggatcgcttcgcgagcgataccggcgtcgcgggcaggactaagaagttcaagacgatgattgtgcaggcgcatacgcgtgttgttatccagtataagggggtcgaaatggcggctattgtagtcagaaccgggcgcagacgaaaaccttttccgccgtcgcgcgacgacgaattttcacttttcaacaaagtattgacggaaaagatatttccctcaaatcacggcgaagagtactgtcatcacgtattccggattttcctcgtcacgttgtga

SEQ ID NO: 2439 - DNA, 1473 bp, Klebsiella pneumoniae
caggaaactgatacatcaatgaatacgaaacacgaaaatgcagcggagcatcatgctgcaaaacgccactggcttaactcacatgaagcgggttatcacaaagcgatgggcaaccgtcaggtacagatgatcgccatcggcggcgctatcggtaccggtttgttcctcggcgccggggcacgtttacaaatggcagggccagcgctcgccctggtctatctggtctgcggcatcttctccttctttattcttcgcgccctcggcgaactggtcctccaccgcccctcgagcggcagcttcgtctcttatgccagggagttcctcggtgaaaaagccgcttacgtggccggctggatgtacttcgttaactgggcgatgaccgggattgtcgatatcaccgccgtggcgctgtatatgcactactggggcgcgtttggcgatgtgccgcagtgggtcttcgccctcggcgcgctggctatcgtcggcaccatgaatatgatcggcgtgaagtggttcgccgaaatggagttctggttcgcgctggttaaggtgctggcgatcgtcgcctttctcgtggtcggcaccattttcctcggctccggtaagccgctggacggcaatgccaccggcttccatctgatcaccgataacggcggcttcttcccgcacggcctcctgccggcgctggtgctggtgcagggggtggtcttcgccttcgcctccatcgagctggtggggaccgcggccggagagtgtaaggatccggagacaatggtgccgaaggccatcaacagcgtgatctggcgtatcggtctgttctatgtcggttcggtggtgttgctggtgctgcttctgccgtggaacgcctaccaggccggacagagcccgttcgttaccttcttctcaaagctgggcgtgccatatatcggcagcgtgatgaacatcgtggtgttaaccgcggccctctccagccttaactcgggtctctacagtaccgggcgtattctgcgctcgatgtcgatgggaggctccgcgccgaagtttatgtcgaagatgagccgtcaccacgtcccttacgccgggatcctggcgacgctgggggtatatgtagttggggttttcctcaactatctggtgccatctcaggtatttgagatcgtactcaacgtcgcctcgctggggatcattgcctcctggggctttatcgtggtgtgtcagatgcgtctgcgcaaagcgatcaaggaagggaaagcggcaaaggtcagcttcagaatgccgggggcgccgttcacctcctggctgacgctgctgttcctgttcagcgtgctggtgctgatggccttcgattatccgaacggtacctacaccataggatcaattccgctgctggcggtattgctggtggctggctggtttggtgtgcgtaaacgcgtgcatgagattcacagcacggcgccgacgctgaggaagtaa

SEQ ID NO: 2440 - DNA, 696 bp, Klebsiella pneumoniae
accgcggctgatttactttttgcccgtctggcggcaagatccggcataatgcaccgctgtcgcaggacggccgtgtcaccggcaatcgtgacagcgaaccattcgacaggaaaacgcatgaagccaaaacaagcggacattctccgccacgccagcacgctgtttaatcgcgaaggatatcagtcgcccagcatcgagcggattgctgaacatgctggcatctccaaaatgaccttctaccgctattacgccgataaagaggcgctcattctggctatcctcaagcagaaagagagcgaatttatgcaggatttggcgcagatcaccgcggataaagccagcgcgcgggaaaagctgttcgccgtgttcgactactaccatcgctggtttacctgcgaaacgttccacggctgcatgtttactcgcgcgctgtttgaatatggcgcgtcatcgccggcgatccgggagcaatgctcccgatttaagtcgctcctctggcagttcttccgcgatatcctcctgcaggtgttaaaaccggaacctgccgagcgggtggccatgatgatggtgatgctcatcgatggcgccatcgccgcccagcaggccgagtccgccgaatgccgggagatcccgccagggatgaccgcctggagcgcggccaaagcgcttatttactcagaaggcggtacgctgtga

SEQ ID NO: 2441 - DNA, 666 bp, Klebsiella pneumoniae
taccgtcatgattttcaacaggagccaaacatgtttactggtattgttcagggaaccgcgaaagtggtctccattgatgataaacccaattttcgcactcacgtggttgagttaccggcacatatgctggaggggctggaaaccggcgcctcggtagccaacaacggctgctgcctgacggtgaccgaaatcaacggcgcgcgcatcagcttcgatctgatgaaagagacgctgcggattaccaatcttggcgatattcaggtcggcgatgaagtgaacgtcgagcgagcggcgaaatttagtgatgaaatcggcgggcatttaatgtccggccacattatgaccaccgcggaaatcgtgaagattctgacttccgaaaataaccgtcagatctggtttaaagtgcaggatccaacgctgatgaaatacatcctctataaaggattcatcggtattgacggcattagtctgacggtgggtgaggtgacggcgacccgtttctgcgtacatcttattccggagacgctgcagcggaccaccctgggagcgaaaaaactgggcgatcgcgtcaatattgagattgatccgcagacccaggcggttgtcgatacggtcgaacgcgtgctggccgcgaaagagatggcggctaaggtcaatgaagcctga

SEQ ID NO: 2442 - DNA, 1380 bp, Klebsiella pneumoniae
agactgcgtgatgcagacgctcagcgcgctggaagcggtcctgaactacctcaggttcaccaccactcagggcgcggcgatgcaggcggcctgggatcactaccgcaccgaggccaccctatgagtgacaccgtccgccagcaggcggagagagaggcggcggccagccgggtgatggcgcgtgccgatcggctggccgccttcagcgaaaccgccgacgccctgacccgggtctatctgtcgcccgagcatctgcaggccaaccagctggtggggcagtggatgcaggctgccggcatgatggtgtggcaggacagcgtcggcaacatctgcggacgttatgaaggacaacaggagggggcgccggcggtgctgctgggctctcatcttgacaccgtgcgcaacgccggacgctacgacggcatgctcggcgtgctggcggcgattgaggtggtccagcgtctgcaccagcatgggcgacggctggcgaaggcaatcgagatcgtcggctttggcgatgaagagggcacccgctttggcatcaccctgctcggcagtcgcggcgtcaccggcacctggcctgaaagctggctgtcacagtgcgataccgacggggtgagcgtcgcccaggcgctggtgaatgccggactcgatccggcgcggatcgcccacgcggcccgtcacccgcgggatatcgccgcctatctggaactgcatatcgagcaggggccgtgcctggagcaggcggggctggcgctcggcgtggtggaggcgattaacggcgccagacggctgaactgccgttttaccggcgaagctggccatgccggcacggtgccgatgcttcatcgcaaggacgccctcgccgcggcggcggaatggatggtgcaggtggaaaacctgacccgccagcgcggcggtaacctggtggcgacggtcggcaccctgcgctgtgcgccgggcgcggtaaacgtgataccgggcgaggtgcagttgacgctggatattcgcggcccgcaggatgcgccgctgacggcgctgctggaggaactgctggggcaggcgcaggcgattgccgggcgccgccagctgagtttcgccgccgaggagtattatcgcatcgccgccaccgcctgcgacagtcacctgcaggcggtgctgagcgaggcggtggtggcggtgcaggggcgttccctgacgctgccgagcggcgcagggcatgacgccatcgccatcgccgagcgctggccatcggccatgctgtttgtacgttgcctggggggcgtcagccatcacccggcggagtcggtgaccgccgccgacgtcgggctggctatcgacgctttctcccgggcggtagagaaggtggccgacgcctga

SEQ ID NO: 2443 - DNA, 618 bp, Klebsiella pneumoniae
caacagagtgatacaacaatgcatctggtaaaaaccatcctcaccgccggtctgcttttgtccgccgccgcccaggcccacaatgtgctggaatttccccagccggaaaacaacccggaagaattttacgccgtcactgagatcccgacgggcgggatcattaagtacgaaaccgatgctaaaacggggtttatcgtcgccgaccgctttcagtcgatgccggtggcctacccggcgaactacggctcgctgacccagtcgctggccggggatggcgacccgctggacgtggtgttttatacccgcgcgccgatggccccgggcacgctgattaagctgcgggcaattggtgtgctgaagatgatagacggcggtgagaaagacgacaaaatcatcgccgtaccggccagtaaaattgacccgacctacgacgacatcaagaccatctccgatctgccgaaaatagaacagcagcggctggaggccttcttccgggtctataaagaactgccggaggggcgtaaaaaggtcgagctggccggctttaatgacgccgcggccgcgaagcaggagatcaaatcggcctgggaggcctggaaggcgaagaacccgcaataa

SEQ ID NO: 2444 - DNA, 597 bp, Klebsiella pneumoniae
tggtttggtgaagttgtaatgagcgcagtctggatagccgtgatcgccatcagcctgttagggctgattttcggcttaatactgggatacgcctcgcgtcgtttcgcggtgcaggacgacccggtggtggaaaaaattgatgagctattgccgcagagccagtgtgggcagtgcgggtaccctgggtgtcgcccctatgcggaagcagtcggcgtacagggtgagaaaataaaccgctgcgcgccgggtggcgaagcggtgatgttaaaaatcgccgccttgctgaacgtcgacccgcagcctgtcgacggcgacgcacaggaagcggagccggcccgcatgctcgcggtaattgacgagccgaactgcattggctgtaccaagtgtatccaggcctgtccggtggatgccatcgttggggcgacccgcgccatgcataccgtgatgagcgacctgtgcaccggctgcaatttgtgcgtcgccccctgcccgacccagtgcatttcactcgttccggtggccaccaccccggagacctggaaatgggatctgcatacgatcccggtgcgaaatattcctgtggaacaacatgtttaa

SEQ ID NO: 2445 - DNA, 723 bp, Klebsiella pneumoniae
attcaccgcctgtggagaataaccatgagcgaagttaaagacgtcatcgtccagggcctgtggaaaaataactccgccctggttcagctgttaggtatgtgtcctctgctggcggtcacctcgaccgccaccaacgccctcgggctgggtttggccaccaccctggtgttaaccctgaccaacctgaccatctccagcctgcgccgctggacgccggcggagatccggatccccatctacgtaatgattatcgcctcggtggtgagcgtcgtgcagatgctgatcaacgcctatgccttcggcctctatcagtcgctggggattttcatcccgcttatcgtgaccaactgcatcgtggtcggccgcgccgaagcctttgccgccaaaaaagggccagcgctgtcggcactggacggtttctcgatcggcatgggcgctacctgcgcgatgtttgtgctgggctccctgcgcgagatccttggcaacggcaccctgtttgacggcgccgacagtctgcttggcagctgggcgaaggttctgcgcatcgaggttttccacaccgacacccctttcctgctggctatgctgccgccaggcgcctttattggcctcggcatgatgctggcgattaaataccttatcgatgaacgtagcaaacagcggaaggcgcaagcggcccgggccgtctctgtcgccccgtccgacgtgacagggaaagcataa

SEQ ID NO: 2446 - DNA, 1143 bp, Klebsiella pneumoniae
catcacgacgaggaagagacagttatgaaatcacgcgcagcagtggccttcggccccggtcagccgttaaaaatcgttgagattgacgtcgcgccgccgaaaaaaggcgaagttctggtgaaaatcacccacaccggggtgtgtcataccgatgccttcaccctctccggtgacgatccggaaggtgtcttcccggcggtgctgggccatgagggcggcgggattgtcgtggaagtaggcgagggcgtcaccagccttaagccgggcgatcacgtcattccgctgtataccgccgaatgtggcgagtgcaaattctgtaagtcgggtaaaaccaacctctgtcaggcggtgcgtgccacccagggtaaagggctgatgccggacggcaccactcgtttctcgtacaatggcgaaccgatctatcactatatgggcaccagcaccttcagcgaatatacggtttgcgccgagatttcgctggcgaaagtcaatccgcaggcgcctttggataaagtgtgcctgctgggctgcggcgtaaccaccggtatcggcgcggtgcataacacggcgaaggtcaaggccggggatagcgtcgcggtctttggtctgggcggcattggtctggcggtgatccagggcgcggtgcaggcgcaggccgggcgcattctggcggttgataccaacccggataaattcactctcgctaaagagatgggcgcgaccgattttatcaatccgaacgactacgataagccgattcaggatgtgattgttgagctgaccgacggcggggtggatttcagcttcgagtgcatcggcaatgtaaatgtgatgcgcgcggcgctggagtgctgccataaaggctggggtgagagcgtgatcatcggtgtagccggcgccgggcaggagatcaagacccgtccgttccagctggtgaccggccgcgtgtggcgcggttccgccttcggcggcgtaaaagggcgcagtcagctgccgggcatggtggaagacgccatggcgggtaaaattcgcctcgatccgtttattacccatcgcctgccgctggagcagattaacgaggcctttgatctgatgcatgaaggtaaatcgattcgcaccgtgatccactttggcgaccagtaa

SEQ ID NO: 2447 - DNA, 1209 bp, Klebsiella pneumoniae
aggcaggacgaggaatgcgccagagcacagtaccataccgatagcaaatttgtgcggcatcggcaggcggtcgcccatcttgttgtagatggcggccagaatcgggctaccaatcatgatccagaacgggttcagcgcctgatactgttccggttcaaaggcgagaccgaggatcgagtgctccacgttacggatggcgaagaagttcagcgaggtcggcatctggctgtacaacacgaagaagacaatcgcttctaccatcagcaggaaagcgacgatcattttacgacgcggagcgcctttcaggcctatggtttctttggcgaaaatcacgacgatacccagtgcgacgacgcccagcaccatacgtgcgataccctggttgtgcagcagccaggtggcgatagcgaccagcaccaccacgccagcgatggtcgccagcagtttacccatgtgtaccggggcaaagtccggtttagagccgtactgtttaacccatttctgacagaaggcgaagttaataatggtgatcaccatccccaccacgctgagggcaaacgctacgctccagccaaaacgtgcggccagccacggggttgccagcatagagaagaacgaaccgatgttgatggacatgtagtacatggtaaatgcaccgtccagacgtgggtcgtttttgtcatagcaggtagaaagcagggaggacgggttggctttaaacaggccgttaccgacggcgatggtcgccatacccatatagacgatagcggcgtcatggccggaccaggccaccagcgcatagccaatcgccagcacgatagcgcccagcatgatgacacgcttggtacccagcactttatcacccagccagccgccaatggcgacgaggccataaaccagcgcgctaaaggaggagaacagagtaatggaatccgcttccgacatacccagctgttttaccaggtaaacggccatgatcccttgcaggccgtagtaaccaaaacgctcccacaactcgatcgagaaaatgagatagaacgcgcgtggttgtttgaaagcgttcagactcacgctttctgctggtttattgtttgcagtagacacatatacctctttttttacatcccatatttactggggggtgttcggggcgcaatctcgttggaccgccgcctttatagttattcttggagggaaaacggcaagtaa

SEQ ID NO: 2448 - DNA, 300 bp, Klebsiella pneumoniae
cctggtggcgacggtcggcaccctgcgctgtgcgccgggcgcggtaaacgtgataccgggcgaggtgcagttgacgctggatattcgcggcccgcaggatgcgccgctgacggcgctgctggaggaactgctggggcaggcgcaggcgattgccgggcgccgccagctgagtttcgccgccgaggagtattatcgcatcgccgccaccgcctgcgacagtcacctgcaggcggtgctgagcgaggcggtggtggcggtgcaggggcgttccctgacgctgccgagcggcgcagggcatga

SEQ ID NO: 2449 - DNA, 465 bp, Klebsiella pneumoniae
cgaacaagcctgtcttcgcgccgcgcgggcgctggaagcgatgggcattaccgatgcccgagtggcggagagtgcagcatgatcaatctggataatgtagaccgcccggcgatcctcgccgaggtgacggcggcgttttatcagtatgaagaggcgctggtcagcaataacatcgaggcgctggatgcgctgttctggcacgacccgcgcaccgtacggctgggagccggcgaaaatctgtatggcatcgaggcgatccgcgcctttcgcgccgcccgccccgccgccggtctggcccgcgatctgcgccataccaccattaccacctttggcgcggatatggcggtgtgcagcaccgagttcacccgcgaaggcagcgcgcgcctgggccgccagcagcagacctgggtacgcttcccctacggctggcggattgtcgccgcccaggtcagtctgatggactga

SEQ ID NO: 2450 - DNA, 1395 bp, Klebsiella pneumoniae
caacaattagaaggtgttcacgtgcagaagtatttcgttgaagcgcgtcagttattagctctggctatacccgtcatccttgcgcaggtggcgcagacggcgatgggttttgtcgataccgtgatggcgggtggctacagcgccacggatatggccgccgtggccatcgggacctccatctggctgccggcgatcctcttcggccacggccttctgctggcgctgaccccggtggtggcgcaacttaacggatccgggcggcgagagcgtatcgcgccgcaggtgcgtcagggcttctggctggccggctttgtctcggtgctgatcatggtcgtgctgtggaacgccggatacatcatcagctccatgcataacatcgatccgctgttggcagagaaggcggttggctacctgcgcgcgctgctgtggggcgctccgggctatctgttcttccaggtcgcccgtaaccagtgtgaagggctggcaaaaaccaagcccgggatggtcatgggctttattggattactggtcaacattccggtgaactatatttttatctatggtcatttcggcatgcccgagctgggcggcgtcggctgcggtgtggcgacggcctccgtttactgggtgatgttcgccagcatgctgtggtgggtgcgccgggcgcgtacgatgcgcgatatccgctgcgccgagcgcttcagcggccctgattttgccgtcctgttacggctggtgcagctggggctgcccattgctctggcgctgttctttgaagtcactctgtttgccgtcgtcgcgctgctggtctccccgctcgggatcattgacgtcgctggtcaccagatcgcgcttaatttcagctcgctgatgttcgttctgccgctgtcgctggcggcggcggtcaccattcgcgtcggcttccgccttggccagggctcaacgatcgatgcccaggtttcggcccgcaccggcgtgggcgtgggggtctgcctggcggtatttaccgctatctttaccgtcctgatgcgtaagcagattgcgctgctgtataacgataatcccgaggtggttacgctggcctcgcacctgatgctgctggcggctatctatcagatctccgactctattcaggtgatcggcagcggcattctgcgcggctataaagatacgcggtctatctttttcattacctttaccgcgtactgggtgctgggtttgccgagcggctatctgctggcgctgaccgatatgattgtgccccgcatgggacctgccggtttctggtgcggatttatcatcggtctgacctccgccgccatcatgatgatgctgcggatgcgttttctgcagcgccagccttccagcatcatcttacagcgcgctgcgcgctaa

SEQ ID NO: 2451 - DNA, 2334 bp, Klebsiella pneumoniae
cgacagccagaacagagcagcaggagtaaagagatgaccaataaaagacgcgcggttcccggtgttcacccctatgacggtccggcaggcgggtggggcgcgttgaaggccacggccatcgccgtgcgcacccagatggatgcctttgaggcgcccgccacgctgctgcgtaccaaccagccggacggttttgactgcccgggctgcgcctggccggataaagaacataaatcgaccttccagttttgcgaaaacggcgccaaagccgtgacctgggaggcgaccaccaaacgggtgacgcccgcattcctcgcggcaaataccgtatcttccctgctggcaaaaagcgattttgaactggagggctacggccgcttaacccatcctttggtttacgaccgggacagcgataccctgcgcccggtggcgtgggagcaagccttcgcccgtatcggcgagatcctccgcggcctgcagccggatgaggttgaattctacacctctggccgagcctccaacgaagcggcgtggctgttccagctgtttgcccgcgagtatggcactaacaacttccccgattgctccaacatgtgtcatgaatccaccagcgtgggcctgccacagtcgatcggcattggtaaaggcaccgtctccctcgacgattttgaccagaccgagctggtgatctccatcggccataatccgggcaccaaccacccgcggatgatgggcaccctgcatgagctatcccgccgcggcgtgccgattatcgttttcaatccgctgcgtgaacgggcgctggagcgttttgccgatccgcagaacgtaatggagatggcgacccggcgctcgacgccgatcgcctcgacctactaccaggtacgggccggcggcgacgcggcggcgttgaaagggatcgccaaagcgctgctgcagctggaggaggagcagggcaatgtgctcgaccacgcgtttattgcccaacatacccagggattcaccgccttcgccgatgacctccacgccacccgctggcaggatatcgagcaggagtctggcctgacgcgcgaatccctgacccaggttgcggcggcttacgccaaatccagggccaccatcgtcacctacggtatgggcatcacccagcataacaaaggcacctccaacgtgcgtctgattgccgacctgctgctgatgcgcggcaatatcggcaagccgggggccgggatctgtcctttgcgcggtcactcgaacgtccagggtaaccgcactgtcgggattagcgaaaaaccctccgcggctttcctcgacagcctgcagcgggtgatggggattacgccgccgcggcatcatggccacgatgcggtaaaagccctggaggccatgatcgccggcgaagccaaagcgctgatctgccttgggggcaacttcgccgtggcgatgccggaccacgaacgcgccttcccggcgatgcgcggccttgagctcagcgttcacgtcggcaccaagctcaaccgctcacatctcctgacggcgaaagagacctttattctgccgtgtctgggccgcaccgagcttgacctgcaggccagcggccggcagtcgatcaccgtcgaggattcgatgtcgatggtgcatgcttcgtctggcaagcttaagcccgcctcgccgatgctgcgctcggagccggcgattgtcgccggtctggcgaaggccaccttgcccgccagcaaagtggactggcagtacctcgtggaagactacgatcgcattcgcgatctgatcgaacagaccattcctgggttcgaggattataaccagcgcattcgccatcctggaggcttccgcatgccgctgccgccgaccgagcgcatctggcctaccgccaccggtaaagccatgttctcggtatttaaaggggtgcatgagaacgtggtggtggagggtgaggacgtgatgcgcctggtgacgctgcgcagtcatgaccagtacaacaccaccatctacgcgatggatgaccgctaccgtggcgtctttggccgccgcgacgtgctgtttatgaacgagcaggatatggccgcccagggtctggagcatggcgatcgggtagatattcataccgcgctgccgggaagcgcgctgacgctggaagatatcacggtggtggcctacggcattgcgccgggcaccgtcggcgcctattatccggaagccaacgtgctggtgccgctgaactatctcgatgaagagagcggcaccccttcgtataagtcggttcccgttcgcctgacgctgcgctcgaaagagatccgtccgctggccggcgggcgctaa

SEQ ID NO: 2452 - DNA, 1386 bp, Klebsiella pneumoniae
tttatggcagaaacaacgtttaccctgtggcggcagcgccttggctatggcattgccgatctctcctgcaaccttgtgtggcagatgatctctctgtatctgatgttcttttacaccgacgtcatgggtctcccggcctattatgtcggcctgatgttcctggtcacccggctggtagacggcgtggccgacgtgctgatggggctggtgatcgacaataccaccacccgctgggggcgctgccgcccctggctgctgatcggcgccctgccttttggcctgctgtgtattctggccttttatgtgccggatttcggcaccaccggcaaactgctgtacgcctttgtcacctatctgtgtctgtcgttcctctacaccctggtgaatattccgttctgcgccatgctgccgtttttaaccagtgattccgcagaacgcaccacgctgtcggcggtgcgcattttgctgggctcccttggcgccaccatcgtcgccgtggctacgctgccgctggtcggcatgctaggcaaaggcaaccagcagcagggattcctctataccgcggtgatttttggcgtactggcggcctttttcctgctggtgagctttcgcaacgtcgaagaaaagatcacccttaccggggagcgcatgaccctgaaacgcgcctggattagtctgcgcgccaatcgtccgtggtgggtcttcgccagcaatatctttctgatgtggggtgcctttttctttcagaccggggccctggtgtacttcttccattattacgtcgggaataccgagctgacggcggttatcgccgggatctccaccttcgttcccctgctcggcaccctcaccgtcccgctgctggcccgacgcatgaaaaaacgtcatgtctatctggtggccagcgcggtcaatctgctcgggatggggattatgatggtgtctggcgcccacgttctgggactgatcgtcggggccgtgatcctctccctcggcgccggccaacgcacggctatctatttctcgatgcaggccgacccggtggattacggcgtgtggaaaaccgggattaataccgcagggatcctgacctcgataaacggttttctcggcaaggtggcgatggctggtgccggggctatcaccggcgtgctgctctcctccagcggctatatcgccaaccacacgcagagcgacagcgccctgttggccatcaaggcctgctatctatacattccggcgctattgatcctcgcctcgatgctatggatgggccgcttctaccgcctcgacgatcagtatgagcagattcgtgccgaccttgatgccggacgcggcgcctcgccagccccggccccgaccgccggagaatcccccgccatgtaa

SEQ ID NO: 2453 - DNA, 306 bp, Klebsiella pneumoniae
acgccggcagaccgtcgcccgccgcctggcgcatcaggtacattcccatggcgtacccgccgagggcaaagaagatcccgtgccccagcgacagcatgcccgcatagccccagaccagatccagcgccaccgccacaatggcgtagcagaggattttgccgctcagcgtcagcagccagctcggcaccgccagcggatgggaggccggcagcagcgccaggaatggcatactcagcagccccagcaccagcaggatccccagccagcgcagaggccgcggcgcgcgctgcgccagcgttaaggtga

SEQ ID NO: 2454 - DNA, 564 bp, Klebsiella pneumoniae
tggataagagaatggaaatgggccgcctgggcgccgcggttacgatacgcatgcgtcgcgtcgccggcgaaacgcctaccctcacccgcctgcagcgagtgccactccccttgtaagcacaaatccagcgtaccacttatcactaccacatgctcaatcacccctttctcatgcggcgttgattcgctcagcgcgccgggggcaagggttatcgaaaaatggtcaaagcgcagctcgggatcccacgggaatactggcgtcaccaccatcgcctgctgctgcggatcaaacgcggagggcgcggcgctggcgtccgggacgatgaacgccgaaaacggtacgttcagcccggtggcaatcttccacagcgtcgccaccgttggacttgattcattccgctcaatctgcccgagcatggctttcgacaccccggtctcttccgccagtcgcgacaggctccagcctcgctgctggcgcagggttttaagcgttgccgccagatgttgcgcaatattcatccttcctcctgtttttactgcgcaaagtataccgccatttgtctga

SEQ ID NO: 2455 - DNA, 1053 bp, Klebsiella pneumoniae
gcaggaagagaaatcatgaagacaaccacccccacgccccccgcccattgcacctttgatccagaggactggctgcggctggcccgctgctggcacccggtggcccgcgcctgcgatattgccggcgccccggtgaaagccaccctgctggacgaacagctggttatctatcgtattaaaggccaggtggtggtcgcccgcgacgtctgcccgcaccgcggggtgccgctgaccctgggatttcatgaagaggaaggcatcgtctgcccctatcatggcctgcgctttggcgaggatggccgctgcaaccgcatcccctccagtccggggcaacccattccggccaaactgcatctcaccagcttcgccgtggaggagcgctacgggctgatctggacctgcctggcctgcgatccggacaatccgccgccgttaccgaccatgccgcactgggacgacgcgggatttcagcaaatcaactgcccggccttcgaggtgaagggatttgccggccgccaggtcgaaggctttctcgatgtcgcccacttcgcgtggatccacaccgacaccttcgccgatccggacaaccagcaggtgccggactataccccgcaggagacgccgttcggctttgttgccgactactggagctcggtgggcaattacccggccagctctgatttccgcgcgccggaagggttccagtggctgcgtcactttgaaatgcatctgccgttcaccgctacgctgaccatccattttcccgccgacgccaggctggtgatcatgaacgccgcctcgccggtgtcgtcccgggtgacgcggatgtttgcccctattgcccgcaacttcgatctgcacgtgccggtggaagacgtacatgcgttcaacctgcgggtatttgaagaggaccgcctgatggtcgagacccagcgtccggaacggttgccgctggatctgaccctggaggcgcatattccggcggaccgcagctctatcgcctaccggcgcgggctgaagaagatgggttttggcgatttctttctggtatga

SEQ ID NO: 2456 - DNA, 1641 bp, Klebsiella pneumoniae
ccgccagtggagtggagcacgcccatgaccgttctgtccgttgaagatctacgcatcagctaccgctcgcggggcgaatggcgcgaggtggtgcacaacatcagcttttccatccagcgcggcgaaatgctggccttcgtcggagaatccggctcggggaaaaccaccaccgcgcaggccattatcggcctgctggcggataatgcccgccgggatgccgggcggattgtcctcaatggcgaagtgattagcgactggtcggataaacgcctgaaccgcctgcgcggagtgagcatcagcctggtcccgcaggatcccggtaattcgctcaacccggtaaaaaccattggtcagcaggtggaagagatcctccggctgcatcagtccctctccgccgcagagcgccgacagcaggttcttaacctgctcgctaaagtcggtctcagccacccggaacagcgttttgaccagtatccgcatcagctgtctggcgggatgaaacagcgggtgctgatagccatcgccattgccctgcagccggatctgattattgctgacgagcccaccagcgccctcgacgtcacggtgcagaagcgcattctcgacctgctcgatatcctgcgtcgcgagtcgggtaccgccgtgctgtttgtcacccacgatctggcgctggccgccgaacgcgccgaccggatcatggtgtttcgccagggagagattcaggaacaaggcgccaccgagacgattgtccagcgtccacagcatccttacacccgccagctgctccacgacctgcaggatgcgccgttgaggctaacggcggcgcgtcaccggccgctggccacgccggccattcgcgtggaggggatcagcaaacgcttctcgctgggcaaacaggcgctgcaggcgctcgacagcgtcagctttgaggtcagacgcggcagcacccatgcgctggtgggcgaatccggctccgggaaaaccaccctggcgcggatcctgctgggctttgagcgcgccgatgccggacaggtcatcatcgacggtatcgacgccgggcatctcagccgcgaggcacagcgtcagctgcggcgcaagatccagtttgtctaccagaaccccttcgcttcgctcgacccgcgccagacgctgtttgcgattatcgaagagccgttaaaaaactttgagcgcctcagcgcggcgacgcgtcgccagcgtgtggagagcgttgccgcccgggtggccctggcccccgagctgctgtcgcgtacgccgcgggagctttccggcggccagcgccagcgggtggcgattgcccgggcgctgatcctcgagccggcgatactggtccttgacgaagcgacttcggcgctcgacgtcaccgttcaggcgcagatcctcgccctgctgcagcagctacagcagcagctgggtctgagctacctgttcattacccacgatctggcgacggtcaggcggatcgccgacagcgtcacggtgctgcgcgccggccaggtggtggagcatggcgacgtaaaccgcctgttcgccgccccgcagcaggcctacacccgcgaactgatcgccgccattccccaggtttcctcccgcttagcacaggcccacacggagaacgcataa

SEQ ID NO: 2457 - DNA, 1275 bp, Klebsiella pneumoniae
gatgaccaggatgttaataaacctggagagttgtatatgagttcctgcatagctgctgacgcgagcctgtctcccgccaaacctgcctggcgcgccgtctatgccctggccctcggggtgttcggcctgatcgtggccgagtttctgcccgccagcctgttaacgccgatggccagcagcctcggcgtcagtgaagggatggccggacaggcggtcaccgcgacggcgctggtggcgttagttaccggcctgctgatcgccaccgccacccgcaatatcgatcgccgctgggtgctgatgttcttttccgtactgcagatagtctccagcctgatggtcgcttttgccgattcgctggcgtttctcctgctgggccgtctgctgttggggatcgccatcggcggcttctgggcgatgtccaccgccacggcgatgcgtctggtgccggcggcccatgtgccaaaggcgctggcgatcattttttccgcggtgtctgtcgccacggtggtggccgcgccgctcggcagctacctcggggagctgatcggctggcgcaacgtgtttattctctgtgcgatacccagcctgctggcgctgctctggcagctgtgggtgctgccctccatgcgcccggagagcgtcgggaccttctccacgctgttcagggtgctgcgccgtcccggtatgctgggcggcatgctggcgacgatcctgattttcagcggccatttcgccttctttacctacctgcggccgttccttgagaccgtcgcgcaggccagtgtcgaagggggttcgctgatattgctcggcttcggtatcgctaactttatcggcacttcggtggcgagctatctgctgagccgtagcctgcgcctgaccctggcgctggtgccgttgatgatgagcgttctggcgctgctgatggtgacgtttggccatctgaccgtgctggccgggctgctggtcgccctgtggggatttgccttcggcctggtgccggtggcctggtccacctggcttgccaccaccgtgccggatgaagcagaaagcgcgggcggtctgctggtcgcctctattcagctggccatcagcgccggggccgccggcggcggggcggtgtttgatttgcacggcgccagcggcgtcttcaccggcagcggtctgctgctgttgggcgcgatggtgattgttttcgccgccgtacgggtgaaaccggtcgcccgcgccgaccagccggtgacgggccgcttatcccgcgagatcgataactaa

SEQ ID NO: 2458 - DNA, 705 bp, Klebsiella pneumoniae
ccaccacaggagtcagcgatgtcacataacaaaccatcccggctgcgtttcgccattaatctgggcaatgcggtcctggcccatctcggggagacaggaaagcccgcgggcatcaccgtcgagctcagccatcggctggcgacgcgctggggcgtcagcgccgaattcgttccctatcctgccgcgggtaaagtggtggctgacgccggtggcgagcactgggatattgcctttctggccatcgatccggcgcgggaagccaccctgcgctttacctcgccctatatcaccatccagggtaccgcgctggtcagcgttgattcgccctgccagagcgtggccgacatggatcgcccggcaaccaccattaacgtcggacaaaacgccgcatacgatctatggctaacccgccatctgcagcacgccagcctgcatcgccttccctcttcgcaggaggcaatcgacgccttcctcgccggtgaaggggatatggtcgccggcatccgccagccgctggaggcgacagcccgtcagcacgccggggtgcgggtactggcggataattttaccgagatccagcaggccatctgcgtcgcccgggcggacgtagaccgttttcacgcggtaaacgacgcgcttagcgagtggcgggcggatggcagtctgcaggcgctgattgccggtcacctgggtcaagcgaactga

SEQ ID NO: 2459 - DNA, 945 bp, Klebsiella pneumoniae
aaggggcaggagatgggagagaaccaggaacactatcctcgcgatctgcgaggttatgcaggggagccgccgcacgcgcgctggccgggcggggcgcggatcgcggtgcagtttgtcctcaactatgaggaaggcgcggagaatcacgtcctgcatggcgatgcgggttcggaacagttcctgtccgatattatcggcgccgccagctacccggcgcgccatatgtcgatggattcactctatgagtacggcagccgggcagggttctggcgcatccatcgcgagttcagccagcgcgggctgccgttgacggtcttcggcgtggcgatggcgctggcgcggcatccggagattgtggcggcgatcaaggctgcggattacgatgtggtcagccacggctggcgctggatccactatcagcacatggatattgccgaggagcgcgagcatctgcaaaaagcggtgcaggtactgaccgacctgttcggcaaaccgcccaccggctggtataccggccgcgacagccctaacacccgccagctggtggtggagcacggcggctttgattacgacagcgattattacggcgatgatttacctttctggagcgaagtggcctgcagcgacggcagccagcggccgcacctgatcgtgccttataccctcgacgccaacgacatgcgcttcgccaccgcccagggattcaacaccgcggagcagttttatacctatctgaaagacagctttgacgtgctatacgccgagggtgaaaccgcaccgaagatgatgtccgtggggatgcactgccgactgcttgggcgtccaggccgtttccgcgcgctgcagcgtttccttgattatatccagcagcacgacaaggtgtgggtctgcacccggcagcagattgccgaccactggcgcgaaacccatccgtatcgcgggtag

SEQ ID NO: 2460 - DNA, 1641 bp, Klebsiella pneumoniae
ataacaaaggaattcaccatgcatcgtcattttcgcctgcccgcgctggccgcgctgtttctcaccggcgccttttccgtctgggccgccgacacgccggttaaaggcggcaccttaatttatctggagcagcaaccgcacaccaatctctatccgcccgccggcggcttttacccgaatggcgggattctcaatcagataaccgacaagctcacctggcagaacccgaaaacgctggagattgagccgtggatcgccgagagctggaccagcaatgccgataaaaccgagtacactttccacctgcgcaaaggggtcactttctcagatggcacaccgctggacgccgccgccgtcgccaaaaacttcgatacctatggtctgggagataaagcccatcgtctgcccgtctcggaggtcatcaataactaccagcgcagcgaagtgatcgacccgctgacggtaaaattctacttcaacaagccgtcgccgggcttcctgcagggaaccgccaccatcggctccggtctggtatctctcagcaccctgcagcgtaattttgaagagctgggcgatgcccgacatattatcggctccggccccttcgtcgtgcaggatgaaaaaccaggccgcgagctgacgctggtggcgcgcaaggattaccagtgggggccgaaaaacattgcccagcaggggcccgctaacctcgacggcatcacctatattgtgacgccggaagacagcgtgcgtatcggcgcgctgctggcaggtcaggcgggctttattcgccaggtgcaggcctacgatgaaaagcaggctaccgatcagggatttaagatctacgctgcccctacccgcggggtcaacgacagcctgagcttccgcccggataacccactggtcgccgacctgcgggtgcgtcaggccctgctccatgccaccaacgctaggcaggtggtggagacgctgttctccgctaactacccgcaagccacctccgtgctggccagctctgccgccggctatgtcaatctgagcgataaactgaccttcgaccaggccaaagcccgacagttgctggacgacgccggctggaagcccgccgccgacggtattcgcagtaaagacggccaacggctggcgctgaccgtctatgagtcgctcccgcagccgcaaaataaggaagtgctgcagctgatcgcccagcagtggcgccaggtgggtgtggcgttgacggtcaaagccggggatgccggtagccgtacgctggataacctcgacccgcagaaaaccccgctcaccgtctcagaagtggggcgcgccgacccggatgtggtgaaaagtatgttcttccccaacaaccgcgatgcgctgctgcagaaaggcggctccagcgataaagtgcagcgcttccgcgatgataagctcaatgacctgctgaccggtatctccgcggcggtagagccgcagcagcgcttgcagttaaccggcgacgcccagcgctatctgatcgataacgcctatgtgatccctattttcgaagagccgcaggtgttcgccggcgcgccgtgggtcaaaggcgtcagcttcgaggccgtcggtcgtccgtcgttctacggcgcgtggctggacaagcactaa

SEQ ID NO: 2461 - DNA, 825 bp, Klebsiella pneumoniae
aacgtctgggagccttcgatgcactctgaacgcgcgccctggtatctgcgactggcgacatggggcggggtgatattcctccactttccgctgctgattatcgccatctatgcttttaatacggaagatgcagcctttagctttccgccgcaggggctgacgctgcgctggttcagcgaggcggccgggcgcagcgacattctgcaggcagtgacactgtcacttaagatcgcggccctgtcgaccgccattgccttagtgcttggcacgctggctgcaggagccctgtggcgcagcgccttttttggcaaaaatgcggtgtcgctactgctgctgctgcctatcgccctgccggggatcattaccggcctggcactcctgacggcgttcaaagcggtcggccttgagcctggcctgctgacgatcgtggtggggcacgcgaccttctgcgtggtggtggtgtttaacaacgtcatcgcccgcttccgccggacttcgtggagtatggtggaagcctcgatggatttaggcgctaccggttggcagacctttcgttacgtagtgctgcccaatctggggtcggcgctgctggcggggggaatgctggcattcgctctgtcgtttgatgaaattatcgttaccacttttaccgcggggcatgaacgcaccttgccgctgtggttgctgaatcagctggggcggccgcgagatgtgcccgtcaccaacgttgtcgcgctgttggtgatgctggtaacgacgataccaatcttaggggcctggtggctcacccgcgacggcgataacgacgccggaaacgggaaataa

SEQ ID NO: 2462 - DNA, 684 bp, Klebsiella pneumoniae
cacgcccgggacgcgacagcgtcgggcggtcagaacacgattcaggtgaaaacctcatcctgtcaatgtgagataaaacaaaaagttataaggagagtagcaatgtcgtttgaattacctgcattaccatatgcaaaagacgccctggcgccgcacatttccgcagaaaccctggaatatcactacggtaaacaccaccaggcgtatgtcactaacctcaacaacctgatcaaaggcactgcgttcgaaggcaagtccctcgaagagatcgtccgcacgtctgaaggcggcgtattcaacaacgcagcgcaggtctggaaccacaccttctactggaactgcctggcgcctaacgccggcggcgaaccggaaggcgaactggcggccgcaatcgccaaatctttcggcagcttcgcggattttaaagccaaatttaccgatgccgcggcgaaaaacttcggcgctggctggacctggctggtcaaaaatgccgacggcagcctggctatcgtctccaccagcaacgccggcaccccgctgaccaccgacgcgaagccgctgctgaccgttgacgtttgggaacacgcctactacatcgactaccgcaacgcccgtccaagctacctggaccacttctgggcgctggttaactggaagtttgttgcggctaacctcgcggcataa

SEQ ID NO: 2463 - DNA, 444 bp, Klebsiella pneumoniae
cgacgccgggaactcgctggccggcgtggcgatgctggaaaaactgactcagcggatggggaggtcggtgttctgatggtcgatcaggatcgcttgtttgcgcgcctggcgcgctcgacgtttcgctcacgcttccgtctggggggaaaagagcggcaatattgtctcgataagggaccggaggtcattgatcggcatgccgcagactttattcgccagcggctggcgcccgctgcgccgaacaatgatggcaagcagacgccgatgcgcggtcacccggtgtttatcgcccagcacgcgaccgctacctgctgtcgcggctgcctggaaaaatggcatgccattccccacggccgcgcgctgagcgagccggagcaggactatatcgtgcaggtcatccaccgctggctggtgctacaaatgaatgcgccgtctgtgcgctaa

SEQ ID NO: 2464 - DNA, 1233 bp, Klebsiella pneumoniae
acgaccagggaaagcgcttcgcccgccgatcgcgagaggcatcggcggggaaggggcgcgttattcgaagcgccaggcgaggttcatgccgatgccgtagttacgtcccggggcaggctcgtagtaacgtccgttagactcgttaacgatgacagacccgacgtactcccggtcgaacaggttgtcgatgcgaccgaacagatccatatccatcctgccgtagctccatttatagccggtcgtcaggccaaccaccgtccaggagggcgctttggcggtgttttcgtcattggccatgatatcgctcatatagcgaatatcgctcccggcgtaccaaccttgctccggctgatagccaaaggaggcgtagcccatattgcgcgcgatccccggaatgcgattgccattgcagctggcgtcgtcgcagacgttagtgcgataggtcgcgtccagccaggtccaggccgccttcagacgccagctctcgccaaactgctgatccagccccagctccatcccctgacggcgggtcttgccggcgtttttataactggtgcgcccgccgctgctgctgtcgaccacaatctcattatcggtattggtctggaacagggcggcggtgaacagcccattgccgatccgcgtcttgctgccgatctccaccgtgtcgttggtggagggtttcaggccgaagttgaggccactctggttatcggagcggtaggagagttcgttaatggttggcgtctcgaagccgcggccggcggaaagatagacgttccacgcgtcggtcagggcatatttcagcgagcccgcgggcagccatttgtgatagctggcatcaccgctgtcatcgccattgcctggggtgatgtagtagtcgttcgagtcgaaccataccgagctgtagcgaaccccggcatcgagcgagagtttgtcagtgagctgccactgggtctgcaggtaggggtcgacgttccacatcaggttgcgttcgttacggcgcagcgcgccctgttcgccatactgtggcgcgccgttgaccatcacaaagttttcataccctttgcgccgctcgctcatgttttcgtagtcgagaccggcggtgagcgtgacgggcaccagcagctctccgcgatgggtcagccgggtatcgatcccctggtagtgacgggtaaggtcgatcaccccgccggcatggctcggcttcagctgcggcgcgcgcgggattga

SEQ ID NO: 2465 - DNA, 1425 bp, Klebsiella pneumoniae
atgtcttcactgtcgattcggtcatttacgctgtttcgtgaagaacaacccgtgcgcgatgcattggtcttatttacgttaacgctactgctgcattttcttggcgctatgctgcgtctggtgcaggagctctctttcttctggccgctcaatgcagtgatggccgggatttttgcacgctatgtatggcttaaccgcagctatttttatgccgtctgttttgcggcaatgctggtctatgacggattaacctcgcgctggggaatgggctttgcctcattgctgattaacttttccaatattgtctttattgtgacgctggcgcagctggtgctgtgggataaacgtcgcgccgactccatgccgggcccgataaacgcgcttaatttattctgtttctgcctgttagccgccttactgtgcgcagcggtcggcgcgctggggtcggtggatgttgaacgcgccaccttcgttccccagctggcggactggtttagcgaacagttctcaacggcggtattaatcctgccctttattctgaccctgacgctgccttcggcattaagcggttttcgctttcgccagctgctgccggtgctggcgctggtcctgtcaattgcgcttggcgtggcggtaggcggcgcgggcagcattaccttcccgttaccggctttgatctggtgcgctgtacgctatccgctgccgctgacctgtctgctgacttttctcactggcatcggcgaaatactgctggtcgctaattcgttaattcacttttcgccagatgcgcgaatgcagccgtggcagctgttctccacccgcctcggaattgccgccatgctgattagcccggtgattgtcgcatccagtgtcgaagcgattaacacgctggtgaagcagctggccctgcgcgccgattttgactttcagacccgcgtctattctcgttccggactgagcgaagcgttgaagcgtcagacgctgccggcggataagctgctgacggtgatggtgctggatatcgatggcttcaaacgggtgaatgatgctctgggccatgaaggcggcgattgcgtgctgacccagtttgcccagcaggttcgacagctggtgggtgagcaggggatggtggcccgtatcggcggcgaagagtttgcggtggccgccgtcgtcgacagcgcccagcagggctatttgctggcggaaaagatccgtcacggggtggagtcgcagcctttcggcctgggccagaacccgatccacctgaccatcagtctgggactggagacgcgcgaggtaggccacgcccgcatcaccgagctgtttaaccagctgctgttggcggcggacgatgagatggtgaaagccaaacagagcggtcgtaaccaaatttgtatgccgacgctgaccgaaagcgcgccataa

SEQ ID NO: 2466 - DNA, 846 bp, Klebsiella pneumoniae
ccaacgtcacttatcagccgtttaaagtgtttgcccttgtggcgctgggctatttcattctgtgctatccgctgtcccgctacagccgctttctggagaacaaattcaatgcctctcatcaccattaatcagatgcagaagtactacggcgacaaccatgtgctgaagggcgtcgatctggatatcgacatgggggaagtgatctcgatcatcggccgcagcggctcgggtaaaagcaccctgctacgctgtatcaatggtctggagggctaccaggagggaagcatcaagctcgggggcatgaccatcaccaaccgcgattcccaggcccgggagatcagccgctccatcggcatggtgttccagaactttaatctctttccgcacatgacggcgctggagaacgtcatgctggccccgcggcgggtactgaagaagtcccaggccgaatgccgggagctggcgcagcggatgctggagaaggtcggtcttggcgaccgtctggattactatccagccaatctctccggcggccaacagcagcgcgtggctattgcccgggcgctggccatgtcgccgaaagttttactctgtgacgaaatcacctcggcgctcgacccggaactggtgggtgaagtgctgaaggtgctggagcaactggcggcggaaggtatgacgctgatcctcgtcacccatgaaatgaattttgcccgcgaagtgggcgaccgcgtggtgtttatgcatcagggacgcgtctgggagcagggcgacagcaaaacgctgttcgccagcccgcagaccagcgaactgaaacagtttatctcctcggtgcgcggtcttaactaa

SEQ ID NO: 2467 - DNA, 1035 bp, Klebsiella pneumoniae
gattggctttgcccgcgaggtggccgaccaggtggtgtttatggtcgacggcaggatcgtcgagcagggcagcagcgacgaggtgctcaaccatccgcagcatccgcgtacccggcagtttttatccagggtgctgccgtcatgaacagagcgctaatgacccttgttctcagcgcttttgccatgagcgcttacgcggcgctagatctgcgcgccaatgagcagccattgccggtcacccgcgacccgcaggcgatagcgaaaattccgccgggctatcgcttcgtcgagccggggacgctaacggtggcgatctcggcgctcaattcgccgccgctggccctgctggccagcgacaaccgcacgcggatcggtagcgacccggatatagcccgcctgctggccggaagccttggcctgaagctcaggctggtgcccaccgcgtgggaggactggccgctgggcatcgcctccggccgctacgatgtggcgctgatcaatatcgcggtaaccgagaagcgcaaagagaagttcgattttgcgacttaccgggtggactccctggccttctcggtgaaatccaccagcgacatcgccgcggtaaacggacccgccgatctcgcggggcgcaaagtgatcgtcgggtccggcaccaatcaggagcggatcctgctgggctggaacgaggacaaccgcgccgccggacggccgcaggcccagccggtctacctgaccgatgatgcctccggcaatctctatatccagtccgggcgggcggatatctttttcggcccgcagtcggtggcagcctataaagcggcgcttaacggccagacccgggtggtgggcctggggccgaaaaaagcgtgggtggcgacaaccaccaaaaaaggcaacggcctggtctatgccctgcaggcagccctcgacggggcgattgcccgcggtgaatatcagcaggtgctggcgcgttggggggagcagggcgaagcggtggcgcagtcggtggtcaacccgccggggataacctactaa

SEQ ID NO: 2468 - DNA, 996 bp, Klebsiella pneumoniae
tggttgtattgtacaaccatttcattttctggacccgccgccatgcctgatacccccttaatccaacagattcgtaccgcctcgcggttaatggtgcgcgagctgggctttatgagcaccacgctggccgccacccattattcaccttcggcggtgcacaccctgcttgaggtatcgatgaggggggagatgacggccgcgcagctggtcacgttgctgggactggaaaaatcaagcgtcagccggatggtctctcgtctgctggcggccggtgagctggaggagcgtccttgcgcggaggatgcgcgcgcgaaatcactcgccctgacggcaaaggggcacgatacggtggcgaaaattaacgcctggggtacccgtcaggtggtggcggcgttagaccatctggatgagacgcagcagcaaactgtcgccactggactggcggcctatgcccgggcgctggcgcagtgtcgggatagcgcgctcgcggatacggctccgcaaatttcgctgatgaccggctaccagccggggatgatcggccggatagcccagatgcacggggagtattacgcccgtcatcatgactttggcgctttttttgaaggcaaggtcgccagcggcgtagcggaatttgccacccggctctcctccccggccaaccagatctggctggcgatccgcgaagggaaaatcgtcggctcgctggctatcgatggcgaggacctcggccagcaggaggcgcatttgcgctggttcattctcgatgacagctgccggggaagcggcattggcaggcggctcctcagcgaggcgatggctttctgcgatagtcgccagtttagcgcggtgcagctgtggacctttaaagggctggacgcggcccgcaaactgtatgaatcctttggcttcacgttaatccgcgaatggcagggggagcagtggggaaaggtaatgaccgagcagcaatttacccggtccgtaaacaccggctaa

SEQ ID NO: 2469 - DNA, 564 bp, Klebsiella pneumoniae
cctgctcattggcctgcacctcccgcagcgatccctccgccagcacctggccctgatgcaggaccgtcacccggtcggcgatggtctcgacaaatcccatgtcgtgctccaccaccatcagggagtgctgtccggccagcgtgcgaaacagctccgccgtatactccgtttccgcatcggtcatgccggccgccggctcatcaagcagcagcagatgcggctcctgcaccagcagcatgccgatctcaagaaactgtttctgaccatgggacagcagaccggcctggcggtagcgctcgccgtcaagacgcagcaggcgcagcacctcattcagccgatcgtcctgttcgctgctcatccgggcgcgcaggctggcccacaccgatttatcccccttcatcgccagggcgagattttccgccaccgtcagcgcttcgaagaccgtcggcttctgaaacttgcgcccgatgccctggcgggcgatggccaccgggtcaagagtggtcagatccaccgactggtcatagagcgctttgccgctttgcggccgggtcttgccggtga

SEQ ID NO: 2470 - DNA, 888 bp, Klebsiella pneumoniae
tcaggggattgctcagtggcgcggctaaacaaaatcgcgatatcgctctgtgcattactgttcacgtctatctcattcacgccactggctcaggcatcagggcatacgcacgcctccgcttcgccaaaagcgttgcccgcgaaaagtggctcagagcgcaagaaaaaagcaaccagtcaaaaaactaaaaccaccgctaaaaccaccagtaaaaagtcctcgcgcacccggctccctacccgcactaccgcagcaagccaaaccgcacttcatcgtcaggccgccggcgcgaccaaaaaatgcgtgctgcgtaaaggttataaaaagcagtgcgcgaaaacggtcgccgccagcgccgagccgaccctggcgctaaacagcgtcaaaagcaagtgcgtggtgcgcaagggctataaaaaacgctgtaagcccgaggccagcgaagcgaatttaacgatcgccgacgcccacaaggtccgggtgcaaaaagcgcaaaataccgcgatgaataaactgatgggccagttgggtaaaccctatcgctggggcggcacctcgccgcgcaccgggtttgactgcagcgggctggtctattacgcctataaggacctggtaaagatccacatcccgcgtacggccaacgaaatgtaccacctgcgcgatgcgcgtccggtggatcgtgatgaactgcagagcggcgatttagtcttcttccgcacccgcggacggggcgctgccgaccatgtcggcgtctacgtcggcaacggaaaattcattcagtcgccgcgcacaggtcgtgatattcaaatcacctccctgagcgaggattactgggttcgccattatgtcggcgctcgtcgcgtcatgacgccgaaaaccattcgctga

SEQ ID NO: 2471 - DNA, 1005 bp, Klebsiella pneumoniae
gattattgttgtcatattagggtgttcacatccatcaccattaattcactctgctgttgcaaaaaagagtacaggggcgccatgagtccattttcccgtttcgcgcactatttcatcgccgtggcccgctgcggcagcctgcgccgggccgccgagcagctgcatatttccgcctcggcgattaaccgccagatcctgcaggccgaggaggccttcggcaccccgctgttcgagcgcctgccggagggactgcggatgaccaccgccggtgagttgctgtatgacaacctgctgcgctggcaaaaggagtttcgccagacgcggcagaaattcgatgagctgcaggggatgaagcgcggaagcgttagcgttggcatggtgcaggcgctggcggaagggggtttcgccgccgcgctggcggagatcatcgccagctggccgtggctggagctggatctgcaggtggctgacagccacaccgtcagccagaaagtgcgtcaggcggacctggacgtcggcctgatcctcgatccgcaggggcaggctggactcagcgtgctggcctttgccgaactggaggtggggattgtgatgcgtccggaccatcccctggcgggggcgaaggcgctgtctttgggcgagctcagcctggagcggcatatcgtgcccggcgcgccgctgatcgtccatgagcgggtggcgctcctctatcgccaccatgactttgcgccggagaataccatcagctgcaatgatatccggcttatcaagtcgttggtgctgcgcggcagcggcgtgacgctccttagcctgctcgacgtgctggacgaggtccagtgtggtcagctggcctttgtcccgctgcgcagtacgctgctgcgaccgctgaccctggcgctgtgtactgcgccctcgcgtcagctttcgcggcccgcgcaaatggccattcagacgctgagtgcggtgatcgaatccatggcgacggtcagcccagcggcccgctga

SEQ ID NO: 2472 - DNA, 189 bp, Klebsiella pneumoniae
aacaatggttgtcagagcaggaatcgaggtgtacagacagaagtttctcggcgcgatttccctggagagaaactggattatgtcaggaatattttttacaacgaaaactcaaaattgatggaaagcaatttcttactggcccccgttatcagggcggaaatattaacaaaccttttattgatattgtag

SEQ ID NO: 2473 - DNA, 3849 bp, Klebsiella pneumoniae
cgatttatctgccggatagcggcttacgccttatccggccttacgagttcgttcgctcatccggccgggtggcacgatgccggacatcatcggagcaggagaaatgtcatgagtaaacttctggatcgctttcgctactttaagcagaagggcgagacctttgccaacggccacggccaggtctacaacaacaaccgtgactgggaagatagctaccgtcaacgctggcagttcgacaaaattgtccgctccacgcacggtgtgaactgcaccggctcctgcagctggaaaatttacgtcaaaaacggtctcgttacctgggaaacccagcagaccgattatccgcgcacccggccggatctgccaaatcacgaaccgcgcggctgcccgcgcggcgccagctactcctggtatctctacagcgccaaccgcctgaagtacccgctggcgcgtaaacgactgattgagctgtggcgcgaagccctggcgaagcatcccgacccggtgctggcatgggatagcatcatgcaggatccggcaaaaacccgcagctataaagcggcgcgcggcaaaggcggttttgtccgctccagctggaaagagctgaaccagatcatcgccgccgccaacgtctggaccatcaaacactatggcccggaccgcgtcgccggcttctcgccgatcccggcgatgtcgatggtttcctacgccgcgggcactcgctatttatcgttgattggcggcacctgcctgagcttttatgactggtactgcgatctgccccccgcctcgccgatgacctggggcgaacagaccgacgtgccggaatccgccgactggtacaactccagctacattattgcctggggctccaacgtgccgcagacccgaaccccggacgcccacttctttaccgaagtgcgctacaagggcaccaaaactatcgccatcacgccggactattcggaagtcgctaagctctgcgaccagtggctggcgccgaagcaaggcaccgacagcgcgctggcgatggccatgggccatgtgatcctcaaagccttccacctcgataacccgagcgattactttctcaactactgccggacctacaccgacatgccgatgctggtgatactcgagccgcgcgacgacggcagctatacgccgggccgtatgctgcgtgcttccgacctgcttgacggtctcggagaaactaataacccggaatggaaaaccgtggcctataacagcgacggcgaactggtggcgccgaacggctccatcggctttcgctggggcgaaaaaggcaaatggaatctcgaacaacgggcagacggcaaagatgtcgagcttaagctgtcgctgctggatattcgcgacagcgtggtgtcggtgggcttcccctactttggcggcaacgaaaacccgcattttcgcagcgtagcgcagtcactggtgacccttcacccgctaccggctaaacagctgacgctggccagtggcgaaagcggcctggtggtcagcgtctatgacctgattctggccaactacggtctggatcgcgggcttgacgatgtcaatgcggcgaaggatttcgccgaggtcaaagcctataccccggcatgggcggagcagatcaccggcgtaccgcgtcaacatatcgaacaaatcgcccgcgagtttgccgatacggcgcataagacccacggccgctcaatgattatcctcggcgccggggtgaaccactggtaccacatggatatgaactaccgcgggatgattaatctgctggtattttgcggctgcgtcggccagagcggcggcggctggtcgcactatgtcggtcaggagaaactgcgcccgcagaccggctggctgccgctggcgttcgccctggactggagtcgtccgccgcggcagatgaacagtacctcttatttctacaaccacgccagccagtggcgctacgaaaaactgaccgcgcaggagctgctgtcgccgctggccgacgccagcaaatttagcggcagccttatcgacttcaacgtccgtgcggaacggatgggctggttaccctctgcgccccagctcaacgtcaacccgctgaccattaagcagcaggccgaggccgccgggctctcccccgcggagttcaccgtccagtcgttaaaatcaggcgatattcgctttgccgctgagcagccggatagcggcaaaaaccatccgcgcaacctgtttatctggcgctcaaacctgctgggatcgtccggtaaggggcatgagtacatgttgaaatacctgctcgggaccgacagtggtattcagggtgatgaactgggcgccagcgatgaggtaaaacctgaggaagtcgagtggcagaccgcggcgattgagggcaaactcgacctgctggtgacgctggatttccgcatgtccagtacctgtctcttctccgatattgtcctgccgaccgccacctggtatgaaaaagacgatatgaacacctcggacatgcacccgtttatccacccgctctccgccgccgtcgacccggcctgggaggcaaagagcgactgggagatctacaaggatatcgctaaatccttctcgcaggtctgcgtcggccatcttggcaaagagaccgatgtggtgctggtcccgctgcagcatgattcccccggcgaactgtcgcagccgttcgaggtgcttgactggcgcaagggcgaatgcgatctgatccccgggaaaaccgcaccgtcgattgccctggtggaacgcgactatcctgccacctgggaacgcttcacctctctcggcccgctgctcgataagcttggcaacggcggaaaaggcatttcgtggaatacgcaaagcgaagtcgatttcctcggcaagcttaactacgtcaagcccgatggtccggccaaaggccggccgcggatcgacagcgccattgacgcctctgaagttattctcagcctcgcgccggaaaccaacggccaggtggcggtgaaagcctggcaggcgctgggagagtttaccggccgcgatcatacccatctggcgctcaataaagaggatgagaagatccgctttcgcgatattcaggcgcagccgcgcaaaattatctccagcccgacgtggtccggactggaaagcgagcacgtctcctacaatgccggttataccaacgtacatgagctgatcccatggcgcactctctccggccgccagcagttgtatcaggaccatccgtggatgcgcgccttcggcgaaagcctggtagcctatcgcccgcccattgatacccgcagcgtcagccagatgaaggccgtgccgccaaacggctttccggaaaaagcgctgaatttcctgacgccgcaccagaagtgggggatccactcaacctatagcgaaaacctgctgatgctgacgctgtcgcgcggcgggccgatcgtctggcttagcgaaaccgacgcgaaagagctgggcattgaagataacgactggattgaagcgttcaacgccaacggggctctcaccgcgcgggcggtggtgagccagcgggtgccgccggggatgaccatgatgtaccacgctcaggaacggattatgaatatcccgggttcggaagtgaccggtcgtcgcggcggcattcataactcggtaacccgcgtctgtccgaagccaacgcacatgattggcggctacgcccagctggcctatggctttaactattacggcaccgtcggatcgaaccgcgacgagttcatcatgatccgcaaaatgaagaagattgcctggctggatgacgaaggtcgcgatcaggtacaggaggcgaaaaaatga

SEQ ID NO: 2474 - DNA, 240 bp, Klebsiella pneumoniae
atctctccctggcgaaacaccatgatccggtcggcgcgttcggcggccagcgccagatcgtgggtgacaaacagcacggcggtacccgactcgcgacgcaggatatcgagcaggtcgagaatgcgcttctgcaccgtgacgtcgagggcgctggtgggctcgtcagcaataatcagatccggctgcagggcaatggcgatggctatcagcacccgctgtttcatcccgccagacagctga

SEQ ID NO: 2475 - DNA, 270 bp, Klebsiella pneumoniae
ggttacccctgtaatggcaaaggatttttgcttgtgaaactgagtcttaacacatccggattgccgctgcaggacctggtgttcggcgcatccgtctatttccctccgctgttcaaagccgtcttgttgggtttctttatctggttgtttttacatcgccagctgcgtgactggatgtatgcgggcgacatctggcacccgctactaatggatctctccctgttcgcgctcgcggtctgtctggccctggtattgctcattgcctggtga

SEQ ID NO: 2476 - DNA, 639 bp, Klebsiella pneumoniae
gctttaccctggaggccgaccatgataaccgtttatggcgtgccgggatggggctcgacgattagcgagctgatgctctccctggccgatattccctacgaggtggttgacgtggagggctttgaccagcccggtccggcgcgcgagcgtctgcggcagattaatccgctgtgccaggtgcccaccctgaggctggccgacgggagcatcatgaccgaaaccgccgccatcgcgctgatgatcctcgaccagcgtcccgatctggcccccgcgccggggacgccacagcgtccgcagtttcagcgcctgctggtctggctggtggccaatgtctatcctacctttacctatgccgattacccggaacgctgggcgcccgccgccgcggagcagctggtggagaattgtcgccagtaccggaaaaatctctatctctggttcgaacagcagctggccgccgggccgtgggcgctgggcgcgtcggtaacgttgctggattgctatatcgcggcgatgtaccgctggggaccccgccaggcgtggtttgacgaccacgcgccaaaattcgccgccatcgcccgggcggtctgtcagcgaccggagctggccgcggcgctacgccgtaacaagctgatttaa

SEQ ID NO: 2477 - DNA, 456 bp, Klebsiella pneumoniae
ttacttgcctgggcaaccattatgaaaagtaccagcgacctgtttaatgaaatgatcccgctgggtcgcttgatccagatggttaaccagaaaaaagatcgcctgctcaatgactacctctcacctatggatattaccgcgacccagtttcgcgtgctctgctccattcgttgcgaagtatgtattacccccgttgagctgaaaaccgtgctttccgtcgacccgggcgcgatgacgcgcatgctcgaccgcctggcgtgcaaaggctggattgaacggttacccaaccccgctgacaagcgcggcgtgctggtgcagttgacgccggacggcgcagccctttgcgagcagtgtcatcaggttgtgggtcagaagttacaccaggagttaacgaaaaatctgtcggcggacgaagtcgccatgcttgagcaactgctcaagaaggtcctgccgtaa

SEQ ID NO: 2478 - DNA, 693 bp, Klebsiella pneumoniae
agaggcgcctggtgctggacgagcgtcagcgcaaccgaaaccgtgcgcccgttgcagccgcgcgagctggcggtcaatgagcagaccaacacggtctacataaccggtctgggcaaagagagggtgatttgggtggtagatggcgcgaccctgaagctgaaaacgaccattaccggcaccggggcaatggcgacgggtctggcgatcgatccgcaggctaagcgtctgtataccaccaacgccgatggcgaactgctgaccatcgacagcgagagcaacacgattgcgtcgcgcaaaaaattgcaggatgacggcaaagcgcatttctatcttaacctgagtctcgataccgccggccatcgtgcctttattaccgacagcaagcagccggaagtgctggtggtcgatacccgcgacggcaaggtgctggagaaaatcgccgcgccggagtcgctggcggtgctgtttaacccggcgcgcaacgaagcctatgtgacgcatcgtaaggccggggaagtcagcgttatcgacggcaagagctacaaggtggtgaagacctttaaaacgccgactcaccccaacagcctggcgctctccgaggacggcaaaacgctgtacgttagcgtgaaacaggcttccagccgtgagaaagaagccaccgcgccggacgatgtgatccgcatcgccctgtaa

SEQ ID NO: 2479 - DNA, 1170 bp, Klebsiella pneumoniae
gcggataactgtatgattattacaacagcgctggctaatgaaattgtcgcccgggcaatggcgataattcatcataacgtgaatgtgattgaccatcatggacagatcattgcctcaggtgaacggcatcgtatcggcgaacagcatgaagtcgcccgggaggtaatacgcaccgggaaacgcatttgtattaacaacgccgcggaagccgcgcgttttcacaacgtgcatcctggtattaatcatcccattatctatgacgatcgcgtggtgatggtggtaggcatcagcggcgatcccgcggcgataagccgctatgctgaactggcggtgctcaccgccgaactgctggtccgccaggccatagagatgcgggaaaccaactggcggcaacgtctgcgtgacaccttgttttgtcagtatctggaacaaggggctacgcccgccgggcaagaagcgcttcatcgcctgctggaacttggtttcgattttgatacaccgcgggttccgatcgtagtgaccgtgcaggtcgaacagcatcagttaagcgacatactgagtacgctgttgcgggaattctcgcagctctccggcgtaagtgacgttattttgctgggcagccatgaaatattgatccttaacgcgctaagcgaagcccaggaaactctgctgcggggcattgagtttgtactgagtaatcagataagccattaccatatcgggattggcgtgcaggcggacagcgccccggacattcgcgaggccattcggttcgcccgctcggtgatcgaagtgggtagcaaagtgcagccgcagcggcagatctactactttcgcgaaatggcaatgctctgcctgttcagggtgctggaagacagctatatggtcaatttttttatcaataacgtacgccagctgcttgagcatgattccggcgaagtgctgctggataccctgagcagctttattgccaataatgccgaaccgggcaaaacgtcgctgctgttggggattcatcgtaatacgctcacctatcggctgcagcaaattaaaaagcatatacagctcgatccgatggtcttcaccgacctgacgcagctggcggtgtcggtacactgttatcgccggctgaatccgcgccagagcgaatggattgatagcttaagctaa

SEQ ID NO: 2480 - DNA, 1164 bp, Klebsiella pneumoniae
tgtcagcgctgcgccgcgagatactgtgtgatacaaagccgaggttggcaattgttgcgggcatgtgaatttatgcttgccccgggagataaatccgttaccgtggcaggcatttttcaccacttaagaacgcaggaacccgctatggcgatttttgatggtcacaatgacctgctgctgaatctctggcttcaccatcgcgaggatccggtgagcgccttctttgccgggattgagaacggccatctcgactatccgcgcatgctgcaaggcggatttgccggcgggctattcgcgctattcgtgccaccgcaggaatatattgcccgtatgacgccgcaatacgccagccaacgatgggatccgatcgatatcctctggcagcaactggccatcctgaagcaacttatcgcccactccgctggacgcttgagattgtgtctgagcgcggcggatatcgaacgctgccgcgaggataaggtactggcgatggtggcgcatattgagggtgccggaggttttgatggcgagggccgcgacctgcaggccttttatgccgccggggtccgcagcattggtccgttctggaatattgcgaaccgcttcggcagcggcgttaacggttcgtttcccggtagcccggacactgggcctggactgacagcggcaggtatcgatctgattaagcaggtcaatgccttgaagatgcagatggacgtgtctcatatgaatgaaaaagcgttctgggataccgcccatcactcaacgtcaccgctggtggccacccactccaatgcccacgccctgtgcccgcagccgcgcaatctgaccgaccagcaactgcgggcgatccgcgatagcggcggcgtggtgggcgtcaatttcggcaatgctttcctgcgcgccgacggccggcgcgatagcgacacgcccttaaccaccattgtccggcatatcgactatcttattaacataatgggtgaggatcatgtggcccttggctcggattttgacggcatcaccctgccggacgagctgggcgatgtggccggcttaccgcggcttatcaatacgttgcgcgctagcggctatgatcaattggtgctggataagctgctgtggcgtaactggctacgggtattaaaaaatgtttggcaacaatag

SEQ ID NO: 2481 - DNA, 507 bp, Klebsiella pneumoniae
aagcagagctgtcagcaaaccatgaagataaaaaatccactcgtctcaccagggaggttggttatgatcgataacatcacgctggataatctgcatattggctgcaaagccagtaataaagcggaagtcatcgccatgatcggcgaggagtttaaagccaaaggctatgtcaatcaggaatgtgtccactttctgctggagcgtgaacatcaggtctcgacctttttaggcaatggcatcaccctgccgcatttgccgaaatccgcgacggatatcatccttaaaaccgggattgagatctatcagtttcctgatggcgtaatctgggatcggagcaatgtaatgtttattgccatcggcgtgatcgcgaaagagaaagagcatattgacgtactcaaggaaattgcctcgatatttagcgatgagctgatcgctaacgcactgtcattaatctcagacaaacatgatttcctgaaaattctgcagcataacgccttgccccattaa

SEQ ID NO: 2482 - DNA, 1239 bp, Klebsiella pneumoniae
tgtcgtggctgccactctcggcagcgacggcataatgaggagaaggcgatgtcgatattaattgcatttttgggcgggatgttaactctgctgagcccctgtacgctgccggtgatcccgctgctgttcgccagcgtccggggccgccgggggcagctggcgatcatgctggcaggaatggcgctgatgttcggcgctgtctcctggctggtgacggtcgccagcggctgggtggtgaatctgaccctcgcaggccgcggtctggcgctggcgttcttcgccctggtcgggttgagtctgctttcgcaacgcgtcgcgcaacggctgacctcacccctggtagcgttggggaatcagcttaacgatgccagttcacgccagcgcggctggatcggttctctactggccgggctggcggtgggcctgctgtgggcgccgtgcgccgggccggtattgggagcgatacttatcctgggctttgtgcatccggggcaggcgactaccggcggcttgctgctggcctacggcagcggcggggcgctgatgttattcctgctagggtggtgcgggacggcgttgatcaccagattgcgtcgcggacaggcgttcggcgaacgcctgcgccggttggcagggagggccatgctggcctcggtggcgctgatcgccagcggcggcgatcgctatctgcagagcgctggtggactgagccaggcgctggagcagcggctggccgcccgtctgccgcagccggagcaaaagaccagcctccagccgatcgccgcgccgcagcccagcagcgcgatgccctctctggcggggggcagcgcatggatcaacagcccggcgttaactccggagcgtctgaagggcaacgtggtgctggtggatttctggacccgggagtgtatcaactgtcagcataccctgccttacgtgcgcgactgggcgaacaaataccgcgcggcgggcctggtggtgattggcgttcataccccggaatatccctgggagcgttcgttgcccctgctgcgccaggcggtgaaggactggcggataacctacccggtggtggcggataatgagtacgccatctggaacgccttcggcaatcagtactggccggcgcattacattttcgacgctcgcgggcagctgcgttataccgcattcggcgaaggggattatgcccgccaggagcaggtgatccagcagctgctgcaggagagcaaagcctga

SEQ ID NO: 2483 - DNA, 534 bp, Klebsiella pneumoniae
cttcgcggctgccttcaggcgcagggcaggcagcatcagcagcagagtgatggcgaacagggtggcgaagatggcttgccactcgaagtgcaccagcagccagctgcccagcagcggggccagcgccggcgacagtcctaccagcggcataatggtggcgaagatgcggttcgtgcgctgggcaggatagtaatcggcgaccatcgcctgccaggtaacggccgcggcacagacgccaatcgcctgcagaaagcgcagcgccagcatcagggtggcgttgtgcacccacagcatccccagacagccggccgcgaaaatcgccaggccgctcagcagcaccggtttacgtccatagcggtccgacagcggtccccagaacagctggcccagcgcgaagccggcgaggaacaggctcagactggcgctgatggaggcggcggaggtgttgagatcctgctgcatggcggcaaacgccggcaggtacatatcggtggccagaaagcccagcacgctcaggccggccagccagactaa

SEQ ID NO: 2484 - DNA, 1266 bp, Klebsiella pneumoniae
ttctatagacttactagttttaaaaagcaaccagccagagggcctcttatgaaatgcaaggcaagtagatgtaccggccaaaggatccaaactgcgtcagtccctgacacgatgctgaccacagggataacggcgttgttttcactaacctgcgcgctggcagtagccaatgtttattcagcacagcctttactcgactcgatggcggtcagcctgaaggtgtcgccaggcatgattggcagcgtcatcaccgctacgcaggcgggctatgccattggcctgctgttcctggttccgctcggggactggttgaaccgtaaatacgtggtgatgagtcaactgttgctttcagtagcggcgttagtcgcggcagggttatcccccaatatagcaactctgcttggcgccatgctgatcgtcggcctgatggccgtggtggtgcaggtgctggtggcctgggtggcagtactggcgacgccgcagaaacgaggccaggcggtgggtaccctgaccagcggcattgtttcaggtatcctgttatctcggtttatctcaggcgcgatagccgatatcgccggctggcgagccgtgtatctcacggctgcctgtctgatgttggtgattgcaggggtcgtctggaaaatcatgccttcgcccccgcagcagccgcagccgcaaaagccgacttacctttccttattgaagtccgtgtttcagctgtacctcaccgagccgcaactgagaaagcgcgggatcctggcgctatttatcttcgccgctttcagcatgctatggacgaccatggtcatgccgctcaccgccctttccctctcgcacacccagacggggatgtttggcttagccggcttcgctggcatgctggccgccgccagagcgggcaagtgggctgaccagggatgggctcagcgcactaccggcctggcgctggcgctgctgaccatctcatggcttcctatcggctatgccgaaacctctctgctctggctgatagctggcgtcattgcgctggactttgcggtacaggccgttcatgtctccagccagagcctgatcattgccgccaggcctgcagcggcaagccgcctggttggggcttacatgtgtttttattcgctgggcagcgcggcaggggctatcgttgccacacagctttattcccactggggatggcaggcggtctgccttgcgggcgccgcggtcagcgcgtgtgcatttctgatctggtcaggatcgcgtcaatcatga

SEQ ID NO: 2485 - DNA, 270 bp, Klebsiella pneumoniae
tactttctatggaggttaaatatgttgcgtgattatttaaaagtggaaaaagaagaccagcttgttgaacaacagagtcgacatgacaatagccagcattattcttcggtgaccgaatgggttattttaagtaaagatggccagcgcaaaggccgggtatccctgttcgaccgcttcaccacccgccgctcctggagcgacagtttccgcattacgcagttcgataatgcgggtaaagtggtggtggataaactcactgacgcgctgtaa

SEQ ID NO: 2486 - DNA, 843 bp, Klebsiella pneumoniae
ccaaagatatggatggttccgccggagagctgctcaaaaccggcaatcagccgcaggcaggtggttttacccgagccggacggacccagcatcgagaaaaattctccatcgcgtatgccaatgctaaccccatccaccgcccgcacatcgccatacaggcgcgatacattctggaactcgaccgcgtacgtcattgtttgcctccgatccttagcggccgcccattatcgcaatatagtcctgagtccagcggctatagggcacgtatttcccgccttccgcaaccggcgttttccagaagtgaatgcggttaaactgctcatagccgttggtctcacagcctttatcaccgagcagcgcgctggctttacagccctcaggcaccaccggcagcgaaccgaaccaggccgccacatcgccctgcaccttcggcgtgagcgaccagttcatccatttataggcgcagaccgggtgcttcgcctcgctgtgcagcatggtggtatccgcccagccggttaccccctccttcgggaacacggtggcgaccggctggccttccgccttcaggccgttggcttgatagggccacgaactggaggcggctaccccttcgtttttgaagtcgttcatctgtacggtggcgtcatgccagtagcgatggatcagcggttgctggtcgcgcaggactttcagcaccgcgttgtactgggtttcggtcagttgataggggtcttcgatccccagctgcggctgggtggctttgacaaacagcgcggcgtcggcgatatagatcgggccatcataggcctgcacccgcccctggttggttttaccatccggtag

SEQ ID NO: 2487 - DNA, 831 bp, Klebsiella pneumoniae
ccgctgacatgccgcctgacgcgttctatgctttaccctgtctccctcctcacacaggaactgcacccgatggccgactggaatccttcgttgtatctgcaatttgacgctgaacgtacccgccccgcggccgacctgctctcgcgtattgcccatctgcaggtcgagcacgccgtcgacctcggctgcgggccgggaaacagcacccgcctgctacgcgccgcctggccgttggcgacgatcgtcggtatcgataactccccggccatgctggtccaggcggcgcaggccttacccgactgcgaattcattgatgccgatattgcccgctggcggcctgcgcaaccaccagatgtgatctatgccaacgcctctctgcagtggctgacggatcatgagacgcttttcccccatctggtaaaccagctggcggacaacggaacgctggcagtgcagatgccggataactggcaggaaccttcccataccctgatgcgtcaggttgccagcgagatggggttgccggaccgtggacgccagccgttactcccgcccgccgcctggtacgatctgctcagccgccagggttgcgaagttgatatctggcgcaccacctattttcatccccttgcttctcatcaggcgattgtcgactggctgcagggcaccgggttacgcccctatctggcaggcctggacgagcaggccggaagcgcgtttctcacacgctatctcacaatactggccacacactatccgttacagtgtaacgggaaggtgctcctgcgtttcccacggctgtttatcgtggcgcgaaagatcgccgcctga

SEQ ID NO: 2488 - DNA, 1257 bp, Klebsiella pneumoniae
cgtaaggaatggcagatggatatcactcagttttcgcaaattaacccgccgcagcgcctgctgatggggccggggccgatcaatgccgacccgcgcgtgctgcgcgccatgtcgagccagctggttggccagtacgatccggcgatgacccactacatgaatgaagtcatggcgctctaccgcggcgtgtttcgcaccgaaaatcgctggacgatgttggtcgacggcacctcgcgcgccgggatcgaagcgattctgctgtcggcgatccgtcccggtgacaaggtgctggtgccggtgttcggccggtttggtcatctgctgtgcgagatcgcgcgtcgctgccgggcagaggtgcacaccatcgaggtgccgtggggtgaggtctttacgccggatcaggttgaggatgcgatcaagcgcgtgcggccgcgcctgctgctcaccgtgcagggcgatacctccaccaccatgctgcagccgctggcggagctgggagagatttgccgtcgtcacgatgtgctgttctataccgacgccaccgcgtcgctcggcggtaacccgctggaaaccgacgcctggcagctggacgccgtgtccgccgggatgcagaagtgcctgggcggtccttccggcacctcgcccatcaccctcagcccgcggatggaagaggtcatccgccgccgccgctgcattgagcaggggatccgcaccgatgcccatcacgatggcgtcgacgagatgatctactccaactatttcgatctcggcatggtgatggattactgggggccggagcgccttaaccaccataccgaagcgacctcggcgctgttcgccgcccgggagtgcgcgcgcctgatcctccaggagggactcgacaacggcatcgcccgccacaaactgcacggcgatgcgctgctgaagggcatccaggcgatggggctcgagacctttggcgacctgcggcacaaaatgaataacgtgctgggggtggtgatccccaacggggtcaacggcgatcaggtacgcaaactgatgctggaagatttcggcattgaaattggcacctcgtttggtccgctgcacggtaaagtctggcgcattggcaccatgggctataacgcgcgtaaagactgcgtgatgcagacgctcagcgcgctggaagcggtcctgaactacctcaggttcaccaccactcagggcgcggcgatgcaggcggcctgggatcactaccgcaccgaggccaccctatga

SEQ ID NO: 2489 - DNA, 915 bp, Klebsiella pneumoniae
atctgccgatggactgctcggacggcgtttgcggtacctgcaaatgccactgcgccaggcggtgagtacgacctgggcgaagattatctcgacgaggcgttaagcgacgacgaagcgcagaatcgccaggtgctgacctgtcagatggtcccgaccagcgactgcgtgatcgatgtgccggtggccgccgcgcagtgtaaaaccacgttggcgaacattggggcgcaggtacgacaggtgaatttactgtccgataccgccatcgaactggtggtcgccctcgatgagccgctggccttcctgccggggcagtacgtcaacattcaggtgccgggcacgcttcatgtccgcgcctactcattcagctcgcaaccgggttccctcgaagggcgttttctgatccgtaacgtgcctggcgggatgatgagccagtggttaacccagcgggcgcggcccggcgatcgtcttaccctcagcggcccgatgggcagcttctatctgcgccacggcgaacgtccgctgctgatgcttgccggcggtaccggcctggcgccgctgctctccatgctccataccctgcagacacagggcagccagcgtccggtgatgctgctgtacggtgttacacgtgactgcgatctggtgaaaaccgacgcgctggatacctttactcaacagttgacggggtatcgttggctaccggtggtggccgatgaaaacagcacttgcccgcagcgcggctttgtcaccgaccatctcgacgacgcgatgctgaacaacggcgacgtggacatctatctctgcggcccgccgccgatggttaacgcggttgccacggcgttgcgcgaccgcgggatcaccccggcggggttctggtatgagaaatttatcgccagccagagcgcggcggcataa

SEQ ID NO: 2490 - DNA, 410 bp, Klebsiella pneumoniae
tgctgcggatgcgttttctgcagcgccagccttccagcatcatcttacagcgcgctgcgcgctaacttgtctaagcccgccgctccggcgggctttttcgttcttcgctataacggcgcgttgtacattccgttactccctgacaccaaagactcactgatagcctcccggcaggcgcttatagtgttgccaacagccccgcagtggggttactcaagaaaccaagtcgaggatttcagaatgaaaaaagtattagctctggtcgttgccgctgctatgggtctgtcatcagttgctttcgctgccgatgcggcaagcaccaccccgagtgcagcagccagccatactaccgttcaccataagaaacatcgtcttcaccacggggctggaaggatccgcggtgacgctag

SEQ ID NO: 2491 - DNA, 480 bp, Klebsiella pneumoniae
cctcggcagtgccatcggcgccttctgcggcggaatgatgatcgcccagggctttggctggaacagcgtggcgctccccgccgccgcgctgtcgtttctggcgatgagcgccttgctcatctatggctgtcatcagcggcgacaagcttactaacgacgcctactcacgccagggttcgcccagggtcagcatcaggcggttggcccaggcgaaaaaggccgcggactgcagcagatccagctgggccagagtatctaagccctgctcatcaagcgccgccagatgatcggcgtttaatgcgggtggcgtcaccgatagcgcggcggcggcgtcgatttccgcctgccagcgcggcgattgcccgtcgcgcagatcctctcccggcgtcaccgccagcagcgtgtcgacggcggtctcgtccttcgccagctgcgccgctttgcgggcatgcaccgaggcgcagtagatacagccgttga

SEQ ID NO: 2492 - DNA, 1383 bp, Klebsiella pneumoniae
ataacgaggtgggaagcatgccattcccaccaatataacgaacatctacttagagccgaatatatgaacacgacagctaacactactcgtattcgctggtggatagccgggttaatgtggttggctattgccatcaactatatcgaccggacagtattatctgccgcagccccacatttaatcgatgaactgaaactcgaccccgaaatgatggggtttatcatggctgcttttttttggtcatactcgttattacagatccccgccgggtggttcgccgatcgttttggtcagaaaaaaggtcttggtttagccgtcgcctggtggtcaattgccacctcgatgatgggtgttgccacgggttttaaatcacttctggcactgcgtctggctttaggtgttggcgaggccgccgcctaccccagcaacgctgggatcgccgcacgctggtttccggataaagaacgtgccaccgtatccggactcttcgatagtgcgtcaaaatttggcggggcgattgccatgccgcttatcgtctggatgatctacacctttgactggcgactgacctttttgattatcggcagtgtgggcattttatgggttatcgcctggtattttatctatgctgaaaacccggaagaacacaaacgcatcagtccttcagaagtgcgtattattcgcgatggccaaaaacaacatcacggcgacaaaactgtattgcccatgaaatggtataagctcttgcgttatcgtaacatttgggcaatgtgcatcggcttttttaccatcaattatacctcctatttttttattacctggcttcctacttacctggtaaaagaaaaaggtatggattttattaaaatgggaatggtagccgctctgcctttattatgcgggatggttattgaagtttttgctggctgggcctcggatcgtctggtacataagaaagtactgtctcttacggccacccgtaaactgtttttgactatcggcttgcttatggcactttgtatcggctttgcaccatttaccgactctgtgtttatgaccgtctttctcttgtgtgtcgcaaaatcaggcacgacggtcgccgcatcgcaggtttgggccttaccgggtgatgttgcacccaaaaatagcgtctcaattgtcgctgggctgcaaaatacggtttcgaatatgggaggcgcagtcggtcctatcattacgggtgcgatcgttgctgcgacaggctcattcaactgggcactgattttctcggccattcttgtcgttatcgggataatcaactacctgttcctgatgggtaaaattgaacctatcaatgataaaggtggaaaatcacccgtccttaatgccgcagaacaacattaa

SEQ ID NO: 2493 - DNA, 651 bp, Klebsiella pneumoniae
accgacattcgctggcgcggcatgaccgggggtacggcagcccgaaagatgatccaagagtatcgccaggcagagtctggtaaccggggagaaacagagatgaatatcaacgtggtcggcaccagcggctcaggcaaatccactttggcccggcgcctggcgcacaggctggaattaccctggatcgaactcgatcgcctgtactggcggccgaactggcagggcgcgccggatgaggcatttttcgccgccattgccgccgcgacggccacgccgggctgggtgctggatggcaattacaatcgcagccgcagcgttaaatggcgtgcggtggatttggtgatctgggtagattatggtttctggcgcactctgcgccaggcggtatggcgggcggcgagccgggcgtggcgacatcaggagctgtggccgggcacgggcaactgcgagagctttcgccgttcgttctgcagccgggaatccatcatcctctggacgctgaaaacctggcggcagcatcgccgacgctatctggccgatatgcaggatccgcaatatcgtcatattcgcttcgtccgggtgcgcaatccgcggcaggccgaggcgctgctccgcgagctggaagcgcagcgttcagccgggcatatctaa

SEQ ID NO: 2494 - DNA, 336 bp, Klebsiella pneumoniae
aggcctgttcgacatcaatttcaatcacccgtactcgggaatggacctgcagcgcagcaacctgacgctgcgccatctcgctcatcgaaccgaccaccgccagcagcgggccctgctcgctgcggcgcaggcggcgagccagcgcctcgcagagacccgccgagccgaccagcagggtctcccgcgcatggggcgcaacggcgtcgatcacctggtccagatggctgtcttcccaggcgtcgacaatcaacactcgcttttcctcgcccgccgtcgctaatgccgccggaagctggccagcgttcagggtcagacagggaagacggctctgcatag

SEQ ID NO: 2495 - DNA, 1671 bp, Klebsiella pneumoniae
aaccaggttcgcttaagcgaagcgtcatcaatgccgcatctgcccacaggaagggagagaatcatgaagagaattgccatcgtcggcgtggggccgacggggatttacaccttttatgaactggtgaagcgcggtgagccgctggccatcaccttgtttgaaaaagaggcgcaggccggggtgggtatgccctacagtgacgataataccgcggcgcaaatgctggccaatattgccagcattgagatcccccccatcgacctgacctacctgcaatggctgcagcagcaaagcgatgactggctggcggcgcgcgggcttgaacggcacgccgtgcatgagcgccagtttctgccgcgggtgatcctcggcgaatactatcgcgaccgttttctgtacctcgttgagcgggcccgggacgtcggctttgtgattagcgtttgtgaatcctgtgaagtcacggatattgcggttcagcccaccgggatcgccatccacaccgatagtgcagcagacccggtaattgtcgacctggtggcgattgccaccggccatctgtggcctgaagaagagcgcgccagccgacagtacttccccagcccgtggaccggcctgatggaggcccgcattgccccctgtcgggtggggatccttgggacttcattaagcgcgattgatgccgccgtggcggtagtggcccgccacggcgttttccataccgaggacgacaaaacgacccatttttccctccatccaggcagcgaagcgctggagatcaccctgatgtcacgccacggcgtgctgccggaggccgatttttactgcccgatcccgtgggagccgctggagattgccactcccgccgccctcgaagcggccattgcggagggtagcgacgctctgttagatcggatttttgagctgatcgttaaagagctggaatatgctgcccccgactggagcgaggcgatcgggcttcgtcagctgacgcctgacagtatcgccgacgcctggtttgccgaccgcctcacccatgacccctttcagtgggcgcagcgcaatctgcaggaggtggagcgcaataagcgcgaacaccacacggtgccctggcgctatgccattctgcgcctgcatgaggcgattgaaaccgtggtgccgcagttcaacgacgcggacagccgtcgcttccgccagggcctcgctcgggtatttatcgataactacgccgccattccgccggagtccatacgtcggctgctggccttgcaccgggctggcattctgcggatcctgacgctgggcgaagattatgagctgcagcgggagcctgaccggacgctgattgttcatcatcgtcagcgctgcgaattcgatgtctttatcgatgcccgcggacaaaaagcgctgaaaacccgggatctgcccttcccttcactgcgccagcagctgctggcctgcggcgacgacattccggacgttggtgatgactacacgctgcaggcgccggagacagtgcgcggtcgggtcgccttcggcgcccttccctggctgatgcacgatcgcccctttgtgcaggggctgacggccagcgccgagattggcagcgcaatggcccgcgccgtgtcgcagcaggccgccggccgacggcgccgtctctggtatatcgaatag

SEQ ID NO: 2496 - DNA, 837 bp, Klebsiella pneumoniae
ccatcacctcgccggcacacctccgcgcgcgccggacgcgcccgatctcctgatcggccaggccgccctgctgcagcagctgatgagggcccaaccatgaccggacgtctctggcgcggcggcatggtattcggcgggctgatgctcctctggggtctggccagccgcagcggcattccccattttcttttaccgtccccgctggcggtcgccgaggcgctatgggtaaatcgcgcctatctcggctggcatacgcttatcacgctcagtgagatcctgagcggcctggcgctgggcgtgacgctcggcgtcaccctggcgctgggcatgatcctctccccccgtctgcagcgctggctgatgccgctggtgctcaccagtcaggcgatcccggtctttgccctcgccccgctgctggtgctgtggctgggctttggcatgagcgccaaagtggcgatggcggtgctggtgattttctttccggtaacttccgccttctttgatggcttgcggcgggtcaaccaggagtatctcgatctggcgcgcagcatgaatgcctccttcggcgctcaactgcgacatgtccgcctgatggccgccctgccggcgctgggctctggcctgcgcatggcggcggcggtggcgcccattggcgcgatcatcggcgaatgggtcggctccgccgaggggctgggctacgtcatgctcaacgccaatgcgcgactgcaaaccgatatctgcttcgccgcgctgtttattttagtactactgaccctcctgctgtggctggcggtagataccctgctacaccggctgatcgactggtcgccggaataa

SEQ ID NO: 2497 - DNA, 1029 bp, Klebsiella pneumoniae
tatgccgctcgagctggcctgggaaaccatgtcccgcgaactgtccgccgcgctgcactcccccgagctggtatagaggagcgaatgatgtcaggaaaagtctgtgtttttggttcattcaatttcgacatggtcgccagggtggatcgctttccggtaccaggtgagtcgttagtggcctgcggaagtatgaccagcgccggaggtaaaggggcgaaccaggccaccgccgcgctaaaagcgggagcaaatgtccactatatcggcaagattggcaatgacaccttcggccattttgcccgccgtcatctgaaaggcgtgggcttcaatgctgtgacgctgctggtcgccgaagagacccccaccggcaatgcgctgatttatgtcgccggtaacgatgccgaaaacatgattgccgtcgatcccggcgcgaatatgacggtgaccgatgatgaaatcgccggctgcattcccgctatcggctgcgcggatgtggttctggttcagctggagaacaatctttctgctattgaacaggtcatagacgccggcaaacaagccggggccctggtaatactcaatcccgcgccctggcagcccgttgagcacgcccttctacgcaaagtggatttacttacaccgaacgccacggaggccgggttaatgaccggacgccgggttgacagtctgacggccgcggctgaggccgccgacgtgttacatgctcagggcgcgcgcaacgtcattatcactctcggtgccagcggcgccctgctgagcgagcatggggtgaaatcccctattccctgctttccttctcacccccgagacactaccggtgcgggcgatgccttcaacggcgcgctggcggcgcggctggcctgcggggaaccgctacaggccgcagcccgattcgcggcggcctatgccgccgtcagtgtcgaaaagcaaggcgcctcatctttacctgagtacctggaggcacaggaacggcttctccgtgccgccgctgattatgaaatggcataa

SEQ ID NO: 2498 - DNA, 978 bp, Klebsiella pneumoniae
ccaggatatcgccctactacaggcggtggtgatgatctccgccctcggtttcgtcctgatcaacctgctggtcgacctggtcatgccgcgactggatccccgactccatttacagaccggaggtgcgaaatgagcctggtcgactataccatcgcggttcgccgccgcccggagtggcgtagagtgcgcctgcagcctggcctgtggctggcgtgggcggtgatgatcgccgccctgttaatggccattgccccacagtggtttacctccgctaacccgctggaggggatccccggcgctcagcgcctggcgccgcaggcgcactactggctgggtaccgaccagctggggcgcgacctgtggacgcgggtggtttacggcgcggtgcattccctgtcggcggcgctgatcgccgtcgccatcggcctggtggtgggtaccacccttggcaccctcgccggggcgctggccggacgcgtggaatccaccatcatgcgcctggtcgatgtcctgctggccatcccctccctgctgctgcagctcacggtgattattctgctgggtttcggcacggtgaatgcggcggtggcggttggcgtcgcggctatcgccagcttcgcgcgcctggcgcgagcagaagtggtgcgcgtgcgccacagcgattacgtcgaggcggcccggggcagcggcggcacttttttcgccgtcttctggcgccatattctgcccaactcgctcactgcggtgcttgctttcgcgacgctgcagttcggtcaggcgatgttggccctggccaccctcagtttcctcggctacggcaccccgccgccggtcccggagtggggattattgatcgccgaaggtcgcaattacctgtcaaccgcctggtggctgaccaccttccccggcctcgccgtggtcgccgtggtccttgccgccaatcgtcttagccgccagtggagtggagcacgcccatga

SEQ ID NO: 2499 - DNA, 831 bp, Klebsiella pneumoniae
tcatattgtcgccagcctgtgcttcgagcgcgatggcgtcagcctgcccgatttttcccggctgttcgccggccacaaggagtcgtgatgtcttccgttcgtatacaagtgattaaccccaacaccagcctggcgatgactgaaacgataggcgccgctgcgcgtgcggtcgctgcaccgggcaccgagatccttgcggtctgtccccgcgccggggtgccgtcaattgagggccactttgacgaagccatcgcggcggtcggcgtgctggagcagatcagggccggacgcgagcagggggtggatgggcatgtgatcgcctgcttcggcgacccggggctgctggcggcgcgggagctggcccaggggccggtgatcggtatcgcggaggcggcaatgcatatggcgacgatggtcgccacccgtttctccattgtgaccacgctgccgcgcacgctgatcatcgcccgtcatttgctgcaccagtacggatttcatcaacactgcgcggcgctgcacgccattgacttgccggtgctggcgctggaagacggcagtggcctggcgcaggagaaagtgcgtgagcgctgcattcgcgctctgaaagaggatggcagcggggcgattgttcttggctgcggcgggatggcgaccctggcgcaggagctgacccgcgagctgcgggtgccggtgatcgatggcgtcagcgcggcggtgaagatggtggagtcgctggtcgcgctgggcctggcgaccagcaagcatggggacttagcgttcccggagaaaaaaacgttaagcggacagtttcagtcgttaaatccattttaa

SEQ ID NO: 2500 - DNA, 1359 bp, Klebsiella pneumoniae
cgatttcgtcgccgcctgctcctgcggcagaataaggttcagcgctatcgctaccagcccaccgctggtggctgccgaaccgaacagatcgccgaccatcggcggaaaatggctgagaaacgccggcaccgactccacgccaagacccgcgccaaacgccagccccacgatcagcacatcgcgacgagtcagcggagtctgggtaataatccggatcccggccgccactacgcagccaaacatcaccatcgtggcgccccccagcaccggcgccgggatctgccgcagcagttcgcccaccggggggaacagcccgagcaggatcagaatcacgccaatgtagcgtccgacatagcggctggccaccccggtcatctggatcacgccgttgttctgcgcgaaggtggtgttcggaaaagcacagagcatggccgccaccatacagctgacgccatccgccaggataccgcccttcagccggttacgaaaagcgcgatcgtcaacagactgttgcgaaatcagcgagttggccgtcagatcgcccaccgcctccagaatacagaccagcgacaccagggcgaccggcagaaatatcgcgctgttaaactgaaagccgaacggaaacagcgtcggcaggcgaaacagagtgtcgcccaggctgtgaagatggaactgaccgctcagccccgctgcgatgcagcccacggcaatgcccaccaccaccgaggagagccgcagccagcggtttttggcgcagctcagcaggacgataaccccgagggtgcccgccccgagcgcgatattgctcatgctggcgaaatcctcggccttttccccaccgcaccagttgatgacgctgaccttgatcaggctgatgccgatcagcgcaatcacgctgccggtaatgatgggagtaaagattttcttcagcggttcgataaagcggctgacaatcaccggcaccagagcggcgacaaagttaacgccaaacagcatcgccatcatatcctgcggcccgccgccctgggcttttacccacatccctccggccaccgtcacgccgaggaaggcaaaactggtgccctgcatgcagatcatcccggcgccgatgccccatacccgattggactgcagaaaagtgccaatgcccgaggccagcagcgacatactgatgagatacggcagccagtcgccaagcccgagggtagcgccgatgatcagcggcggcgtgatgatccccaccaggcccgccagcacatgctggagagcgctgaaaaaggccggaagcggtgggatccgctgttcaaggccgtaaagcaggccactgtgatgttcgtcagacatagtgatatcccgtag

SEQ ID NO: 2501 - DNA, 1674 bp, Klebsiella pneumoniae
cgtcagctgctgcgctttatcgatcagcagggtttccgtcgagacaccgccttcgatacggcgatagttgcggaagccatccgccagcggctgcagcagatcaaacgactcgacgtcggtctgctcaggcagagcgtcgacgcggcctggggtaaacggcacattgacgctgacgccggcggcagcggccgcctgctcaacgccgaccacgccggccagcacgataatatcggccagcgacgctttgccggaggcgcgctggatcgcctgcagggtcggcagcacccggctggcgatggcgttaaccggccagtctttctgcggggccagcgccagacgcgcgccgttagcgccgccgcgtttatcgccgccgcggaaggtggaggcggacgcccaggcgaccgagaccagctcactgaccgacaggccggcgccggcgatggcggttttcaggctggcgatatcttccgcgctcggctgatgggtcgctgccggcagcggatcctgccaaatcagatcttctttcggcacttccggcccgaggtaacgggattttggccccatatcacggtgggtcagcttgaaccacgcccgggcgaacgcctcgttaaaggcctgcggatcgttgaggaagcggcgggagattttttcaaactccgggtcgaagcgcagggtcaggtcggtgaccagcatggtcggtttgcgctttttctccgggttaaacggatccgggataatctccggcgcgtctttggcttcgaactggatcgcgccagccgggctgcgggtctgcacccattcgtatttgaacaggttttcgaaaaagtagttgctccactgggtgggcgtctgcgtccagaccacttccagaccggaggtgatggcgtccgcgcctgcgccgctgccgtagctggagtgccagcccagaccctgcgcttccagcggcgcggcttccggctcggcgccgacgtggctggtttctgcggcgccgtgggttttgcccagcgtatggccgccggcgatcagcgcgacgatctcttcatcgtccatcgccatattgccgaaggtggcgcgaatggccgccgcggcggacagcggctcgccgctggcgttcggaccttccgggtttacataaatcagacccatttcggtggcgccgatggcctgtttcgccaggctttccggatgacggtgggccagccactctttctcatcgccccagtcgacgtcgagatccggttcccagacgtcttcgcgaccggcgccaaagccaaaggtgcggaagccggcgttttccagagcgacgttacccgccagcatgtaaaggtcggcccaggagattttctggccatatttctgtttcaccggccacagcagacggcgggccttatcgaggctgacgttgtcaggccaggagttcaggggggcaaagcgctgctgtccacgacctgcgccgccgcgaccgtcaacggtgcggtaggtgccggcgccgtgccaggccatacgaataaacaagccaatatagctaccccagtctgccggccaccactcttgcgaatcggtcagcagcgctctgagatcagccttcagcgcggagtaatcgagctttttaaactcttccctgtagttaaaattctcacccaacgggttggagcgattggagtgctggtttaa

SEQ ID NO: 2502 - DNA, 903 bp, Klebsiella pneumoniae
ataatgggtcggttggcaggtaacacgttaagccgcaatgaaaatgtaatcaatacgtcatctcgtctgactatagtcgccagcactaagtcccaaagaggatcacaatatgttggctcccctgatgctatcccaggtgagcgtgccccgtcggatgtcgaccgccgggctggtctcgctgtcccgaaagggagggcgatgatgcgcacgctgacccctatcaccctgcaggaggtctctttcgccttcgcagagacccccattcttgaccgcttcacgttgcatatcgaacccggccgcatcgtggcgctactgggcccttccggctgcggcaaaagcacgctgctgcgtctgctggccgggctgagcgtgccggccagcggcgaaatccgctttggcgacaggctggtcgcccgcgcaggatggggattgcccccggagcagcgcgatatcggcatggtttttcaggattatgccctctggccgcatatgagcgtggcgcagaacgtcgcctttccgctgcgcatgcgcggcgtctcccgcagcgaacgcgagcgccgggtcagcgaggcgctggcgcgggtaggcctcaacggctttgccgaacgtaagccttcaggcctatccggcggtcagcagcagcgggtggcgctggcgcgggcgatcgtcgccgcgccgcgggtgctgctgtttgatgaaccgctctccaacctggacagcgaactacgcgaatcgctgtgtggcgaaatgagccgcctgctgcgacagctcggcatcaccgccctgtatgtcacccatgaccgacgtgaagccgagctgttagccgaccagattgtctatttatccgcgggccgcgtggccgctgtccgcgccgttacgccaacctcaggggaagttgcatga

SEQ ID NO: 2503 - DNA, 309 bp, Klebsiella pneumoniae
tcctctatccggagggtatggccaaactcaatgagaccgccgcggcgatcctcgagctggtcgatggccggcgcgacgtcgcggcgattatcgccatgcttaatgaacgtttcccggaagcaggcggcgtcgatgacgacgtcatcgagttcctgcagatcgcctgtcaacagaagtggatcacctgccgtgagccagagtaaacccaccgtcaatccgccactgtggctgctggcggaactgacctaccgctgcccgctgcagtgtccctactgttccaatccgctgggacttcgcccggcaggataa

SEQ ID NO: 2504 - DNA, 186 bp, Klebsiella pneumoniae
gcatcagtccggcgagaagccactgcaggatccgggggaatccgcgcggcgcgttgccagttgccatgtaatctccttaaccacaccagccacctcactgtgaaccaaatgaaacatattgcttttgaatcatttttgaatgaagtggttttaaccttcataaaactgtatttgttgcttgattag

SEQ ID NO: 2505 - DNA, 546 bp, Klebsiella pneumoniae
tattttccccgcgtttcgtttcgccaggagcgtaacgataaggacattcttatattagacgatatcagaacaattgactttgtaaaaatggccagcctcagccaggctttattctcatcgtcagcaaaaaacggaggcatgatgaaaaaactagcattggccatggcatgtctgtttgccgtaggcgtcgcgcaggcggacgataagggagggtttagccaggatgccgcgccgccgccgccgcacaaactcgatgacggctatcgcggcgtcgaggatggccggatcatgaccgttgagcaggcgaaaaccatgcacgatggcgcgaccgtttcgctgcgcggcaacctgctcaagcggcagggagatgaccgttatcagtttcgtgataaaagcggcaccatcaccgttattatcccggtcgccgcgtttaacgaacaacacgtagagccagacgatctggtcaatatcaacggcagtctggatcgcaaaatgacgccgccggtcgtgcgaatcgatcgtctgctcaagcagtcgcctaagtaa

SEQ ID NO: 2506 - DNA, 483 bp, Klebsiella pneumoniae
catgtaacccggcacccggaggcgatgctgcgcatctgtccgggctacgcgttctcagcggtctgcagttccgtagcccgggcaaggcgctttgcgccgcccccggggaggggcttctccggcgacgcactgagagaaacagcatgttcatctatcctaagcgccagagagccaaccgaggtgggtatgaaagacgaattgtttgccgatctgctggcgagtgcagaagaaatggtcaggatcgagaaaggtgaacaaatgccgatggagcagcacgttcataccttcagcgaaattgacgtgaaagcgatacgtgaagccacaggtttaaaacagcaggactttgcagcggccgttggcgttagctacgagttggttaaaagctgggaaacgaaacgacgtcacccaaccggtgcagccagaaaactgcttttattgcttcagggtaatccattgattatcaacttgttgaaggttgtttga

SEQ ID NO: 2507 - DNA, 246 bp, Klebsiella pneumoniae
cggatagtgctcgccaggcatgaatttaccgcacaacaacaattagcgctccactttgagataaataatgattactattcgcattcaaaaataagggtaaagccaggactttaccgccggaagcgatgtcgggtcagcacatactggtttatcaaagggagtcgtcatgtcattacgtcattttgccgcgccgcgtctgcgccattcactgctcgtcacttctctgctgctggcaggcagctttag

SEQ ID NO: 2508 - DNA, 477 bp, Klebsiella pneumoniae
ggtatccaccggcccgcttccggtccggtaacatgttatttggagtcgaagatcatggtgttcatcagagcggctgaagcagaagatatcccctcgctgcaaacgctatttctgcagctgggctatcagacggagacggcgatcttagcgcaacgcatcactgccccgcagagcatgatgagtgcgctggtggcggaaacagaaaacgccgtgtgtggcgtaatcgttatcaattttattttaccggtacatgagaaccgtttatgggcattaatttccgcgctggtcatcgaggaatcgtcacgtggatcagggataggccagcagcttctccaggccgcagagcgcctcgcccgtgataaacaatgcgctcagatcgagctttcaagtagtgaaaaaagaatcagagcgcatcaattttatgaaaataacggctacaaggaggttcgcaaacgcttcgttaaacatttgtcttaa

SEQ ID NO: 2509 - DNA, 1314 bp, Klebsiella pneumoniae
aaaagccgccggcacactaatactacaggagagttaactatgggcgtttccgttaaacgcattgtcgtcaccgggatggggattgtcagcccgctgggctgcggcgtacagcacgtctggcagtcgctgctggcaggaaagtcaggggtcacccggctcagcgagcagctggtcgcggatattccctgcaaagtggccggccaggtgccgtccattgacagcgatccgctgcacggcttcgacccgctggcgaccatcccggcgaaagagcgcaaaaagatggatcgctttatcgagtttgcgctggtcgccgcccgtgaagcgctgacccaggccggctggtcgccagcatctgcggccgaacaggaacgtaccgccacggtgatcgccaccgggatcggcggcttcagcgagatcgccaatgcggtacataccaccgaggagcgcgggccgcgtcgtctctcgccgttcactatcccctctttcctggccaacctggccgccgggcatgtgtctatcgcccacggcttccggggccccatcggcgcgccggtcaccgcctgcgcagcgggtgcccaggccatcggcgatgcagcgcggatgatccgtagcggcgaggcggatattgccctctgcggcggcgcggaagcggcaattcatcgcgttagcctggccgggtttgccgcggcaagggcgctgtccagcgcctacagcgaccagccggaaagcgcttcccgcccctttgaccgtgaccgcgatggttttgtgatgggagaaggcgccgggcttattgtgatcgaatctctggagcacgcgctggcgcgcgaggccacgccgctggccgagctggtgggctacggcaccagcgcagatgcttatcacctgaccgcaggcccggaagacgggaacggcgcacgtcgggccatggagatcgctattcgccaggccggggtgaccgtcgacgagattgaccatatcaatgcccacgccacctcgacgcaggtcggtgataaaggtgagctggcggcgattaaaacgctgtttggcgcgcatccggtcgccattacctcgacgaaatccgccaccggccatctgttaggcgcggccggcgggatcgaggccatcttcaccattcaggccctgcgtgaccaggtggtgccgccgacgctgaacctgcatcaccccgatgaagacgcggcaggcatgaacctggtggcgctgcaggcccgcccgcagaagatgcgttatgcgctgtcgaacggttttggctttggcggcgttaacgccagcctgctgctgaaacgctggcaataa

SEQ ID NO: 2510 - DNA, 702 bp, Klebsiella pneumoniae
catccgcgccggaggcccgaaatgatccagtatctgaacgtcttcttttacgatatctacccttacctgtgcggcaccgtctttctggtgggcagctggctgcgctacgattacgggcagtatacctggcgcgcctcatccagccagatgctggataagcgcgggatggtgctatggtcgaacttatttcatatcggcattctcggcatcttctttggccatctctttggcatgctgaccccacactgggtctactcgtggttcctgccgatgtcccagaagcagctgatggccatgatccttggcggcatctgcggcgtgctgaccctggtaggcggtatcggcctgctgatgcgccgcctgaccaacccgcgaattcgcgccacctccacgaccgcggatattttgatcctgtgcattctgctgattcagtgcgcgctggggctgacaaccatccccttctccgcccagcatccggacggcagcgaaatgctcaagctggtggactgggcgcaggcggtggtcaccttccacggcggcgcctcggcgcatctggacggtgtcgcatggatttaccgcgtccacctggtgctcggaatgaccatctttctgatcttccccttcacccgcctggttcacgtctggagcgcgccggtggagtatttcacccggcgttaccaggtggtacgctcccggcgctga

SEQ ID NO: 2511 - DNA, 468 bp, Klebsiella pneumoniae
atgattttacgtgttttggctgtatcgatgattggttttacgctcgcaggctgcgtgagcagcagcggcctgtccggcgacgtttattccgcatctgaagccaaacaggtgcagagcgtgacttacggtaccatcgtgcatacgcgcgccgtacagatccagagcggcgacgatagcaatgccatcggggccattggcggtgcggtactgggcgggttccttggaaacaccatcggcggcggtaccggacgctctctggctacggcggcaggtgcggtcgcgggcggcgtagccggtcagggcgttcagggcgcgatgaataaaacgcagggcgttgaactggaaatccgtaaggacgatggcaataccattatggtagtgcagaaacagggcagcactccgttctccgttggtcagcgcgtggccattgccggcagcggcagccaggtcaccgtctctccgcgataa

SEQ ID NO: 2512 - DNA, 777 bp, Klebsiella pneumoniae
tcgacgttacgctgctttttacgccagagggcttcgggatgttgtgagccacacaaaattcctgcaaaaaaatgtgcgataaccgcccggctaacgcttcccgtcagtgccgcccggtacactgggggaaccgcagaacaagaggtttccaccatgacaatcacctgcaatctgtacattaacggccagtggcacgatgccgaaggccgccgcacctttacccgacgccacccggcccacgatgaggcagcctcggtggccgctgccgccagcctcgccgacggcaaacgctgcgtcgaaaccgcggcctgcgcctttccgctgtggcgcgatactgcgccggcggaacgacgtcgcttactgctcgaggcggcggaacagatgctgttgcgggaggcgaaatttatcgccgccatggcggcggagaccggcgcgaccgcgcactgggccggatttaacgttcatctggcggcagatattctgcgtgaagcggcggcgctgaccacccagattgaagggcaaataattccgtccaacgtgccgggtaacctggcgatgggcgtccgccagggggcgggagtggtgctgggcatggcgccgtggaacgcgccgctgattctggccacccgggccctggcgacgccgctggcctgtggcaacacggtgatccttaaaggcgccgaactttcccccgccactcagggactgattatcgacgcccttgacgcggcggggcttcccgccgggcgtggtgaactatcttacctgtgcgcctga

SEQ ID NO: 2513 - DNA, 546 bp, Klebsiella pneumoniae
cgcccgctacgatctcaccccgacgctggcgcagcccccccatccactcatcttacagcagacgttatcatgtcctttttaactctcctgcgtcgggtcgccctgacgctgttattcactctgttaccggccgccagcggatgggcctgtacgccagtgtttgtccacggccaggcctccacccttcggctgaacgtggggcagctcacggttccggctgacgccagacccggcaccccgctgtatcataaaagtttcgcctggaaccgccttagcgacggcggcgaacagtggatccgctgcgcggacgacccgcacgggctgtcaccgctgctggcggaacatctgctgtccgggggaagtgccgcgcccggcgggtttatcaaactaccttccccggcattggggttcgagaatcgcggcgggctatcggcgggctatggcggctttcctgaccgggccaacgccctcgccgtttacccacggggtggacaatcccgccgctttgccccgatgcggtgtggaaactgggctatttccgcctga

SEQ ID NO: 2514 - DNA, 1428 bp, Klebsiella pneumoniae
gccagaatacggacacttcgcaagcaacgagagagaataatgatgaatttatctgcaacgcacgccgtctccgtcaatccgactaccggtgaggtggtctcctcgctgccgtgggccagcgaacgcgaggtcgacgcggccatcgcgctcgccgcggcgggctatcgccagtggcgtcagacgccgcttgccgaccgcgccgatgccctgcgccgcatcggggcagcgctgcgcgcccgcggtgaagaggtggcccagatgatcacccttgagatgggcaagccgatcgctcaggcgcgcggtgaggtggcgaaatcggccaacctctgcgactggtacgctgaacacggcccggcgatgctggcgacggaagctaccctggtggaaaataaccaggcggtaattgagtatcgtccactgggcgccatactggcggtgatgccgtggaacttcccggtctggcaggtgatgcgcggcgcggtgccgatcctgctggccggcaacagctatctgctgaagcatgccccgaacgtgatgggcagcgcccgtctgctgggcgaaatttttgccgccgccggcctgccggatggtgtatttggttgggtgaacgccactaatgacggcgtttcgcagattatcaatgacgaccgcatcgcggcggtgaccgtcaccggcagcgtccgcgccgggaaggcgattggcgcccaggcgggcgcggcgctgaagaaatgcgtgcttgagctggggggatccgatccctttatcgtgctcaacgatgccgatctcgatgaagcggtaaaagccgccgtcaccggccgctatcagaacagcggccaggtgtgtgcggcgtcgaaacgctttattctcgaagccggcattgccgaggccttcacccgcaaatttgtcgacgccgtggcagcgctgaagatgggcgacccgcgcgatgagcaaaactacgtcggaccgatggcgcggttcgatttacgcgatgaactgcaccagcaggtaacggcgacccttgatgaaggagcgactctgctgctgggcgcggaaaaaatcgaaggggcgggcaactactatgcgccaacggtgctgggcaacgtcaccgccgggatgactggctttcgtcaggagctgtttggtccggtagcaaccctgaccaccgctcgcgacgctgaccatgcactggccctcgccaacgacagcgagtttggcctgtccgccacggtctataccaccgacgaggcgcaggcccagcgctttgcccgcgagctggagtgcggcggcgtcttcctcaatggctactgcgccagcgacgcccgcgtggccttcggcggcgtgaagaagagcggttttggccgcgagctgtcgcattttggcctgcacgagttctgtaatgcgcagaccgtctggaaagaccgtcgctaa

SEQ ID NO: 2515 - DNA, 321 bp, Klebsiella pneumoniae
ttcattccacgcggccccagcagaaggcgccgttggttgagagtaggtttagtgaatgctgataatattcaacgcaataattccgattataaaatggatacgaaaatgaccgtgctggactacttattaaaatttcgcaaaatcagttcgctggaaagccttgaaaaactatttgatcaccttaactactccctgactgacacccaggagatcgtgaatatgtatcgcgccgccgatcatcgtcgcgcagagctggtctccggtggtaaattgttcgatgtgggccaggttcctaaatccgtttggcgattcgtgcagtaa

SEQ ID NO: 2516 - DNA, 498 bp, Klebsiella pneumoniae
tggagaccacgattgctgcgaggcaacgcgtatcgttacgcgaccgtccgtaaacatggcgcctcgttttgcggtggcgcaagatggcgcccggcgcggcgcgatataatagaaaaattgctaatccttacggatattaatggtttgcttttcggcgggcgggttcttatccttaagaaaactcaagaggttattacgatgaaagatgtagtagataaatgcagcaccaaaggctgcgccattgatgtcgggacgatcattgataacgaggactgcgtctaccgggccgagaaggtgttcccaagccgcgaagaagcggaatccaccgtagccgccgtgcgcgaacgtgctgccgccgcagcgccggccagtgaaccgccgcaggtcgattacaccatcgtcgccgctggcgacgcggtgaaactcgacctctccatcgccttctcctgccaggcggaaaagatcattttcgagttatccctgcgaaatctgctttaa

SEQ ID NO: 2517 - DNA, 393 bp, Klebsiella pneumoniae
acaccgccacggtttgcgtaccggccggagagagcagcagcgaggtcaccagctcccgggaggccaccgcgaacaccatcagcatcgccgccagcagcgccggaaagaccagcggcaggacaatcaaccgcagcgcctgcagtggcgacgccccgtgcaccctggcggcgggctcaaggttcgggcccagctggcgcagcgcgctgccgacatagcgcaccggccagggcaacagcaggcagcaataggagagcagcagcatccacagcgtgttatagggcgagcgcggccagaagggctgattccacagcaggatcaaaccgacccccaccaccacgcccggcagcgccgccggcatcagcgacagcgcgtccaccatcccgcgccctttaa

SEQ ID NO: 2518 - DNA, 624 bp, Klebsiella pneumoniae
ccgggccaacgccctcgccgtttacccacggggtggacaatcccgccgctttgccccgatgcggtgtggaaactgggctatttccgcctgacgattgagctcattaaaaccggtcccgcggcgacgccgggcgagcttgagtatcacagcgagcgctttttaatggcggagcataccccgctggccgcgttagacttaaccggcaggatcagcaccgcgggatgttcagtgaatgacgccacgccagccctgatcaagctccctgcggcgatgcttgaccacttcggcggcgtcggcaaaaccaccggcgacacccctttcgcgctgcagctggattgcaacagcgcggtcacgatttccctgcgagttgacggcgcggagcccctctccgcccgggggcatggcgttctgcgcaatgacgccaccgacgatcgggcgcagggtattggcgtgcagttgctttaccatcgtcagccggtcgtactgaatcatgagatgacgctgggcagcgcgagcgcgggccggtttaccctgccgctcactgcccgctactaccagacacgttcccggatcaccgccggtcaggtgtcggccgtcgcgacctataccttgcattatgactag

SEQ ID NO: 2519 - DNA, 831 bp, Klebsiella pneumoniae
aacctacaacggctcggtgatcccggtggcccctcagtcatgataaccatcgaagggctgagcaaaacctacgccggaaccggccgaccggcgctgaacgatatcgcgttgcagataccgaaaggggcaatatacggcattctcgggcgcagtggcgccggcaaaagtacgctcatccgctgtctcaatttactggagcggcccacctcgggccgcattctggtgaacggacaggatattacccagttgaacaaggcggcgctgcgggattatcgcctgcgcaccgggatgattttccagcacttcaatctgctgcatgcccgcaccgtcgctgacaacgtcgcggtgccgctggagattgccggagtgccgagggctgctcgcgaggtccgggtgcgcgaactgctggagctggtggatctcagcgaaaaggccgctgctttcccgtcacagctttccggcgggcaaaagcagcgcgtcggcatcgcccgggcgctggccgcccggccggaagtgctgctgtgcgatgaggcgaccagtgcgctggatcccgagaccaccgcctcggtgctggccctgctggcggatattaaccagcgcctcaatctgaccattgtgctgattacgcaccagctggaggtggtgaaaaccatctgtgaccacgcggcgctgctggaacagggcgagattgtcgaaagcggtaaactcgccgacctgctggtgactccatggtcgcggctgcgccagtcgctgctgcacgacccgcaggctgaacaggaatttcttacccgccacggcgttcaggggaggccattatgcggagtagcatga

SEQ ID NO: 2520 - DNA, 216 bp, Klebsiella pneumoniae
aggctgcaacgggcaatttttttgctcatcaggtgttactcctgtcacaaaggaattagcggcagccgtgccgtaaaaatatctcctgaaataagggtagtcagcggattaacgcccccaggggaatttattcaggttgtgacccgggacgcattacgtaaaaatcgccaacacaagcaggactttatggattatagacaacgagttagggaatga

SEQ ID NO: 2521 - DNA, 1275 bp, Klebsiella pneumoniae
atcatgcaacgtagaacgttattaaaagcttttgcactctccgcctctgttatggctatgggtctctccttccaggcctatgccgccgacaccatcaaagtcgggatcatgcattcgctctccgggacgatggcgatttccgaaacgccgctgaaagacgtcgcgctgatggccatcgacgacatcaacgccaaaggcggggtgctgggcaagaaactggagccggtggtggtcgacccggcctccaactggccgctgtttgccgagaaggcgcgccagctgctggcccaggataaagtggcggtggtgtttggctgctggacgtcggtctcgcgtaaatcggtcctgccggtgtttgaggagctgaacggcctgctgttctacccggtgcagtacgaaggggaagagatgtcccccaacgtcttctataccggcgcggcgcctaaccagcaggctatcccggcggtggaatacctgctgagcgaggacggcggcggcgctaaacgtttctttctgctggggacggactacgtctatccgcgcaccaccaacaagatcctccgcgcctttctgcatgccaaagggatccaggacaaagatatcgaggaggtctacaccccgttcggctacagcgattaccagaccatcgtcgccaatatcaaaaaattcgccgccggtggcaaaacggcagtggtctccaccatcaatggcgattccaacgtaccgttctacaaagagctggctaaccagggtctgaaagcgaccgatgtaccggtggtggccttctcggtgggggaagaggagctgcgcggcatcgataccaaaccgctggtcggcaacctcgcggcatggaactactttgagtccgtcgataatccgaccaacaaagcctttgtcgccgattatcgcgcgtatgccaaagcgcacaagctgccgaatgccgatacggtggtgaccaacgatccgatggaagcgacctgggtgggtctgcatatgtgggcgcaggcggtgaccaaagcgggcaccaccgatgttgacaaagtacgcgaggcgatggccgggcagaccttcaacgcgccgtccggttttaacctgaccatggatgccaccaaccaccatctgcataagccggtgatgatcggtgaaattgaaggcaacggccagttcaacgtggtctggcagaccgatgagcccgttcgcgcgcagccgtggagtccgtggatccccggtaatgataagaaacctgaccatccggtgaaaaccgtcagccagtaa

SEQ ID NO: 2522 - DNA, 1404 bp, Klebsiella pneumoniae
gctgacgaacgggatcgtctcgatcccggcaaggcttctgaccacgaatacggggaaataataaccatgtccgcaataaatgaaaaggcggtaaacgggacgcagctgcaacgcacccataaaaaaatctaccgccatttgatgccgctgcttatcgtggcgtacatcatcagctttattgatcgtaccaatattggcatggcgaaagcgaccatgtcggtggatatcggcctttccgcaaccgcattcggcctcggggccgggttgttttttctcacctacgcagtgctggagatccccagtaacctgtttctcacccggattggcgcacggcgctggatagctcgcatcatgataacctggggcatcctctcctgcggtatggcgtttgtcaccgggcctacatccttttacgtgatgcgccttctgctcggcgccgccgaagcgggactctatccgggcattatttactacctcaccctctggtttggccgcgaagagcgcgcaaaagccaccggcctgttcctgctgggggtctgtctggccaatattatcggcgcgccgctgggcggattgttattaagccttgatggcatgtccggctggcacggctggcagtggatgttctttatcgaagggctgcctgcgatagcgctggcgttcgtcgtctggcgcagactgccggataaaccagccgacgcccgctggctggacagcgacgatgtgcaagccattaacgcggtactggcgaaagaagccgaggaaacgcgccatacgccgagccgtttctccctgaaaaccgcgctgtccacccgagtgtttttgttgctggtgctgatttactttacccaccagttttcggtttacggcctgagttatttcctgccggggatcatcggtagctggggccagcttactccgctgcagattggtctgctgaccgccatcccgtggattgccgccgccgcgggtgggatcctgctgccgcgattcgcccgcacggaacagcgttcccgcagcatgctgatggccggatatctggtcatggcgaccggcatggcgattggcgccattgccggccacggtgtggcgctgcttggcttctcgctggccgctttcatgttcttcgctatgcaatccatcatatttaactggctcccgtccatcatgagcgggcatatgctggcgggcagcttcggcctgctcaactgcctcgggctgtgcgggggctttctcgggccgtttattctcggcgcgtttgaggaccgcaccggtgcggcaacgtccggcttatggttcgctgtcgcgctactgattatcggcgcgctggtgtccctgtttctcaaaagttcctcatccccaggctccgtatcggcgaaacaggcccacggcgaaaaagtgtaa

SEQ ID NO: 2523 - DNA, 336 bp, Klebsiella pneumoniae
aagcgggaacgatcacaggacctccatttattcaggggagatccgggcgtgcaggggtgtgaacaggcaatggcggtaatgctggcaaaattgccgacccgtcccttcgctggcatgacccagatcaggttcaaagggttcggcttgcgccatctcagccctcacgggacacccctcggtagcgctatgttatacgacattcaccttttgaatacaatcaccgcgccaccttgccgcaggatggtggtaatgggggatagccagcgcttttccgcgcaacaactactaaccaccgggccgcgacgaacggaagagcggcttttacgcgcgcaatag

SEQ ID NO: 2524 - DNA, 1584 bp, Klebsiella pneumoniae
cggagaggacgcagtatgtcacaagcaattcaatacaattccagcgtggcgatgatccgtcacccgcgctttttacagcgtgcggccgacctgacgcccgcgctgcaacgcctgcgccagacgccgcaggccatcgtcgaggccgtcgctgaaccaggagcgctgaacggctggcgggggaataccgtctgcacgccggagcagttttatcagcaaccgctcaacgtcggcgacagcatcattattgattttggcagccattttgttggctacctgcagttcagctgccgcagcgtcggcagcccgcccgatgccccggcccatctgcacttcaccttcggcgagacgctgagcgaagtctgtgagccgttcagcgaataccagggatggctgagcagcagctggttgcagcagcaggatctgtggcttgacgtcctgcccgcccgggtcgctctgccacgtcgctattgcctgcgctacctgaaggtggaggtcaaagcgctgtcgcgcaagtttcgtctgcagttcgatgagatcgctctggaaaccgtcacctctgccggcagcccgcacccggcggtcatcgccgatccgcagttgaaagccattgatgacgttgccgttcgtaccctgaaaaactgcatgcaggaggtgtttgaagatgggccgaaacgcgaccgtcggctgtggctgggcgacctgcgcctgcaggcgcaggtgaatgacgtgaccttcggccaccacgatctggtccgccgctgcctgtatctctttgccggccatacccgggaagatggcatggtttccgccaatgtctttgttcagccagaggtacgcgccgatgacacctttctgtttgattactcattgttttttgtcgacgtgctttataactacctgcaaagcaccggcgacacggaaaccgtcggtgagctgtggcccacggcgcggcggcaaatcgagctggcgctgacccgctgcgattctcaggggctggtgcgcgacagcgatgactggtgggtctttatcgactggcaggcggagctgaataaacaggcgtcggcgcagggggtgctcatctactgtctgcagcgcgccctctggctggcgcagcgttttgaaccgcagcgggtacccgactacactgccacgctctggcagttgaaggaggccgccttccaccacctgtgggacaacgagcggcaggtgtttatcagcggcgccgtgcgtcaggtctcatgggcgtcgcagatctggctggtgctggcggaagttggcaccgccgggcagcgtcaggcgctgatgcgccgcctgcagcagcagccgcccgccattgccatgaataccccgtacctgcgtcatcatcacattgttgccctgctacagtccggcctgcgcgaggaggcggtggcggagatcaaagcctactggggggcgatggtcgcctatggcgccgacaccttctgggaaattttcgacccccaacatcctgacttttccccgtatggcagtaagcttatcaacagttactgccatgcgtggagctgtaccccggcctggtttattcgccagtacggactttaa

SEQ ID NO: 2525 - DNA, 696 bp, Klebsiella pneumoniae
ggccttatgcgttattacctttctccctcgctgatgtgtatggacatgatgaagctgacggaacagctgcgctttctaaacagcaaagccgacaggctgcatgtcgacatcatggacggccactatgtcaaaaatctggcgttgtcggccagctttgtggcgcagatccgtccctacacctcgcttcctatcgatgtccatctgatggtcgaagcgcccgcttcgtttataccggcgctgttagacgccggcgcagacgccttctcactgcatccggagaccatctgccgcgaagcgttccgggttatcaatatgcttcgtcaggcggggaaagaggtgggaatggtgctcaatcccgccacaccggttgagagcatccagcactatctgcatctgctcgataaggtgacggtgatgaccgtcgacccaggctatgccggtcagccgtttattcctgaaatgctcgccaaaattacgcagcttcatcagctcaaagagaccggcagcctccgcttcttgctggaagtcgatggctcctgtaaccgcaacacctaccgcgcgctgctgggcgccggcgcacagatattagtgatgggcagcagcggtttattccgcgctgatatgccgctcgagctggcctgggaaaccatgtcccgcgaactgtccgccgcgctgcactcccccgagctggtatag

SEQ ID NO: 2526 - DNA, 1578 bp, Klebsiella pneumoniae
cgaaggtcgcgatcaggtacaggaggcgaaaaaatgaaaatccgttctcaggttggaatggtgctgaatctggacaaatgcatcggctgtcacacctgctcggtcacctgtaaaaacgtctggagcagccgcgaaggcatggagtacgcgtggttcaataacgtggagaccaaaccgggcattggctaccccaaaaactgggaggaccaggatcagtggcaaggcggctggatccgcggcattagcggtaagctgacgccccgcctcggcaatcgggtcagcgtgttatcgaagattttcgccaacccgatgctgccggcgatcgacgattactacgaaccctttacctatgactaccagcacctgcacaacgcgccggagggcaaatatctgccgaccgcccgcccgcgctcgctgatcagtggcgagcgtatggataagattaactggggcccgaactgggaggagctgctcggcggcgaattcgagaaacgcgcccgcgaccgtaacttcgaagccatgcaaaaagagatgtacggccagttcgaaaataccttcatgatgtatctcccgcgcctgtgcgagcactgcctcaacccgagctgcgtggccacctgcccgagcggcgccatctacaagcgtgaggaagatggcatcgtactgatcgatcaggataaatgccgcggctggcggatgtgcatcagcggctgcccgtacaaaaaaatctactttaactggaagagcggtaagtcggaaaaatgtatcttctgctatccgcgcattgagtccgggcagccaacggtctgctcagaaacctgcgtcgggcgcatccgctatcttggcgtactgctgtatgacgccgaccgcattgaagaggcggctagtaccgaacatgaaaccgacctctatgagcgccagtgcgaggtgttccttaatccaaacgatccggcggtcatcgaggaagctctaaagcaagggatcccgcacaacgtcattgaggcggcgcagaagtcgccggtctataagctggcgatggactggaagctggccctgccgctgcatccggagtatcgcaccctgccgatggtctggtacgtgccgcccctgtcgccgatccagtcggttgccgacgccggcggcttaccgagcaacggcaacatcctgccggcggttgagagtctgcgcatcccggtgcaatacctggcgaatctgctgagcgccggcgataccggaccggtcttgcgcgcgctgaaacggatgatggcgatgcgccactacaagcgctcgcaaaccgtcgagggcgtcaccgatacccgggccattgaagaggtgggcctcagcgttgagcaggtcgaagagatgtatcgctatctggcgatcgccaactacgaagaccgcttcgtgatccccaccagccatcgcgaactggcggaggatgcctttccggaacgtaacggctgcggctttaccttcggcgatggctgccacgggtcagatacgaaattcaacctgtttaacagccggcggatcgacgccatcgacgtcagcggcgtgcgtaagcatggggagggcgagtga

SEQ ID NO: 2527 - DNA, 345 bp, Klebsiella pneumoniae
cgatatccgcgctggtgcgttcttcggtttcgatctgcaccgccgggtgcgctgccatccaggcggcgagcttccccggcagaaaggccgacatcgccgaggtgttggcgaacaggcgcagcgtcccccgctgaccgcaggcgaaggcgtgcatcgcctggcgcagacgctgctgctgcgcaagaagcgggcgggcatggcgcgccagtacctccccggcctctgtcatcgtcaccccgcgggcatgacggtgcaacagcggcacgccgatctcggcctccatcttgcgcagcctctcactggcggacgccagggccagatgggcattcgccgctccgccggtga

SEQ ID NO: 2528 - DNA, 360 bp, Klebsiella pneumoniae
agcctggcgcgacgctgggcgatattggccacgctattcagcgctgggtggaggaacatggctatagcgtggtcagagaatattgcggtcacggcgtcggtcaggaaatgcatgaggaaccgcaggtgctgcattacggccgccccggcagaaggcgccgtgctgcaggaaggcatggtgttcaccattgagccgatggtcaaccagggcgacagccgtatcaaaaccaaaaaagatggctggacggtggttacccgcgataaaaaactctccgcgcaatgggagcacaccgtggccgttaccgccaacggttttgaggtgctgacgttacgcgacgatgaacagtcgcggatccgctga

SEQ ID NO: 2529 - DNA, 981 bp, Klebsiella pneumoniae
ttatcggcgcgctggtgtccctgtttctcaaaagttcctcatccccaggctccgtatcggcgaaacaggcccacggcgaaaaagtgtaatcaggaggccattatgcgcattgaagtattactggatttaaaaacccgactcggcgaaagcccggtctgggatgtcgaacagcagcgtctttggtgggtggacagcctcgacgggcgcctgttcgcctgcaacgcgcagggcggcgcgattaagagctgggacgtgcgacagaaaattggctctttcgccctgcgccagaacggcgaaggcgcggtggtggcgctgcagaatggcgttcatctgctcgacttcgccagcggcgagctgacgctgttgcaccatccggaagcggaccgaccctttaaccggctcaacgacggcaaagtcgatcgtcagggacgctttctgttcgggtcaatggatatgcgcgaagaggaaccgagcggcgcgctatatcgcctggacgccgatctgtcactgcacgtgctgaagaaagacattatcgtctctaacgccccctgctggagcccctccggcgagaccttctattttgccgatacctggacgggcgaaatctgcgcctgggactacaacaccgcgaccggcgatctttccggcgaacgggtcttttgccatgtcgatcgcagcgaaggcggcgcggcggacggcgccaccgtggacagcgaaggctatctgtggaacgcgctggtctacgcgggcaagctggtgcgctataccccggagggcaaggtcgatcgcatcattgagatgccggtgaaaaaagtgaccagcgtgatgttcggcggcgaaaaccttgatgtgctgtacgtcacctccatggcgcagccgcccctgccgcgcttcccggaagataatcagctgcgcggcagcctgttcgccatttacgacctgggcgtgaccggcgtagcggaacggcgcttcgccggctaa

SEQ ID NO: 2530 - DNA, 531 bp, Klebsiella pneumoniae
acgccgtggcgggtaagaaattcctgttcagcctgcgggtcgtgcagcagcgactggcgcagccgcgaccatggagtcaccagcaggtcggcgagtttaccgctttcgacaatctcgccctgttccagcagcgccgcgtggtcacagatggttttcaccacctccagctggtgcgtaatcagcacaatggtcagattgaggcgctggttaatatccgccagcagggccagcaccgaggcggtggtctcgggatccagcgcactggtcgcctcatcgcacagcagcacttccggccgggcggccagcgcccgggcgatgccgacgcgctgcttttgcccgccggaaagctgtgacgggaaagcagcggccttttcgctgagatccaccagctccagcagttcgcgcacccggacctcgcgagcagccctcggcactccggcaatctccagcggcaccgcgacgttgtcagcgacggtgcgggcatgcagcagattgaagtgctggaaaatcatcccggtgcgcaggcgataa

SEQ ID NO: 2531 - DNA, 1365 bp, Klebsiella pneumoniae
aagggccggcgctttattctatgtacttttcgcatctggcgaaaagtcgtgtaccggcagaggtgcagtcgtttatacatggagaatttgatggcaagcagtaacttgattaaacaattgcaagagcgggggctggtagcccaggtgacggacgaggaagcgttagcagagcgactggcgcaaggcccgatcgcgctctattgcggcttcgatcctaccgctgacagcttgcatttggggcatcttgttccattgttatgcctgaaacgcttccagcaggcaggtcataaacctgtggcgctggtgggcggcgcaaccggtctgattggcgacccaagcttcaaagccgctgagcgtaaactaaacaccgaggataccgtgcaggagtgggtggataaaatccgcaaacaggtggctccgttccttgattttgactgcggcgacaactcggcgatcgcggcgaataactatgactggtttggcagcatgaacgtgctgaccttcctgcgcgatatcggtaaacacttctctgttaaccagatgatcaacaaagaagcggtgaagcagcgtctgaatcgtgacgatcagggtatctcctttaccgagttctcttacaatctgctgcagggttacgactttgcctgcctgaacaagctgcacggcgtggcgctgcagatcggcggctctgaccagtggggcaacatcacctccggcatcgatctgacccgtcgtctgcatcagaaccaggtgtttggcctgaccgtaccgctgatcaccaaagcggacggcaccaaattcggtaaaaccgaaggcggcgccgtgtggctggatccgaagaaaaccagtccgtacaaattctaccagttctggatcaacaccgcggatgctgatgtctatcgcttcctcaaattcttcacctttatggacattgcggagatcaatgccctggaagaagaagacaaaaacagcggtaaagcgccgcgcgcccagtacgtgctggcagagcaggtgacgcgccttgtccacggcgaagaaggcctggaagcggcgaagcgcattaccgaaagcctgttcaacggtaacctgagcgacctgagcgaagcagacttcgaacagctggcccaggatggcgtgccgatgatcgaaatggaaaaaggcgccgatctgctgcaggcgctggttgattccgagctgcagccgtcccgcggtcaggcgcgtaaaaccgttgcctctaacgcggtgaccatcaacggcgaaaaacaggccgacccggaatatgtattcagtgacagcgatcgcctgtttggccgctacaccttgctgcgtcgcggtaagaaaaattactgcctggtctgctggaaataa

SEQ ID NO: 2532 - DNA, 318 bp, Klebsiella pneumoniae
cccctgcggcgcgcaaggaggactgttcttaatctggctccccagggttgctattaccgagaaaatggaccaccctacctgtggccgcacaaaaaacgcgcggccgactttgggttacatttcatccggtcgttaccgggtttgcccttgaaaccagaacaggataaaggagtcagaatgaaatcgaaccatcaggcacgtcatcttctcggtctgaactataagctttcccggcagaaaaaagtggtgctggaaggcgatgaagaaaccaccatcaaccacatccatgctaccggccgcaaacgccgcggtggttaa

SEQ ID NO: 2533 - DNA, 1227 bp, Klebsiella pneumoniae
cgtcggcggcggcatggtgctgtaaggagaaaaacaatgacccaggctaatgatattgtgattgtcagcggcgtccgtaccgctattggcacgtttaacggcagtcttaaacatacccatcagcatgaccttggggccgccgtcattcgcgaagcgatcgcccgcgccgggattgcgccgcaggatatcgacgaaacgatcgtcggcaacgtcgggcaaatcgccgaaagcggttttatcgcccgcatctgccaactgcgcgcggggatcccgcaggagagcaccgcctattccgttaaccgccagtgtggttccggacttcaggccctggcggacggcatgatgcagctgcaaagcggccaggccgaggtggtcgtcgcctgcggcactgaaaatatgacccagctgccctactacctgcgtaaagcgcgcgatggctatcgcatgggccatggcgagctggaagatggcctgatctccattctcacctggccggaaggcccttatcacaacggcatcaccgcggaaaacgtcgcgcaacgcttcggtattacccgcgaagcgatggacgatttcgcctggtcgagccagcagaaggcgctgaaggcgatcgcggagggtcgctttcgcgagcagatcctggcccttgaggtgccggacggcaaaaaagcgacccgcctgtttgcgaccgatgaacacccgcgcgacaccccgcgtgaaaagctcgccacgctgcgtccggcgtttaaagccgacggcgtggtgacggcggccaactcatcgggcattaacgacggcgcggcggcgctggtgatgatgacccgccagcaggcggaaaaacgcggcttaaccccgcgcatgcgcattcgcggctgggcggtcgccggctgcggagcggagattatggggtttggtccctctcccgccacccgacgcctgatggaccgtctcaatatagatgtgcagtccattgatttaattgaactcaacgaggccttcgccgctcaggcgctggcggtgatgaacgatctgcgtctcgacccggcccgcgttaacgtcaacggcggcgcgatcgccctcggccacccggtaggcgccagcggtgcgattctgccggtcaaactgatgtatgaaatggcgcgcagcggcgcacgcactggtctggtcaccatgtgcatcggcggcggccaggggatttctatgctgttcgagcgcgaaggcgcttag

SEQ ID NO: 2534 - DNA, 1173 bp, Klebsiella pneumoniae
tcacttgggcgtgatggagaagctatgagttcatcgtgtatagaagaagtaagtgtaccaaatgatgactggtaccggattgcagctgaattattaggccgtgcgggaattgaaatcaatggctccgcgccgtccgacctgcgggttaaaaatcctctcttttttaaacgggttttgcaggaaggttcgctgggtttaggcgaaagctatatggacggctggtgggaatgcgagcgtctggatatattcttccacaaggtgttacgcgccgggttggaaaagcagctcccacaccatttcaaagacacactccgcatcgcaggcgctcgtctgtttaatctacaaagtaaaaaacgtgcctggattgtcggtaaagagcactacgaactcggcaacgatctcttcagccggatgcttgatccctatatgcaatattcctgcggttactggaaagaggcgcagagcctcgaggccgcccagcaggctaagctggatctcatctgccgcaaactggagctggagccaggcatgcgggtactggatattggctgtggatggggcggtctcgccgaatatatggcgcgaaattatcaggtcagcgtcgtcggcgtcactatctccgccgagcaacaaaaaatggcccaggcgcgctgcgccgatcttgatgtagagattcgtctacaggattatcgcgatctgcacgacagctttgaccgcatcgtctccgttggcatgtttgagcacgtggggccgaaaaattacgctacctactttgaggttgccgaccgtaatttgaaacccaacggccgctttttactgcacaccattggttccaaggtcaccgaccataacgttgacccgtggatcgataaatatatcttcccgaacggctgcctgccttccgtgcgtcacattgccgaagccagcgagaagcattttgtgatggaagactggcacaacttcggcgccgattatgacacgaccctgatggcctggtatgagcgtttcctcgccagctggccggaaattgccgataactattctgagcgtttcaaacgcatgtttacctattatctgaacgcctgcgccggcgccttccgcgcccgcgacattcagctctggcaggtggtgttctcgcgcggtattgaacatggactgcgcgtcgcccgttaa

SEQ ID NO: 2535 - DNA, 588 bp, Klebsiella pneumoniae
ccgctggggcgaaggggtggaaagcattccgcaatcggaaatcaatccgcccggactgggcgactgacaggaggcgcgatgagcgaagcattccgcgatatttctccggaggctccggagctgcagccgattattagcgggctgtttgccgaatatgccgcccgctacggcgactatttttcccgcgatgcggaagtggagttaagtgagtggtatgtgccgccgcaggggctgtttattgtccttgagcgtgagggcgaaattatcgccaccggcgcgtataagccgaaggatcgccacaccgcggagatcaaacgtatctggacgcaccgccgtctgcgccagcaggggctggcggcgaaggtggtccaggagctggaacgacgggcggtgctggccgggtacagccatatctacctgaccaccggtttccgtcagccggaggcggtaaagctctatctcagccaggggtatgaggcgcagtttgacctcacgcgagacccggaagagtacagtcagccgccgtacgatggccggctgcggttcactaaagcgctggtggtgagcgcctacagccacagcgcctga

SEQ ID NO: 2536 - DNA, 366 bp, Klebsiella pneumoniae
ccgacggggcggcctgcagggcggcgcaaaaatcggcgaacccggcgggcggcgcgccgggggcaaagccgaatgcccgctggcgcagctgatcgagaggcgacagcgcctgaaagcggcggcgggatagctgatagtagtgttgctgctgctcaggcgtcgtttgctgtagcgcctgcagccagtgggttatctgccggtcgacctcttccggccggtcgctggcgaagaccagcgccagccagccgaggtgccgatcctgatacagccagttcagcgccacatccccggccagccggcgctggcgcaggccggccatcaggctgccgggggcttcatccagcaaaaactcgcgcattaacgtga

SEQ ID NO: 2537 - DNA, 957 bp, Klebsiella pneumoniae
cctattcttagagctggcccgttctgtctgaaggagatgactatgcaagatgaaaaaccgccaatgaagaagttacccacctccatgttgccagaagagacggctccacgtccggagttcccggagcaagaacaaaccccgccgggtctggatgcggaaatggagccatccccggaccacggtgaaaccagctacaccggctccggacgactggccggtaagaaagcgttaattaccggcggcgactccggtattggccgtgcggtggcgatcgcctttgcccgcgaaggcgccgacgtcgcgataaactatctgcccgaagagcaaaaggatgcggatgaagttatcgccctgatcaaagccgaagggcgcaccgcggtcgccctcccgggtgatattcgctcagaatccttctgccagtcgctggtggccgacgcggtggaacagctgggaggtctgagcatcctggttaataacgccgggcgtcagcaatactgtgaaacccttgaggaactcactaccgaagatttcgacgctaccttcaaaaccaacgtctacgcgccgttctggatcacccgcgccgcactgcctcaccttcaggccggaagcgcgattatcaataccacctcggtgcaggcgtataaacccagcccgatcctgctcgattatgcgcagaccaaagcctgtctcgcgatcttcactaaatcgctggctaaacaggtggcgaaacgaggcattcgcgtaaacgccgtagcgcctggcccttactggacggtgctgcaatccagcggcggccagccggacgagaaggtgaaacagtttggcaaagacacgccgatggggcgcccggggcaaccggtagagatcgccccgctgtatgtcaccctggcatccgatgcctgctcatatacctccggacaggtgtggtgttctgacggcggggatggtgtggtctaa

SEQ ID NO: 2538 - DNA, 1389 bp, Klebsiella pneumoniae
ccggcgaatagtaagagaatagcgcctacacgcgacgatctgagtacacgggagttcatcatcagccattctcgtcgattccccttagccagcaaagtggcgctggcaggcgcggcgctcatcgccgctggcatgctgttcagctgcaccagtaaagcccctaaatcccttgtcacgccgccgaacgctgccgccgtcaaagccgggcaggcgcaccgggagccggtgcgcggcgtgtggctcaccaccgtttcgcgccttgactggccgccggtcgggtcgattatcgccagcacgccggagagccgcatcacgcagcagaagctggcgctgatcgctaaactcgataacctgcagcgcctggggatcaacaccgtctttttccaggtgaaaccggacggtacggcgctctggcggtcggatattctgccgtggtccgatatgctgaccggcaaaatcggcgaataccctggctacgatccgctgcagtttatgctggatgaagcgcacaagcgcggcatgaaggttcacgcgtggtttaatccctaccgcgtctcggtcaacaccaaaccgtcgacgattgccgagctgaacaacacccttactcaggtaccggccagcgtgttcgtcctgcaccgtaactggatccgcaccgccagcgatcgctttgttctcgacccgggcattcccgaagcgcgtgactggatcaccagcatcgtcgctgaagtggtgcagaactacccgattgacggcgtgcagttcgatgactatttctataccgaaaccgcctcttccccgcttaacgacaacgagactttccgccgttacgggcagggctatgcctcgaagggcgactggcggcggcataacacccagcagctcatagcccaggtttccaccaccatcaaaaagctcaatccgaacgtcgagtttggcgtgagcccggccggggtgtggcgcaaccgctcccacgatccggcggggtccgatacccggggcgcggccgcctatgatgaatcctatgccgatacccgcagctgggtgcagcagggactgctcgactacatcgcgccgcagatctactggccgtttgcccgcgatgccgcgcgctatgatgtgctggccaactggtgggccgaggtggttaaaccgacgcatacccggctgtatatcggcgtggcgctgtacaaggtgggtgaaccgtccaaaaacgagcctgactggacggtggatggcggcgtgccggagctgaaaaagcagctcgatctcaatgagactctgccgcagatccagggcaccatcctgttccgcgaaaacaacctcaatcagccgcaaacccggcaggcggttaactatttgcgcagccgctgggggcagccgcagagctag

SEQ ID NO: 2539 - DNA, 264 bp, Klebsiella pneumoniae
ccagtcgatagctttaccgatacggtagccatggccgtcgactgctgcaatctgtctgagatgatcggactgatcgctcatcaaaagccggtagtgtatctctctttggatcagcggcccgagaacaggaatggcttcaggttcgtcaagcaaagaaagcagacggcagaaaggctccagcaaagcatcggtaatagtacctatcccgacactcgttcccgcgtctcgttttttgaccggcggcaggcttccctgggcaattaa

SEQ ID NO: 2540 - DNA, 1053 bp, Klebsiella pneumoniae
atggttttcagaatcgcaagctccccctatacccataaccagcggcagacctcgcgtattatgctgctggtgctgctcgccgctgtgcctggcattgtggtccagacctggtttttcggctggggcaccgtactgcagattgtcctcgccgccctgacggcctgggcgaccgaagccgctattctcaaactgcgtaaacagcctgttgctgccacgctgaaagataattccgccctgctcaccggcctgctgctggcggtgagtattccgccactggccccgtggtggatggtggtgctcggcactgcctttgccgtagtcatcgccaagcagttgtacggaggcctgggccataaccccttcaacccggcaatgatcggctatgtcgtgctgctgatttcgttcccggtgcagatgacctcctggctgccttcctatgagatagccgcccatctcccggcattcagcgacgcgctgcagatgatcttcaccggccataccgccgccggaggcgacatggccagtctgcggctgggtatcgacggcgtcagccaggccaccccgctggatacctttaaaacctccctgcatgccggacatagcgttcagcaggtgctgcaattgccggtctacggcggcgtgctggcaggtctgggctggcagtgggtgaatatcgcctggctggcaggcggccttttcctgctgtggcagaaggcgatccgctggcatatcccggtcagcttccttgttagcctcggcctgtgcgccaccctcggctggattttttcgccgcagagcctggcctcaccgcagatgcatttgctctccggggcgaccatgcttggcgccttctttatcctgaccgatccggtgacggcctcaacaaccaaccgcggccgtctgatctttggcgccctcgctggcctgctggtctggctcatccgcagcttcggtggttatccggacggcgtggcgtttgccgttctgctggcgaatattaccgtgccgctgatcgattactacacgcgcccgcgcgtatatggccaccgttga

SEQ ID NO: 2541 - DNA, 408 bp, Klebsiella pneumoniae
acgtcgcccagtcgtagcggtcgccgtcgcgatagcggtcttcgctatgctgggctatcaccgacggcgccagctgccagtttttccccaacggcaggatgccatacgacgcaaagcgcagggaggccgcgttctcggtcagatcgccatcgctccccggctgacgcgcttcggcgcccagcccgacgccgtattgcagggcgctttcagacacccccggcgccaggccgtagaactgctgtttgtcgtggagggccagcatcgcgtagtagccgtttttggcggtgttatcgctgcgcagggcatagctcccggtggtcgaggtattatctttcaggtcatcgttgccctgggcggtcatcaccgtggtcatcagttgccagttgccgtaaaaatggttggcggtga

SEQ ID NO: 2542 - DNA, 939 bp, Klebsiella pneumoniae
gagagaaccagtatgagtaatgtattcgtacaacaaccagctattcaaaaattattacgcgacagtgccggattagatgttgccggcggcgatgaacgttttaaggcgattattcatcgtctgctggaaaatatctgcacgctcatcgacgactataacgttacggaagaagagttctggcacgcggtaaactatttgcacgagctgggcgggcgccaggaggcggcgctgctggcagcgggtctgggactggagcatttcctcgatctgcgccaggacgccatcgacgcggcagcgcatcgggaaaccggcaccccgcgcaccatcgaagggccgctgtacgtggctaatgcgccgctggccgagggtcacgcccgcatggatgacggcgccgacgccggagaagtgatgtggctgcacggtgaagtcaaagacaccgaaggccggccagtggccaacgctattgttgatatctggcacgccaacaccctcggaaattattccttcttcgacccaggccagagtgagtacaacctgcgccggcggatccgcaccggcgccgatggccgctacagcgtgcgcagcatcatgccctccggctacggctgcccgccggatggcccaacccagaaactgctggacagactgggtcgccacggcaaccgtccggcgcacattcactttttcgtctccgcgccgggtcataaacatctgaccagccagattaacctcaatggcgataaatacctgtgggacgattttgcctttgccacccgcgacggcctgattgccgatccggtaaaagtgaccgaccgcgagatcatcgcgcaacgcaatcttgagggagagcacaccgaggtttgttttgatttcaccctgtgtaaagcgctgagcgccgacgaagagcagcgcgggatccgcgtgcgcgccaaagagtaa

SEQ ID NO: 2543 - DNA, 909 bp, Klebsiella pneumoniae
aggagaaccagggtgaacgcattactctatgcactcgttgtcgtgatctggggtacaacgtggattgcgatttttttacaacagggaccggtggccgcgccggtatcgattttctggcgtttcgccgtagccagcgtcacgatgctggcgattctgctcgtcacacgacgcctgcggccgctgggcgcgaaagatcatctctgctgcctgctgcagggctgctgcgtcttctgctttaatttctggtgtttttataccgccgccgcctggatcaataccggtctggaatcggtgatcttttcgatggcggtactgtttaacgccatcaacagctttctcttttttcgccagcagccgccgggccgcttctgggccgccgccgcgctgggtctcgccggtatcgtcatcctgttctgggacgacctgctggccaacggactgaacgcctcgctgctgtgggggatcgggctgagcgccctgggcacctacggtttttcgctcggcaatatgttcagtattcgccaccagcgccgcgggctggaaacgctgaccaccaacagctgggcgatgctctacggcacgctggtgatgggggcgatcgctctgctgcgcggcgataattttatgccagaatggaccgtcagctatctgggcgccctgctttacctggcgctgttcggctcggtcatcgcctttggcgcctatttcactctcgttgggcgcatcggcgccagcaaagccgcctacagtacgctgctgtttccgctggtcgccttatccatttccaccgtctatgaagggtatgtctggcacagcaacgccgtgatcgggctggcgctgatcctgctgggtaacctggtgatgtttgccaaaccggaacagctattgctgcgccgaaggctggcctga

SEQ ID NO: 2544 - DNA, 3015 bp, Klebsiella pneumoniae
  unsure (16): Identity of nucleotide at the above locations are unknown.
ccgcctgccagcagcnatcccgttttcgccagctggcgcgatgagcttgccgcccgcgataacctaccttcatcccgccgccgtcaactggacggcgagtggcagttctcttacgcccgcagcccgtttgccgtcgatgcacagtggttgacgcaggatcttccggactgccgcggcacgcctgtgccttccaactggcagatggagggctatgacgcgccgatctacaccaacgtccgctatcccatcgacaccaccccaccgcgggtgccggaggataacccgaccggctgctactccctgcactttacggttgaggacacatggcgcgagaacgggcaaacgcagattattttcgatggcgtcaactcggcgtttcatctgtggtgcaatggcgtgtgggtcggctattcgcaggacagtcgcctgccggcggcgttcgatctcagcccctttctgcgtccgggcgacaaccgcctgtgcgtgatggtcatgcgctggagcgccggcagctggctggaagaccaggatatgtggcggatgagcggtattttccgctcggtatggctgctgaataagccgcagcaacggctatgcgacgtgcagttgacgccagcccttgacgccctctatcgcgacggcactctgcaggtccaggcgaccatcgaagcgaccgaggcggcgcttgtcgggctcagcgtcggggttagcctgtggcgcggcgaggagcagatcgccgccgggcggcagccgttaggtaccccgacggtggatgagcgcggccactacgcggaacgggtcgatttctccctggcggtggcgacgccggcgcactggagcgcggaaaccccgaactgttatcgcgccgtggtcaccctgtggcgcggcgacgaactgctggaggccgaagcgtgggacatcggttttcgccgcatcgagattgccgatggcctgctgcgtctcaacggtaaaccgctgctgatccgcggcgttaaccgccatgagcatcatcatttgcgcgggcaggtggtcaccgacgcggatatggtgcaggacattctgttaatgaagcagaacaactttaacgccgtgcgctgctcgcactatcccaacgcgccgcgctggtatgaactctgcaaccgctacggtctgtacgtggtcgatgaagccaatattgaaacccacgggatggtgccgatgaatcggctgtccgacgatccggcgtggctgccagcattcagcgcccgcgtcacccggatggtacagagcaaccgcaaccatccgtgcattatcatctggtcgctgggcaacgagtccggcggtggcggcaaccacgaagcgctgtaccactggctgaaacgcaacgatccgagccgtccggtgcagtacgagggcggcggcgcggataccaccgccaccgatattatctgtccgatgtacgcccgcgtcgaacgcgaccagccgatcccggcggtccccaaatgggggatcaaaaaatggatcagcctgcccggtgagcagaggccgctgatcctttgcgagtacgcccacgcgatgggcaacagcctcggcaacttcgccgattactggcaggcctttcgcgagtacccgcggctgcagggcgggtttatctgggactgggccgaccaggcgatccgcaaaacctttgccgacggcagcgtcggctgggcctatggcggcgactttggtgataagcctaacgatcgccagttctgtatgaacggtctggtgtttcccgatcgcacgccgcatccgtcgctggtggaggcgaagcacgcccagcagtattttcagttcacgctgctgtcgacctcgccgctgcgggtgcgcatcatcagcgaatacctgttccgcccaaccgataacgaagtgctgcgctggcaggtgcaggcggccggtgaacccctgtatcacggcgacctgaccctggcgctgccccctgagggcagcgacgagataacgctgctcgatagcctgatcctgcctgaaggcgcccgcgcggtgtggctgacgctggaggtgacccagccccaggcgaccgcctggtcagaagcggagcaccgcgtcgcctggcaacagtttcccctgcccgccccgctggcgctgccggcgcccaccgtgtctgccggcgctccggatcttatcgtcagcgatgaggtctggcagatccgcgccggttcgcaatgctggaccatcgatcgccggacgggtctgctgagccgctggtcggttggcggtcaggagcagctgttgacccccctgcgtgaccagtttattcgcgcgccgctcgacaacgacatcggggtcagcgaagtagagcgtatcgaccccaacgcctgggtggagcgctggagaagcgccggcctgtacgatcttgaggcgcactgcgtccagtgcgatgcgcagcgcctggcaaatgaaaccctcgtcgactgccgctggcactacctgcgcggcgaagaggtagtgattgtcagccactggcgcatgcacttcactgctgacggaaccctgcggttggcggtggacggcgaacgggcggaaaccctgccgccgctgccgcgggtcgggctgcacttccaggtggcggatcagcaggcgccggtgagctggctgggtctggggccgcatgagaactaccccgaccggcggagcagcgcctgcttcgcccgctgggagcagccgctggcggcgatgaccaccccctatatcttcccgacggaaaacggcctgcgctgtgatacccaggcgctggactgggggcgctggcacatcagcggtcatttccacttctccgttcagccatggagcacccgtcagctgatggagaccgaccactggcacaagatgcaggccgaagacggcgtgtggatcaccctcgacggcctgcatatgggggtgggaggcgatgactcctggacccccagcgtgctgccgcagtggctcctgagccaaacgcgctggcagtacgaggtctcattgcgttgcttttaa

SEQ ID NO: 2545 - DNA, 2652 bp, Klebsiella pneumoniae
aaaaatgccagcaacgccaatttagccatggtggggaagatgttaagtattaattaccaaacggaaaacattattgtcgatcatctgccaattatggtgtgctggtctaccaattatcctcaaaagtcattttcgataaaagtgtataaaggtgccgaactggtatctcttatcgcaagagagggtaataatacaattgtcactctcgatgcaatatcgttacaaagctttacttcttataccatagaagtccttacccacggtgacaatggtgagaacaacgtttttagaaacagttttacaaccagtaatcttggccatttttctggccgctgggtgagcggtgggcatcacttcactaatgatattcattactatcgcggtaaacgtaatgtggtgatgagaaaaacaatttatctcgacgaagacctcctcgatgcctatatcagtattgttggtcttggtttttataaattgtatatcaacggtaaagaggtcacacgcggtgagctcaatactgactggacaaattatgctaaaattatttattatgatacttacaatataaagccgtttattaatcagccgaaaaatgaagtcattgttgagctagccgatggctggtttaatccagcaccgcttaaattatttggtaaatataacctgagagagaccttaaccatcggtgaaccacaggtcatcgctgacatttatatgaggtttgcagatcgcgaaatgatcatcggtagtgatgccgactggcaatattgcgaaggcgcttataccttcaataatatctatttgggcgagcgcctggatatgaaactgtttcgcggagacaacaccaccgatttgctgatgcctgactggaaaaatgtggtgctgagcaacgggcctgaaggccgtctggtctcgagttttattccgaaaattaaccatacgttgtctctcggggcagagcatatccacgtcgtagacgaagagacattcattattgatttcggtgccatcgtcaccggatttatcgatttatccattaccgcgtctgagaatcaacgtgtggaactgctctatagcgaagacgttgatgaaaactacgaactaaacactgactccacccttgcgggatttgtcggcaaacaggttactgaaggtgtgattattgacggcggaattggagcaccggcgagggcggagcagaaggatgcctttgaatgccgcagtgggaagaatcattttatcaatgcctttacctgtcattcgtttcgctatgtgcagttaagcggtattaatattgaacaattaaacaacgttcaggcgctttcagtacatactgtactaagggaaaacgggggcttttactgctcagatccttacataaataagctctttgagattgctaaaagaaccaaactgaataacattcattcggtcttcggggattgtgcccgcgaacgtttcgcctatggcggagacattgtcgcgttggcccggtcgcaagtgtatcagtttgactctgccgctatttataagaaaactatctttgattttatcaatgatattcgtccctgtggtggtgtgacggaaactgcgccatttatgggaattaagactaatggagtcggcggggaaacgggccccctgggctggcaactggtattaccttatttgatagccattcactatcgacattatggcaatgtcaatctgctggccgaaagcttgccatttcttgagaagcagatcctctccctggaaatgcgcgactttgatgacctggtgacctgctgcctgggtgactggggaagccgcgttcatgatatgcgtaattacaaaaatggctcgccagctctccatttcaccagtgcttgtttctattattatcatttgttaattatcgcaaaaatatgtgatgatcttggttttaaagaaaaatggctaaaatatattggcaaggccaataaaattagagagaaaattttatcactctataagaatacggatggcagctttgccgatcgcagtcagaccagctttgtttttgcaatctacttcgatttgtgtgatgatatcgagagttcattgaatgcattgatcgatctcatcaaaaaagagcaaaatgttatcacttgtgggatttttggccaaagttttgcctatgaaatatttcatcgctatggtcataatgaattaatccttgaatggttaagagtcgaagccggattcaagaaaatgcttaaaaatgatgccagcacattgaaggaatttttcggtgataacctgaatggttcgaataatcatgcgatgttcagttcttattccagttggctgtttcaggctttgggcggcattaccgtcgctgaggaggcggttggtgctgatgttattttaatcagtccatcctttactgacacgattaactttgtggattgctggcatcaaaccatcagagggcgtattgagtgtcgctggcggcgctataaaaaaggcatagaattagtcatcaaagtgccatttaacctcaaaaaatgcactcttaaattaccaaaagtgtatcaacttaataaacaattacctgcgccgatagactgtgatacctatcatcacttttatgacattaccgatgcaggtgagataaaagtactattgtaa

SEQ ID NO: 2546 - DNA, 897 bp, Klebsiella pneumoniae
ggcttttacagacaatgtgtgaagacgatgggttacgggacatttgaaacattacggcgacagaacgcggtgctgaagggaaccgtggagctgaattccggtattcaactggccgcctggtataacaattgcgataccgtgacggtgcgcagcgaccatcataccttaagtctgtacgtggctgatggctacgaaagctatcaaaagacgccgcacggctggaaaaatggcggcggcccggaccgtttttgtctgatgccgaaaggcgatgaaagcgtatgggatatccgcggcgatctgtcgtttgtgcatctttactgtaccgatgcgcacctgcgtcgcgtcggcgaggaggtgtgggaccgcagcccggcgaacttcaccctgcaggaaaagaccttcgccagcgatgataaaatcaccgcggtatatcgtcagtttttgctggctaacgactggcggcagccggcgaaccagctgaccctcagcgctgccagcagcttactgcttacccatctgatccagcactattccaccgtgcagtggcgtttgccgacggtcaccggcgggctggcgccaggcgtaaagcgtcacgtactggcctggatcgatgctcatctcgatcagcccttgaccctggccgacctggcgcagcaggcgggtctgagtgagtttcattttgctcgtatgtttcgtcagtcgctaaatatggctccgcatcagtacgtcatgcagcagcgaatggcgaaggcgcaaaacctgatctgccatagcgcgctgccgttaaccgagatagcgctggcctgtggttttagctcccccagccatttcagccatcgggtcaaagccgccaccggcctgacgccctcccagctacgggcggcgcagcgcggatag

SEQ ID NO: 2547 - DNA, 1104 bp, Klebsiella pneumoniae
ttggtgtacaggtacgatgccgcagagtgtagggagtgcattgtggcttgtgaaacgctaatatttgtcacatgcattcaaaaattttgcaggcagaaaatgtggtctgaatactctctggaagtggttgatgccgtcgcccgtaacggcagcttcagcgcggccgcgcaggagcttcaccgggtgccttccgcggtcagctataccgtgcgtcagctcgaagagtggctcgccgttcccttatttgagcgtcgccatcgtgatgtggagttgacccccgccggggtctggtttttacaggaagggcgctctgttatcaaaaaaatgcagatcacccgccagcagtgtcagcaaattgcgaacggctggcgcggacagttgtcgatcgcagtggatgatattgtgaaaccggcgcggatgcgtcagatgatcgtcgatttctatcgccattttcccgacgtcgaactgatcgtctttcaggaagtattcaatggcgtatgggatgcgctggccgacggccgcgttgagctggcgattggcgcaacgcgatctattccggtcggcggtcgctatgcgttccgcgatatggggatgctgagctgggactgcgtggtggcgagcgatcatccgctggcaaagatggatggacccctgagcgacgacgtcctgcgtaactggccgtcgctggtgcgggaggatacctcgcgctcgttgcctaaacggacaacatggttgctggataaccagaagagggtagtcgtccctgactgggaatcatcagcaacctgtttgtcggcaggactctgcgtcggcatggtgccgagccatttcgcccgtccatggatagatcgcggcgagtggactgcgctggcgctggaaaatccgttcccggatgccgcctgctgcctgacgtggcagcagaacgatgcctcaccggcgctgaactggatgcttgactatctgggggacagcgacacgctgaatcgggagtggctgcgggcgccggagagatccgcgcccgccagatgccttaacgacgataatcgacaaacgggccatccgctaccgagcggcgctcaaccagacgagggtgcacttcgatag

SEQ ID NO: 2548 - DNA, 993 bp, Klebsiella pneumoniae
accaatcggctcatagataatctctattctgtattcagagataatgaccagagcggtaattcaggaagtcagacaatgatcattcggccagaacaacactggtttcttcgcctatttgactggcacggctccgtgctgtcgaaaatcatctttcgcctgctgctaaatgtgctgatgtcgatcatcgccattatcagctatcaatggtacgaacagctggggatccacttaaccgtggcgccgttcagcctgctggggattgcgattgcgattttcctcggctttcgcaacagcgccagctacagccgcttcgtcgaggcgcgcaatctgtgggggacggtgcttatcgccgaacgcacgctggtgcgtcagctgcgcaatatcctgccggcggaacacgatgcccatcgccgcatcgtcagctatctggtggcctttagctggagcctgaagcaccagctgcgcaaaaccgatccgacggctgacctgcggcggttgctaccggaggagagggtgacggagatcctcgccagctcaatgcccaccaaccggatcctgctgctggccggcaacgaaattggccagctgcgggaggcgggcaagctcagcgacatcacttacgggctgatggacaacaaactcgacgagctggcgcacgtgctgggcggttgtgaaaggctggccaccaccccggtgcctttcgcctataccctgatcctgcagcgtaccgtctacctgttctgtacgctgctgccgttcgccctggtcggcgatctgcactacatgacgccgtttgtctcggtctttatctcttacacctttttatcgtgggattcgctggcggaagagctggaagatccgttcggcaccgcagccaatgacctgccgctgaacgcgatgtgcaataccatcgagcgcaatctgctcgacatgaccggtcagcatccgctgccggagacgctgcgtccggaccgttacttcaatctgacctga

SEQ ID NO: 2549 - DNA, 426 bp, Klebsiella pneumoniae
tgttatcacagacaaggagaagacgccatgagtgtagtaacccaatttacccccgccacctccgctgaggctatccgctggttcagccataagctgcatcttgagaccgactgcgccgatgtgcacagcgcccagcgtgccggcgaggtcgactttgtcctgctgcacgtggtcggcagcgaggaagctttcgccagacgtcacctgccaggcgcgcagcatctcccgcacagccagatcaccgccgagcgaatggcggcctggccggcggataccctctttgtggtctactgcgccgggccgcactgcaacggcgctgacgttgccgcgctgaagctggctgagctggggcggccggtgaaaatgatgctcggcggactcaccggttgggaagatgagggctatgcgtttgtttccggtaaatga

SEQ ID NO: 2550 - DNA, 1590 bp, Klebsiella pneumoniae
tttatgcacagtagcaacgtttcgacccacggcatggcggtggccccccaccacctcgccagtcagagcgcgctggcgatcctgcgcgagggcggcagcgccattgaagcgatggtggctgccgcggcggccatcgccgtcgtctatccccatatgaatggcctcggcggcgatggcttctggctgatcgtgccgcctgagggagaccccatcgccattgacgccagcggggccgccggatcgctggcgaccctcgaggcctacgccggacagcagcatattccccaccggggatcgcaggccgcgctgaccgtcgccggcaccgtcagcggctgggacgaggcgctgcgtatttcacgggacttaaccggccgcgcgctgccggtggcccgcctgttggccgatgcgatcggctatgccgaagacggcattccggtcactgcctcgcaggcccacgccaccgccagcaaactggaagagctgcgccatcagccgggcttcagcgaaacctggctggtcgcgggcgaggccccgcggcccggcagccgcttccgccagcccgccctcgccggtaccctgcgcatgctggccagcgacggtctcgacagcttttatcgcgggccgctggccgagcgtctggcgcagggtatggccacgctggggatgcctgtcaccctcggcgacctgcaggcccaccgcgccaggcgtccggggccgctgacgctccagcaccagcagggaacgctgtggaatcttgcccctcccacgcagggactggtgtcgctggcgatccttggcatcaccgaccgcctgaagatggccgatgccgacgacgcgcaaacggtgcaccgtatcgtcgaagccaccaagcgggcgtttgccctgcgcgatgcgcatatcaccgatccgcgccatctggatgtggatgtacagcagttgctcaccccggaagccctgcagccgctggccgacagcatcgacgacgccagcgcttccccctggggcggcggcaaaggcccgggcgataccgtctggatgggcgtcgtggataacagcggactggcagtgtcgtttattcagagtatctatcacgagttcggcagcggcgtggtactcccggacaccgggatcgtctggcaaaaccgcggggcggccttcagcctcgacccgcagcatctcctggcgctggcccctggcaaacagccattccacaccctcaaccctgccgccgcgcgcctgaacgatggccgggtgatggtctatggctcgatgggcggcgacggtcagccgcaaacgcaggcggcgctgtttacccgctatatcctgcagggggtgccgctccaggagagcatctcccgtccgcgctggcttctgggccgcacctggggccagtcctccgactcactgaagctggagggacgctttgcccccgcctgtatcgctcgcctgcgcgagctggggcacgacgtagaagtgctggccgatttcagcgaagcgatgggccacgccggggccattgtccgccatcccaacggtctgcttgaaggggcgaccgatccacgcagcaacggcgccgccgccgggtactaa

SEQ ID NO: 2551 - DNA, 417 bp, Klebsiella pneumoniae
tcctgcgacagaaaaaagcaaccgcatatgaaagaggagaggtatatgtactggaaccctgaagtattaacaagaatagatgcggccgacgacctgaaaatcgcaccgtatcatcccgatatgaatacgaccggtacgccgacatggatatgggaagtgaaggtggacaaccgacttttcgtccgagcctatagtggtatccgttcaaaatggtatcaggctgcattgtcccagcaggcaggtaagatactggctatcggacaggaattcgacgtactgttcgcaaaaccctcggaccctgagcttgaaagtaaaattgatcaggcttacctgaaaaagtactccggcagcagctatgtttccgcaatgacagggatacgcgccagggcagccacgattgagattctaccttcgtga

SEQ ID NO: 2552 - DNA, 1818 bp, Klebsiella pneumoniae
gtgagctgcaggcgcgccagcgccacctccagcagaccccgcacattatcatcggtttccgcctgcagccgctgttgcagcagcgcggccatggccggagtcgcttcccgctgtagcgttcgtgcggcggaagctctctccgtgacgttgtcacttaaaataaggtggctggccagcgcgccggcagccagattgcgcagccggttggtcagacggaccggccgggtttcgccctgcggcgcggcgacagcgcccaatggctgtaatccgccctgtcgggtgcggaaagcatgttttccgtcgtccatcaccaggctctcggtggtcaacgcccgcagcagcggcagacgatccgcctgcggcgctgccgcccactgggtcaacagctgcgcctgctggctgcgactggcggcaacgaagtcgtccgcctccgcggcctgcgcccgccatggcagcaaggtcagcaatagcgccaacacactcacgagacgcaatgcgttcatgtcgttctcctctggtcagcggccgacgggcgcgacgctcccgccccgtcggccgtggcgcttactggctgacggttttcaccggatggtcaggtttcttatcattaccggggatccacggactccacggctgcgcgcgaacgggctcatcggtctgccagaccacgttgaactggccgttgccttcaatttcaccgatcatcaccggcttatgcagatggtggttggtggcatccatggtcaggttaaaaccggacggcgcgttgaaggtctgcccggccatcgcctcgcgtactttgtcaacatcggtggtgcccgctttggtcaccgcctgcgcccacatatgcagacccacccaggtcgcttccatcggatcgttggtcaccaccgtatcggcattcggcagcttgtgcgctttggcatacgcgcgataatcggcgacaaaggctttgttggtcggattatcgacggactcaaagtagttccatgccgcgaggttgccgaccagcggtttggtatcgatgccgcgcagctcctcttcccccaccgagaaggccaccaccggtacatcggtcgctttcagaccctggttagccagctctttgtagaacggtacgttggaatcgccattgatggtggagaccactgccgttttgccaccggcggcgaattttttgatattggcgacgatggtctggtaatcgctgtagccgaacggggtgtagacctcctcgatatctttgtcctggatccctttggcatgcagaaaggcgcggaggatcttgttggtggtgcgcggatagacgtagtccgtccccagcagaaagaaacgtttagcgccgccgccgtcctcgctcagcaggtattccaccgccgggatagcctgctggttaggcgccgcgccggtatagaagacgttgggggacatctcttccccttcgtactgcaccgggtagaacagcaggccgttcagctcctcaaacaccggcaggaccgatttacgcgagaccgacgtccagcagccaaacaccaccgccactttatcctgggccagcagctggcgcgccttctcggcaaacagcggccagttggaggccgggtcgaccaccaccggctccagtttcttgcccagcaccccgcctttggcgttgatgtcgtcgatggccatcagcgcgacgtctttcagcggcgtttcggaaatcgccatcgtcccggagagcgaatgcatgatcccgactttgatggtgtcggcggcataggcctggaaggagagacccatagccataacagaggcggagagtgcaaaagcttttaa

SEQ ID NO: 2553 - DNA, 1596 bp, Klebsiella pneumoniae
aaagtgagcagcaaatttatcgacgcccatgaggcggcgcggtgggtcgccagcggcgacaccgtctgcaccgtcgggatgacgcttatcggcgcggcggagtccattttaagcgccatcgaagcgcgctttctgaccgcgggcgaaccgcgtgacctgacgttactgcatgccgcagggcaaagcgatcgccagcgcggtatccagcactttgcccatccgggtatggtgacccgccttatcggttcgcactggggcctggcgccgcgctggatggcgatgatcaacaacaacgaagtggaagcctggtgcctgccgcaggggcagatcgttcatctctatagcgcgatggccgccggactgccggggcggctttcccccgtcggtctcggtacctttgtcgatccgcgcatagagggcggaaggatgaacgcccgcacccgcgaacgacccaatctgatcgagcacgtcacgtttcgcggcgacgaatatctgttttatccggctcttcctctggacgtggtcattgtgcgcggcacccatgctgatgaagacggcaacctcacgaccgatgaagaggtgatgaagctggaagtcctgcacgccgttctcgccgccagacgctacggggcgaaggtgctggcgcaggtgaaatatcgcgtagcgaaaggctcgctgcatccgaaaagcatcactgttcccggcaacctgatcgacgccattgtggtgtgcgaagagccgcagacggatcaccgccagacttcaagctgggccttcgacccagcgctgtgcggcgatatccagctgcccgccgcgcagaatgcgccgctgccgctggacctgcgcaagcttatcgggcggattgcctgccgctatctgacccccggctgcgtcatcaatctcggcaccggtattcccaatgacgtgattggcgccatcattcacgaggaacagctcggcgagcaggtcaccatcaccgtcgagtcagggatctacggcgggcagcaggcgggtggcgtggatttcggtatcggccgtaatctgagcgcgatgattagccaccaggatcaaatgctctactacaacggcgcaggggtcgacatcacctttatgggcgccggcgagattgacccgcacgggcacgtcaatgccacacggctcggcgcatcctgccccggcgcgggcggttttatcgatatcacccagaatgcccgccacgtcgtgttctgctcctcttttaccgccaaagggctggagatcgcctgtgaacacggggcgctgcatatccgccgcgaaggcgaggtgcgtaaattcgtcgccggggtaaaccagatttcttacaacggcgaactggcccgcgccaaaggacaaaccatgcattacgtcaccgaacgggcggttttcgaactgcgcccggaaggaccggtgctgacggaaatcgcccccggcatcgatcttgagcgcgacatcctggcgcatatggattttcatccggcgatcgccgcggatcttcaggttatggacagccgattgttcgccccgccgccctgcggtctcgcggaacatctgtcccggaattcatcctctgactcataa

SEQ ID NO: 2554 - DNA, 1260 bp, Klebsiella pneumoniae
ttagccataagcagcaccaaaaaacgctggcgcaaattatggcgcaaatgggcgttcagcagaacgtcacatcggtgcactggcgtgtcggagaggcgtaggggctggcggcggagcagcggaaatggccgctcgtcgcgcgattcgccatcccgcgggaaagcggctagaatggcctcctcgcaggaggttataagaatgttaaataatggatgtgtaccctcggaatctggtcccacagaggtgacggctgattttcgttttacccgcgtgatggccgagcaggcggcgcgggcgcgtctgacgctggacgacgatcagctgtcactcatcgcccgccttgacgccctcggtcagcagttggtgtccacgacaggcaggccgcaggggatgtacgtctggggacgtaccgggcgagggaaaagctttatcctcgaccactttttcgccagcctgccgctcgccgccaggcggcgggtccattttcatcacttcttccgcgaactgcaccagcggctgaatgcccccggagcgcccgacctgcagacggtgatgaggcagatgacatccggttgccgcctgctatgcttcgacgaatttcatctacacgacccaggcgacgccatgctgattaaagccttgctggaacacctctttcaacacggtatcgtgctgctggccacctcaaactacccgccggagatgctgctgcccaatccgctgtatcacgatcgctttttaccgtcgatcgcgctgatccgcgcccatctaacggtggtggcgctgaacggcgaggaagattatcgcgaacggcatctgagccaggataacgccttctgcagcgggcggatgtgggttaatccgaatgcacaacagcgtcagctgtatgacctgccgtcgctgcctggcgaaccggtttcgctgacggtaggctatcgcacgctgctggcggccgcggcgtcgcccgcgttgctgcacttcacctttacccagctttgtcaggccgccacggcggtgatggactatctgacgctctgcgaaagctatgccgtctggctactggacgaggtgccgccattggctacggtggggccggcggcccagcagcgctttatcaatgtgattgatgtgctgtatgaaaagcagatccgcctgctgctggtgacccgctgcgacctggagacgctggtggcaggggtggaactggaggatattcaacgaacgcggagtcgcctgcaacagctgccgcgggcggtataa

SEQ ID NO: 2555 - DNA, 891 bp, Klebsiella pneumoniae
ttgcacgtaagggataccatcatgatcggcattcgccggatgatcgaggcgcaggtgctcggcctgaccggcatggcgctaaaagagatcgactttgaacgacccaaaggagagccggggctgtttggtccccagtcggccatctggcaggtgcacggcgattttacctcgatgctctgcggcggcattagcgcgctgttgctgcagatgctgcatcctctggcgctggccggcgtctgggatcactctcgttttcgcgaggatattttgggccgcctgcgccgcaccagccagtttatttctgccaccacttttgccactactcccgacgccgaacggctaatcgccaaagtacaggggatccatcagcggatcgccggggtggataaggacggaaccccgtatcaggcgagcgacccggcgctgttaacctgggtgcacgtcgccgagtgcagtcgctttatggcttcccacctgcgctacaagcggacggtggtcagtcccgagcgccaggaggactattttcgtgagtcggcggaaatcgcccggcggctgggggctcgggatatccctcagacaccgcaagaggtggcggactatctcgaggcgatgcgcccgcgactgcgctgcgacgaacgtacccgggaggtagccgaggtgctgctctccacccgtctgccggggcggatgagccagccggtcggccgggtgatgatgaacgcaggaattgaccttttgccggaatgggcgcaggagatgctgggattgtcgctcacgccgctgcagcggcgcacgacgcgcctgatggtgcatggcgtggcccgcgtactgcgcgcctcggtacgcaacggcgcctggcattgcgccatgcgccggatgacggaggcgtga

SEQ ID NO: 2556 - DNA, 288 bp, Klebsiella pneumoniae
atgatggtaaggaacaaggcgatgaattccccgcagatatacagtcccgtgcagctggccaattacctgaagctgctgcgccagcagaaccactggacccaggatgcgctggccaggcggatcggcattaagcaggccacgctgtccaattttgaaaatcaccccgacaaaaccaccttaaccacgctgtttaagatcctccagtcgctgggggtggtgatgacgctgaacgccaaagctgctgagacggcgccggctcccgataacaacacggaccttgactggtaa

SEQ ID NO: 2557 - DNA, 570 bp, Klebsiella pneumoniae
aacgctgggctttatcaccaccgggcagatgccgcaggtgggcaccaaatttggccgctggctggatctgacctttatgcagctgcagctggatgcgcgtcaggacccggacggcaaagcatgaacgcgtcgctcactctcgcctgcctgatcgccgccggcgttggcctggtagtgcagaacactctgatggtgcgcatcacccagtcggcgtcgacgatccttatcgctatgctgctcaattcgctggtcgggatcgttatcttcgtgacgatgttactgctgcgccagggcgtcgccggctttcaggagctggccctgagcgtgaagtggtggacgctgatccccggcctgctggggtcctttttcgtcttcgccagcatcagcggttatcaaaacgttggcgcggcgacgaccattgcggtactggtggccagccagctggtgggcgggttgatcatggatttagttcgcgcccacggcgtgccggtgcgggcgctgatcggaccgttatgcggggcggtgatgctggtggtgggcgcctggctggtggccagacgccagttctga

SEQ ID NO: 2558 - DNA, 1254 bp, Klebsiella pneumoniae
aagatgttgagtaataactgttcgattctgctgattgacgatgatgccgatgtgctggatgcctatacgcagctgcttgagcaagcggggtatcatgtcagtgcctgtaataatccgtttgatgcgcgggagcaggtgccgaaggactggcccggcatcgttttaagcgatgtctgcatgcccggctgctccggtatcgatttaatgacgttgtttcatcaggaggacgatctgctgccgattctgcttatcaccggtcacggcgatgtgccgatggcggtggaggcggtgaaaaaaggggcctgggatttcctgcaaaagccgatcgatccgggcaaactgctcacgctggtggacgccgcgctgcgtcagaggcaatcggttatcgcccgtcgccagtattgtcagcaaaaattacaggttgagcttattggccgcagccaatggacggttcggtatcgccagcgccttcagcagctggcagaaacggatattgcggtatggctttacggcgagccgggaaccggccgcatgaccggcgcgcgttacctgcaccagttaggacggcacgctgaaggtccgtttatcgcctgcgagctgactccggctaacgcccatacgcttaatgaactgatcgcccaggcccagggcggaacgctggtcttaagtcaccccgagcatctgactcacgagcaacagcatcagttggtacagctgcagagtcatgagaagcggccttttcgcctgattggtattggtagcgcttcgctggtggagttggccgccagcagccagatagtggcggaactctattactgctttgcgatgacgcaaattggctgccagcctctttcaaagcgacctgatgatatcgagccgctgtttcatcactatttgcaaaaaacctgtcaacggctgaatcatcccgtcccggaggtggatgctggtctgttgaaggggatgatgcgccgggtgtggccaaataacgttcgcgaactggcgaacgccgccgagctgtttgcagtaggggtattaccactcgcacaaacggttaatccgctgatgcacatcggcgagccgacgccgctggatcagcgggttgaggacgtcgaacggcagatcatcaccgaagcgctgaatatccaccagggacgtattaatgaggtggcggagtatctgctgataccgcgtaaaaaactttatctcagaatgaagaagtatggtctgaataaagagcactacaaaggggtttag

SEQ ID NO: 2559 - DNA, 1152 bp, Klebsiella pneumoniae
cacctgatgagcaaaaaaattgcccgttgcagcctttatgtgctgggtatggcttgtttgaccgttcaggcggcagagccgctcacctcgctggataaaccggaagggcggctcgatattattgcctggccgggatatatcgaacgcggtcagaccgacaaacagtacgactgggtgagtcagttcgaaaaggacaccggttgccaggttaatgtcaaaaccgctgccacctctgacgagatggtcagtctgatggccaaaggcggctacgatctggtcaccgcctcgggtgatgcttcgctgcgcctgatcatgggcaaacgcgtgcagccgatcaacacggcgctgattgccggctggggctcccttgatccgcgtattgcgaagggggcgtggtttaacgtcggcggtaaagtctatggcacgccgtatcagtgggggccgaacctgctgatgtacaacacccgcgtattcccgacgccgccggacagctggcgcgtggtgttcgtcaagcaggatctaccggatggtaaaaccaaccaggggcgggtgcaggcctatgatggcccgatctatatcgccgacgccgcgctgtttgtcaaagccacccagccgcagctggggatcgaagacccctatcaactgaccgaaacccagtacaacgcggtgctgaaagtcctgcgcgaccagcaaccgctgatccatcgctactggcatgacgccaccgtacagatgaacgacttcaaaaacgaaggggtagccgcctccagttcgtggccctatcaagccaacggcctgaaggcggaaggccagccggtcgccaccgtgttcccgaaggagggggtaaccggctgggcggataccaccatgctgcacagcgaggcgaagcacccggtctgcgcctataaatggatgaactggtcgctcacgccgaaggtgcagggcgatgtggcggcctggttcggttcgctgccggtggtgcctgagggctgtaaagccagcgcgctgctcggtgataaaggctgtgagaccaacggctatgagcagtttaaccgcattcacttctggaaaacgccggttgcggaaggcgggaaatacgtgccctatagccgctggactcaggactatattgcgataatgggcggccgctaa

SEQ ID NO: 2560 - DNA, 1131 bp, Klebsiella pneumoniae
tgggtcacgaggtgggcgacagccgctacgcggtgcagtttagtgaccaccagctgcagcagattaaaaatatcattaacacctaccttcactaatttacgtatccgccccggccatcactggctggggcaaggtcttgtatttgcgacgctcattgtcgccagtaaacaggaaacggttatgaaagtaatttgcacctcgccctcattcgccaaatacgacgatgcgcccatttcggcactgaaaaaggccgatcttgaactggtcatgttgcctgccgatgcctctatagagatgctgactcagcatctgcctgatgccatagcgatgattgtcgccttcaccgacatcaatgaatcgctgctggcaaaggccccgaggctaaaaattgtctgcaaacacggcgttggtgtggataacatcgatcttaacgctacacgtcagcgcaaaatttttgtcactaacgttcctgatgccaacaagcatgcggtggccgattttgcttttggcttaattctcaatactgcccgccagatttatcaggcaatcagtgaaacgaaagcaggcaactggcctcgtatttttgccactgatgtatatggcaaaaccctggggatcgtcggtttaggccatatcggtaaggaagtggcgcgacgtgcgcgcggattcaatatgcgagtgctcgcgaccgacgcctggccagacagagaatttgcacaacaacaccagattgaatatgtctcactggataccctgacggcgcaaagtgattttattagcctgcatacccctttaaccccggaaactgaaaatatgtttaatgccgcccggctacagcagatgaaatcaggggcattcctgatcaatgtttccagaggcggtattgttgatgaacaagcgttgtatgaagcactaaaatcaggacacctcgccggagccgcagctgacgtttttctcgaggaaccttgcgctacgcaccctttatttaccctggcgaattttgcgccaacatctcatattgctggatatacggatggcgcaattagcaatattagcgcgcgctgcgtcaacaatattattacctgcgtctgtggtggtgaacgacctgaaaacattatgaattcgctgtaa

SEQ ID NO: 2561 - DNA, 714 bp, Klebsiella pneumoniae
atcggtcagagggaggcaggtgtgcgcaacgtaaaaattgacgaggtcgatcgactcgatcgtgatgtggtggcgttaggtaatgactatgcgcaagggtttatcctgcccccgcaccagcatcgtcgcgcacagctgctgtatggcgcgaccggactgatgtatgtcactacgcaggacggagaatgggtggttcctccgcaacacgctgtctggatcccccctgaaaccgtgcatgccgtcagatttgcaggggtgaccacgcgtagcttgtatattgagccagactgtgtggccgctttcattaaacaccgtcgttgcgaagtgatcagcgtctcgccgctgttgcgccagctactgcttgaggctgtggatttaccaccgttgtacgacagcccacgcgatcgcacgctgatacagttgatgttgctggaactggccgctatgccggtccgcgaatttgacattccgttgccgcagcatccggcgctgctggcgctttgtcaggcttttttgcttaacccctctatccatgatcctgcggcgcgctgggccagggcgctgtttatgagtcctagtacctttcgccgccatttcctgaagcagctgggcctgtcattttccgcctggcgtcagcgagcctgcgtggtgagcgccctggcatggttgatagcaggcaaaccggtgaacgaagtggcattatcccttggataa

SEQ ID NO: 2562 - DNA, 339 bp, Klebsiella pneumoniae
cctgcaaagagaatcactatgagtactcctcctgtcgatcgccgaacgctggctgctatcgcgccaaagctagccgagctgaccgaaacggtgctgtttggcgatatctgggcgcggagcgagctgtcgccccgcgaacgcagcctgatcaccctttccgccctgacggcgcagggcaaaactgaacagctgccgtggcacatcgcgctcggctatcagaatggcctgagccgggaagaaattgtcgaattgtttacccatctggcgttctatgccggttggccggcggcggccagcgccctgacctgtctgaatgcgcaggaggcgtcatgcccctga

SEQ ID NO: 2563 - DNA, 471 bp, Klebsiella pneumoniae
cagtcgtggaggtatggaaagatgggattattaaattttgtgaaagaagcgggcgagaaaatatgggatgccgtctccggcgacagtaaagaagatcgggctgaaaagctgaaaaaacatatcgatggacttaatctgcctggcgccgaaaaggtcaatattgatgttgcggaagatggcaccgcaacggtcactggtgatgtcgcttcgcaggaggataaggaaaaaattctggttgcggtcgggaatgtcactggcgtaggccaggtcagtgacggcgttaaggtgacgcaaagcggggcggaaagtcgtttttacacggtcaaatccggtgacactctgagcgcaatctcaaaagcgatgtatggctcggccaatgattatcaacgtatttttgaagccaataaaccgatgctgacccatcccgacaaaatctatccgggtcaggtgctgattatcccggcgaagtag

SEQ ID NO: 2564 - DNA, 708 bp, Klebsiella pneumoniae
acagtgaggagagacaacatgcagcttggtgtcattgccgatgacttcaccggcgccacggatattgccagcttcctcgtgcgcaacggcatgccgacggtgcaactgaatggcgtgccgacccgcgatcttccgctgaccagcgaggcggtggtcatcagcctgaaaactcgctcctgcccggcggaaatggccgtcagccagtcgctggcggccctgcgctggctgcaggcccagggctgtcagcagttttatttcaagtactgttccactttcgacagcaccgcgcagggcaacattggcccggtgctggatgccctgctggccgagctgggtgagacgcggacggtgatttccccggcgctgccggttaacggccgcacggtctatcagggatatctgttcgtcggcgagcaactgctgaatgagtccgggatgcgccaccatccggtgacgccgatggaggatgcgcacctgggccgcttaattgagcgccaggggcgcggaaaagccgcgctgattgcctggccgattgtcgcccgggggccggaagcggtcgccgccgcgctggcggcagtcaacgatccggcggtgcgctatgtggtgctcgaccccctcaaccaaaaaagatctgcctcccccattggttttgtccttcccggaacaaaaaaccggtctcccgggggtcccggccctcgcccatcgggc

SEQ ID NO: 2565 - DNA, 918 bp, Klebsiella pneumoniae
agaggtgggaggcgggtcatcatgcaaatgaatctgtttgaaaatattaaaatttttattgaaatcgtcgatgccggcagctttgcccaggcggcggaaaatttgcagatccaccgaccggcggtgaccaaagcactgcagcagctggagcaggagagcggggtccggctgctgcagcgcaccacccggcgtctgtatcttacgccggagggggaagagttttatcgtcgcagcaaaccgttgctctcccaggccgacgatctgctggagtcgttcgcgccggaccggccgatccgcggtcagctgcgcgttgatatgccgatcgcctttgcccggctgctggtgatcccgcatctgccggatttttatcaggcccatccggaggtggagattgtcctcagcagctccgacgtacgccgggatatgctgcgcgatggtctggattgcctgctgcgggtgggggatcttgaggatggcgactatgtggcgcgttcgctgggggaggtggcgttaaccacctgcgccagtccgggctatctggcgcgctatggggcgcccgcgacgctggaggacctgcagtcgcatctggcggtgaactgggtgaacagcagcagccggcagattatgccctggcgattccagaccccggagggcatcaggcagatcgccattcccggtaaactggtgctggacaactctgaagtctttactgctgccgggctggcggggctggggatgctgcaggggatgcgtttctttttgcaaccttatatcgacagcgggcaactggtggaagttttgccggactttccggcgccgcgtcgaccgttgtcgctgctctatccgcaccggcatctctcgcataaggttcgggtctttgccgactggctgcaggggctggtggcgaccctggactga

SEQ ID NO: 2566 - DNA, 1422 bp, Klebsiella pneumoniae
actaccgggaggcatatcatgagcgcagaaagctcaggagtgtttactttgaaagagatcaaccggatcaagattatacaggacgtcattgaacgtcgcatcacaacgcgccgtgcggccgagcacctcggtatcagcgacaggcaatgccgcagacttcttgcccgttaccgtgaaggcggaccgcttggtatggccagcagacgatgtggcatgcgtggtaaccgccagttgccacccgggctcgcagatcaggctctggaactgatcaagacgcgttatgctgatttcggtccgactctggcgcgtgaaaagctcgaagaactccacggactgtttcttggcaaagaaactgtccggcgcatcatggtgcgggctggcttatgggttccccgtaaacaacgtgccgcaaggatccctcaaccacggtaccggcgtccgtgtactggtgagctgatacaaatagatggctgtgatcacgactggtttgaaggccgtggcccggcctgcaccgcgctggtctatgttgatgatgcaaccagcaaactgatggaactgttgtttgttaaatcggagtccacgttttcttacttcgaagccacgcggcgctatatcgataagcatggtaaaccgctggcactgtacagcgataaagccggtgtttttcgtgttaacaataaacacgccacaggcggagacgggcatactcagtttgggcgagccatgcatgaactgaacatccagactatctgtgcagaaaccagtcccgccaaagggcgtgtagaacgagctcacctcactttacaggatcgtctggtcaaagagctgcggttacagggcatttgttcaatggaggctgcaaatgacttcgctgaggcctatatggctgactataaccgccgttttggcaaagtaccgcgacatgattttgacgtacaccgtgctgtagaacatgatgaggacctggggcttattttcactgttcgtgaaaaacgtaaagtctcaaaatcgttgacgatacaatatgataaaatgttgtacctgattgaagacagcgaactgagtcgccgtgcaataggtaaatatatcgatgtgtatcactatcctgatggcagaaaagagctgcgcctgaacggtacgctacttccctactctacctacgaccgactgtcagaaatcgaccagggcgcgattgtcgataacaagcgtcttggccgaaccctggagtttatcagtctggtgcagagcaagcgggataacacgcgctctcagtcaattcccgctggagatggcccttcccgacgacggccaaagcaggaagggaagaaatcccagcgctcactggataatgatgacatgctcgaagcactcaaacagcttcagtcacgttcagaggacatttttggtaaaagagcccgctga

SEQ ID NO: 2567 - DNA, 795 bp, Klebsiella pneumoniae
  unsure (72): Identity of nucleotide at the above locations are unknown.
atctcctttggcgcaactgttcttccctgggcgatttggttttatcccgttaaaaagctacggaagtcagcncgctggctggaaagcaaagggaggcatgatgacgcgcatacggtgatgtgtgagatggaagcccgctgcggcctgacgccgtcgccaaagcatgcgcatgcggcacagagcgtcgtcaaacgcggcaccttccgcgaaatctgggcgccgcagtatcggcagcgcaccctgatgctgatggtgatgaacttcttccaggcgatcggtttcttcggctttggcaactggctgccggcgctgctctccggtcagggcgccagcatcacccatagcctgctgtacgccttctttatcaccctcgcctatccgctgggctgtctgttctgcacccgcttcgtgcatcgttttgaaaacaagtggcagattgtcctctccgcgctgatgaccgttatcttcggcaccctgttcgctctgcaaaacagtccgatcctgttggtgatctgcgggtttatgatcacctggtccaacgcctggctgaccatcagctaccacgcctaccaggccgaggtcttcccgacccatattcgcgcccgcgccgtcggcttctgctactcgttcagccggctctcgaccgcggtgaccagcattctgatcggcattattctgcaatacgccggcacgccgggagtaattagctttatcgtcgtcagtatgctgatggtgatgctgtcggtggggatcttcggcccgagaacgcggggcattcgtctggagaatatctga

SEQ ID NO: 2568 - DNA, 1587 bp, Klebsiella pneumoniae
caaaaagttggacatgtgttcaacaatccggcaggatcgccatcctggacgtgtgtccaatattcaatattgattgaggtacaagctatgtcacggcaatggatgacgctgatggcgattttgctggtttatattccggtggcgattgacgctacggtgttgcatgtggccgcgccgaccctcagcgtggcgctgggtagcagcggcaatgagctgttgtggatcattgatatctactcattagtgatggccggcatggtgctgccgatgggcgcccttggcgataagatcggctttaagcgcctgctgctgctcggcagcgccatttttggcatcgcctcgctgtgcgccgcgctgtcgcctacggccatgacgctgattgcctcacgcgctttgctggcggtgggggcggcgatgatcgtcccggcgacgctggccgggatccgcagcacctttgccgaggccagccagcgcaatatggcgctggggctgtgggcagcggtcggctccggcggcgcggccttcggcccgctggtgggcggtatcctgctggagcatttctactgggggtcggtgttcctgatcaatgtgccgatcgtgctggtggttatcgcgattaacgcgaaagtggtgccgcgccagcccgcgcgccgcgaacagccgctcaatctactgcaggcgctcgttttgattgccgcgatcctgatgctggtgtttagcgcgaaatcggcgctgaagggccagctggcgctgtggctcaccgcgctggtggcgctcggcggggcggcgatgttaacctggtttatccgcaagcagctgtcggcggcccgcccgatggtggatatgcgcctgttcacccatcgcattatcttaagcggggtgatgatggcgatgacggccctgattaccctggtcggttttgagctgctgatggcccaggagctgcagtttgtgcaccagaaaacgccgttcgaggcggggatatttatgctgccggtaatggtggccagcggcttcagcggcccgattgccggcctgctggtgtcgcggcttgggctgcgcgaggtggcgaccggcgggatgctgctcagcgccttcagctttctcggcctggcgttgaccgatttcagtacccagcagtggctggcctgggggctgatgacgctgctgggctttagcgtggccagcgcgctgctggcctccagttccgcgattatggcggcagcgccgaaggagaaagcggcggccgcgggggcgattgaaaccatggcctatgagctgggcgccggtctcggcatagcgctgttcggcctgatcctgacccgcagctacagcgcctctattgcgctgccgtctggcctgagtggcgccatggcgcagcaggcgacgtcatcgattggcgaggcggtgagtctgtcccaggcgctgcccgccggggtggcgcaggcgctgatggcggcggcgaagacggcttttattcaggctcatagcctggtgctggcgacggcgggtgtattgcttctgctgctggccgccgggatctggcgcagcctcgccaccgtggcgaaaccgcagtcggcgctatag

SEQ ID NO: 2569 - DNA, 510 bp, Klebsiella pneumoniae
cccggtgctggcgttcgctttttatccgcaggccgctggcgatctcgttgccaaatgcccggagaaagccgcgccgctgctccacctcccatcaccgggagagccgccgaggctcctgctgcgaccgcccttctactgctcgcccgatcaggccgaaggactggcgcgtggggaacagctgcgcccacagcttgccgccctgcgccatgccgggggacacggcgagtggcatctgttcgacggcagctggcagttgaccctccagctgccggagccaggccgacggccggaggcgatcctgcaggccatcctgcggcagctcgcgctcccggtcgcctcgctgaccccaccgccggaaagtatcgctatccgtcatctcatggctcaactccccgaacggctgggtacatccgggcatcaggaaggttggctggcggccctggccggcggcagcgcagaagatgcgcagtgggtagcgcgtcagctgagcctgattaccgccccggttaa

SEQ ID NO: 2570 - DNA, 771 bp, Klebsiella pneumoniae
ccttatcatggaggcatacaggtgaacggtttttattcgtccgtcgctggcgccacgctgcgctggcacgatttcccgggagatggccttccggtggtgtttatccacggccttggctgcgcgtcatcctacgattatccccgcattgccagcgatcctgcgctccgcgaacggcgcaaaatactcatcgatctgccgggcttcggctatagcgataaaccgcgcgcgtttagttacaacatacatgggcaggctttagttttggagcagttcctcaaccgcctgcgcctgcagcgcttcgcgctgttcgggcatagcatgggagggagcatcgccatcaaagcggcggggctactgggcgagcgggtgaccacgctgctggtctcggaacccaatctgttcgccggcggcggcgaatacagcaggcgcattgcggcgcagtcagagtcagcctttgtcgctgacggctatgcccggctgctggcggaggagcgctcgccgtgggcgggttgtttacaaaacagcgccccctgggccgtctggcgggccgccagcagcctgatatgcggcagcgacacgccctggtttacccagctatgccagctgcgctgccagaaaatgctgatcgtcggagagcggtcgctcccttatgcggatagcgacctcgttcaggcacaagggatcccggtcggcatcgtgccccatgccggacactcgatggcgtgggaaaacccgcaggggctggcgcagcttatcgccagccatagttaa

SEQ ID NO: 2571 - DNA, 732 bp, Klebsiella pneumoniae
aaccggagtgggttaatgaataatgaacatcgtctccaggccgcgccagcgctgcaggacaaggacgaaagcatttaccaggcgctgatgacggctatcgtcgaacatcagctcccgccgggcagcaaactgccggaagaggcgctggcggaggtgttcgccgtgagccgcaccggcatcagaaaggtgctgcaacgactcgccgctgtgcaactggtcacgttgacgcccaaacgtggtgcacacgtcaccagcccgagcgtggaagagtcccaggcgatctttcgcacccgggcgctgctcgaggtcgccaatctccccgatgtgatcgcgcgctgtcagccgccgcatctggcggcgctggagaacattattcagcgtgaacagcaggcccatgcggcgcacgacggcccggcggcgatccgccactccgctgactttcatattcagctgcaggctatctccggcaacccggtgctcaccgagatggtgacccgcctcagccagcgctcctctttagtgattgccgcctggggcgccccctggcgacagggctgccgttgcgacgatcaccagcagctggtcggtttgctgcgggataaagccctgcagccgctcagcgaggcgctgatgcaccattttgatcatattgtcgccagcctgtgcttcgagcgcgatggcgtcagcctgcccgatttttcccggctgttcgccggccacaaggagtcgtga

SEQ ID NO: 2572 - DNA, 1503 bp, Klebsiella pneumoniae
gggcctggtggctcacccgcgacggcgataacgacgccggaaacgggaaataaaaccatgaaacaggataatgctatgcaacacaacctattaataaacggtaagttagtggcaggtgaaggcgagaaggttccggtatataaccctgcaaccggcgaagtgatcctggagattgccgaagcgacagcggcccaggtcgatgccgccgttgaggcggcggaccgggcattcgatgcctggagtcagacgacgccgaagacgcgtgcggaatgtctcctgaagctggcggacgccatctcggcgcaggctgaaaccctggcgcagctggagtcgctgaactgcggcaagccgctgcactgcgtgattaatgatgaaatgccggccatcgccgacgtcttccgcttcttcgccggcgccgctcgctgcctgccggggatggcggccggagagtatctcgaagggcatacctcaatgatccgccgcgatccggtgggcgtggtggcctccatcgcgccgtggaactatccgctgatgatggcggcctggaagctggccccggcgctggcggcgggcaactgcgtagtgataaaaccctcggagatcaccccgctgacggcgctgaagctggcggagctggcaaaagatatcttcccggagggggttatcaacgtgctgtttggccgcggtaaaacggtgggcgaccccttgaccgcccacgttaaagtgcgaatggtctccctgaccggatcgattgccaccggagcccatatcattggccataccgcctcgtcgattaaacgcacccacatggagctgggcggtaaggcgccagtgatcgtttttgacgatgcggacatcgatgcggtggtggatggggtgcggaccttcggtttttacaacgccggccaggactgcacggccgcctgccggatctacgcccagcagggtatctatgaccagctggtggagaaacttggggcggcggtggccagcctgaaaatgggggcgccggaggacgctgccaccgaactgggtccgctgagctcgctggcccatcttgagcgcgttagcgcggcggtggaagccgcaagggcgctgccgcacattaaggtggtcaccggcggcagtcgggctgacggcgcgggctattacttccagccgacgctgctcgccggcgcccggcaggaagacgctattgtccagcgcgaagtgtttggtccggtagtcagcgtgacgcctttcagcgatgaagcgcaggccctgagctgggcgaatgactctcagtatggtctggcctcctcggtatggacgaaagatgtcggtcgcgcccatcgtcttagcgccaggctgcagtacggctgcacctgggtcaatacccactttatgctggtcagcgaaatgccgcacggtggccagaagctgtcaggctacggcaaggacatgtcgatgtatggccttgaggattataccgtggtccgccatgtgatggttaagcatagctaa

SEQ ID NO: 2573 - DNA, 1302 bp, Klebsiella pneumoniae
atagatggtggcgaagatgccgacgccggccataaacgagaaatagcagccgaggctgaaggttcgatcctgcagggcgcggagatccatcaccggctgcggatggcgcagggtgcggataacaaaggccacgccgcagagcagggcgacccaggcggtggtcgtcagggtcgcgtcatcaaaccagccccagcgcggaccttcttcgagggtatattccaggcagccgagggacaaggccagcagcagaatactgagatagtcggcgccgcgcagcagagtggggtcggcgctgtctacttttaccagcagcggcactgccaccgcgatgtaaatccccggaacaacgttgataaagaacagccagtgccagttgtagttttcggtgatccagccgcccaccgttggacccagcgtaggggcgagggaggccaggccgccgatcgtcgccgcggcgatgacccgctgtttgccctgaaaaaaggcgaaagcggtggtgaacaccagggggatcatcgacccgcccgccagtccctgcagggcgcggaaggcgatcatactctggatgttccacgcccagccgcacagcaggctcatcagcgtgaagcccgccgcggaagcggcaaacagccagcgggtcgacatgacccgggccagccagccggaaagcgggataataatgatctcggcgatcaggtagctggtttgtacccagacggtttcatcgtcgcccgccgacaggccgccgccaatatcccgcagcgaggcggagacgatctggatgtcgataagggcaataaacatccccacgcacatgctggcgaaggcgaagatcttcttcgccgtcggcatcgacagaccctgcggggcggacagcgcctgaacggtgctcatcgagggctcttttcgttcacggtgacgatcaccgacagtcccgggcgcaggacgtcaagctttgccccgtcaccttccagcgcaatgcggaccggcacccgctgcacgattttagtgaaattcccggtcgcgttctccgccggcagaatgctgaagcgtgagccggtcgccggcgccaggctggcgacatgccccttaaaggtatggttcggcagcacatcggcgacgatggtcaccggctggccggcacgcatatgcgccagctggttttccttgaagttagcgtcaatccacaggccgtgcgcgggtaccagggagagcagctgcgtaccgctgctgacgaaggagccggaccacgcgcggcggttgccaatcaccccatcgaacggcgcgcgaatgtcggtatag

SEQ ID NO: 2574 - DNA, 456 bp, Klebsiella pneumoniae
cgacgattcggcttccgtgccaacatcccgtcagcgtctggcaacagatgcatggacggtactggtagacaacagagttcgcgcaacgatccagcccggtaccgtagtccaatccgaatcactgacccacacggtgaattcctgattctggcgggaaatacagacatgcaccaaagttttaatcagcgcgttcatttctattactgtgtcctggtcgcgctgaagatgcacggaaaatcgaaaaaagcgggtggtatcaggggaaagaataactttctgctgaaatggctgcgccgggcgcaggataacaacatttttcctcccgatatcaccagtgaaatcgaatggctgcgaggaaaaattattcaggctggctatgacaccgatctcgagccgatgctggattttgtctacgccaccgccagccgcgccgaggcgctcaaaaacgccgaatag

SEQ ID NO: 2575 - DNA, 1512 bp, Klebsiella pneumoniae
ggtggcctcggtgcggtagtgatcccaggccgcctgcatcgccgcgccctgagtggtggtgaacctgaggtagttcaggaccgcttccagcgcgctgagcgtctgcatcacgcagtctttacgcgcgttatagcccatggtgccaatgcgccagactttaccgtgcagcggaccaaacgaggtgccaatttcaatgccgaaatcttccagcatcagtttgcgtacctgatcgccgttgaccccgttggggatcaccacccccagcacgttattcattttgtgccgcaggtcgccaaaggtctcgagccccatcgcctggatgcccttcagcagcgcatcgccgtgcagtttgtggcgggcgatgccgttgtcgagtccctcctggaggatcaggcgcgcgcactcccgggcggcgaacagcgccgaggtcgcttcggtatggtggttaaggcgctccggcccccagtaatccatcaccatgccgagatcgaaatagttggagtagatcatctcgtcgacgccatcgtgatgggcatcggtgcggatcccctgctcaatgcagcggcggcggcggatgacctcttccatccgcgggctgagggtgatgggcgaggtgccggaaggaccgcccaggcacttctgcatcccggcggacacggcgtccagctgccaggcgtcggtttccagcgggttaccgccgagcgacgcggtggcgtcggtatagaacagcacatcgtgacgacggcaaatctctcccagctccgccagcggctgcagcatggtggtggaggtatcgccctgcacggtgagcagcaggcgcggccgcacgcgcttgatcgcatcctcaacctgatccggcgtaaagacctcaccccacggcacctcgatggtgtgcacctctgcccggcagcgacgcgcgatctcgcacagcagatgaccaaaccggccgaacaccggcaccagcaccttgtcaccgggacggatcgccgacagcagaatcgcttcgatcccggcgcgcgaggtgccgtcgaccaacatcgtccagcgattttcggtgcgaaacacgccgcggtagagcgccatgacttcattcatgtagtgggtcatcgccggatcgtactggccaaccagctggctcgacatggcgcgcagcacgcgcgggtcggcattgatcggccccggccccatcagcaggcgctgcggcgggttaatttgcgaaaactgagtgatatccatctgccattccttacgttagttaagaccgcgcaccgaggagataaactgtttcagttcgctggtctgcgggctggcgaacagcgttttgctgtcgccctgctcccagacgcgtccctgatgcataaacaccacgcggtcgcccacttcgcgggcaaaattcatttcatgggtgacgaggatcagcgtcataccttccgccgccagttgctccagcaccttcagcacttcacccaccagttccgggtcgagcgccgaggtgatttcgtcacagagtaa

SEQ ID NO: 2576 - DNA, 270 bp, Klebsiella pneumoniae
aattcttccgggttgttttccggctggggaaattccagcacattgtgggcctgggcggcggcggacaaaagcagaccggcggtgaggatggtttttaccagatgcattgttgtatcactctgttgttataagaaattgatgcgcaaaacaatagattcgagtgatgacaaaaacatgaccattcagcgtcaatattattacctaacaaatatagcgatgttgtctgaattttgtgctatctctgtagcaaaaagccacattctgtactaa

SEQ ID NO: 2577 - DNA, 2433 bp, Klebsiella pneumoniae
cgccgacccggtgtgcagcaaatccccgcatcatcacaaaatcctcgaggcccggcgcgaagcggcctgcagcgacataaaagtcagccagctgcagttccgcaaccgtacccgctcgcagctgatcttccaaacccgggacctgtaatgacgctggcgacccgcaccgtcactttgccgggcggcctgcaggccaccctggtccatcagccgcaggcggatcgcgcggctgccctggcgcgggtcgccgccggcagccaccacgaaccgtcgcgcttccctgggctggcgcacctgctggaacatctgctgttttacggcggagagcgctaccaggatgatgaccgactgatgggctgggtgcagcgccagggcggaagcgtgaatgccaccaccctggctcgccatagcgcgttctttttcgaggttgccgccgatgctctggctgatggtgtcgcgcgtctacaggagatgctgcaggccccgctgctgctcagggaagatattcagcgcgaagtggcggtgattgacgccgagtaccgcctgatccagcagcatgagccatcgcgccgggaagccgcggtgcgccacgccgccagcgcgcccgcggcgtttcgccgctttcaggtaggcagcgccgacgcgctggcgggcgatctcgctgcgctgcaggccgccttaggcgattttcaccgcacccattacgtcgcccggcgaatgcagctctggctgcaggggccgcagtcgctggaggcgctcggcgagctggcggcccgtttcgccgccggacttgccgcaggcgaggcgccgccgccggcgccgccgctgcgcctgggcgagttcactgcactgcagctagcggtctccagccagcccgcgctgtggcgctgcccgctgatcgctttaagtgacaatgtcacgttaatgcgcgagtttttgctggatgaagcccccggcagcctgatggccggcctgcgccagcgccggctggccggggatgtggcgctgaactggctgtatcaggatcggcacctcggctggctggcgctggtcttcgccagcgaccggccggaagaggtcgaccggcagataacccactggctgcaggcgctacagcaaacgacgcctgagcagcagcaacactactatcagctatcccgccgccgctttcaggcgctgtcgcctctcgatcagctgcgccagcgggcattcggctttgcccccggcgcgccgcccgccgggttcgccgatttttgcgccgccctgcaggccgccccgtcggtcagcctggcctgtcagaccgtttccccaggggagcctgttgccacccagggctttagcctgccgcttagccgctggcgccgccgccctgagtctgacccggtgctggcgttcgctttttatccgcaggccgctggcgatctcgttgccaaatgcccggagaaagccgcgccgctgctccacctcccatcaccgggagagccgccgaggctcctgctgcgaccgcccttctactgctcgcccgatcaggccgaaggactggcgcgtggggaacagctgcgcccacagcttgccgccctgcgccatgccgggggacacggcgagtggcatctgttcgacggcagctggcagttgaccctccagctgccggagccaggccgacggccggaggcgatcctgcaggccatcctgcggcagctcgcgctcccggtcgcctcgctgaccccaccgccggaaagtatcgctatccgtcatctcatggctcaactccccgaacggctgggtacatccgggcatcaggaaggttggctggcggccctggccggcggcagcgcagaagatgcgcagtgggtagcgcgtcagctgagcctgattaccgccccggttaatccgccgatgcccgctccggcgccctgccgccgcggcgtcgaacgtctggtttatccgggaggcgatacagcgctgctggtctttattccgctgccggatggcgcctcgctggcggccctgcggctgctggcgcagcattgtgagccgctatttttccagcgcctgcgggtggagcagcagattggctatgtggtgagctgccgctatcagcgggtcgccgatcgcgacgggctgctgatggcgctccagtccccggatcgccgcgccggggaattgctgcgctgtggtaaagactttctgcgccagctggcccccatggatgaggcgaccttcagaccgctacagcagcgcctggccgctcagatccgcgccagcaggccgccagaggcgcgggcgctgtccgccctgcgtcaggagtatggtttaccagagctaacgccgcaggcggtcgacgcgctgcgcgttgcagaggtggccgatctggcacgcgaaatgacccgccggcgtcgccgctggcaggtgctgttcacgacaggggattaa

SEQ ID NO: 2578 - DNA, 306 bp, Klebsiella pneumoniae
tctccgcccggctcaccggcgttttcggatcgctggcaaattcggtctgatcgaggggcacgccatgcacatagcagcgcccgtcccgggtatgccgcccggctgccggataagccggggccaccaccgccatccggcagccttgcgccgccatcattgcctccagttcgccgccgggattaccgcgcagcgtggagtcgatcttctttacctgccagtgcgggacgaatgtcgccgcgccgcgcagcagagcggcgaccttgtccgccgccgcggcggcggtcatcgcccggctgtcgctgttga

SEQ ID NO: 2579 - DNA, 1335 bp, Klebsiella pneumoniae
tactgtaccggtaaatcggcccggcgtgtgttaagccgtgcccaggcgccaccttctctctgtaaataccatagcggattaacatccgccttgcgccaacaatacctcttcatcataataaaaaaagaattatacaatattattgttcttaaattgagaatcattgtggggtggtggatgaataaccaatcgcgccaggccttatggctggcactggctggatcgatagtactgatgatcggcatgggctatgggcgctttgccttcaccggcgtgctgccgcttatgcttaatgaaggtctgttaaccctgcacgaaggcaatctcgctgcgtcggccaattacgctggctatctggtcggcgcgttgctgctggcgcgggtgcagcctggggccgccacccgactgagcattatctccgccgggttgaccatcgccagcctggcgctgctggcctgggtgagctcgccgtggaccattattacgctgcgcgccgtcgccggcgcgctgagcgcgataacgctgattgcaggttcgctgtggctgctggaacatatggggcatcatcacggggcgccgttgctgtatgccggggtggggctggggatatttatctccgcggaggggatcgcccttggacatgccctgagcctcaccagccagcagatctggctgctctgcgcattatgcgccggtctgctgctggcgctggcgatccgttggctgctgactccgccggctgcactggtgcgggtttcccatgttgaaacctcctcgcctgcgtccgggagcgatacccgtcgcgcggcgtggcgactcttgatagtttatggtctggcgggcttcggctatatcatcaccgccacttatctgccgttgtttctgtccggttcgctgcagagcgttgacccggtccatctgtgggcgctgtttggtctggcggccgcgccgtcctgcctcatctggcataagctggtgctaaagtggggataccggcaagcgctgacccgcaacctgctcgtccaggcgcttggcgtgatccttccagcctgcagcgcttcattgctgttttgcgtgctaagcgcgcttttggtgggctttacctttatgggcaccgtaaccattgcgctaccgaaggcgaaaagtctcagccatcaggtgagcttcaatatgattgccgcgatgactgcactgtacggtgtgggacagattgccgggccgcttatcgccggcgcgctgtatcagatcgcggcttcatttaacccggcgctctatgccgcggcgctggcgttgctgattgccgcagggctggtctttaccgaacgccaggcttag

SEQ ID NO: 2580 - DNA, 1557 bp, Klebsiella pneumoniae
tacgctgccggccgatgtcaccctggtctccggcaccacctgcactgtctcaattggcgggcagtaatgaacctgcagaccctgtcgtggcgcgcactcccctgggttaaagccacccggccgcagtggcggtacgcattgcgcaacggcatcgcgatgtgtcttgcgctgagtatcgcctatgcgctggatcttgatgagccctactgggcgatgacgtccgcggcggtggtcagctttcccaccgtcggcggcgtgatcagtaaaagttttggccgcatcgcaggcagcctgctcggcgcctgcgccgccctgctgcttgccggtcatacactcaacgatccctggctgtttctgttcagtatctccggctggctggcgctctgcacctgggcctgcgccctgttcaccaacaacgtcgcctacgcctttcagctggcgggctatacctgcgccatcatcgcctttccggtgattaacatcagcgacagctacgagctgtgggtcatcgcccagtcgcgcgtctgcgaagtcatcgtcgggatcctctgcggcgggctaatgatgatgatcctgccaagcacctccgacggcagcaacctgctgacggccctgaaaaccatgcacacccggctgctggagcacgccagcctgctgtgggtgccggagacgacggatgccattcgcaccgcccatgagagcgtgattggccagatcctgaccatgaacctgctgcgtatccaggccttctggagccactaccgtttccgtcggcagaatcctctgctgaactacctcctgcatcagcagctcagaatgaccagcgtcatctccagtctgcgacggatgctgctgaactggcctgacgcgccggcgaatactcgccaggtactggagtcgctgctcgccgagctcgccacccctcatgccgacagctatcacgttgcgcggatcctggcgccgctggcgccgcggcaggatgccgattaccggcacatcgctttctgggcgcgattgcgctatttctgtcgcatttacctggagagcagccgctggatccgccgcgttgaaaatgcctcggcgatcgccgagttcaatgtgcccgccgccccgccattagcccgccataccgatcaggcggaggcgttgctcaacggtgtccgtaccttttgcgcgctggtggcgattggcgcatgggggatcagtacccagtggaccagctgcgccggcggccctgaacctggcctccatctgctgcgtgctctactcggtatccgcctcgccgtttcgctcgctgacattgctgatgcagactctggttctgctgtcgctattcattttcgtggtgaagttcggcctgatggtgcaagtaaccgacctgtggcagtttctgctgtttcctgttcccggctcctggacaccatgcagttactcaaactgcagtggcccaaatacgccgggcttgtgggaacagcttatcgtctttatgggctcgttaatcgccgtcaccaacccgccggtgtacgattatgcggccttttttcaatgataatttga

SEQ ID NO: 2581 - DNA, 522 bp, Klebsiella pneumoniae
gcgaagaacggaccacactatctaaagaatgatatcgcctattatgttgggaccgctcatgttaaaaaagggatagcttttcttttcattgacgataacgaaggaattttcatggttgaggttgaggaaataaaaaagaaatatcccggcgcagatgcctggcaaatgggggacagtccgcaactggctaacgagctggctgacctgatcaaaaaagggatcaaaacggcctcttgcggatcttttgcctcttaccagcaggaagaatccgccccgagaatcgggagttataacattattcttgatggtcagaatgttccagtttgcgtgatcagactgatttcgatgcagctggttcgtttttgtgatgtcactgaagcgttcgcccgcaaagaaggtgaaggcgatttaagccttgaatactggaagaaagagcatcagagatttttcagctctgaaggtcatttttctgaagatatggagttgatcgcagaagaatttgaagtggttgaggtgctgtaa

SEQ ID NO: 2582 - DNA, 282 bp, Klebsiella pneumoniae
agatcctgcggggcatccacctgctcaatgcgcccgttgttaaacaccgccacgcgatccgacatcgacagcgcttcgctctggtcgtgggtcacgaagatgaaggtgatccccagcgactgctgcagctttttcagctccacctgcatctgctcgcgtagtttcaaatccagggcgcccagcggctcatcgagcagcagcacccgcggctggttcaccagcgcccgggcaatcgcgacccgctgccgctggccgccggagagctgggagggcttgcgatga

SEQ ID NO: 2583 - DNA, 339 bp, Klebsiella pneumoniae
tgccaaagcgggtgccctcttcatcgccaaagccgacgatctcgattgccttcgccagccgtcgcccatgctggtgcagacgctggaccacctcaatcgccgccagcacgccgagcatgccgtcgtagcgtccggcgttgcgcacggtgtcaagatgagagcccagcagcaccgccggcgccccctcctgttgtccttcataacgtccgcagatgttgccgacgctgtcctgccacaccatcatgccggcagcctgcatccactgccccaccagctggttggcctgcagatgctcgggcgacagatagacccgggtcagggcgtcggcggtttcgctga

SEQ ID NO: 2584 - DNA, 510 bp, Klebsiella pneumoniae
agacgaagcggtcgacgttggcgtagaacgcgccgccgcgggtggcaaattcgcccaccggcaggccgggctcattgtgcatgccgaagatcgccgacacctcctccagcgccccggcgcggatcagggttttcgccccaccaaaattttcctccgccggctgaaacaggatccgcacccgccccgggagttccgcttcccgctccttcagcagcagcgccgcccccagcatcacgctggtgtgaatatcgtggccgcaggcatgcattaccccttgattctgcgagcggtaaggcagaccggtcgcctcctcgatgggcaacgcgtcgatgtccgcccgcagggcaatcaccttgtcgccgctgccgacttcggcgaccagcccggttttcagatcgtagggcagcagggtcagcccgccgctctgcagccagtcgcggatccgcgcggtggtggccacctcctgcagggagagctccgggttctggtgcagctcgcgccgccagctaa

SEQ ID NO: 2585 - DNA, 429 bp, Klebsiella pneumoniae
ctgccgagcggcgcggccaccaccgtggcgacagacaccgcggaaaaaatgatcgccagcgcctttggcacatgggccgccggcaccagacgcatcgccgtggcggtggacatcgcccagaagccgccgatggcgatccccaacagcagacggcccagcaggagaaacgccagcgaatcggcaaaagcgaccatcaggctggagactatctgcagtacggaaaagaacatcagcacccagcggcgatcgatattgcgggtggcggtggcgatcagcaggccggtaactaacgccaccagcgccgtcgcggtgaccgcctgtccggccatcccttcactgacgccgaggctgctggccatcggcgttaacaggctggcgggcagaaactcggccacgatcaggccgaacaccccgagggccagggcatag

SEQ ID NO: 2586 - DNA, 1173 bp, Klebsiella pneumoniae
caggctggcgggcagaaactcggccacgatcaggccgaacaccccgagggccagggcatagacggcgcgccaggcaggtttggcgggagacaggctcgcgtcagcagctatgcaggaactcatatacaactctccaggtttattaacatcctggtcatcttagggacttactttcggacgatatatgatgcatactcttcagttattgattattcgtccggaattaccatgagccagcctgccatcgacctgaccagcgaactgttgcgcggtatgcgcctcttcggcgttaactaccggcgcatcgaaaccgcacgcccgttcggcgtcggctttagcgccgtggcgggtaaagcccagttccatttcatcagccgcgggccggtgctgctgcgcatggccagcggggaacagttcaccctcgagagcggcgatgcgctatttattcccaacggcgacgggcacgccctgctctcggatccgcaggccacggtggtcaatgtggcgcagctgcccagcgaaacggtgtgcagcacggtaagttgtatcaacgctggcgaccagcctgactgcccggagcgcgccgtcattttcagcggttgtatggactttgagctcggcggcatgcagccgctggtgaaggccatgcccgaggtgatgcgggtcagcagcctgctaaacacctggccggagatccagccgctgttggtagcgatggagcgggaatcgctcacccgccaggcgggctatgccgggatcctcgcccggctggcggacgtggtggccgcgctgattgtccgcggctgggtagcgtgcgggtgcggcaacgccaccggctgggtacaggtcctgcgcgatccccggctggcgaaagcgatctacgccatgcatcagcgcccgggggtcaactggaaagtggaagatctggcgcgggaggcgggtctttcacgctcgctgttcgcggaacgttttctcgccgccaccggcaccacccccgcccgctatctcaccgagctgcgtatgcggctggcggtgcagtacatcacccatgaaggccaggcgctggaaaaagtcgccttcagcctcgggtatcagtcgctggcggccttcagccgggctttcaaacgcatcaccggccagccgccgggggccctgcgcgccacggcacgctag

SEQ ID NO: 2587 - DNA, 372 bp, Klebsiella pneumoniae
gcggagggcggagtgcccgccgtgaccgggaaagtcgaaggcaaacgaatgaaaaaaattcttatcgcagttgtaccttttatgctggcgggctgtagctactacaaccagtttgtcgagcggatgcagacggacacgctggagtatcaatgcgaccagaaaccattgacggtccatcgcaataacgcacgccagcaggtcagttttatctatgataatcagcaactgaacctgtctgaggggctgtcggcttccggggcgcgctacaccgacggcgtctatgtgttctggtcaaaaggcgataccgccaccgtctataagcgcgaccgcatcgtccttgataactgtcagctgcagacggccaaacgttga

SEQ ID NO: 2588 - DNA, 936 bp, Klebsiella pneumoniae
aaaaacatttttacatccaagggcaaaatattttttatgctatcttacatgctatctcaatatgccaggctacctgtgcctgaagttactctacgttcatggttaaaacaatggttgtcagagcaggaatcgaggtgtacagacagaagtttctcggcgcgatttccctggagagaaactggattatgtcaggaatattttttacaacgaaaactcaaaattgatggaaagcaatttcttactggcccccgttatcagggcggaaatattaacaaaccttttattgatattgtaggtatggattctgacctaaatcatactgcattagaactcattagtaaggaatggtcacaactcagagctcagtatgtccgcattcttgtgccaggccagtccttcccgcagggtattcccgaccagtatatatatgccacgtctttttctgaaccccctgaattcaatgataaatctctttctttgcaagtggcgacatacgaagattttgactggtgttgtcaggccctgggtgatgcctataagcatacatggcagacagttcgcgaactgtctgcaagcaatttggtagcagttgatgaagaagagttgtgtgaccatatttctgagagagaagtatatattatctatgaaaacgatgttcgcgccgggttgctaatatgccagaaaggaaacctcgcttttctgagaggatatcgtattactgacaaagtaatacttcctgcttttcgtggtcgatcattgtcggcccgagcgcaacgcctgctgtaccgattattaactcattccgattcggaactatctatgtatatgggcacaattattccgcagaatatcccctcgatgaaaactgcagaaagagcgggacgaacttgcatcctaagttatcaatttctacccatctgcagaacccacgactaa

SEQ ID NO: 2589 - DNA, 282 bp, Klebsiella pneumoniae
ggcatattaggttttgacgttgatgtcgctgtgaaaatttttgcttttattctgctggctatcggcgctgtggcgctgagctatggtaatgccccggcgaaacgaatccaaagctgtgagaagatgggcgtagggcaggccgtctgcgccgccgccgaatgggatagtgaaaaagtcaatgtactgccgcgctataaccccagtcttaataaggtaatagctgccgcgcagttagcccccgccgcccgacagcaagaaaacaactctgttgttcgcgcgtaa

SEQ ID NO: 2590 - DNA, 303 bp, Klebsiella pneumoniae
gacgaatcaggctttattctgaatattcagcccgtttctgattttgttatacaggtatctctgaatcacgacgtcatggcagataatcatcccaccatggaacgcccctcagggaaggaaaaagtaagaatgacgttatatcaaaaaatgttggtgttttacgccattatgggcgtgatatgcgccgtgattagctggtttttaaccaaagagagccggatgatccgcctgctggcggccctgctgatcggcgccacctggccgttcagcttcccgatggcgctgctcgtctcgctgttttaa

SEQ ID NO: 2591 - DNA, 1302 bp, Klebsiella pneumoniae
actgggtcagggatacatcatcgactcgtttctggtggtggtgctgggcggcgtcggccagctggccggcagcgtggcggcggcctttgggctgggcattttcaacaaaattctcgaaccgcaaatgggcgcggtgctgggcaagatcctgatcctggtgatgattattctgtttattcagaaacgcccacagggtctgttcgcgctgaaagggagggttatcgactaatgagccaaccaatcaccttaacgctggcgcagcgcgcgccgcggcctctgcgctggctggggatcctgctggtgctggggctgctgagtatgccattcctggcgctgctgccggcctcccatccgctggcggtgccgagctggctgctgacgctgagcggcaaaatcctctgctacgccattgtggcggtggcgctggatctggtctggggctatgcgggcatgctgtcgctggggcacgggatcttctttgccctcggcgggtacgccatgggaatgtacctgatgcgccaggcggcgggcgacggtctgccggcgtttatgtcttttctctcctggagcgagctgccctggttctggtggggcacgcagcatttcgcctgggcgatggcgctggtggtgctggttcccggtctgctggccctggtgttcggctggtttgcctttcgctcgaagatcaaaggggtctatttctcgatcatgacccaggccctgacctatgccggtatgctgctgttctttcgcaacgagaccgggtttggcgggaataacggcttcaccggttttaccacgctgctgggttttccggtcaccgccaccggcacccgcgccaccctgtttatggccacggttttgctgctgttgctgaccctgtggctgggctcggcgctggcgcagagtaagtttggccggatcctcaccgcggtacgtgacgccgaaaaccggctgatgttctgcgggtacgacccgcgcggcttcaagctgctggtatggacgctgtcggcggtgctctgcggtctggcgggggcgttatatgtcccgcaggtggggatcatcaaccccagcgaaatgtcgccgaccaactccatcgaggccgccatctgggtagcgctcggcgggcgcggtaccctgattggcccggtgcttggcgccggattggtcaacggtgcgaaaagcattttcaccgtggcgatgccagagtactggcagctgtttctcggcctcatcttcatcattgtgaccctgtttttaccccgcggggtgatgggcctgctgcgtcgaggagaccgctaa

SEQ ID NO: 2592 - DNA, 480 bp, Klebsiella pneumoniae
cgccccccaggcaacgtacaaacagcatggccgatggccagcgctcggcgatggcgatggcgtcatgccctgcgccgctcggcagcgtcagggaacgcccctgcaccgccaccaccgcctcgctcagcaccgcctgcaggtgactgtcgcaggcggtggcggcgatgcgataatactcctcggcggcgaaactcagctggcggcgcccggcaatcgcctgcgcctgccccagcagttcctccagcagcgccgtcagcggcgcatcctgcgggccgcgaatatccagcgtcaactgcacctcgcccggtatcacgtttaccgcgcccggcgcacagcgcagggtgccgaccgtcgccaccaggttaccgccgcgctggcgggtcaggttttccacctgcaccatccattccgccgccgcggcgagggcgtccttgcgatgaagcatcggcaccgtgccggcatggccagcttcgccggtaa

SEQ ID NO: 2593 - DNA, 246 bp, Klebsiella pneumoniae
tttgtaacagggtcattttccatttaccaaccgatattgatcaaaccaaaggtgaaaattatggcagagcatagaggcggttcaggtaattttgcagaagatcgtgagaaagcatccgaagccgggcgtaaaggcggacagcacagcggcgggaactttaaaaatgatcctgaacgtgcatccgaagccggtaagaagggtggtaagaacagtcatggcggcggccgtaaatccggtgacagctag

SEQ ID NO: 2594 - DNA, 1338 bp, Klebsiella pneumoniae
cgaatgacaggggaaggggtagctatgtctgaaaatcgacaattgcgtctgggaaccatattgcatggcgcatcgggaaatatgtccgcctggcgtcatccggcggcccaggcggacgccagtattaattttgatttcgtcacccagacggcgctaaaagcagaagcggggaagctggattttatttttgtcgccgacggtttatatattaacgaaaaatcgattccccattttttaaatcgcttcgaacccttaacggtactttccgcgctggccgcgatcacccggcgactggggctggtggggaccttatcgacttcgtacagcgagccgtttaccaccgcccgccagttcgccagccttgaccatttaagccagggacgggcggggtggaacgtggtcacttccccgctggaggggtcggcgaaaaacttctcccgggcccaacatccggatcatgcgctgcgctatcgcattgccgatgaatacctgcaggtggtgaaaggcttatgggattcatgggaagaagatgcctttgtgcgcaataaggagactggtcagttctttgataaaaataaactgcatacgctcgaccaccacggcgatttctttaaagtcgccgggccgctgaatattgcccgcacgccgcagggccgaccgattattttccaggccggcgcgtcggatgacggcaaaaaattagccgcgcgccacgccgatgccatttttactcatcaggactcgctggccgaggcgcaggcattttatcgggatgtcaaaagccaactcgccgcatatcagcgcagtccggaccaactgcatatcttccagggcgtcagcgtcatcgtcggagatgacgccgaggacgcggagcggcagtaccagaccaccgcggcgttggtctccatcgaggatgccctgaattatctcgggcgctatttcgaacaccatgacttttcgcagtacccgcttgatgaaccgttcccggatattggcgacctgggacaaaacagcttccgcagtaccaccgatgagattaagcgtcacgcccgcgagcggggattaaccctgcgccaggtggctctggaggcagccagcccgcgtccgcgctttaccggcaccgccagcgatgtcgctgatggcctgcaactgtggttcgagcagcacgcggcggacggcttcattattcagggcggcacgccggaaaccttcccgcgctttgtggatgaggtggttccgctgttacaggcgcgcggactgttccgtcgcgactatccgggcaccaccctgcgggaaagtctgggtctggcgctacccgctaatcaattccaaaaataa

SEQ ID NO: 2595 - DNA, 885 bp, Klebsiella pneumoniae
cccgccgcaggaggatccgacggcgtttgtgcaggcggtggtggacgccgatcgtttgtaacccgcgccttgccggcggcgcgacgttgcgcttccggcaacacggcttatgcttgtgaagagtttattttgccccaggagcagcctttggagcgtattgaccacatcctggtcgtcgacgacgaccgcgacatccgggaactgattgtcgactatctggaaaaatcgggatatcgcgccagcggcgcggcgaacggcaaagccatgtggtcggtactcaaaaaccatcaaattgacctgattgtgctggatattatgatgccgggcgaggatggcttaacgctctgtcgccagctgcgcgctaacccgcagcaggatatcccggtgctgatgctcaccgcccgcaccgatgacagcgaccggatcctcggcctggaaatgggggctgacgattatctgattaagccctttgtggctcgcgaactgctggcgcgcatcaaagccattttacgccgcacccgggcgctgccgccgaacctgcagatcaccgaggcgggcaggctgatcgcctttggcgactggctgctcgacactgccgctcgccatttgctggacgacagcggcgccatcgtcgccctcagcggggcggagtatcggctgctgcgggtgtttctcgaccatccccagcgggtgctgaaccgcgatcagctgctcaatctgacccagggacgcgacgcggaactgtttgagcggtcaattgacctgctggtgagccgactgcgccagcggctacgggaggatgctcgcgagccggcctacattaaaacggtgcgcagcgaaggctatgtgctgtcggtaccggtctccattcgcgagagggcatga

SEQ ID NO: 2596 - DNA, 1326 bp, Klebsiella pneumoniae
gagaaggcaggttcgatgatggattaccagaccgcggtgcgcggtgcattttttgatatcgccggcgtggcagagaccccggatgaggtggccgcccaggcccgctatctcgatgatggtctgttgttcctgcaggaggggaaaattatcgccctgctgccatggcaggagggggaagcctttctgcatcccctgaagggctatgtcgatctgaggggtaagctgctgctgccgggttttgtcgatacccacattcactatccgcagaccgagatgatcggcgcctttggcgaacagctgctggagtggcttaccacctacaccttcccggtggagagccagtttgccgatgcggagtatgcccaggagatagcgcagttttttgtaaatcagctgataagccatggcaccaccaccgcgctggtgttttgtaccctgcatccggcatcggtggaggcgttattcagcgaagcgctgcgcctcaatatgcgcctgatcgccgggaaagtgatgatggatcgccatgtgcccgactacctgtgcgaaaccgccggggagagctacgagcagacccgggcgttgatccgccgctggcatcagcgcggcaggctgggctatgccatcaccccgcgctttgcccccacctcgaccccggggttgctggaggcggtgcagcgcctgcgggccgagtttcccgacacctggctgcagacgcatctcagtgaaaaccgggaggagatcgcctgggttaaacagctgtggcctgagcatgcgcgctatctggatgtctatcatcactatcagctcaccggcgaacgcagcgtcttcgctcacgggatccatctcgatgatgccgagtggcagtgcctgcatgacaccgggtccgccgtcgccttctgcccgacgtcgaatctgtttctcggcagcgggctgttccgcctgcccgcctgctggcagcaccaggtgcggatgggcatcggcagcgacgtcggagccgggaccaccttcagcatgctgcggacgctgggcgaggcctacaaggtaggacaactgcagagctatcgcctgcgcgccagcgaggccttctatcacgccacccttggcggggcgcgcgccctgcggctggaggagaaaattggcaatttccagccgggcaaagaggcggattttgtggtgattgacccggcggtcaccccgctgcagcgcctgcgcataggccgctgccatgacatttatgagcagctgttcgtgctgatgaccctgggtgatgaacgcaatatcagcgagacgtgggtgaacggcgagcgggtgtggtgtcaggattga

SEQ ID NO: 2597 - DNA, 954 bp, Klebsiella pneumoniae
cgtaataaaggaaaacagatgaaaaagtcgctattcgccggggcaaccttgaccgccctgttcagcggccacgcgctggccaatgaaccgctgacgctggtgctggactggtacattaatcccgaccatgcgccaattatggtggccgagcagatcggcgcctttaaggcccaggggctggacgtcaggattgtccccccttccgatcccgcgctgcctccgcgcatggtggccgcccgtcaagcggatctggccatcacctaccagccgcaggtgcacttctttgctgacgaagggttaccgctggtgcgtgtagggacactgattaattcgccgctgaatacggttatcgccctggataagcagatcaaaaccccggcagatctgcaaggcaagaaggtgggctactcggtcagcggcattgagcaggccaccctggcgaccatggcgcaacatgcagggatcgatccggccagcatcaaactggtgaacgtcaatttccagctgaccagcgccctgctggccggccaggtggacgcggttatcggcggctatcgtaatatagaagcgcaggagctgaagctgcagggcaaaacgccggtggtgatgaacgtcgaagattacggcgtgccggcctatgacgagctggtgattgtcgcccatcgcgacgcaattcatgaggcgaagatccgtaaattcctcaccgccctgcaggagggagtgggctatctgcgcgcccatccgcagaagagctgggaggcgttcgccgccgcccacccggagcttaggaccgaactcaaccaccaggcgtggttgcaaaccgtgcccctgttcgccaccgatccggcagcgctggataaaccgcgctacgagacttacgaacagtttttatataacaataagttggtgaaaaaagttacacctttaacaaattatgcggtgcaactgcattga

SEQ ID NO: 2598 - DNA, 342 bp, Klebsiella pneumoniae
cccggacgaggcctacgcgccaaatccgggtatttatcgtacctgactccaggctttatgccggatggcggctacgccttatccggcctacagggtcctctcacaggctcataccccgtaggcccgcgcaagcgcagcgccgccgggcaagatatcaggcacggttcctgtaatttcgccgggtggcggctgtcaccttgcccggcctacagggtcctctcacaggctcatacctcgcaggcccgcgcaagcgcagcgccgccgggcatgaggagatttacttcccggcttccggatgggtatcgaacgccgccatcaccgccgccagcgccgcttcgctga

SEQ ID NO: 2599 - DNA, 501 bp, Klebsiella pneumoniae
tatgaaagaggagggggaatgtcaaatccagcatatttatggttaactgatgagaatgattcgcctattataggttcttgcctgatgcccacacgcacgggttccatcgaattgcgcgcagtgaatcatcatgtttggttacctaccgataataatacaggaaagctgacgggaacccgtcttcatacaccggttaaaattcaaaaagagtttgacagaacaacacctttgctatttagggctctttgtgaaggtcgaacattaagatcggcaacgctaaaaatgtacagaataaatgaggcgggactggaagttgaatattttaacatagcgatggcgaatattaagattacggcaatcacaccaaatttacatccggccggaatgacaagtactcaccttgaagacattgatttccgttatgagacgatcacctggatatacacagaagggaacatcatgtatcgtgattcatggaacgatcgctgttgtgcatggtag

SEQ ID NO: 2600 - DNA, 711 bp, Klebsiella pneumoniae
ataaatggaggtcctgtgatcgttcccgcttttagccaaggtctttacggccgtttacgccagctggccgccgctgactggcagcgctatgtggcgcatcctttcgtccagcaacttgcctctgggacgctggcggaaaacgcctttcgtcgctatctgacccaggattatctgtttctgattcactttgcccgcagctacgcgctgctggtgagtaaactgcgcacgctgccggagatgcgggccgcgaccgcctcgatgaatgccatcctcaacgaactgccgctgcacgtcggctactgtgcccagtgggggattagcgaaccggagatggccgcccaacctgaagcccccgaaaccctcaactatacccgctatgtgctggatattggccactcgggtgacgcgctggatctgctggtcgccctgatgccctgcgtcgcgggctacgccgaaatcggtctcggcctgctgcagcatcccgccacccgactggacgataacccctacgcctcatggatccgcaactatggcgatgaaggctatctgcagggcgtcagcgccgcgctggcgctgttggaaacggtgtggcagcagcgcgggagcgaggcgcgaatcactgagctgagcgagattttcaccaccgccacccgccttgaggcgcagttctggcagatgggcctcaacgccgcggcggagacccgggcgtga

SEQ ID NO: 2601 - DNA, 714 bp, Klebsiella pneumoniae
gcatggggagggcgagtgatgcggatcctgaaagtgatcggtctgctgctggagtaccccgacgagttactgtgggagaaccgcgacgacgccctggcgctggtcagggccgatgtcccttccctgacgccgtttgtcggtgagctgctgacggctccgctgttggatcgccaggccgaatggtgcgaggtgttcgagcgcgggcgcgccacctcgctgctgctgtttgaacatgtgcatgccgaatcccgcgaccgcggccaggcgatggtcgacctgatgaatcagtatcagcaggcgggtctgcagatcgattgtcgcgagctgcccgaccatctgccgctgtatctggagtatctcagtattctacctcccgcggaggctcgggaggggctgcagaatatcgcgccgattctggcgctgatcggcggccgtcttaagcagcgagcctgcccgtactaccagctgtttgacgccctgctggcgctggctaaaagcccgctcaccagtgacagtgtcacaaaacaggtggcgggagaaaagcgcgacgatacccgtcaggcgctggacgccgtgtgggaagaagagcaggtgaagtttatcgaagataatgcgaccgcttgcgatagctcgtcgatgcaagcttatcaacgacgctttagtcaggatgtggcgccgcagtacgttgacatccgcgccggaggcccgaaatga

SEQ ID NO: 2602 - DNA, 456 bp, Klebsiella pneumoniae
accccctcgggagagattatgatcagagactggttaaccccggataaaattaaagtcattaactcaatagatagctgggaaaatgccgttcgacttgcagcagaacccttgctgatgcaagggtatatagccgggtcgtatattgaggcgattttgcaaagccataaagagcttgggccctattacgtattagctcccggcttggcgatgcctcatgcccgtcctgaacagggggtattaagaaatggattatcgcttcttcatattaaagaaggggtgtcgttcggctcggaagagaacgatccggtatacgtggtaatcatgctatgcgctcgttccgggaatgaacatatcacgatgatcggtgaactggctgaaatctttagcgatcagcaaaagttacaccgattgttaaatgccgatgatagcaaggcgattcaggccgttattgactga

SEQ ID NO: 2603 - DNA, 483 bp, Klebsiella pneumoniae
cacacgccgggccgatttaccggtacagtatcaactcaacttatgctcacgggagtcattatgtcgttctgtcatatgcgcattgccaggccggtcagcgaactggacaccaccgccagcatgtattgcgccgggctgggactcgagcagctcggcagctttaccgatcatgaaggatttagcgggataatgctcggcgcgcccgaagcgggctggcatctggaattcacccactgccgccaccatcccgtcaccccctcgccaggcgatgaagatctgctggtgctgtactatccgcagcaggcggcatgggaggcacagtgcgcagccatggacgccgccggatttctgcgcgttacggcgtttaacccttactgggaggtcaatggcgtcactttcgtcgaccgggacggctaccgcacggtattgcaaaaccgcgcctggggcatggtgtgtgattcgtcgggtatagcggcgagctga

SEQ ID NO: 2604 - DNA, 1554 bp, Klebsiella pneumoniae
gagaccgcgggcctggtggcccgccttaagacgtcaccggagttagtgatgaaagataaaatactcacgattgatgttggcactggcagtacccgcgccgctattgtgcgcattgacggcgcgatgatcggctttgcgcaaagagagtatgagcaaaccacgccgcgtgcaggttggtcagaacaggccccgtctttatggtggcaggccgcctgcgactgtatacgcgaggtgctttaccgctatcctgaaacggcagcgcaaattgcggttattggtgcttgcggacagatgcatggcaccgtccttctggacgaccgtggcgagctggtggaggatagggcgttgctgtggaatgataagcgcagccagccgcaagttgacgcctttaacgcgcgcgaaggttgggaaaagtggctggcgcatttgaataatccgcctgcggcagcatggcccgctttcaagttagcctggtggcgcgaaaatcatccggatcgctggtcgcagctcgccaaagtattaatgccgaaggactatattaatttcatgctgaccggtgccatggcgaccgattatagcgaagcgtcgtgctatttcctgatggacagcgaaacccgtagctggtcttcgcaagcctgcgaaacgtttggtctgcgggtcgatcagcttccggatcttaaactttccagcgacataatcggccaggtgacgcagcgcgcagccgacctgacgggcctgccggcgggtatcccggtggttgccgggacgtcggatatggcggcctctctgctgggctcgggtgtgtatgaaccggggatggcgtctgattcaaccggcacgtcgacgctgatgacggtggtgtcgccgcggccgttacaccatccgctggttaataatcttcatcttgccaacgcggcctggggcggatttacgatcctcgacgccggcggcgatgccgttcgctgggcgcggctggcacttgccgataaccagattacgcatccacagcttttacaggaagcggcggcggtgccggtgggggcagaagggctgctgtttcttccctatctgacgggagaacgtctggccgaacacacgaactcgcgggcacagttttttggcctgcagcgcaagcatcgccgcggtcatttattccgcgcagttctggaaggggtggcctttgcatcctggcgcaatcttcggcagctgcagaagtgcgggcagtatccgcaacaaatgatcgcttccggcggcggcgcgcgcagctcgctgtggcttgaaatcaaagccgcggcgtacaatctgccgatattatctacgcgtaatcaggagaatggcgtcaccggatgcggtattatcgccggggttggcgtagggttgtacgccgattttgccagcggcgtgcggcaaacggtgcagttcgacaaactgatctcaccggatccccgtctgcgggattattaccacgcctgctgcgagctttttgatacgctgtaccggcaatccgctgccttatacgacaggctggatgcgctcagcgtaggacccgactga

SEQ ID NO: 2605 - DNA, 585 bp, Klebsiella pneumoniae
aaatttaagggaacgccgctatgttggcagcatcatactttccataaaggatatgccatgcgcgataaatattccggcctgcagattgggattcactggctggtttttttgctggtagtagtagcctatgcggcgatggagctgcgcgggtttttcccccgcagtgaacggccattgattaatatggtgcatgtttcctgcgggatcaccattttcgtgctgatggtggcgcgtctgctggtgcggctgaaatcgccggcgccgccgatcgtacctaaaccatcgccgatgatgaccggtttcgcccatcttggtcacctggcgatctatttgctgttcattgccttgccgttgatcggcatggtgatgatgtactggcgcggtaacccctggtatgcctttggtctgaccatgccgtatgccccgcagagcgattttgagcgggtggataccctgaaggcgatccatgaatggttggccaatgccgggtactttgtgattggcctgcatgctctcgccgcgctgctccatcattactggtggaaggataatactctgctgcgaatgatgcctcgtaagcgctaa

SEQ ID NO: 2606 - DNA, 1167 bp, Klebsiella pneumoniae
tggagtgagggcatacaagggtcatggaatgaaggaaaacgtatgagatcgggtcgctttattggcgttatgtctggtaccagcctggatggtatcgatgtcgttttggccaccattactgaaaacatggtggcgcagcaggctagtctcacctggcccattccacacgcgataaaagaagagattctggcgatttgccaggggcagtcgctgaccctttcgcagctaggccgtctggacacccgtctgggacggctgtttgccgatgccgtactggcgctgatgcgccaggaaagtctcaaacccaccgacgtcatcgccatcggctgccatggacaaaccgtatggcatgaaccgcagggagaggctccgcataccctgcaaattggtgataacaaccagatcgccgcccacaccgggataaccgtagtgggggattttcgtcgccgggatatggcgctaggcgggcagggggcgccgctggtgccggcttttcatcatgcgctgctggcccaccccgttgagcgacgtatggtgctcaatatcggcgggatcgctaatgtgtcgctgctggtgccaggtcagccggtgcgcggctatgataccgggccgggaaatatgttgctggacgcctggatctggcgccagaagggcaaaccgtacgacaaggacgcccaatgggctagcgaaggtaaagtgctgctgccgctgctgcaggacatgctgagcgatccgtggtttgccttgccggcgccgaaaagcaccggtcgggaatatttcaattacggctggctggagcagcatatggcccgctatccggggctacgcggggaggatgttcaggctacgcttgcggaattgaccgccgtcaccatcagtgagcaggtattgttaagcggcggctgcgagcgtttgttagtgtgcgacggcggcgcgcgtaaccccttgttaatggcgcgcctggcggcgctgctgccgggaaccgaggtctccaccaccgatgaggcggggatcagcggcgatgatatggaagcgctggcctttgcctggctggcctggcgaacgctggctggtctgccgggcaatctgccctccgtgactggcgccagcgaagcctcggtgctgggcgccatttttccggctaacccgccgcagaatcggagttaa

SEQ ID NO: 2607 - DNA, 831 bp, Klebsiella pneumoniae
cgccagcggggccgccggatcgctggcgaccctcgaggcctacgccggacagcagcatattccccaccggggatcgcaggccgcgctgaccgtcgccggcaccgtcagcggctgggacgaggcgctgcgtatttcacgggacttaaccggccgcgcgctgccggtggcccgcctgttggccgatgcgatcggctatgccgaagacggcattccggtcactgcctcgcaggcccacgccaccgccagcaaactggaagagctgcgccatcagccgggcttcagcgaaacctggctggtcgcgggcgaggccccgcggcccggcagccgcttccgccagcccgccctcgccggtaccctgcgcatgctggccagcgacggtctcgacagcttttatcgcgggccgctggccgagcgtctggcgcagggtatggccacgctggggatgcctgtcaccctcggcgacctgcaggcccaccgcgccaggcgtccggggccgctgacgctccagcaccagcagggaacgctgtggaatcttgcccctcccacgcagggactggtgtcgctggcgatccttggcatcaccgaccgcctgaagatggccgatgccgacgacgcgcaaacggtgcaccgtatcgtcgaagccaccaagcgggcgtttgccctgcgcgatgcgcatatcaccgatccgcgccatctggatgtggatgtacagcagttgctcaccccggaagccctgcagccgctggccgacagcatcgacgacgccagcgcttccccctggggcggcggcaaaggcccgggcgataccgtctggatgggcgtcgtggataa

SEQ ID NO: 2608 - DNA, 1878 bp, Klebsiella pneumoniae
atagtcaggggtaaaaagcggcaggcagcgtgtatgcccaggctacacgtcagaggaaatgaaaaaaacaggctgttcctctggacagggcttttttaccttttttctgctggcaacaattggattattaatcgtttttgtctagagtgggcggaaattatcacgcagcgtgatgacgcgttgcgaatcaattcacccgtgcagaaggacgctttctcaggcatgaaccgcagacgttttcttaaatcttccatggctgttgccgccgtatgcggaacgtcaggagtcgcttccttattcagtcaggccgcttttgccgaagacgcgggcattgccgacgggcaaacgcgtcgttttgattatgctgttctgcaggcgatggctcacgatctggcgcgccagccgtggggcggcgccccgcgcgatctgccgccgacgctcgccaatctcaccccgcaggcctataacagcatccagtacgatgccaaccactcgctgtggaacaatattgaagagcgtaagctggacatccagtttttccacgtcgggatggggttccgtcgccgcgtgcggatgttctctttagacgccagcacccagcaggcgcgcgagatccacttccgtccggagctgtttaagtacaatgacgccggtgtggatacccgtcagctggaaggacagtctgacctcggcttcgccgggttccgggtgtttaaagcgccggagctggcgcgccgcgatatcgtggcgttcctcggcgccagctacttccgcgcggtagacagcacctatcagtatggcctgtcggcccgcggtctggcggtggatacctttaccgataccccggaagagtttcccgactttacgtcgttctggttcgaaacggtcaaaggggacgccacggtgtttaccgtttacgcgctgctggacagcccgagcatcactggcgcctacaagttcaccatccactgccaggatacccaggttatcatggacgtggaaaaccacctgtacgcccgcaaggatatcaaacagctgggtatcgcgccgatgaccagtatgttcagctgcggcaataatgagcggcggatgtgcgacaccatccatccgcaaatccacgactccgatcggctgtcaatgtggttgggcaacggggaatgggtctgccggccgctgaataacccgcagaagctgcagttcaatgctttccaggacaagaacccgcgcggctttggtctgttgcagctggaccgtgatttctcccactaccaggatgtgatgggctggtataacaagcgtcccagcctgtgggttgagccgcgtaaccagtggggcaaaggggcggtcagcctgatggagatcccaactaccggcgaaacgctggataatatcgtctgcttctggcagccggaaaaggcggtgaaggcgggcgacgaactggacttccgctaccgtctttactggagcgcgcagccgccggtgagcactccgctggcgcgcgttctggccacccgcaccgggatggggggcttccccgaaggatgggcgccgggtgaacactacccggataagtgggcgcgtcgttttgccatcgactttgtcggcggcgatttgaaggcggccgcgccgcgcggtattgaaccggtgatcaccctctccagcggggaagcgaagcagattgagatcctctacgtcgagccgttcgatggctaccggatccttttcgactggtatccgaccaccgactcaaccgacccggtggagatgcgtctgttcctgcgctgtcagggagaagccatcagcgaaacctggctctatcagtatttcccgccggcagcagataaacgcaactacgttgacgaccggatcatgaaataa

SEQ ID NO: 2609 - DNA, 678 bp, Klebsiella pneumoniae
atggctgggggtacaggcctgatgaccacttttactgactgggacattatccgcaacctgctgctggccggtcgctggacggtgctgctgtcgctggtcgcgttcaccggcggggcgctggtgaccttaccgttactgctgctgcgcctcaccggcggacgccaggtgaaacggctgatccgcgggtatattgagctgttccagggcacgccgctgctgatgcagctgtttctggcattctttggcgtggcgctgttcggcgtcgacgtctcggcgtggaccgccgcctcggtcgccctgacgctctacaccagcgcctttctgctggatatctggttcggcagcattcgcgcgctgccgaaaggccagtgggaagcctcgcgctgtctcgggctgagcttcggccagaccctgtaccgggtggtggcgccgcaagcgctgcgcattgccatcgcgccgaccgtcgggttcgccgtacaggtgatcaaaggcacggcgctggcatcgattatcggctttgtggagctgaccaaggcagggacgatgctgaccaacgtcacttatcagccgtttaaagtgtttgcccttgtggcgctgggctatttcattctgtgctatccgctgtcccgctacagccgctttctggagaacaaattcaatgcctctcatcaccattaa

SEQ ID NO: 2610 - DNA, 1596 bp, Klebsiella pneumoniae
aatttaatttttgtatacaagattcatcattctggcctggatcctgcaatagcctcagcaatccatatcaaagggttttcattcagaggagcaggtttcatgccacattcatcccacacgcagcagacgaagactcacaaggcggccgccggctacagtccgcggctatgtaatgacgatctggcgccgacccgcgaccagaactggagctggtacaatatcttttcattctggatgtcggacgtgcacagcatgggcggctacgtagtggcggcgagcttctttacgcttgggctggccagctggcaggttctgctctgcctgctggtgggcatctgtattgtccagctgtgcgccaacctggtggcgaagccgagccagatggccggggtgccttacgcggtgatttgtcgtcaggcgtttggcgttttcggcgccaatatcccggcggtgatccgcgggctgatcgcctttgcctggtacggcattcagacctatctggcggcgaatgccctgatgctggtcctgctcaagttctggccctcccttgcctcgctgaccagcagcagctttctcgggctgtcgcccctcggctggctgtgcttcgccactatgtggctgctgcaggcgacggtgttctggcatggcatgaacgccatcaaacgctttatcgatatcgccggtccggcggtttatgtggtgatgctggcgctggccggctggattgtatacaagactggtctggatgggatctcctttaccctcgccagcaaatccctgagcgccggcgagcagacctggcagatgatcaccgccacggcgctggtggtctcctacttctccgggccgctgcttaacttcggtgacttttcccgctacggcaaaagcatgggcgagatccgccgcggtaaccgctggggtctgccgtttaacttcctgctgttctcggtggtgaccgtggtgattgtctccggcacccagtcgctgttcggcaaaatgatcactgacccgatcgaaaccgtcagccgcgtgggtaacgatctggcggtggccatcggcctgctgaccatgatcaccgccaccatcggcattaatatcgtggctaacttcgtctcgccggccttcgatttttccaactgcgccccgcagaaaatcagcttccgtaccggcgggatgattgccgcggtgggctcgatacttctgacgccgtggaatctgtttaactcgccggagttgatccactataccctcgacgtactgggcgcctttattggcccgctgtttggcatcctgatcgccgacttctacctgatcaaacgcggccgggtgtcagtggacgatctgtttgacgatacgccgcagggtaaatactggtaccgcaacggctttaacccgaaagcgattgccgccctgctgccgtcggtgggcctggggctgattatcagctttattccggccctgcatgaagtggcgaacttcagctggtttatcggcgtctgcctcggcgccaccacctaccgctggctggctcgcgacgagcgcgaagtgcaggcgaaagctgccttccgctccggcgcggtggcgcaaaaagagtaa

SEQ ID NO: 2611 - DNA, 186 bp, Klebsiella pneumoniae
ccctggtttattgcccaggtttcatatgcgcccggggcttcaaaactttcatgtacgataaagtgtacacgcatgaggttaagctcctgtaatatctttgatgatcagaatgataagtcacgcacccattgcctaaggctctactccgggtggttccagtttcgatatgataatggcaggggctaa

SEQ ID NO: 2612 - DNA, 219 bp, Klebsiella pneumoniae
aattaccttatgacagaccttacggtgatttacggcaccgggtggattccggacgctgtgagcccctcattgctacgaagcctgattctgctgtacctcacgccatatgatagcctgcgcaacaatcacatcctgcccattaatgcgtccaggggagtactcccgggccctggacatcccctgtgtgccaaaagcggaagtaggctgaagataaattag

SEQ ID NO: 2613 - DNA, 687 bp, Klebsiella pneumoniae
cgccaccttatgactacatcctcaatggccatgtctgataacgacgaactccagcaaattgcgcatttgcgccgtgaatacacccgtggcggtttgcgtcgccacgatcttcctgctgaacccctgccgctgtttgaacgctggctgcgtcaggcctgcgatgcgaaacttgccgacccaacggctatggtggttgccaccgtcgatgagcgcggccagccctaccagcgcattgtgctgctgaagcactacgacgaaaaagggttggtgttttataccaaccttggcagccgcaaagcgcatcaaattgaaaacaacccgcaggtcagcctgcttttcccgtggcatatgctggagcgccaggtgatggtaatcggcaaagcggagcgtctgtcgacgctggaagtggtcaaatatttccacagccgtccgcgcgacagccagattggcgcctgggtctcgaagcagtcgagccggatctcagcccgcggcatcctcgaaagcaaattccttgagctgaagcagaagttccagcagggtgaagtgccgttgccgagcttctggggcggattccgcgtcagcattgagcagatggagttctggcaggggggagaacaccgtctgcacgatcgctttttataccagcgcgatagcggcgcctggaaaatagaccgtctggcgccgtaa

SEQ ID NO: 2614 - DNA, 1614 bp, Klebsiella pneumoniae
tcaggacttataaccatgtctacagggaaaaccacgctggcgctgctgctgagcgcactgctgccggccggcgccgcctgggccgcaggcaatgacactctggtctactgctcagaagcctctccggagtccttcaatccgcagatcgccagctccggtccgtcgttcgtcgccagctcgcaggtactgtataaccgtctggtgagctttgacccggtgaaaaatacgccgatcccgtcgctggccaccgagtggcacgtctctgaggatggcaaaacctggacctttactctgcgtcagggggtgaagttcaacagcaacaaattcttcaaaccgacccgcgattttaacgccgacgacgttctgttctccgtgctgcgccagatggatcctcagcatccttatcacaaggtgtcgcaggggaactatgaatacttccacgacgtgggcctcgataagctgattaaatcggtgaaaaaggtggatgattaccatgtccagttcgagctcaacgagccgaacgcggcgtttcttgccgactggggcatggacttcgcctctattctgtcggcagagtatggtgaggcgatgctgaagaaaggaacgccggaaaacgttgataactggcctgtcggtaccgggccgtatgcgctgcagcagtataaagtggattcgcaaatccgctatattgccaatccccactattgggaaggcgaggtaccgaccaagcacctgatcttctccattacgccgaacgtcgagactcgtctggcgaaactgcagaccaacgagtgccagattattcccgcgccgtcgccggtacagttcccggtgattaagggcaataaagatctggcgctgcatgcggttgaggcgctgaacgtcggctatctggcgtttaacaccgagaaaaaaccgtttgataatgtgctggtgcgccaggcgttaaactacgctaccgacaagcaggcgatcgtcaaggcggtattcctcgattccggcagcgtggcgaaatcaccgatcccgtcgacgatgctcgggtataagaaagatctcccggactatgactacgatccgcagaaagccaaagcgctgctcaagcaggcgggtctggagcaaggcgcggaagtgaccctgtggtcaatgccggtccagcgcccctacaacccaaactcaaaacgcattgccgaaatgatccaaaacgactgggcgaaagtgggggtgaaagccaaaattgtcagctatgaatggggcgaataccttgccggtatgcgtaaaggggagcacgacagcgccctgtatggctggatgtcggacaacggcgatccggacaactttgctggcacattgctcagctgtgataatatccagactggctccaacgccgcccgctggtgtgataaatcctatgacgcgctggtgaagaaagcgctgttggtgagcgatccgcaggcgcgggccaaactctacgaacaggcgcaggagattttttatcagcaggcgccatggatcaccctggcgaccgggaaaaccttctatgcgacgcgcagcaacgtcagcggctacaccgtcagcatgatggggagcgatttttccaaagcgaagctgaattaa

SEQ ID NO: 2615 - DNA, 936 bp, Klebsiella pneumoniae
ggaggcattatgcattcatctgaaacgatcaaagtggtgccggcgcgctatccgctgcgggtggtcggggctctggtcgccctgctggtgctggcggtggtgatccagtcggtggcctttaacccgcgctgggagtggggcgtcttcgcccgctggttcttcgacccggtgatcctcgaggggctgggtcaaaccctgctcctgaccctgctcggcacggtgctaagcgtgatcttcggcggcctgctggcgctggcccgtttgtcctcatcgtggctgctcagcagtctcgcctggggctatatctggctgtttcgctcgctgccgctgattgtggtgctgatcattctctataacttttcctatctctacgacaccctgtcgctggggatcccgtttaccggcgtgacctgggccagctatcagaccattaacgtgctggggcaattctccacagcggtggtgggcctgaccctggtgcagagcgcctataccgcggagattattcgcggcggctttctcggcgtcgaccacgggcagtatgaagccgccgccgcgctggggctacccgcctggcggcgcacgcggcgcattattctgccgcaggcgctgcgcaccatcctgccatccggcttcaacgagatcatcagtctggccaagggaacggcgatggtgtacgtcctggcgatgccggaactgttctacaccatccagatgatctacaaccgtacccaggaggtgatcccgctgttgatggtcggcgccgcctggtatctggcgatcaccagcgtcctctccgccattcaatatctggtggaacggggcctggcgcgcagcgagcgccgctcggcggtaaacagcgcccgcagcagccgtctgaatcaacccgcacgtcaagcgcagccgcaggaggccgttcatgcccagctctcataa

SEQ ID NO: 2616 - DNA, 705 bp, Klebsiella pneumoniae
gcgagaattatgagtttaaagccgcgtagaatcgttttaattcctgggtttatgctgaatgaaatgctttggcatgaatttgaaacatatctcccgtcaaactgtattgttcatcatgcagctgtaactgaaggacgaaccattcatgatgtagtgcagcatttgattactcttctgcctgagaagttttctttgataggtttttcgatgggaggatatattgcccgacaactggcagcagaattccctgaacgtgtagagtccttagtgcttattgccagttccttacgggaagatacgccgttagaagctgaagcaaagcggaaaagcgtgcagtcattgtcccccacaacctttaaggggctgagcagacatgctattgcccggtcactccaccctctaaacacatcaaatcaggatatgatttcagctatccagaaaatgggatgctctctgggatttgaagccttcatcacgcattcatccttatccaggcaaggtataccttctgcaacgatacgttgtccaacgctggttatcgccagtgaagatgatgccatccgttcgatgaaggaggcagaagaattggtcgaagccataccttatgcgtcgttaagaatcattctggattgcggccatatgattccgctcgaacagcccagggagttggcaagaattattgttgaatggatccctgctacgtaa

SEQ ID NO: 2617 - DNA, 591 bp, Klebsiella pneumoniae
tgttacgttatgaatactatagaagacaacctcaatcagcgcatcagcgcgcgcatccgcatcgagcgcgagtcccgcggctggtcgctgaacgaccttgccgaacgggccggcgcctcgcgggcgatgatccataaaatcgagcgcggcgaaagcagcccgaccgcctcgatgctgggccgtctttccggcgccttcggcatcagtatgtcgaccctgatcgcccgcgcggaaatgcaggagggcaagctgctgcgctttgccagccagccggtatggcgcgacccgcaaagccactatctccgccgccacgtttcgccgcgcagcgatttgccgatcgatctggtgcagattgagctgccgcccggtagcgatgtgccgatgcccgccgcgtcctatgcgcttgcccgccagctaatctggctgcaacagggcgagctggtgtttgtcgaaggcaatacccgccatgagatgcaggcgggggattgtctggagcttggcccgcccaacgattgtcgctttattaatgaatccgcagagacctgcgtctatctggtggttcgccttaatcaatcgccatccggctcttaa

SEQ ID NO: 2618 - DNA, 912 bp, Klebsiella pneumoniae
aagacggttattaatgtgatcgtggtggtaaaaccggcacaattcagcgcgccccattttgcgcaaggtatagtgatctgccgtgagctttacgctgcaacggagaaggatgcgatgagcgacaatatccccaatacgctgagcgccaggcaggccgagcacgaccctaactttatgctgtctctggcccgcgggctggaggtccttaacgccttcaccccccagcgccagcggctgaccatttcccagctcagccagaaaacgcaaatctcgcgcgcggcggtacgccgctgtttgtataccctcgccgcgctgggcatggtgcacagtccggatggccgtagctatgaactgctccctcgggtgctggccgtcggccacgcctatctggcaggcacgccgctggccaaggtggcgcagacggcgctggataatcttggcaaagcgctcggcgaatcctgttcggcggccacgctcgacggggataacgtgctctatattgcccgcgcggcggtcaataatttactgagcatcgatctggggcgcggcagtcgcctgccggcgtgggccacgtcgatggggcgggtgttgctgagcgcgctgccggaggaacagctggaagtgacgttgtcacgagttacgcttattcgctacactccgcataccctgtgcgatttgtccggtttacgtgcagagatcgcccgggtgcgcatgcagggctatgccctcgccgaccggcagatcgaggtaggcttgtgctcgctggcggtacccgtgctgtcgcgtcacggtcaggtggtggccgccctgaatgtcggggtacctgccgcgacggtcagcgccgcggcgttaaaagagaaggctctcgccccgctacggcgcgcggcgatggatctttcgctgcagctatag

SEQ ID NO: 2619 - DNA, 243 bp, Klebsiella pneumoniae
tgtcgttctattggaatcaccgctctccccttaccattttttcacaccaggcgtcaccacccaggctacggccctggcgacaccctctgttgttatcgcgctttgccgctgtttttaggctattttagggcaagaatcgccgttgtgcagcctctttccgcctgtgaattttttatattcatgtgggttattcgtgataactctcacataaattcacatgataacgctttattctatcattaa

SEQ ID NO: 2620 - DNA, 1176 bp, Klebsiella pneumoniae
gaatcatctatgcgctcgtttagtcttccgcttcccactctgttcgctggcttcgtcgccgtgttggtggggtacgccagctccgccgccatcatctggcaggccgccgccgcggccggcgctacccccgggcagatcgccggctggatgacggctcttggcctcgccatgggcatcagtactctcgcgctgagcgcctggcggaaagttcctgtgctcaccgcctggtcaacgccgggcgctgcgctgttagttagcggcctgcagggggtgaccctcaccgaggccgtggggatctttattttcgccaacgcgctgatcgttatctgcggcgccaccggcctgtttgcccggctgatgcagatcattccccattcgctggccgccgcgatgctggctgggatcctgctacggtttggtttgcaggccttcgccggcttacaggatcatctgccgctgtgcggcgggatgctcgccgcctggcttctgtgtaaagcgctgtggccccgcttcgccgtggtggccgcgctggtgattggagcgctgattgcggcggcgtccggggatgtggctagcgccgccgtgccgctggcatttgtgacgccggaatggatcgccccgcagtttactccggcgcttttgctcagcgtcggtctgcctttcttcctcgtcaccatggcctcgcagaacgctccggggttcgccaccctgcaggcatcaggctataccgtaccggtctccgcactgatcgtcgtttgcggggggttggcactactgctggcgccgtttggggtttattccatctgcatcgcggcgatcaccgccgccatatgccagagcccggaggcgcacccggatccgaaccagcgctggctggcggccatagccgcgggcggtttttatctgctggccggtctgttcggcgggtcaatcaccgccctgatgtcggccctgccgccggcgtggatccagatgctggcgggtctggcgctgctcggcaccatcggcgggagtctgtttcaggcggtgcatcaggccagtgagcgcgatgcggcagtgctaaccttcctggtcaccgccagcggggtgacgctggcgggaattggctccgccttctggggcgtggtgctcggcggggtgagttacggcgtgctatccgcgctgcgccgcccgtag

SEQ ID NO: 2621 - DNA, 183 bp, Klebsiella pneumoniae
cgtaacactatagtgtgcgcccccctattacacaaccatccaccgagacgcgttattcccgggttagccgttaaaattatgctgaaaacggatgacagcgtggcgttcattattgtaataatattgtactactatagtgtacgaaaaattgaggtttgctatgtccattcgccctgccattaa

SEQ ID NO: 2622 - DNA, 645 bp, Klebsiella pneumoniae
ccttgtctctttcggagacaggaaatgctcgtcactgattcacttcttgcttacaccctcgctgctacactgcttaccctgacgccaggtcttgatactgctcttattctccgcacggcgactgctgaagggggacgcaaagccttgcatgccgcgttaggcatcgatctcgggtgctttatctggggcgcgctggtggcctttggtttaggtgcgctactggcggtttctgagttggcttataccttattgaaatggtgcggagcaggatacctttgctggctgggcatccagttgctcctgcgaccacgccagcaatttaacacccacccggccgaatcagattccacgagtaactggttcctgcgtgggatgctggggaatgtgcttaaccccaaaatgggcgtcttctacgtttcgtttttacctcagtttatccccgccgggcattcacccgtgagctggacttttctcctggtcgctatccatgtattgattggtacgctgtggtcgttaacgctgattaccgccactcgctatgccgcaggcatcctgaaaaaaccagccgtagtgaaatggatggatcggacgaccggctgcctgtttctgttattcgctgcgaagctggcaatgagccgccggtaa

SEQ ID NO: 2623 - DNA, 954 bp, Klebsiella pneumoniae
gatctgaatatgcacaccaaagcccgtaaagtgatgattattggcgccggcaatgtcggcgcgtcggcggcctacgccctgctcaaccagagcatttgcgaggagctgatcctcgtcgaccttaaccaacagcgcgctgaggcccacgctcaggacctgagcgacgccgcggcctacctgccggggatgatgaccatctccacccgcgaggccagcgactgcgccgatgtcgatatcgcggtgatcaccgtctccggcggcgcgctgcgccccggccagagccggctggatgaactgacctccaccgcgaagattgtgaagagcattgtgccgacgatgatggccaacggatttaacggcatgtttctggtggccaccaacccctgcgacatcatcacctggcaggtatggcagctttccggcttgccgcgcagccaggtgctgggcaccggcgtctggctggataccacccgcctgcgtcgcctgctggcgcaggaactggagattggcgcccagagcatcgacgcctttatcctcggcgagcatggcgatacccagtttccggtgtggtcgcactcgtcggtatatggcacgccaatcgccgacctctaccagcagcgcaccggcctgccgctcgatcgcgaggcgatggctgacaaagtgcgcaagctgggatttgagatctacgcgggtaaaggctgcaccgaatatggcgtggcagggaccatcgccgagatatgccgcaatatcttcaccggcagccaccgcgcgctggcggtctcctgcatacttgacggcgagtacggggtcagcggcgcggcggctggggtgccggcggtgctggcccagggtggcgtgaagcagatcattgaactgcagctggccggcgaagagcaggcgaagttcagccagtcgatcgcggtgatcaaggccaatatcgcccgtctgccctga

SEQ ID NO: 2624 - DNA, 927 bp, Klebsiella pneumoniae
aaagatgatatatatgccggctgcatttgcgtaaccatcaggaaaagcatggagaaaaagagagccacgacgatcggcttcgccgccattatcttatggagcacgatggtcggattgattcgcggcgtcagcgaaggactgggagcggtcggcggcgcggcgatgatttacagccttagcggcctgctgctgatctttaccgtcggctttcccaacctgcgccagatcccgcgtcgctatctgctggccggcagcgtgctgtttgtcagctatgaaatctgcctcgcgctgtcgctgggctatgccgccagccgccagcaggccattgaggtgggaatggtcaattacctgtggcccagcctgacgattttattcgccattctctttaatggccagaaaagcagctggctggtgatccccggcctgattctcgccctgctgggcgttggctgggtgttgggcggtgagcatgggctacagcccgatgagattatcagtaacgtcatttccagcccgcttagctatctgctggcctttgtcggggcgtttatctgggccgcctactgcacggtgacggccaaatatgcccgcggtaaaaacgccattacgctgttcgtcctgttaaccgccctgacgctatggctgaaatttctcgccagcgaccagccgccgatgctgtttagctggccggtggtcattaagctgatgacggtctccgtggcgctggggctggcctacgcggcgtggaacgttggcatcctgcacggcaacgtcagcctgctggcggcggcctcctacttcacgccggtgctctcctctgcgctggcggcgatcctgctgagtgcgaccctgtcgtggtccttctggcagggggccgggatggtatgtctcggctccctgctctgctggtacgccacccgccgttag

SEQ ID NO: 2625 - DNA, 474 bp, Klebsiella pneumoniae
atcatggatatttcgacagtgcttaatgttaaaaacatcaagttaaatataaccgccagaaccaaagaagaggtgatagaagaactcaccgatttactagtacaggatggtgcggtgactaataaggaggactttattcgtgatgtctggttacgtgaggagcaaggctctaccggttttgaaaatcatattgcgatcccgcatggcaaatcttccggtgtttcccgtaccgcattagccatcggacgcacgcaacataccattccctgggagaccatggatggcagcgatgttcgctgtattattttatttgcggtttgcctggtggatcaaaatgccactcatattcgcctgttagcgcaagtgtccgggtcactggccgacgaagacattatcgctaaattactggttgaatctgatccatataaaatcattgcgcttttcaattcagaaactgaaagcaccgaagcgtaa

SEQ ID NO: 2626 - DNA, 357 bp, Klebsiella pneumoniae
agaaaggatattgctatgaagaagttagctttactctccgccgtaatgacgctgggaatgtcgtcatgggcttttgctgccgacaacccgccgccgccgccggaaaaaggcgcgcagcatcagggtaaaccgccggtgaaaaacggccaacacgaaggtaagcaagcgcaatacaacagcaaacagccacaacgagacggcaaacagccgcagcacgacggcaaacagccgcagcacgacggtaaacagccgccgcacaacggcaagctgccgccaaaagggagcgagcacagcgggaaaccgctgccgccgaaagggagcgagcacagcgggaaaccgctgccgccgaaagcgtaa

SEQ ID NO: 2627 - DNA, 324 bp, Klebsiella pneumoniae
ggaaaccgtatggatatggaagcaaccgtcatggaactcatcattaacgccggtgagtcccgcagtctggcgatgcaggcgctgcaagccgccagaaaaggagtgtggcaggacgttgataggctgatgcaggacgccgcagatgccgcaaaacgcgcgcatgatgtacaaaccatgcttatcggtatggatgagggctgtggcaaagtaccggttaatcttattctggtacatgcccaggatcatataatgacctccatgctcgcgcgggagttgatcgcggagcttattgaggttcagcgccagctgcaacatcaaaactga

SEQ ID NO: 2628 - DNA, 471 bp, Klebsiella pneumoniae
cggcgacgtatcgccgctatactcaacgttctgatctatcaaataaactgcataggggacattatgcgcttactccacaccatgctgcgcgttggcgacctgcaacgttctatcgacttctataccaacgtgttgggcatgaagctgctgcgcaccagcgaaaacccggagtacaagtactccctcgcctttgtcggctacggcgaagagagcgaaaccgcggtgatcgaactgacctacaactggggcgtggacagctatgagctgggcaccgcctacggccatatcgcgctgagcgtcgataacgccgccgaagcctgcgaacggatccgtcagaacgggggcaacgtcacccgtgaagccgggccggtaaaaggcggcaccaccgtcatcgccttcgtggaagatccggacggttacaaaatcgagctcattgaagagaaagatgccggtaaaggtctgggcaactaa

SEQ ID NO: 2629 - DNA, 498 bp, Klebsiella pneumoniae
cgcacgctctttcctggccgaacgacaaaccgtccaccggtcattacaaaattacacagttttgttacttaccgcgctactgccgccgctatagtacagaatgtctggcagaccacacggccctgggagataagaatgaaggaaatcggcttaccgttattgctactgaccgcgctggccagtccggcttttgctgcagactgtcagccaaacggcattggcggctcgttttgcattaacgatgacggtacgactaccgacacggtgcctaacgaagtcaacggcatggatacgtactcgaataatggcggctataccagttccctgcccgatcggtcaggggcggatgaagcactggaaggttcatcgctgtcgacgcagcaaggcgtcggcagcggacagagcgacagtgcgctggcgggtcgcgactggcattcgcccgccaatctgaatgatggcgccgccacctccagtatgagcctgctggataaaccctga

SEQ ID NO: 2630 - DNA, 573 bp, Klebsiella pneumoniae
ggtttgagtatgaaagaaaaaggcaccctgctggttgttggttcactgctggccttaagtctggctactgtgaccacagcccgcgcggcgggtacactgaatttcaccggtaaaattattaacgagtcctgccagatcgccaataacggtggcgatgttaatgtcgattttggcaacgtcgatatgtcggcgctgaaatcccatgaagcgaaaaccgcagaaacgccgttcactatcaacctcaccggttgcccactggcgcagaacatcagtatcagcctggaaggtactccggacaccaacgctaacggcaccagcgccgccgtgctggcgctctccgacgccgcggataccgccaaaggggtgggcattgaagtcttctcttcccctgacggctcaacggaaggcactcagctgacctttgacaagcagagcaaaacggcggtttcgcaagccgacgaaaacggtgatattgcatttaactttattgccgatctgaagagcgattcctcacaggatgtcactgccggcaatattaatgccacggccaatattgatattgtgtacgaatag

SEQ ID NO: 2631 - DNA, 804 bp, Klebsiella pneumoniae
ggacagggtatgcaggaaattcaattttatctggtcgatgctttcagcgataaaaactttggcggcaatgccgcggccgtctgcccgctcagcgagtggttagccgacgatgtgctcctgaaaatggcccagcagcataatcaatccgaaacggctttctttgtccgtaccgacgagggctatgagctgcgctggtttaccacactcgctgagatcaatctctgcggccacgcgaccctcgccgctgcgcacgttattttcgaatatctcgaccatccttcggcgacgattctctttagcacccgttttgttggtgagctgcgggtcacccgtaatggcgactggctgacgctcgatttcccggcgtggtcgacctccccggtggaaaacccgccggcggatctgctggccggactggggcttgagtctgccgtcgaggtgcgggaagggcgcgattatctggtggtgctggcggatcgccagcaggttgaagcggtgcgaccggatatggcgcggctgcgaacgcttggcaaaatgatctgcgtcagcgcgccggatgaagagtatgactttgtcagccgcttcttctgcccgggagaaggggtgccggaagatccggtcaccggctccgcccatagcatgctgatcccctggtggggcgagaagctggggaaaaccaccatgatggcgcgccaggtctccgctcgcggcggcgacctgcgctgccagtggcagggcgaccgtgtgctgattagcggccaggccaccacctatatgcgcggaacggtttacctgcgaggttaa

SEQ ID NO: 2632 - DNA, 429 bp, Klebsiella pneumoniae
ctggcctttttgcgccagatcggcgacaacgtcacccgccttgaccgctgggaaacggaactgaatgaggcgcttcccggcgacgcccgcgacaccactaccccggccagcatggccgcgaccctgcgcaagctgctgaccagccagcgtctgagcgcccgttcgcaacggcagctgctgcagtggatggtggacgatcgggtcgccggaccgttgatccgctccgtgctgccggcgggctggtttatcgccgataagaccggagctggcgaacggggtgcgcgcggcattgtcgccctgcttggcccgaataacaaagcagagcgcattgtggtgatatatctgcgggatacgccggcgagcatggccgagcgaaatcagcaaatcgccgggatcggcgcggcgctgatcgagcactggcaacgctaa

SEQ ID NO: 2633 - DNA, 1023 bp, Klebsiella pneumoniae
attgatatcatcaataaaatgaataaaacgcaaacgccgcggcaggtgctaaacctgccggcgggttattttggcatggtgctcggcaccatcggaatgggcttcgcctggcgttacgccagcaccctctggccggtcagccgcagcattggtgatgggctggtgacgctggcgatggcgatgtgggtcctgctcagcatggcgtttatcagccgggcgatccgctttccggcgagcgtgctgcgggagatgcgtcatccggtgagcagcagcttcgtcagcctgtttccggccaccacgctgttggtggcgattggtttggctacctggtgccggccgctggcgatcgggctgtttgtgccgggcgtggcgctgcagctcgcctatgccgcctggcaaagcggtgggctatggcgggggaaccatcctcgcgaggccaccacgccggggttgtatctgccgacagtagccaataattttatcagcgcgatggcctgcggcgcgctgggattttccgatgccggactggtgttcctcggcgccggggtcttctcctggctgagcctcgagccggcgatcctccagcgtctgcgcagcgcaggcgagctgccgacgccgctgcgcacctcgctggggatccagctggcgcctgcgctggtggcctgcagcgcctggctcagcgtaaacggcggggaggccgataccttcgctaagctgctgtttggttacggcctgctgcagctgctgtttatgctccgtctgatgccctggtatcttcgtcagccgttcaatgcttctttctggagcttctcgttcggcatttccgcgctggccaccaccggtctgcatctcggccaggccaggggagacggcttttttcatcatctggcgatgccgctatttatttttagcaatctggttgtcggcctgctgctgctgcgtacagcgttgctgttggtcagcgggaaactgttgctccaggtcgaccgggaaacactcctgaataagaaggaaggatcatga

SEQ ID NO: 2634 - DNA, 1281 bp, Klebsiella pneumoniae
caagggatcatggtgatgaaattctcagaactggcgccacgagaacggcataatttcgtctatttcctgctgttctttttcttttactatttcattatgtcggcctacttcccgttttttccggtgtggctggcggacgttaaccatttaactaaaacggaaaccgggatcgttttctcgtctatctcgttattcgccattatttttcagccggtgttcggcctgatgtcggataagctcggcctgcgcaaacatctgctgtggaccattacggtactgttaattctgttcgcgccattctttattttcgttttctccccgctgctgcagatgaatattatcgctggttcgctggtaggcgggatctacctggggattgttttctccagcggctccggggcggtggaagcttatatcgaacgcgtcagccgggccaaccgctttgaatatggcaaagtgcgggtcgcaggctgcgtcggctgggcgctatgcgcctcgataaccggcgtgctgttcggcatcgatcccaatatcaccttctggatcgcctccggctttgcgctggtgctcggtctgctgctctggctgtcgcggccggaaagcagcaacagcgctcaggttatcgaggcgctgggcgccaatcgccaggccttttcgctgcgtacggcggcagaactgctgcgtatgccgcgcttctggggctttatcgtctatgtggtgggtgtcgccagcgtctacgacgtgtttgaccagcagttcgccaactttttcaaaagctttttcgccagtccgcagcgcggtaccgaagtgtttggcttcgtcaccaccggcggcgagttgctcaacgcgctgatcatgttctgcgcgccggccatcgttaaccgcatcggcgccaaaaacgccctgctgaccgcggggatgatcatgtcggttcgtattctcgggtcgtccttcgcctcatcggcagtcgaggtggtgatcctcaagatgctgcatatgtttgagatccccttcctgctggtgggaacttttaaatatatctcttccgcctttaacccgcgcctctcggccaccctgttcctgatcggttttaatctgtcaaaacagctgtccggggtggtgctttccgcctgggtgggtcggatgtacgacaccgtcggcttccatcaggcctatctgatcctcggctgcataaccctgagcttcaccctgctctcgttcgtcaccctacgcggcggcaaccgtctgctgccgaccgcagagacgcagagccccgcctga

SEQ ID NO: 2635 - DNA, 195 bp, Klebsiella pneumoniae
gtacttgtcattccggccggatgtaaatttggtgtgattgccgtaatcttaatattcgccatcgctatgttaaaatattcaacttccagtcccgcctcatttattctgtacatttttagcgttgccgatcttaatgttcgaccttcacaaagagccctaaatagcaaaggtgttgttctgtcaaactctttttga

SEQ ID NO: 2636 - DNA, 1128 bp, Klebsiella pneumoniae
aatatcgtcatgaatatctgctgcgcaaacgcgaaggcgatagcggacaaaaattccagcctgaaccttacagagatgccagcaatgaatccgaccagtaagaaaaatattcttgtcctggcggccctgggcgctgccgccctggcggcagcgagctacggcgcttactggtggcataccgggcgctttatgcagaccaccgatgatgcctatgtcggcggcgacattagcgccatctccagcaaagtctccggctatatccagcagctggcggtgcaggacaatatggcggtgaaaaaaggtgacctgttgatccgcattgacgaccgcgattatcgcgccgccctcgcgaaagccgccggagaagtggcggcgcagcaggccgcgctggccgatatccaggctacccgccagcttcagcaggcgaccattgccggctctgcggcctcgttactggccgccacggcggcaaccgaaaaactggctaacgacaaccgacgctataacgccctggccgcgtcgagcgcgatttccgcacagatccgcgataacgcctccgccgattatcgccgggcgcacgccgagcaggagaaggccaaagcggataaaaccgtggccgaacgtcagctggcggtgctggatgctcgccagcagcaaatcctggctgccctggcgcaggcccaggctaacctcgagatggccaggctgaacctcagctataccgacattcgcgcgccgttcgatggggtgattggcaaccgccgcgcgtggtccggctccttcgtcagcagcggtacgcagctgctctccctggtacccgcgcacggcctgtggattgacgctaacttcaaggaaaaccagctggcgcatatgcgtgccggccagccggtgaccatcgtcgccgatgtgctgccgaaccatacctttaaggggcatgtcgccagcctggcgccggcgaccggctcacgcttcagcattctgccggcggagaacgcgaccgggaatttcactaaaatcgtgcagcgggtgccggtccgcattgcgctggaaggtgacggggcaaagcttgacgtcctgcgcccgggactgtcggtgatcgtcaccgtgaacgaaaagagccctcgatga

SEQ ID NO: 2637 - DNA, 984 bp, Klebsiella pneumoniae
atgcgttccattgtacggatttcgctatttgatagaattcctgaaacaagagatgctgagtttcataaaacgtgcagatcagggggagtgatggacagggtgattgctgcgcaggtgtatctgcgcatctgcgagctgggaagtcttagcgccgcggcgcgggcgctggggatgtcgcgcccgatggtgagccgctatctggaacagatggagagctgggccggcgcccggctgatccatcgctcaacccggcggctgacgctgaccccggccggggagaaggtattgctcaagacccgcggtttgacgcggatcgccgatgaaatcgccggcgagcgtcagcgggccgatcccagcggcacactgcgcgtcgcctgcgcgcactttaccgccatgcagctgatctctccgctgctgccggactttctcgcccgctatccactgctgcgcctggagctggatatcaataaccatccggtcagcctgatcggcgagcgtatcgacgtggccattcgcattaccgacaacccggaggcgggggccatcgctcgtcgcctcggagtgtgccgttcgctgctctgcgccgcgccgggctggatgcgccagcatggcccgttgacgacgcccgacgatctgcaacgacataactgcctgctatacagccatttcgccagccagcactggcagttcagcgatgcgcaggggcgggaagcgtcggtggcggtgaacggtaatctgagcgcagggatatcttcattgctgctggaggcggcggttgccgggtgcggcattgcgatgcttcccgaactggaggcccggggcgcgattgccagcggcacgctggaggtggtgcttccggagtggacgccgaaggcgttgagcgtttacggcatctatctttcccgcgactaccaacctgacggattaccgctatttcttgatgcgctgcagaggcgtctgggagaggagactggccacggctga

SEQ ID NO: 2638 - DNA, 1101 bp, Klebsiella pneumoniae
ggagtccccatgacgctgagtcaggatattctggccgaactggcggagatcgcccccggttccccgctcgatcaggcgcgcgccgtccgcgatgccgccacccgtcacgcccagggaagttatgaagtgctgttccgccagcaggacgctgactttcctcttgatgaacgcttcgcggtggccgcgaaggtggcaaaactgcaccaggcggacgcgctggcggcgcactatgccggtttcggcctcgccgatccgaccaccgatcgtctggtcccggcgctggcctttgcccgcctgctcaccttcacccccgttgaagccactcccggcgcgctgcacaccttaaccggcgcgggctggagcctgcggggcatcgtcaccctggcgcagctggtagcctttgtcagcttccagagccgactgctgctgggcctgcgggcgctcaaccataagcccatcgtcagcgcagatacgccgctggtcgccggatactggcataccaccccgtacgcgcagagcggcaaagcggccccggttcgcttcacccgcgacgagctgcactgggaaccctggctggccgataaaccgctggcggaattcaacgctgaagaacaggcgattctggccaaatatggccatagcgactccccctactttcgcctgctggcgcgcaaccagccggtgctggagcagcggaccctgaccgataagggcattttctataccgcgggaggattgccgcgcgccgaacgcgagctggccgccacggtcgccagtaaaatcaacggctgtatctactgcgcctcggtgcatgcccgcaaagcggcgcagctggcgaaggacgagaccgccgtcgacacgctgctggcggtgacgccgggagaggatctgcgcgacgggcaatcgccgcgctggcaggcggaaatcgacgccgccgccgcgctatcggtgacgccacccgcattaaacgccgatcatctggcggcgcttgatgagcagggcttagatactctggcccagctggatctgctgcagtccgcggcctttttcgcctgggccaaccgcctgatgctgaccctgggcgaaccctggcgtgagtag

SEQ ID NO: 2639 - DNA, 1464 bp, Klebsiella pneumoniae
agggaacccattgtgaaaactttaaaccgtcgtgatttccccggcgcgcagtaccctgaccgtatcatccagtttggggaaggtaacttcctgcgcgcattcgttgactggcagatcgacctgctcaacgagcataccgacctgaatgcgggcatcgtggtcgtgcggcctatcgccacagattttccgccttcgctgaacacccaggatggcctgtacacgactattattcgcggcctgaacgagcagggcgaagcggtcagcgatgcgcgtcttatccgctcggtcaaccgggagatcagcgcttacgcagacttcgacgcttttttacgcctggcgcataacccggagatgcggtttgtcttctccaacaccaccgaggcgggcatcagctaccatgccggggatcggtttgacgacgcgccgccggtcagttatccggcgaaactgacccgtctgttgtttgagcgttaccagcatttcgccggtgcggccgacaagggatgggtgattattccctgcgagctgatcgattataacggcgaggcgctgcaggcgctggtgctgcgctatgctagcgaatgggaactgccgcaggcatttatcacctggctgacctcagcgaataccttctgttcgacgctggtggatcgcattgtgaccggctatccgcgtgatgaagtggcggctctcgaggcgcagaccggctataaagatgctttccttgataccgctgagcatttctacctgtttgtgatccaggggcctgcctcgctggcggccgagctgcgtctcgataaactgccgctgaatgtgcgcattgtggacgatattaagccgtataaagaacgcaaagtggcgatccttaacggggcgcacaccgcgctggtgccggtggccttccaggccgggatcgacaccgtgggtgaggcgatgaacgacgcggagatttgcgcgtttgtcgaaaaggcgatttatgacgagattattccggtgctggatctgccgcgcgatgagctggtgtcattcgccagcgccgtgacagggcgcttccgtaatccctatattaaacatcagctgctctcgattgcgctcaacggcatgaccaagtaccgcacccgtattctgccgcagctgctggcggggcagaaagcgcatggcgcgctgccgccgcgtctgacctttgccctggcggcgctgatcgccttttaccggggagagcgggatggtgagagctatccagtacaggatgacgccgactggatatcgcgctatcaaacgctgtgggcccgccatcgcgatggccagatgagcactcgcgagctggtcaccgccgtgctcagcgtggcggatcactggcagcaggatctgagccagatcccggggctggtggagctggtgactgccgaccttgacgctatcctgacctgcggtatgcgcgacgccgtcaaacctctttgctga

SEQ ID NO: 2640 - DNA, 1482 bp, Klebsiella pneumoniae
gtgaccgccatgtccacattgaatccgattcttgctggttcagcgcagagcgttgaatcctatcatcaggttatcgagcagaccagccaggccgttgtgcagtggctgaagcaacctgagatgtatcaggggaaaagcgttgacgagctgcgtgagcgtatctccctagaatttaacgaacagggtttgggtaaccaggcggcgattgatcgtgcgatcgagtacttcctgaaagacagcctgtcggtgcatcacccgcagtgcgtggcgcacctgcactgcccgagcctggtgattagccaggcggcggaagtgctgattaacgccaccaaccagagcatggactcctgggatcagagcccgtcggcaaccattatcgagatgaagctgatcgaatggctgcgcgcccgggtcggttttccggcgggcgacgccggcgtcttcaccagcggcggcacccagagcaacctgatgggcctgatgctggcgcgcgacgccttcttcgcccgtcagggccactccatccagcaggatgggctgccgggggatatccgcaagtacaaagtcttgtgctcggaaaacgcccacttctcggtgcagaagaacatggcgctgatgggcctcggctaccgctcggtaacgctggtgaaaaccgacgaattcgcgcggatggacgtgtccgacctgcaggcgaagattgcgcaagcgcaggctaacggcgagcagatcatggcgatcgtcgccaccgccggcaccaccgacgcaggcgctatcgacccgctgcgcgacatcgccggtatcgctgcggaacatcagatctggctgcacgttgacgcagcctggggcggcgccctgctgctgtctgagcagtatcgcgactaccttgacggtctggagctggtggattccgttaccctggacttccataagcagttcttccagaccatcagctgcggcgcattcctgctgaaggacgcgcgccattacgagctgatgcgttatcaggcggcctatctgaactccgagttcgatgaagaacacggcgtaccgaacctggtgtctaagtcgctgcagaccacccgtcgcttcgatgcgctgaagctgtggatgggtctggaagcgctgggccagaaacagtatgcggcgatcatcgatcacggcgtcacgatggcgaaaaacgtggcggagtacgtgaagtcgcagccgacgctggagctggtgatgcagccgcaactggcgagcgtgctgttccgttcccgtccggcgcagatggccgggagcgacgcggcggctatcgcgctgctcaaccagcgcgtcggcgacgccctgctggcctccggccgcgctaacgtcggcgtaaccgagcacaacggcgttacctgcctgaagctgactctgctgaacccggtggtgacgctggatgacgtgaaggttctgctgaacctggtggagcgcaccgctcaggagctgctggcgcaataa

SEQ ID NO: 2641 - DNA, 990 bp, Klebsiella pneumoniae
ggatcggccatgcgtaaataccgtctcagcgaacagacccggcagtattgttatgaggaagagcatggcaaacaaagcgtcaccctgcgccagatcgtggcgcttattgatttcgctgacgttaaagcgggcagcgaaggcggctgggtggatgaggaatgcgctctcagccagcagggggagtgctggatctacgatgtcaacagcgtggtcttcgccggggcgcgcatccgtgacgacgcccgcttaaccgggttctgcgtggtcagccatgaggccaccatcggcggacgggcctgcattcacgcctcgcagatcagccatcacgcgcagatcagtgacaacgtcacggttatgcagagccaggtgcgcggttattgtcgccttgccgacgaggcgcgtcttctcccccactgccaggtgattgccgcgcgcgggttaaccgccgatcgcgacaaagtcctgcagatctatcagcgagccaccgtcagcgcctcgcgcattctccaccaggcgcaaatctacggcgatgccttcgttgagcatgcgtttgtcgaacatcgggcggaagtgtttgaccaggcaagacttgaagggaacgaagaaaacgacgtctgggtatgcgataacgcccgggtatacgggcacgcgcgtctgatcgccggtcgtggagaggatgccattcccaccgtgcgctacagttcgcaggtggcagagaatgcggtgattgaaggcaactgcctgctgaagcatcgggcgatggtcggcggcgaggcgcagctgcgaggtggtccgattctgctcgacgacgatgtgctgatccaggggcggacagtcatcaccggcgatgtgatcgttgagcaccaggtctccatcaatgacgaggtgcagattgccgcacaggagggagaggccattcatctgcgcggcccgaaaacgcttgccggccagcagcacatcacccgcacgccgctgttaggcgcgctttaa

SEQ ID NO: 2642 - DNA, 2067 bp, Klebsiella pneumoniae
ggagattacatggcaactggcaacgcgccgcgcggattcccccggatcctgcagtggcttctcgccggactgatgctcatcatcggtctggctgtgggtattcttggggcaaaactggccctcgtcggcggaacactgtacttcgcgctaatgggcgtggtcatggtcatcgcggcggtgttgattttccgcaaccgccgcggcggtattctgttatacgccgtggcgtttatcgcctcggtgatctgggcgattagtgacgctggctggaactactggccgctcttctcgcgcctgtttgcgctcggcgtactggccttcctggccgccctggtctggcctttcctcgccagcccaccggcgaaaaaaggcccggcctatggtgtcgccgccgttctcgccgtggcgctggcggtgagctttggctggatgttcaaatccgcaccgctggtcagcgcgactgaagcggtaccagtcaagcccgtcgcgccaggcgaacagcagaaaaactgggcgcactggggtaacaccacccacggcgaccgtttcgccgccctcgaccaaatcaacaaacaaaacgtcaaccagctacaggttgcctgggtagcgcatactggcgatatcccacagagcaacggctcgggcgcagaagatcaaaacaccccgctgcagattggcgatactctctatgtttgtaccccttacagtaaagtgctggcgctggatgtggacagcggaaaagagaaatggcgctatgactccaaatcctcttcacccaactggcagcgctgccgcggcttagggtattacgcagatagccaggcgcaaaccgcgccagcgtcaggcacgcagccggccgcctgttcccgtcgtctgttcctgccgaccatcgacgcccgcctgatcgccattgatgccgataccggcaaactgtgcgaaaacttcggcgatggcggtattgtcgacctcagcgtcggcatgggtgaagtgaaagcgggttactatcagcagacctccaccccgctggtggcgggcaatgtggtggtggtgggcggccgcgtcgcggataactactccactggcgaaccgccgggcgtggtccgcgcgtttgatgtccacaccggcaaactggcatgggcgtgggatccgggcaatccagcgctgaccggtgttccgccggaaggtcagacctacacgcgcggtacgccaaacgtctggtcggcgatgtcctacgacgcgaagctgaatctgatctatctgcccaccggcaacgccacgccagatttctttggcggcgaacgtaccgcgctggacgataaatacagctcctctatcgtggctgtggatgccaccaccggccaggtgcgctggcacttccagaccacacaccacgatctgtgggactttgacctgccgtctcagccgctgctgtacgatctgcctgacggcaagggcggcaccaccccggtgctggtgcagaccagcaagcagggcatgatctttatgctcaaccgcgagaccggcgagccggtggccaaagtggaagagcgtccggtgccggcgggcaacgtcaaaggtgaacgctactcgccgacgcaaccttactcggtagggatgccgatgatcggcaaccagacgttgaccgagtccgatatgtggggagcgacaccgatcgacctgctgctgtgccgcattcagttcaaagagatgcgccatcagggcgtctttaccccgccaggtgaagaccgttccctgcagttcccgggctcgctcggcggcatgaactggggcagtgtttcgctggatccaaacaacagcctgatgtttgtcaacgatatgcgtctgggcctggccaactatatggtgccgcgcgcgaaggtggcgaaagacgccagcgggatcgagatgggcatcgtgccgatggaaggcacgccgtttggcgcgatgcgcgaacgtttcctgtcgccgctgggcattccgtgccagaagccgccgttcggcaccatgtccgcggtagatctgaaaaccgggaaactggtgtggcaggtgccggttggcaccgtataa

SEQ ID NO: 2643 - DNA, 798 bp, Klebsiella pneumoniae
cgggtaaacatcatgaagaaactgttgatcgcgctggccggggccgcttgtctcctatcgtctgtttctgccgcgcaggctgaccagctccaggatattgaaaaacgcggcgtcatccgcattgccgtaccccaggactttccaccgttcggctcggtgggtaccgacctgcagccgcaggggtatgacatcgatatggcgcgctatctggcgaaatcgatgaagctcaagctgcagctggtcccggtgaccagcgccaaccgcgtgccgtatctgcagaccgacaaggtggacctggtgatctccagcctcggcaagaacgccgagcgcgagaaggtgatcgacttcagccgcgcctacgccccgttcttcctcggggtgtttggcccgaaaggggcggagctgaaggacgcggccgcgctgagcggcaaaagcatcggcgtgacccgtggggcggtggaagatatggtgctgaccagcgtggcgccgcaggcggcgcagattaagcgctacgaggacaataacactacgctgtcggcttacctgtccggtcaggtgcagtatgtcgccaccggaaacctggtggtggcggctatctcccggcagaacgccgacaaagcgccggtcccgagctttatgctgaaggactcgccgtgctttatcggtctgaaaaagaacgaaccggcgctgaaggcaaaagtggataccctcatcgagcagggcattaaggacggcaccctcaacggtctgtctgagaagtggctgaaagcgccactgcctgccagcctcggcgcgtaa

SEQ ID NO: 2644 - DNA, 450 bp, Klebsiella pneumoniae
gggagaaacatgacgtctcaatctgcagagcgcatcggcggatggctgctggctccgctggcctggttgctggtggcgctactgagcgcctcgttatcgctgctgttttttgccaatgcgttgatgtcgccgcagacctataccatactgcgcgccatgagcgcgggccatatggcgctgtgggtcgcctcgctgctgtttgccctcgccatgtggtattacacgctctggctgactatcgcctttttcaagcggcgctcggtggtgccgaaacactatattatctggctgctcatcaccctgctgctggcgataaaggcttttgccttctcgccggtctcggatgtgcttgccctgcgtcagctgctgtttccgctgctggccgctgcgctgctggcgccctattttcgccgttcgcagcgggtaaaacggacttttgttaatccgtaa

SEQ ID NO: 2645 - DNA, 528 bp, Klebsiella pneumoniae
ctgttgaacatgcgaatattgactgtagttgattatgatgagatgtggccgactttatttgagaacgaacgtactctgttgcagatgacgctaggtaaagtgatatcccggattcatcatattggtagcacctcggtgcctggattatcagctaagccagtaatagatatattaatcgaagttgctaatcttgaagaactggacactctgaatcaggcaatggagggtgtaggatatactgtacgtggtgaaaacggcattttaaatcgtaggtactttacaaaaggtggaaatcagcgtagtcatcatatccatgcgtttaccaccggggatgctcaaatcataaaacacctggcattccgtgattaccttattaaacacaatgacgtagccattcagtacgctttaatgaaaaaaagcgcgatgttattatgtgaaaatgacagccaccgatacagcatttataaagcggatttcattcagaaacatcttcgtatggcgcttattgatgcgggtcacctgggctag

SEQ ID NO: 2646 - DNA, 1506 bp, Klebsiella pneumoniae
ccatcagacatctttattttaatattccatgaatcattgcgcctgcgcaatatcttatctgcctgcccctattacgctcaagaacgtaaattagccctggcgactcatcgtcgctgccgttgccttttatgtggaatattgcctatgcccgaacatgtgcatcatatcgttaaacgtctaatcctttatatttgcatttgtttactggccgggattggcatttccgggatgactgcgttttttcataccagcttcagtagtacttcctcaatattatttccgctgctgaccagtttcctgatggtttttcatattaccattgcctgttttatgggcatgaaatactggagcagcaagcggcgtctgtaccttactccagtctctttcgggtttgcctgctcagcgctgctgatgcttggcacgctcagcagctatccggactggcttacctgcaatccggccccggtcgttaatcaaaatgacgccgttatctattatttcttccgcaatataatgatggctgtgttattcatgtcatctattattttgtactattttcgccagcgcatcatgcattcgtggaaagcacacgttcttacatttacagcatgtattctttttacgttgaccattattgttttatcatggctatactccagccattcgccgtggctgagcgtcaattttatcgacgatctgagccatacctttaccccgttgtggcaaagtattatcggctggctgctgatggcagtttggttcatcacgctgattttattaattagcttgagtaaactgcgtaatattttttggttcagcggcgcttttttttgcagcgcttatttgttcacgcttttccagctgctctccaccgcaggggagctggatcagacctggtaccaggcgcgttttttcgaaacgctatgcaccttgttcctgattctggtgctactggttgacgtctttatcctctatcgcgagtctaaccacaaatatgtccattcgtatcagaattcgatccgcgacccgttgacccgcctctacaaccgcagcttcttctacgacactcttaaccaacagctggcgaaggtgaatgcccagcatccgctgtcggtgctcatcagcgacctcgaccatttcaaacgcatcaacgatagctacggccatgtcgccggcgacaaagtgatccagttcgccgcctcggtgctggaaagccattcgcgggtagatgacgccgccgcacgcatcggcggtgaggaatttgctctgctgctggtcaacaccggtgaaaaagaagcgcaagcgatcgccgagcgtatccgcctggcggtcagtgccggggagagccatttaccggagcgaatgaccatcagcatgggggtgtataccacccacgacaatagcgtgacagcggaagcgtgcgttcagcgcgcggacgaagccatgtatgaagcaaagaataacggacgtaaccaggtgatcgtctggcatcggcagggagggtga

SEQ ID NO: 2647 - DNA, 1113 bp, Klebsiella pneumoniae
ggagacagcatgcaacgtcaacaggccccgttccgcgcagacatcgtcggcagttttttgcgcccggacagcattaaacaggcgcgtcagcagctggctgaggggattatcgacgccgctcagctacgcgagattgagaataacgccattcgtcatctggttcagcagcaatgcgactgcggcctgcatgtggtcaccgacggtgagtttcgtcgcgcatggtggcatttcgatttcttcgatggcctgcagggcgttgaacgttacgatgccgagcaggggatccagttcaacggcgtgcagaccaaagcgcacggcgttcgcgtcaccggcaagctggcgtttggcgaccacccgatgctggaggatttccgctatctgaaaagcatcagcggcgacgcgcagccgaagatgaccattcccagcccgagcgtgctgcacttccgcggcgggcggaaagatatcgatgccacggtctacccggatcttagcgactacttcgacgatctggccaccacctggcgcgacgccatccgcgcgttttatgacgccggctgccgctatctgcagctggacgataccgtgtgggcctatctgtgctccgatgcccagcgccagcaggtacgtgagcgcggcgaggatccggatgcgctggcgcgtatttatgcccgggtgctgaaccaggcgctggagggtaagccggccgatctgacggtgggcttgcacgtctgccggggtaacttccgttcaacctggatctcggaaggcggttacgagccggttgccgaggtgctgtttggcggcgttaatgtcgatgccttcttcctggagtacgacaacgaccgctccggggatttcgcgccgctgcgctttattcgtcccggccatcagcaggtggtcctcgggctgatcaccaccaaaaacggcgagctggagaatccgcagggggtaaaagcgcgtctcgccgaggccgcgcagtacgtgccgctcgagcagatctgtctcagtccgcagtgcggtttcgcctccactgaagaggggaatgccctcagcgaagaccagcaatggcaaaaggtccgtctggtgacctccatcgccgccgacgtctggtaa

SEQ ID NO: 2648 - DNA, 297 bp, Klebsiella pneumoniae
gcgcactttttaatgcggaacggacgtatcgtaatgcacagctcgaaagatcccctgcacggcgtgacgctggaagcgctgctcaatgccctggtggcgcgctatggttgggcggaaatggcccgccaggtcaacattaactgctttaaaagcgatcccagcattaagtccagcctcaaatttctccgccggacgccgtgggcgcgcaaagaggtggaggctatgtatctcgcctcccttgatgatgacgcgccggtggagaaagcggatccctgggcaaactggcagaaaaaataa

SEQ ID NO: 2649 - DNA, 543 bp, Klebsiella pneumoniae
atgctattaatgcaacgaatcacaaagctggataacgacttaacctgtaagggaatgctgatgaaactctggaataaaacactactcgcttccgccctgtgcctgaccctgtttggctgcgacgatgcgtcgaaagttgataacaaactggataaggctaaagataatgcggagcagatgaaggatgccgcggcggataaagcgcaggcaattaaacaggatgcggataagcaaatcgatacgctgaaaagccaggctgacgccgaggccgatcgcctgaaggatcaggccagcgccatcaaggccgaggcggacaagaaggcggacgccatcgcccagcaggcgaaagcccaggccgatgcggtgaagcagaacgcaaagcaggaaagtgaccgcatagtcaaagaggcgggtcagatcaaagacaacgccatcggtgacgccaatcagctctcggctgaagcggcgagcaaaaccaaagccatccaggacagtatcgcgaaggataaacagaacgccgcgccgcctgccgcacagcagtaa

SEQ ID NO: 2650 - DNA, 1281 bp, Klebsiella pneumoniae
ttgaatataatcaatttaagattttatcgactacaaggcaggacaatgaacgacggcaataacagagtgctggtgctggcggatgactttaccggggccaatgacgccggggtcagcctggcggaggcgggtatgtcggtggaagtggccttcaccgccggacagccatcaaccgcccgggcattaattctcaacagcgacagccgggcgatgaccgccgccgcggcggcggacaaggtcgccgctctgctgcgcggcgcggcgacattcgtcccgcactggcaggtaaagaagatcgactccacgctgcgcggtaatcccggcggcgaactggaggcaatgatggcggcgcaaggctgccggatggcggtggtggccccggcttatccggcagccgggcggcatacccgggacgggcgctgctatgtgcatggcgtgcccctcgatcagaccgaatttgccagcgatccgaaaacgccggtgagccgggcggagattagcgaaattatcgctatgcagagccgtcttccctgtctgaccctgaacgctggccagcttccggcggcattagcgacggcgggcgaggaaaagcgagtgttgattgtcgacgcctgggaagacagccatctggaccaggtgatcgacgccgttgcgccccatgcgcgggagaccctgctggtcggctcggcgggtctctgcgaggcgctggctcgccgcctgcgccgcagcgagcagggcccgctgctggcggtggtcggttcgatgagcgagatggcgcagcgtcaggttgctgcgctgcaggtccattcccgagtacgggtgattgaaattgatgtcgaacaggcctttagcggatcgccaaaggaggaagcttcacggatcgccggggcgctgcgcgagggccagcactgcgtggtgaccacccgcccgaatcacgccgtccggcaagggattgaagcccggtgccgtgaacgcggcctcagccgcgccgcctacggggagcacatctgcgcctggcttgccgacgtcacggcgcaggcggtggcgcagtcttcccctggcgcgctgtatctttccggcggcgatgtggccatcgccgtcgcgcacgcgctcggcgccacagggtttcagatccgcggccgggtggcggagtgcgttccatacgggcattttctcggcggccgctggtcgcggccggtgatgaccaaagccggaggattcggcaccgacaccacgctgttacatgttgtgaattttattgaggagaaactgagtgtctaa

SEQ ID NO: 2651 - DNA, 1308 bp, Klebsiella pneumoniae
aaactaataatatcacggactgtttacatgtcatctcataccaacattgtacaagaaaaggctttgcaactgatgcaaagcattggtcaaaatacctaccttaagtcaatcatgagcggtatgatgctcatattgccagtaacgatcatgagttctgtggcgactttggttaaagtgtttccgtttgctccatatcaggattttttgttacgacacaacttaactcgcttctttgatatcccgattaccttcacgaataattttttagccgtgattgtcgctttctccgttgcctatacgctagcgaaaaatttcgatgttgatggcttcatgtcaggcctgatttcaatgatctctttctttattttaacgccgtatgatctcggtgaaatagggccgttagggcaatcattttcaatccctggccaatggctggggcccatggggctgtttaccgccattctggtggcgataatttcaacacgaatattcgtggcgataactcgcaaggggttgattatcaaaatgccagaaaatgtccctgaatttatctccaaatcgttctcttcattgattccaggaatcgccatcctgacgctgtttacaattatctccgcagtcattaccagcgttggttatgggagcattcacgaaattatttataaattaatccaggttccgctaacatcacttggatccggaatctggtcactcatctttgttgctgttgttgcgcaattgctatggttttttgggctgcatggccacgctatcaccctcggtatcgtagcgccgatctggtttgccatggatgcccagcagctagctgcgtatgctgcaggcgtcgacttacccaacatcaccggctttgcgttctttatgacttatggcgctgctggagatttattgccgctggctataatgctcgcttttttcgcgaagagcgcacgctataaaacgctcggtaagatcgccttgccgccagctatcttcaccattggcgaaccgatggcttatggcgtgccgctggtaatgaattttactctggcgattccttatatttttatcaatggcatcatgctcggcattgcatggtatctaacggtcattggcgtattgcctcgcgtcgctggggtgagtaccccggccggcatgccgatcattatttctggttttatgcaggggagctggaaaattgccgcattccaatttataggactttttgcgcgatttgcaggatggtatttcttcttcaagactgccgatcttgtcgcttgccgggaagaaaatcagacggataccatttga

SEQ ID NO: 2652 - DNA, 549 bp, Klebsiella pneumoniae
acgcgaataatcgctttcaccggaccgaaggactcttcacgccacagccgcatctcgcgggtcacgccgtccagcagggtcgggctcatatgggtatcgttggctttgccaccggtcagcaggcgagcgcctttcgctaacgcatcctcaatgagcgcgttgcagcgggcgatggtgttcatatcgacaaccgggccagtgagggcggcaggcagggcggcggcacgcctggccagcagcgggataaacgcctccgctacggcattgtcgacaataatgcgctcggtggacatgcagatctgcccggcgttggcgaaggcgccaaaaacagcgcccgctgccgcttgctcaatatcagcatcgtccagcaccagcaggggcgcttttccaccgagctcgagcaccgctggtttcagatactgtccgcaggtgcgggcgataatgcgtcccaccggtgtggagccggtaaagttaacgcgccgcaccgcagggtgggcgatcagcgattccaccagcgccggcgcatcttcaggcgcacaggtaagatag

SEQ ID NO: 2653 - DNA, 1452 bp, Klebsiella pneumoniae
tatatgataatgggacgttatcgtacggggacggccgcaatgaaaaagtatcaacagttggcgcagcaactgaccgagcagatcgcccttggcgtctggttgcctggcgatcggctgccgtcgctgcgcgagcaggtgatcagcagcggcatgagctttatgaccgtcagccatgcctatcagctgctggaaagccaggggcgcatcgtcgcccgtccgcagtcgggttattatgttgccccccagccggtgaagctccgccagccggcgccgcctgcccaggtcactcgcgatgaagccgtcgatatcaatacctatatctttgaggtgctccaggccagccgccaggcgtcgatgctgccctttgcctcggcctttccggacccgcgtctcttcccgctgcagcagctcaaccgctcgctggcgcaggtgagtaaaaccgccaccgccatgagcgtcattgagaatctgccgccgggcaatgcagaacttcggcatgccattgcccgtcgctatgccctgcaggggatgaacgtctcgccggacgagatcgtcatcaccgccggggcgctggaggcgcttaacctcagcctgcaggcggtgaccgagccgggagactgggtggtggtggaaaacccctgcttctacggcgccctgcaggcgctggagaggctgcgtttgaaagcattgtcggtagccactgacgtcagggaaggcattgatctgacggcgctggaggcggccctgcaaaactatccggtgaaggcctgctggctgatgaccaacggccagaatccgctcggcttcaccctcagcgctgaaaaaaaagcggcgctggtggcgctgctgacgcgctataacgtgatgttgatcgaagatgatgtctacagcgagctctattttggccgcgaaaagccgttaccggcgaagttctgggatcgccaggagatgacgctgcactgcagctcgttctcaaaatgtctggtacccggctttcgtatcggctgggtggcggccggcaaacaggcgcggcggatccagcagctccagctgatgagtacgctttccaccagttcgccgatgcagttagccctggtggattacctgtccaccaagcgctatgacgcccacctgcgccgtctacgtcgtcagctggcggagcgtaaacagcaggcctggcaggcgctgctgcgccatctgccgccggaggtcatcgtccaccacagcgacagcggctactttctgtggatcgaactaccggaaggggccgacgctagtgcacttagcgcccgggcgctggcgtcgcacatcagtattgccccagggaaaatgttctccacctccgacagctggacctcgtttttccgttttaataccgcctggggctggggggaacgcgaagagcagggggtgaagcgcctgggggagcttattcgcgaacagcttgcctga

SEQ ID NO: 2654 - DNA, 276 bp, Klebsiella pneumoniae
atgagcgtaatgatagaaactatcacggttagcctgggcagaaaagcgactctctgcccgccctggcctatgccgctgcgcctgccgggtaaccctgttggcgatgcacactctgtgatcaaaagcgactacccgttctggcattgctgctatgctgttgaaataaaattattattaaaggcagcatcgcttctgttggttaaactgcgcgcaaagtcaccctcagagggctttactgggcgcataaccgactatacttggcgcgctcgcgcgtaa

SEQ ID NO: 2655 - DNA, 369 bp, Klebsiella pneumoniae
tttatatcaatacctgttcgatcgttaaaatgcattttacagcgcgattattttagcagggtgaatacgacattggttttacgattgggatatttatttagccgacccgcaagtctgtggggatggctgatgtgtaatgcgtttaacggtattgcgattgtcctctgctttcgtggcataagcagcgtcaccggtttcagcgaggcgatctggcaggtcatcatcacgctggctattatcatatcgacctggtacaacgctaactattttgctgcgctggaagctcgacgcgataaacgacgctatctgctgctggcctgggtggtcatgaccattctgttgaattttattcaccttggcggtggttaa

SEQ ID NO: 2656 - DNA, 1179 bp, Klebsiella pneumoniae
attcaatcaattactaccaaggagaaacgcgtggcgacgatacacagcacaatcatcagcggggctggcgcctcatcggccctgctcccgctgctggccggtaaaacctcaatcctgctggtgaccgacaagaacgtcggggcgctggaggcaacccaggcgattcatcgcctgctggcggctgaagggcgtgaagttgaggtcattgacagcgtgccagcggagcccaaccatcacgatgttacgcagatcgtcagccagctgggcgccagccagccgcagatggtcgttggtatcggcggggggagcgtactggatgtagcaaaactgctgtcagtacttctgcaccctgaggcgccctcgctgacgtccctgctggcaggcgagcagccgcaacgacgaatttgctcattgttaatcccggctaccgcgggcaccggatccgaagcgacgccgaacgccattctggcgatccccgagcagcagacgaaggtggggatcatctccccggtgctgcttccggactatgtcgccctgctgccggagctgaccactagcatgccgcccagcatcgcggcgtcgaccggaatcgatgctctgtgtcatctgctggagtgctttacctccaccgtcgccaacccggtgagcgataacgcggcgttaatcggtttacacaagctggtacgccatatcgagcgttcggtaaatcagccgcaggatctgacggcgaaactggagatgctctgggcctcgtggtacggcggcgcagcgatcaactatgccggcactcacctggtgcatgcgctctcctatccgcttggcggtacctggcacctgccgcacggggtggccaacgccattctgctggcgccctgcatgcgggtggtccgccctcacgcggtggcgaagttcgctcaagtctgggacctgatccccgatgcagatcgcacgctcagcgcggaagagaaatcccatgcgctggtcgcatggctggcggcgctggtcaaacgactgccgctgccggacaacctggccgcgctaggcgtgcctcaggagagtatttccgccctcagcgcagcggcgcaaaacgtcaaacgcctgatgaacaatgccccatgcagcgtcagccgcgaagagatcgcggccatctaccaaacgctgtatccagaacatgcctaa

SEQ ID NO: 2657 - DNA, 708 bp, Klebsiella pneumoniae
ggagcgccaatgttacaggtgagtcagctacatcaatactacggcggcagccatattttacgcggggtggatttttccgcccgccagggcgaagtcacctgcctgctggggcgcaatggcgtcggtaagaccacactgctgaaatgcctgatggggctgatcccggcgcgcagcggtgaggtacgctggcaggatcagaacatcacccatcgcaaaccgcaccagcgggtgcaggccggggtcgcctacgtcccccaggggcgcgagatatttccgcgcctgacggtggaagaaaacctgctgatggggctgtcgcgctttcccgcccgcgaagcgcagcaggtgccggaggagatctaccagcttttcccggtgctcaggaccatgaagcagcggcgaggcggtgacttatccggcggccagcagcagcagctggcgatcggccgcgcgctggccagccgcccacagctgctgatccttgatgaacccaccgaggggatccagccctcggtcatcaaagaaattggcgaggtgatccgccagctggcgagccgcggagacatggcgatcctgctggtggagcagttctatgactttgccgccgggctggcggaccactacctggtgatgtcgcgcggcgccatcgtccagcaaggcaagggtggtgatatggagagcgacggcgtgcgcgccatggtgaccatctga

SEQ ID NO: 2658 - DNA, 780 bp, Klebsiella pneumoniae
ccaggcacaatcgcgggagagatcatggcaaccttgcagtgggaccacgcagtacagtttgtgaatcagccggaagcggcgattgaaatctttgccgggcagcagctgcgggcggtggccggagggcggcatccggggtggggaacccgcaatgcgctgagctattttggcctgacgtatatcgaattcctcgccattgccgacccggacgaactgcgcgccgcgacggacaaattcctcctttcgcgcgacgccgcacggctgctgccggagaatgaggcgctgtttcgggtggcgctgcgcagcgacgacatcgacgccacccatgaccagttgcgtcatacaggggtgacagtgtcacctattgtcgatggccagcgcaacgatccgcagggcaatatcatccgctggcggatcttcaccatcgatggcgacactgccgggctggtctatccctttgtgctgcagtggggagaagacgacgccacccggctgacgcggctgcgcgcccagaggctggacgcgccgcatccgctgggcgacattgcgctcgagcaggcggtgttcgaggtggtcaatccgcaggcggtgcgcgatcgctggcaggcgctgctgggctttccgccactgggggagcagggactggacgtgggcggccagcaatttatcttccgtgaaggggctgccaaccagctgaccgaactggtgttccgcgtcgccaacccggcgcttaaggggcagcgctttcgtgtcggcaacggcgtgtatcgctttacataa

SEQ ID NO: 2659 - DNA, 282 bp, Klebsiella pneumoniae
  unsure (147): Identity of nucleotide at the above locations are unknown.
cgaacgacaatttctgacttaccggggtttaatatgcaaattagcgataccggccgcagccacactcctgactttcacgccgtcctcgcccgtgaagagctggctgagaaccagagcatggcccaccttaaccgcctgccagcagcnatcccgttttcgccagctggcgcgatgagcttgccgcccgcgataacctaccttcatcccgccgccgtcaactggacggcgagtggcagttctcttacgcccgcagcccgtttgccgtcgatgcacagtggttga

SEQ ID NO: 2660 - DNA, 705 bp, Klebsiella pneumoniae
atgaaagcaattaaaaacaaaggacaggataagaccatgaatgaaacaacccatcgttttgcacgtttagttgatctgagcgcagttcaggccaccagtaccgaagcggatgttcgcgcctgcgccgagctggctgccagatacaacattatttccgtccacgtactgccttgctggacgcgctttctcagtacgttgctgccacagcagggtacgggagaggtgatgattggcggtccggtcggctttcccggcggtgggcataccaccgataccaaggttcaggaagtgcggcagctgattgccgacggcgctcgggaagtggatatggtcgtgaatatcggcaaagtgctctccggcgattatgactatgtgcgcgaagatttgcgccgcgtggtggaagccgccgccccggtaccggccaaagtgatccttgaaacgcactatcttaatgaggagcagattcgtcgcgtgtgcgaaattgccgtagaggtggggatgaagtgggtcaaaacctctaccggctgggcgcccaccggcgccacggtggaaaaagtcagcatcatcgccgaccagcttaaaggcccgaatcgatatcaaaggcgccgggggcattcgcgatctgtccacggtgcgtgcgctgtaccagcttggcgtgcgccgctttggcatgagccatggcgcggtaaccaaggtgctggctga

SEQ ID NO: 2661 - DNA, 486 bp, Klebsiella pneumoniae
acggcggcaatatgcaaatcgcctttatcgctccgctcctgtgctttgtgtatgtcgctttctacggcttctggtgcgtgcgtaagggggtataacatgcgcgaacttatcaacacgattgctcatattggctatcaggtcagtgacttaacgcgttcgcttgccttctatgaaccgctgggctttcagcgccagcagcggtttagcaagccatcgccacagggcactattgaagttgcgttcctggaaatggcgggcgccgtcctcgagctgtatcagcttcccgctggaacgccctttgacgcccctcgctgcggtatcgatcatctggcgctggaagtcagcgacctggatgcggtgcagcagcggctggcggcgctcggttatccgctcgatgaagggccgatagaagaagacaacgtgcgcttcctgcttattcgcggccccgatggcgaacggctcgagttcgatgcctgtaaacgctaa

SEQ ID NO: 2662 - DNA, 225 bp, Klebsiella pneumoniae
ggtaataaaatgaagttgacgccagtgtttattaagcgctgtcatcttgtcgccgccgttatgtgggtgggtctggcgataccctcgttaatctggtggaaagacagcgtactgtgggtcattctcatcagtatttatgccaatattgttggccatttatccggatatagcgcagcgcgagctgaccaggcggcggaagagagtgaagattccacgtcaaaataa

SEQ ID NO: 2663 - DNA, 783 bp, Klebsiella pneumoniae
ggagacaaaatgcgttttaccgataaagtcgtcgtcatcaccggcgcggcgcagggcattggccgccagacggcggagcaggcggctgcagaaggcgcggctctgctgctcatcgatcgctcgtcatacgtccatgagctggcggcgacgctggcgcaatccggctgtctggtgctggcgctggaggcggatctggaagcgtgggaaagtaccgagcaggcgtttgccgccggggtcgctcattttggccgtatcgacgtgctgatcaacaacgttgggggcaccatctgggcgcgcccctttgccgaataccagccggagcagattgagaaagagatccgccgctcgctgttccccacgctgtggggctgccgcgcggcgctgccatggatgctgaagcagggcaaaggcagcatcgtcaacatttcatcggtggcgacggcgggagtgaatcgggtgccgtactcggcggcgaaaggcggcgttaacgcgctgacccggtcgattgccatggagtacagcggtagcggtattcggattaacgccgtggccccgggcgggaccgaggcgccgccgcgcctgacgccgcgtaacgaagagcagccgagcgagcaggaaaaggcgtggtatcagcaggtcgtcgatcagacggtggcgagcagtctgctgcaccggtacggcacgctggcggaacaggcgaatgcgatcctgtttctcgccagcgatgaggccagctatatcaccggcgtgacgctgccggtagccggaggcgatctcggctaa

SEQ ID NO: 2664 - DNA, 354 bp, Klebsiella pneumoniae
cccgaaaaaatgctgaatataagcccgctggtcgggcttttttgcatggtgctcgccatccacgccacaaaatgccaaggacatcccgcgctggattgtatacgatgtatatacgaatcattacggtatatatctatgggaatcgtcaaaatctccgatctgctgcacgatgatattcgtgatgccagcaaagccatgtcccgctccgtcaatgcccaggcggaatactggatccgtctgggcatgatgagcgaactctaccctgagcttaaccaccagcagatcaaactgctgatgctgaaatccggctctgaccgtctgctggaggtgatcaatgccatcaataatcattaa

SEQ ID NO: 2665 - DNA, 1017 bp, Klebsiella pneumoniae
gcctgcgaaatgtcttatcgaatcagtattctggataaaagtccgcttgccgccggggaaaccgccgcgcaggcgctggcgcgtacattaacgctggcgcaacacgctgaagcctggggctaccaccgcttctgggtcgccgaacaccacaataccgatcagctggcgagcccctcgccggagctggttatcgcctggctgctgggccacacccggcggatccgtcttgggtccggcggcgtcatgctccagcactatagcccctataaggtcgcggaaaactttaacctgctggccgccctcgcgccgggccgcatcgatctcggggtcggcaaggcgcctggcggcctgccgctctccacccgcgccctgcagcagggcctgcatcaagaggagaaagggacctttgccgatcagctggcgcagctggataactggctgtcgctgactgagcccgggggagaggagagcctacgcgccacgccgatcccgccgcgccgggcagacggttttctgctcggcgccagcctggagagtgctgaactggccgcccgccttgactggaactttgtctttgccgcccatctcaatggcgacagcgcgctgcgccgtgccgtgttcaaccgctggcgcgagctcagcccgcgtgaggcgatggtcgccgtccaggtggtggttgctgacgatccggccaccgccgccgcgctggcgcagcaggtcgaggtgtggggcgtcgagctggagaacggccagcgggtgaccgtcggcagtgaggcgcaggccgtcgcttttgcccgccaggccggcagccgaccgacgcgcattgcccgccgtgaatcttcgctgatctccggtactcccgaacaggttaaaacccggcttgacgcgctgcaggcggaagaacagttggatgaactcatcattgatacccccattagcgacgggccagcgcgcctgcactctctgcgcctgctggcgcaggctcactacggcaaggaggtgctgaatgtcctttga

SEQ ID NO: 2666 - DNA, 441 bp, Klebsiella pneumoniae
ccgccgcccttgatgccgcgctgttctgtttcccgccaggggccgatgggcaaccggcctgtcccgccgaggtggcattcaaccccggtgttttatgaaaccctgatgctggtccgtccgcagaccccgggtccgctgcggttcgcggcatttgccagcggctgcagctaccgcgcgctgggagaacgctggctggcggaacagcaggcggccgtcgaggtgcatgaggtcaattcctatcacagcatgcttgcctgcgtggcgtccgggcgctacgcctgcctgctgccgcagagcgtgctgtcgctgatgacgcttcccgaaaactgccttagcgaaccgctgtgcgaggcgaccacccagcttatctggcgcagcggcttgagcgcccccgccctgagcgagtggcgcaagctgctgcaaagcgtggcgattggctaa

SEQ ID NO: 2667 - DNA, 1218 bp, Klebsiella pneumoniae
tgctggggaatctggcttccgatgtcgcccccagcgtggcgatccttgaccgcctgccggcctctgagcggccacaatggctgccaaagctggcgcgcggcaattatcgctatctgctggacgtcggggagcgcggcgattacccggacagctggcgcgcccgggacgccggcccgctccctgcaggaggcgctgagcgcgcagtatccggtaagtattgtggcgatccccggcccgcggcagcatattcaggcccgtattacccttcgcgacggcgcgccgttgaccctcgacctgtggccgaacctaccggccatcgcccgctggctgccggtggtgctgatcgctcagtttgtcctcctgctggcctgcgcctggtacgcggttcgccaggtattgctgcccatctcccgctttacccacgcggtaaatgccctggagccggccagcgacacggcgggaactatggccgagcaggggccggaggaggtgcgtcgcgccgcccgcgcgtttaacgcgatgcaggcgcgcatccacgatcatctgcaggagcgagcgcggatccttgccgccatctcccacgatctgcaaaccccgataacccgaatgaagctgcgggtggagatggccgaccagccggaactgcgcgataagctactgcaggatctcgacaatatgacccgtctggtgcgggagggcatcgccttcgcccgcacctcgcagccgctggaggaggcgcgacagcggctgaatctcgatgcgtttctcgacaccatcgtctgcgattatgccgatgtcggccggccggtccagttttgtcccgaagagaccgccggggtggtgtggatcccgccgcaggctctgcgccgggtgatgaccaatcttatcgataacgccttgaaattcggtacgacggccacggtaaccctgacccgtgacgccgtgggggatatcacccttcatgtgctggatgaggggccggggatcccggaggcctcgctgcaggcggtgctgcagccgttttatcgcctggaggactcgcgcaatcgcgataccggcggcaccggcctggggctggcgatcgccgcgcagctggtcagccagatggacggcgcgctgcgcctggccaaccgcccgcagggcggcctggacgccagcgttcgccttgccgcggcgggattgtatcctgttgtatctccgggaaagacggataactaa

SEQ ID NO: 2668 - DNA, 657 bp, Klebsiella pneumoniae
gagaatctgatgtccgagaacgctcaactgaatggtctatgcggccgtttccgcggtttttatccggtggtgatcgatgttgaaaccgcaggatttaacgccaaaaccgacgccctgctggagatcgccgccattacgttgaagatggatgagcacggctggctgatgcccgatgaaacgctgcatttccatgttgaacctttcgagggcgccaatctgcagcccgaagcgctggcttttaacgggattaacccgcatgacccgcagcgcggggccgtcagcgaatacgatgccctgcatgccatcttcaaaatggtgcgcaaagggatgaaagagagcgactgcagccgggcaatcatggtggcgcacaatgccacctttgaccacagcttcaccatgaccgccgccgaacgcgcgggacttaaacgcaaccctttccatccgtttgttaccttcgacaccgccgcgctaagcgggctggcgctgggccagacggtgctgtcgaaagcctgtattgccgcgggtatgccgttcgacggcgcgcaggctcactccgccctgtatgataccgagcagacggcgcagctgttttgcgagatcgtgaaccgctggaagcgtctgggcggctggccgctgcccgtagccaccccggagtga

SEQ ID NO: 2669 - DNA, 186 bp, Klebsiella pneumoniae
ttatggatgattatccggttatataacaaacaactagttcattcattttttatcagcgcaaaatttctatgcatttgtgatccagatcatgctcgcaactttatgttgattgaatgttactggaatggaaataaatgtcaggcaatacaacggatgagtaaagattgtcaggataatgacccatga

SEQ ID NO: 2670 - DNA, 2115 bp, Klebsiella pneumoniae
gtattatcgatgaaaatcctgtccgtgcgtcacgccgccctcccggccctgctcttgccgctcattgccgcagcccaggccgctgatgaacaaaccatggtggtgaccgccgcgccaaccacggtttctgaactggatacccccgccgccgtcagcgtggtgaatggggatgagatgcgccaggccgcgccgcgcgtcaatctctctgaatcgctgggcgccgtgccgggcctgcaggtgcagaaccggcaaaactatgcccaggatctgcagctgtcgattcgcggctttggctcgcgctcaacctatggcgtgcgcggactgcgcatttatgtggatggcattccggccaccatgcccgacggccaggggcagacctcaaatattgatatcggcagcgttgacaccattgaggtgctgcgcggccccttctctgccctgtacggtaactcgtccggcggggtgatcaacgtcaccagccagaccggcacccagccgcccaccgtggaagccagcagctactatggcagcttcggcacctggcactacgggatgaaagccactggcgccgttggcgacggcagccacgcaggcgatgtcgattacacggtctcaaccaatcgcttcaccacccatggctatcgcgatcacagcggcgcgcgcaaaaatctggcgaacgcccggctgggggtgcgcatcaacgacgtcagtaagctgactctgctgctgaatagcgtggatatcaaagccaatgacgccggtggcctgaccgccgatgaatggcgcgataacccgcgccagtcgccgcgcggcgaccagtataatacccgcaagaatacccgacagacccaggccggcctgcgctatgagcgccagctcagtgcccaggacgatctcagcgttatgatgtacgctggagaacgtgaaaccacccagttccagtcaatcccgcgcgcgccgcagctgaagccgagccatgccggcggggtgatcgaccttacccgtcactaccaggggatcgatacccggctgacccatcgcggagagctgctggtgcccgtcacgctcaccgccggtctcgactacgaaaacatgagcgagcggcgcaaagggtatgaaaactttgtgatggtcaacggcgcgccacagtatggcgaacagggcgcgctgcgccgtaacgaacgcaacctgatgtggaacgtcgacccctacctgcagacccagtggcagctcactgacaaactctcgctcgatgccggggttcgctacagctcggtatggttcgactcgaacgactactacatcaccccaggcaatggcgatgacagcggtgatgccagctatcacaaatggctgcccgcgggctcgctgaaatatgccctgaccgacgcgtggaacgtctatctttccgccggccgcggcttcgagacgccaaccattaacgaactctcctaccgctccgataaccagagtggcctcaacttcggcctgaaaccctccaccaacgacacggtggagatcggcagcaagacgcggatcggcaatgggctgttcaccgccgccctgttccagaccaataccgataatgagattgtggtcgacagcagcagcggcgggcgcaccagttataaaaacgccggcaagacccgccgtcaggggatggagctggggctggatcagcagtttggcgagagctggcgtctgaaggcggcctggacctggctggacgcgacctatcgcactaacgtctgcgacgacgccagctgcaatggcaatcgcattccggggatcgcgcgcaatatgggctacgcctcctttggctatcagccggagcaaggttggtacgccgggagcgatattcgctatatgagcgatatcatggccaatgacgaaaacaccgccaaagcgccctcctggacggtggttggcctgacgaccggctataaatggagctacggcaggatggatatggatctgttcggtcgcatcgacaacctgttcgaccgggagtacgtcgggtctgtcatcgttaacgagtctaacggacgttactacgagcctgccccgggacgtaactacggcatcggcatgaacctcgcctggcgcttcgaataa

SEQ ID NO: 2671 - DNA, 282 bp, Klebsiella pneumoniae
tccggcgcgatggatgacaacaggttgccgacggtgaagatccccatcagaaaaatcagcgcattgcgccgtgcgcgatgcgacaatagcagcgtcatcagcggtgcgccgaccatgacgccgatggcatacgcactgatcagcattcccgctaccggtatcgagacgtccacacctttcgcaatcaccggcagcaatcccatcggggagaactcggtggtaccgatgccaaaggcgccgatcgccagcgcaagtaaaggaaagttgattttcattcaatga

SEQ ID NO: 2672 - DNA, 753 bp, Klebsiella pneumoniae
acgcgggcgatagccgcggcgacggccgctttgcgcgggtcgtcattggctgcggctgacgcgagatcctgttgtgtggcctgctgttcggctttacgcgctttggcgcgggcgatggcggcttccaccgccgccttgcgcgggtcgaccggttcgacggccggggcttccaccggcgcggcctgctgttcggctttacgcgctttggcgcgggcgatagcggcttccaccgccgccttgcgcgggtcgaccggttcgacggccggagcttccaccggcgcggcctgctgttcggctttacgcgctttagcgcgggcgatagcggcttccaccgccgccttgcgcggatcgaccggttcggcggccggggcgtccaccggcgcggcctgctgttcggctttacgcgctttggcgcgggcgatagcggcttccaccgccgccttgcgcgggtcgaccggttcggcggccggggcttccatcggcgcggcctgctgttcggctttacgcgctttggcgcgggcgatagcggcttccaccgccgccttgcgcggatcgaccggttcggcggccggggcgtccaccggcgcggcctgctgctgcgctttgcgcgcccgggcctcagccttacgcgcttcgcgggcggcaatcgcctcgctgttgtcaggtttggcgccggcttggatcacgatcggctgcgcggcatcgcgctgtttatcccgtacccgggccagggcggcgctaatcgcctcctga

SEQ ID NO: 2673 - DNA, 255 bp, Klebsiella pneumoniae
ggacgacagatgagtaatgacatccccctgaaattttatgacatcgtggacgaatacgagaccgaagcggctgcgccggtaaaggatgaagaacgcgatgcgctggcgcgctatttccaactgctgattgcgcggttaactaataacgaagagattgacgaagaggcgcagcgagaaatggcccgcgaggcggccattaacgaagaccgcattgacgatatcgctaatttccttaatcagtggggcaacgaataa

SEQ ID NO: 2674 - DNA, 987 bp, Klebsiella pneumoniae
gtgtctaagatgattgcagtgacaatgggcgacccggcagggattggtccggagattattatcaaatccctcgccgagggggcgctgagcggcgcgccggtggtggtggtgggctgcgcgcaaacgctgcggcggatcctggcgctaaatatcacaccgcgtgcggagctgcgcattattgaccatcccgccgaggcgagtttctccccagcgaccatcaacgtcattgatgaaccactcagcgacccgcaggggctgcgccctggcgaagtccaggcccaggcaggggatctcgcgtttcgctgcatcaggcgggcgaccgcgctggcgctggagggcgcggtcgcggccatcgctaccgcgccgctgaataaagaggcgctgcatctcgccgggcacgcttatcccggccataccgaactgctggcccacctgacgcagactaccgattacgccatggtgctctataccgagaagcttaaggttatccatatcactacccatatttccttgcgccagttcctcgataccctcaaccagccgcggattgagacggtgattggcgtggcggatcgctttctgcgccgcgtcggctatccgcgtccgcgcatcgcggtcgccggcgttaacccgcacgccggggagaacggcctgtttggcgatgaagagatccgtatcgtcgccccggcggtcgccgccatgcgggcgaagggagtggaggtgaccggcccctgtccgccggacacggtgtttatgcagtgtcacgaaggcatgtacgacatggtggtggcgatgtatcacgaccaggggcatattccgctgaagctgctgggattctatgacggggtgaatattaccgccgggctgccgtttatccgtacctccgcggatcatggcactgcgtttgatattgcctggacaggtaaagcgaagtctgagagcatggcaacctccattgagctcgccatgcacatcgcgcaggaataa

SEQ ID NO: 2675 - DNA, 756 bp, Klebsiella pneumoniae
tcatcaaagatattacaggagcttaacctcatgcgtgtacactttatcgtacatgaaagttttgaagccccgggcgcatatgaaacctgggcaataaaccagggtcatgatgtaacttactcacgcgtctatgcaggcgatcggctacctgatgacgccgtaggcatcgattttctagtcgttatgggcggtccgcaagatccggacaccacgcttgaagcgtgcccgcactttaatgctaaagcggaacaggcgctgattgcttccgcggttaaaaccggtaaggcggtgatcggtatctgcctgggttcacagctcattggtgaagcgctgggcgcgccgttctctcatagcccggaaaaagagattggtaaattcccgatcacattgaccgaagacggcaggaaggatgagatgttctctcactttgggaaaacactggaagtgggtcactggcataacgatatgccaggtttgacgccagaggccaaaattattgcttacagcgaaggctgtccgcggcagatcgttgcctattcagaccgcgtctttggtttccagtgccacatggagctcacattggacgttgtagaacggctgatcgctcattctgagaaagacctgagccgtgcagcagaatatcgtttcgttgacacgcctgaagcgctccgggcgcacgattacagtgaaatgaatcaagtactttttggctttttggataagctggaagcacgttacaaagcagcgcaagcataa

SEQ ID NO: 2676 - DNA, 1074 bp, Klebsiella pneumoniae
  unsure (743),(744),(745),(746),(747),(748),(749),(750),(751),(752),(753),(754),(755),(756),(757),(758),(759),(760),(761),(762),(763),(764),(765),(766),(767),(768),(769),(770),(771),(772): Identity of nucleotide at the above locations are unknown.
ggagaaaagatgccgcgtcgtaccgcaaccctggaggatgtcgcccgcgccgcgggcgtgtcccagcagacggtctcccgggtgctgaaccgtcctgaggtggtgtcagcccgcacccgcgagcaggtgatccgcgcgatgcaggcgctgcactatgtgcctaaccgctcggcgcaactgcttgccggcaaagcggcgccctccatcgggctgattaccgcctcgctgacgctgcacgccccctcgcagatcgccgccgcgataaagagccatgccagcctgcatcagctggaagtggcgatagcgatgccggcgcaggccgattttatcgcgctgcaggcccggctggacgagctgcgcgcccagcatattcgcggggtgatcgtcagtctgccgctggagagcgccactgccgagcggctggtgcaagacaatccggatatggcctgcctgtttctcgatgtctccccggaggccgatgtctgctgcgtgcgcttcgaccaccgcgacggctgcggggcctgcgtgcgccacctgtgggagctggggcatcgcgaatttggtctgctggcgggaccggaaagttcggtttccgcccgtctgcgtctcgccagctggcgcgaggcgttgcacagtctgaatattgcccgctctactacggtgtttggcgactggagcgccgccagcggttggcagaaaactttcgagctcctccacctgcagccgcggatcagcgccatagnnnnnnnnnnnnnnnnnnnnnnnnnnnnnntgctcagcgcgctggcccagctcaatcgcagcggcagccaggcggtatcggtgaccggctacgatgacaccgccgacagcctttacttccagccgccgctcaccacggtggcgcaggacttcgatctgttgggcaaaagggcggtggagcggctgattgccctgatggcggccccgcagctgcggatccgcgagctgctgccgacccggctcatcgtgcgccagtcggcctggcctgtcgccgccgcggaggaccggcagcagaccctggcgcagctgaaagcgctggtggagaagctttag

SEQ ID NO: 2677 - DNA, 204 bp, Klebsiella pneumoniae
ggtgaatggatggatttcttgaaaagatggttaaaagaagaattcattctttttttatggggatggggtattgtattattaatcattatatttagcatgattgcagtctctctttttcctgacattgccattaacttaataggactttttgttttattaatcattgggtttcacgttgtcgtttggtttaaagttaaaaactga

SEQ ID NO: 2678 - DNA, 510 bp, Klebsiella pneumoniae
ggagtcaggatgatcgcgctgagtcagtttaacagcctgagcaaagatgaggcggcggggctgctggccccttgcgtggcgatcccggcctggggcgagatgctggtgagcttacgacctttcgccagccgccatgcgctgctgcaggccgcccgggaggcgatggctaactggggagaggacgagctgaacgcggcgctcagcgcccatccgcggatcggtgaaaagccgaccggcagccaggcgcacgcggcgctgtcgcgccaggagcagtcgtcggtggacagcgagaatgagcggctcgcgcaggccctgcgggagggcaatgcccgctacgaagcccgctttggccgggtgtttttaatccgcgccaaagggcgcagcggcgaagagatgttgcaggcgctgacgcgccggctgcagcataccgccgacgaagaagtggccgaggcgcttgcccagctgcgagagattacgatgttaagactggaaggagtgattggcgaatga

SEQ ID NO: 2679 - DNA, 654 bp, Klebsiella pneumoniae
aacaacaggatgattgagcccatgcttcgatacgagttaacgccgaacaatgcaggttttatactgtggggagattcagaagccctgaatgaattacatgaactcattcattacatcgtggatgaaagcccactgattaaagttaaagacggatttatgttatcccttgcctatgatattcgtaaagcacgggaaggtaatcgtcgtgttgagcaacatcagtatgatcaacatgatacatataagctttatggtgttgagcttttatggcctctggtcctggtacagtcctcaatactcagaaactcaatgggttatattcagacagacaaaaaccagctgtctgtcatgtatgcctttgaatacctgatagaatcagcattaacagagtctgagagaacaacgtcgaatgatattatgctaacagtaaaatatgcatcagactctgattttaatttcattgaggataatattgacagcaggtgctgctattttatcagcctatctccggagcaaagaaaaaagcagttaatcagtattgttcgttcttttcattcattatggggtaagtatgcccgtgaaaagcaggacataaagatgctgaacgaaatgaataatacatcatgggtctggccggacaatatcaactggtga

SEQ ID NO: 2680 - DNA, 609 bp, Klebsiella pneumoniae
gaaggaaggatcatgacaaagcgtgacgcggattattttagtcaaaaatacagcctgacccgcacccattccgaggtgctgcatgccgcgacgattgtgccgccggggcgggcgctggatctgggctgcggcaaggggcgtaacagcctttatctggcggcgaacggcttcgcggtgacggcgtgggataaaaatccgatgagcctcaacaatctggaaagtattcgcgccgccgagcgactggataatctgcaaacggcggtgaaagacctcaacagcctgagctttgatggcgagtatgacctgatcctctccaccgtagtgatgatgttcctcgagcctgacaccatcccgggcctgatcgccaatatgcagcgctgcaccgccgccggcggctataacctgattgtggcggcgatggataccgaagactatccctgcaccgtcggcttcccgtttgcctttaaacctgatgagcttcgtgattattaccagggctgggagctgctgaaatacaatgaggacgtcggcgagctgcatcgcaccgacgccaacggcaatcgcatcaaattgcgcttcgccaccctgttggcgcgcaagcctgcctga

SEQ ID NO: 2681 - DNA, 675 bp, Klebsiella pneumoniae
ggtctggggatgacggagcaacttcatttctctgagctctggccgcactggccggagctgctggccggcctgtgggtgacggtgcagttgacggtgctggcgacgatcggcggactggcgatcggcatccttggggcggcgatccgcagcggtcgcccgggaatgctcagccgggtatggggcggatatgtggaaatcatccgtaatacgccgtttgtggtgcagctcttttttatcgtctttggtttaccgaacctcggactgaagatgaccgccggtgaagcggcgctgctggcgatggtggtcaacctcggcgcctatagcaccgagatcgtccgcgccggcatccaggtgacgccgaagggccagtgggaagccggtcgcgtgctcgggcttagccggacgcaaaccttcgttcgcgtcgtactgcccccggcgctgcagcggatttacccggcgctggtcagccagtgcatcattgtgatgctcggctcgtcagtggtgtcgcaggtctcctatgaggagctgaccttcgccgccaatctgatccagtcgcggacatttttgagctttgaggtctatctggtgaccaccgggatctacttagcgttatcgatagcgatgcgccagctgctgatggcggcggggcgtaaatggctgggggtacaggcctga

SEQ ID NO: 2682 - DNA, 1413 bp, Klebsiella pneumoniae
cccatgcacttctctttgctacgggatatcactatgtctgacgaacatcacagtggcctgctttacggccttgaacagcggatcccaccgcttccggcctttttcagcgctctccagcatgtgctggcgggcctggtggggatcatcacgccgccgctgatcatcggcgctaccctcgggcttggcgactggctgccgtatctcatcagtatgtcgctgctggcctcgggcattggcacttttctgcagtccaatcgggtatggggcatcggcgccgggatgatctgcatgcagggcaccagttttgccttcctcggcgtgacggtggccggagggatgtgggtaaaagcccagggcggcgggccgcaggatatgatggcgatgctgtttggcgttaactttgtcgccgctctggtgccggtgattgtcagccgctttatcgaaccgctgaagaaaatctttactcccatcattaccggcagcgtgattgcgctgatcggcatcagcctgatcaaggtcagcgtcatcaactggtgcggtggggaaaaggccgaggatttcgccagcatgagcaatatcgcgctcggggcgggcaccctcggggttatcgtcctgctgagctgcgccaaaaaccgctggctgcggctctcctcggtggtggtgggcattgccgtgggctgcatcgcagcggggctgagcggtcagttccatcttcacagcctgggcgacactctgtttcgcctgccgacgctgtttccgttcggctttcagtttaacagcgcgatatttctgccggtcgccctggtgtcgctggtctgtattctggaggcggtgggcgatctgacggccaactcgctgatttcgcaacagtctgttgacgatcgcgcttttcgtaaccggctgaagggcggtatcctggcggatggcgtcagctgtatggtggcggccatgctctgtgcttttccgaacaccaccttcgcgcagaacaacggcgtgatccagatgaccggggtggccagccgctatgtcggacgctacattggcgtgattctgatcctgctcgggctgttccccccggtgggcgaactgctgcggcagatcccggcgccggtgctggggggcgccacgatggtgatgtttggctgcgtagtggcggccgggatccggattattacccagactccgctgactcgtcgcgatgtgctgatcgtggggctggcgtttggcgcgggtcttggcgtggagtcggtgccggcgtttctcagccattttccgccgatggtcggcgatctgttcggttcggcagccaccagcggtgggctggtagcgatagcgctgaaccttattctgccgcaggagcaggcggcgacgaaatcgttaaggagtcaggatgatcgcgctgagtcagtttaa

SEQ ID NO: 2683 - DNA, 1422 bp, Klebsiella pneumoniae
atcaattttgttgtggagtcctgcatgttcggtcttgatgcattccatctggcgcgagttcaattcgcttttacggtctcatttcatattatcttccccgccattactattgggctggccagctatctggcggtgctcgaaggcttatggctaaaaacaaaaaatcccgtctggcgctcgctgtaccatttctggtcgaagattttcgccgtcaacttcggtatgggggtcgtttccgggctggtgatggcctaccagttcggcaccaactggagcggtttctcacagtttgcaggcagcataaccggccctctgctgacctatgaagtcctgacggcattttttctggaagcgggcttcctcggggtgatgcttttcggctggaaccgcgtggggccggggctgcactttttcgccacctgcatggtggcgctgggtactatcatctccaccttctggatcctcgcctctaacagctggatgcagaccccgcaggggtttgagatcgttgatggccaggtcgtgcccgtcgactggctggcggtgatctttaatccgtcgttcccctaccgattattgcatatgacagtagcggcgtttctcagtagcgcgctgtttgtcggcgcctcggcggcctggcatctgctgcgcggcaatcagtcgccggcgatccgtaagatgttctcgatggcgctatggatgacgctgctggtcgcccccgtccaggcgctgatcggcgatatgcatggcctgaataccctgaagcaccagccggcgaaaatcgccgccattgaggggcactgggaaaatccgccgggtgagccaacgccgttgctgctgtttggctggcccgatatggaccaggagcgcacccgctacgggcttgagataccggccctgggcagtctgatcctcacccacagtcttgataaacaggtgccggcgttgaaagagttcgctcctgaggagcgcccgaattctactgtggtgttctggtcatttcgcctgatggccgggctaggcatgttgatgctgctgctgggcgtgctggccctgtggctgcgtcgcggcgaccggctataccactcgcggccgtttctgcgttttgccctgtggatggggccatccggcctgatcgctattctcgccggctgggtgaccaccgaggtgggccgccaaccctgggtggtgtatggcgttcagcgcaccgccgatgccgtttccgctcatggcgatctgcatatgtcggtcagtttattgacctttatcgtagtgtacagcgccgtcttcggcgtcggctacagctatatgctgcgcctgatccgcaaggggccgcaggagatgctcccggcgacaaccggtacgcccgcccgcccgctgtccgccgccactgaaggttatctgcagaaggagtcccgctaa

SEQ ID NO: 2684 - DNA, 1014 bp, Klebsiella pneumoniae
actaattctgtaaaaaagattacttttcaggacatgaaaaagatacttattattgtacccgatggcggtatgctgtttgaatccgccggtattgctgacattctgatgcaggccaaccgcctgcacccggaaggtgcccgggaaatctgctaccaggtcaagctagcgacaactcaaccgcatcaggttatccatggtcagtcaggtttaaatctgctggccgaccatcgtctgcatgagattgaccctcgcgagcccctcgataccatcatgattaccggcagaggtcaaaacccgcaggaggggatggcggtggttgactggttgcgccttgccgctccccatgcccgccgcatagtctccatttgcggcggtgcgatgctgctggcgcaaaccggactgctggacggcagacgggccactacccactggaagctgctggaaaccatgcaggcggaattcccgcagatccgcgtcgagggcgggccgctctatattcaggacgaacatatctggacctctggcggggtcagttccggctttgatcttacgctggcgctggttgaagaagactatggcttcagcctggcgcgcgatatcgcccaggacttcgtcatgtatctgcgtcgcccgggaggccagctgcagtttagccgctataaccttcagcagaccgccacccagggcccgattaacgatctgctggcgtggttgctcgaaaacctcaccgccgacctcagcgtagataagctggcggaaaaagtcgccatgagtccgcgaaatttcacccgcgtctttacccgggaaaccggcgcttcgccagcgcggtacgtcgcggaagcccgcctggccgccgcgcggcagcgtttggagcagactcacgagacgctggatcgtatcgccgagcaaacgggatttggcagcagtattaacctgcgacgcttgtttgagaaacagcttaacctcactccaggtgaatatcgtcaacgatttcactgtcgcaaaatggcgtaa

SEQ ID NO: 2685 - DNA, 1272 bp, Klebsiella pneumoniae
cgaagcgacttcggcgctcgacgtcaccgttcaggcgcagatcctcgccctgctgcagcagctacagcagcagctgggtctgagctacctgttcattacccacgatctggcgacggtcaggcggatcgccgacagcgtcacggtgctgcgcgccggccaggtggtggagcatggcgacgtaaaccgcctgttcgccgccccgcagcaggcctacacccgcgaactgatcgccgccattccccaggtttcctcccgcttagcacaggcccacacggagaacgcataatgccaaaacgcctcggtttttttacccgtctgctcgatcagggctccgcgcaaacgcgctaccggctggcggccgaacagatccgccacgcggagcgtttgggcttcgacagcgcatggattgcccagcaccattttcatgaacaggaaggcggcctgccttcaccgctggtgtttctctcccacgtggcggtgcagaccgaccggatccgtctcggcacggcgattatcactctgccgatggaaaatccgctgcgcgtcgccgaagacgcagcggtactggatttactcaccgacggacgtctggaggtgggttttggctccggcggcacgccaacctcgtttctgcccttcggcctgaccagcgagcagcgcggggcggcgtttgccgaccatctgcacctgatccatagcgcctggcgcggcgacacgctgagccacccggacaaccgtctctatccgccggcgccgcagctggcggagcgtatctggatcgccaccttctcggcggagggcgctatccgcgccggtcaggcgggacacgggttgatgctgtcccgcactcagccacggccgcccggcgagccacgcctgccgctggacgccattcagaacccgatcatcgacgcctacctggcggcgctgccgaacggcgttgcgccgcggatcctcgcctcgcgcacagccttcgtcgccgacagtcacgcccacgccctgcaggtcgccgagcccggtctgcgcaagcaggcaactcagcaccgggcggcgggtcatacgatagaaggtgacagtgtcaccgactatctgcaacagctggatgcccacgttggcgatcctgagcatgttattgcctccctggcgcaggacagcgtgctggcccgcgccaccgatatttcgtttcaggtgcactcggtcgagccttcgcaccgggatacgctgcgttccattgagctgatcgctcagcatattgccccccacatcagataa

SEQ ID NO: 2686 - DNA, 1059 bp, Klebsiella pneumoniae
agccgagctgttagccgaccagattgtctatttatccgcgggccgcgtggccgctgtccgcgccgttacgccaacctcaggggaagttgcatgaacaccgttatgaccgttaagaaaggagtggtactcgcgatggctctctccgccatgatgctctccagcgcccatgcgctgaccgtttacaccgccggacccggctcgctggcgaaaagcctggccagcggttttgaacaacagaccggggtgaaggtgaccgtttttcaggccaccaccggcaaagtgatggcccgactggaggccgagcaggccaacccgcaggcggatgtgctgatctccgcctcgtgggataccgccgaagatctgcaccagcggggctggttgttgccttttgcgagcgccaacgccgaccaggtaccggcgaacctgaaatcggcggactatatcgcccagggcgtctccgccctgggtattgtctggaacagtaaaagcggcaccccggaaccgaaagagtggcgggatctcacccagccggcgtttaaagacaaggtgacaacccccgacccggcgctctccggcgcgtcgctggatttgctgatcgggctgcaaaacagcatgggcgaccaggcctggcaactgtttgacgatctgaaaaagaacggcatggtagtcagcggacccaacgcccaggcggtgacgccggtgatgcagggagcgaaagcggcggtgtttggcgcggtggattatgtctcctacggcaacattcagcagggcgagtcgctgaaggtgatcttcccggccagcggaacagtgattgccccgcgcccgatgatgatcctcaaaaccagccagcatcccggcgatgccaaagcctttatcgattacgtgctgtcgccggaaggtcaggcgaaggtcgccgacgcctggctgatgcccgcccgccgcgacgtggcggctaaacgtccgctactggacgcgctgaaggtgctgcccaccaccagcgagggcagcagcgagcggggcgccgtgctcgcccgcttcagtcagctgtacgcgcagtaa

SEQ ID NO: 2687 - DNA, 828 bp, Klebsiella pneumoniae
tctgattatgtacttcaggagagagctatgttgccgctggaacgtcatcgtttgattgttgaactgctgggccaacacggcgtcatgcgggtgaatgagattgcgcaagcgactcgggtctccagggaaacgattcgccgcgatctgagcgagctggaacgcaaagggatcttaacccgaagccacggtggagcgctggcggcggaaaatccgctgccggcgacccgggcggcggcatccgccctgccagttgaagatagccagggaagctttcagcacagaacgctgctgcacagcgaaggcaaaatgcgcgtggcccgtaaagcactgcagtttctccaaccgggacagaccattgtcctggacgggagtagcaccagctggtttttggcccggcagatgccggagatggcgttgacggtgattacgccctccattcgcatcttacaaactctgatgagccgacgctcgttgcatctcgtcgggctggggggcgatttctccccgaccgaagagtcgttcttcggggaaaccgcctcacgaacgctacgcgaatatgccattgatacgctctttttctcctgccaggggctggagcgcgatagcggcttgtatgcgggtacgcaagcccacgccgccctgctgaaacagatgctgctggccgcccgtcagactgtggctttggtcgacggcagcaagctggggcgaacaggcgtcgcgcgtatcggcggactgggcgagctggactgtctggtgactgaaaggtttgtcgatccgctgctggaaaaagagatgacctggcataacgtcagcctgcaaatcgcctga

SEQ ID NO: 2688 - DNA, 186 bp, Klebsiella pneumoniae
agccaggactttaccgccggaagcgatgtcgggtcagcacatactggtttatcaaagggagtcgtcatgtcattacgtcattttgccgcgccgcgtctgcgccattcactgctcgtcacttctctgctgctggcaggcagctttagcgcccacgccgcggaagagatgctgcgcaaggccgtctga

SEQ ID NO: 2689 - DNA, 930 bp, Klebsiella pneumoniae
ttaactaatgttcacaaggagaccagcatggctgcacacactaacgtctgcgtgattggactgggttcaatgggcatgggcgccgcccgcgcctgcctgcaggcgggcctgaacacctggggcgttgacatcaatcccgacaactgtcgcgcactgctggcggcgggcgccaaaggcgcgggccccagcgcggtgccgttcgccgcggaactggatgcagttgtgctgctggtggtcaatgccgcccaggtgcgggggatcctgttcggcgagagcggcctcgccgcccatctgaagccgggcaccgtcgtgatggtgtcgtccaccatcgcctccgccgatgctcaggccattgccgaggcgctggcggagtaccagctattgatgctcgacgcgccggtatcgggcggcgccgtgaaagcggccgccggcgacatgacggtgatggcctccgggagcgatgccgcctttgcccgcctcgcgccggtgctggacgccgtggccggcaaagtctaccgcatcgggagcgacattggtcttggctcgacggtaaaaattatccatcagctgctggccggggtgcacatcgccgttgccgccgaagcgatggcgcttgccgcccgcgccgggatcccactggaaacgatgtatgacgtggtcacccacgcggcgggtaattcctggatgtttgagaatcgcatgcagcacgtcctggatggcgattactcgccaaaatccgctgtcgatatttttgtcaaagatctcgggctggtgaatgacactgcccgggcgctgaccttcccgctgccgctcgctaccaccgcgctgaatatgttcacctccgccagtaatgccggattcggtcgggaagatgacagcgcggtgatcaagattttcaacggcatcaccctgccgggccataaacagtga

SEQ ID NO: 2690 - DNA, 1707 bp, Klebsiella pneumoniae
atggataatgtcgtttatgcggactgcgtattgattaacggcaaggtcgccacggtggacgcacattttagttttaagcgcgccatcgccgtgaagcagggatggattattaacgttggtgaagaccaggagattcagcagcatattggtccccagacgcaggtcattgaccttggcggcaaactcattttacccgccgcgcatgactcacatatccatatcggctggctcgctgacagctggcattgcctgaactgccaggacgtgcgttccctggcagtactgcgggaaagactgcgcgaccaggcagcccgcactcccgccggggcatggatccgcgtctgcggtctggatccaaacgcaatcaaggagtgcgcggccgagcagcgctctctgacgcgctgggatattgacgacgtcacggccgatcatcccaccctgctcgccctgtgggacggtcactcctgcatcgtcaacagccgggcgctggccctctccggtcttgacgccagcaccccggatcccctcggcggacatctggggcgaacggccagtggcgaactggacggcaatttcatcgacctgcccgccctgcatctcgcatccggcatgatgccccgtctgaccgtagcggccctcaaagagaaccttctggcagcccagcgcctgatgaacagcgaagggtatgccagctacacggaaggcgccatgggtccgggggaaaacacgcgcgaggtgggcgctgcgggggatcgcgccatcgccgcctaccgtgaactgcaggatgaaggaaaactcaccgcccgggtatccatcgccttttactctgccgagcggggggttcaatcctgcgccaccctgaagcgcgatctggatagctttgatttctcccagttcaccgaccgggactggctggactgtcggaccataaaactgttctgcgatggcgttcccacatcgcacacagcgtggatgaatcaggattacgccgaccgaccgggatatcgcggacgctcggtgtttggtggccccgaggcgaccgaggaagcacaagttgaggcgctacagcagatgattctgctggctcaccagcgcggttttcaggtggcagtccatgcggtcggcgataaggcggtaaaagtcacgattaacagcttcgtgcaggcgattcagcgctatccgggggagagccgacggcattatgtgctgcacggctcaatgggcgatcggcaagatttcgtgacggcggcaaaatacggcattctgctttccgaacaaccctcacccggcggcccggcatatgactatgaacagcgcgcccgctactgtggcatcaagggggaaatctgcaaagggctacgggatatcatcgaccttggggtcatcgtcgccggcgggtcagatggcattatggcgctggtgaactggcgcaaaatggttcaggcagcggtcacccgcaaatcatcttccagcggcaacgttattcgcccggaactggcaattagcgtggcggacggcgtgcggatgtacaccatcaatgcggcctatcaggaagggaaagaagcggtacgcggatcgatagaggtcggcaaagtcgctgattttcaggtgctggaccgcgatatcttcgccgtagcccatgaggagattggcgccagccgcgtggtgatgaccatggttggcggaaacgtcgtctttcaagactaa

SEQ ID NO: 2691 - DNA, 882 bp, Klebsiella pneumoniae
gctataaatgtcggacacctacagctggaggccctgatgagtccctttttacgcgcctatttttcccgtctgagctggacgggtgagcctgatgtttccattgataccctgcgggaactgcatctgcagcataacagcgccatcccctttgaaaacctcgacgtcctgctgccgcgtgaaatccaccttgacgatggggcgctggaagagaagctgatcgccgcccgccgcggggggtattgttttgaacagaatggcctgctggagcgcgcgctgcgcgagataggctttaacgtccgcagcctgctgggccgcgtggtgctggccaacccgccgcagatgccgccgcgtactcaccgtctgttgctggtggaggtggcgggggagcgctggatcgccgacgtcggcttcggcggccagacgctgaccgcgccgatcaaactgctggccgatatcccacagcaaacgccgcacggcagctatcgtctggtgcatgaaggggatgagtggacgctgcagttcaaccatcacgaacactggcagtcgatgtaccatttcgatttaggccgccagtatgcgtctgattatgtgatgggcaacttctggtcggcgcactggccgcagtcccacttccgtcaccatctgctgatgtgtcgtcatctgccggacggcggcaaaatgaccctcaccaacttccaatttacccactgggagaataaccatgtggtggagaagatcgattttgccgatgtctccgcgctgtatgaagggctgcagacccgtttcggcctgggggtggacgatcctaaacatggcttcagcgaagcggcgctggcggcggtgatggcggcgttcgatacccatccggaagccgggaagtaa

SEQ ID NO: 2692 - DNA, 561 bp, Klebsiella pneumoniae
tataagaatgtccttatcgttacgctcctggcgaaacgaaacgcggggaaaatattaatgattaagaatcaacagccttgtcctatcgtcgatgagaatgaacgctccttacgctttgaatatcgcttccgccgctatgggataattgttttgagtctcatcattcttaccgcgttaagcggcctgtggtcctccggttatttcagtgaagcacaccgggaaaccggcggaggcgaattaagcgtcgattatcagcgctatgccaggctgatgagtgaaaccgagcttaatattcagattaaaccggatacggccagcgacaccattatcagcttcgccgccccgttattaacccgctaccagatcggtgatatccgtccgcagccggataaaatgtatagcgccgacgggaaattacatctcgtctatcagcggtcgaacccgccttcaccgatatctgtgtggttagccgttaccccaaaaacggccggtaatatctctctgcaggcggtagttaacgatcgctattctgtaacctggcagcagtttgtctatccgtag

SEQ ID NO: 2693 - DNA, 2517 bp, Klebsiella pneumoniae
gcgtctgatgtcgcgatgcgccacggcccggctcataccgttaccgtcgtcagcctctccatcctgctgggcggacagagcgcgctcttgcacgcccaggcgacctttaatatggatctgctggagaaaaacgaccatttgccggcagtggatctgcaacgcttcaatcagcaggcgggccagccgccaggcgcctatccggtgagctggcaggtcaacggcgtcacgctggacgcccgtaagaccgtcacgtttcgccagaacgatcgcggacagctcacgccctgccttaagccggaagatctgctgcaggccggagttaacccggccgtgctgttccaggcgcccagcgcaacgccccgctcatgtcccgaactcaacgcactgctgccgggcagcacggtcaatttcgattttgctcatcagcggctggtaatgaccattcctcaggcgctgatgacgcaccgggcgagggataatgttccctctgcgctgtgggacgaaggtattagcgcctttcagagtaactatcgttattcaggcgccagccagcgtacccgcgagggcagcaccgagcgcgataactatctgatgttgaaaagcggcgtgaacgtcggcgcctggcgcctgcgcgccagcaatagcctgaccgccaacagcgatgataagccccagtggacgaccagcggcgcctggcttgagcgcgacctgacgcgctggcagagtgaactgaccctcggggataccttcacgtcgggcgatgtgtttgacgcggtacagtttcagggaatatccctcgcctccagcgatgcgatgctcccggactcgcagaaaggttttgccccgaccatccgcgggattgccagaaccaacgcccaggtcacggttcggcaaaatggctacgtgctgtatcaaacctacgtcacccccggcgcgttcgtgattgacgatctttatcccaccgccagcagcggcaatcttgaggttgccgtcaaagagtcggatggcgaaatccgccgcttcacccagccgtatgcttcggtgaccagcatgcagcgcgaaggcagcctgaaatacaacctggtcgccgggcgctaccatagcgacgatgccagccagcggccgttgatgatgcagctgtcgctgatgcgcgggttcgcccacaacctgacgctgtttggcggactgcagagcgcggcgcaataccataacctctcggtcggcgcaggacaggggttgggagaagccggggcgctctcgctgcagctgttaaacgcccgcgaccggcaccagcaggatccgatcgatggccgggcctggcagctccagtacagcaaaggttttgatcgtcttggcacgcagttcaccttcaccggctggcgttattcgcatcagcgctatgccacgctgagcgaggcgttttccagcccgggtagcgaagacgacctgcaggatagcgacaacaaaaaagcaaccctgcaaatcaccgccagccagagcctgccgtacgatatcaccctctatctgagcctcgaccaggacagctactggtcagggggcgcctcacagcgtaccgccaatatggggatcagcagccaggttcacggtatcgcgtggtcgctcagctacagcgactcccgcagcagccacggtgacgaggaggatgacgagccgcattccgacaaagtggtgacgttgtcactttccgtgccgttgagccacctgctgccggggagctatgccggctataccctgacctcctcccgccacagcgttggcagtcagatggtcagcctcaacggcacattgctggacaatcacgcgcttagctacgccgtcagccaaacccgcgatcggcaaaacgggtccagcggcagcctgacggccgggtacagcagtggaaggggcgatctgaatctcggctacagccacgattcgcaggccgctcgtctgaactacggcgccagcgggggcattctgattcaccgccacggggtagtctttacgccggaaatgaatggcgctgtcgtcctgattgacgccggtggcgccgggggtgtgaccctcgccaaccagaaaaccatcgccaccaatggtgacgggtacgccgtgctgcccttcgccaccgcctatcaccgcaacgacgtctctctcgacagccattcgctgccggagaatgtggatctggccaacagcaccgtgacgctggtccctaccaaagacgcggtggttctggcgcgctttcacacccacgttggctataaggcgctgtttacgctgctgtcgcgaggacaaccgctgccctttggcagcgaagtacgcgccaaagacaccagcagcatcgttgccagcgagggtcaggtgtatctggccggcctggcgccaaaaggcaccctgtatgcgcaatgggggcctggccctcagcagcgctgtagcgcccgctacgatctcaccccgacgctggcgcagcccccccatccactcatcttacagcagacgttatcatgtcctttttaa

SEQ ID NO: 2694 - DNA, 267 bp, Klebsiella pneumoniae
ataactgatgttaatcgcctgcactataaaagacgtattgaggaaatcatgaaactattcgctgccgcagctatcgtactcttgtcgctggcctccagcctcagctatgcggagcaaaacaccacgccggtgcgtcaaaaccagcgtgatacaatgattatcccttccgaacataatgattcgccgtttgatttcaatcatatggcggctggtaatgataaatctgacgaacttggcgtgccgtactaccagcagcacgacctgtga

SEQ ID NO: 2695 - DNA, 1533 bp, Klebsiella pneumoniae
atatgggatgtaaaaaaagaggtatatgtgtctactgcaaacaataaaccagcagaaagcgtgagtctgaacgctttcaaacaaccacgcgcgttctatctcattttctcgatcgagttgtgggagcgttttggttactacggcctgcaagggatcatggccgtttacctggtaaaacagctgggtatgtcggaagcggattccattactctgttctcctcctttagcgcgctggtttatggcctcgtcgccattggcggctggctgggtgataaagtgctgggtaccaagcgtgtcatcatgctgggcgctatcgtgctggcgattggctatgcgctggtggcctggtccggccatgacgccgctatcgtctatatgggtatggcgaccatcgccgtcggtaacggcctgtttaaagccaacccgtcctccctgctttctacctgctatgacaaaaacgacccacgtctggacggtgcatttaccatgtactacatgtccatcaacatcggttcgttcttctctatgctggcaaccccgtggctggccgcacgttttggctggagcgtagcgtttgccctcagcgtggtggggatggtgatcaccattattaacttcgccttctgtcagaaatgggttaaacagtacggctctaaaccggactttgccccggtacacatgggtaaactgctggcgaccatcgctggcgtggtggtgctggtcgctatcgccacctggctgctgcacaaccagggtatcgcacgtatggtgctgggcgtcgtcgcactgggtatcgtcgtgattttcgccaaagaaaccataggcctgaaaggcgctccgcgtcgtaaaatgatcgtcgctttcctgctgatggtagaagcgattgtcttcttcgtgttgtacagccagatgccgacctcgctgaacttcttcgccatccgtaacgtggagcactcgatcctcggtctcgcctttgaaccggaacagtatcaggcgctgaacccgttctggatcatgattggtagcccgattctggccgccatctacaacaagatgggcgaccgcctgccgatgccgcacaaatttgctatcggtatggtactgtgctctggcgcattcctcgtcctgcctttaggggcgaagttcgccagcgacgccggtatcgtctcggtcaactggctgattctgagctacgcgctgcagtctatcggtgaactgatgatttccggcctcggcctggcgatggtcgctcagctggttcctcagcgtctgatgggcttcattatgggcagctggttcctcaccacggcaggcgcggcgatcatcgccgggaaaatcgctaacctgatggcagtcccggagaatgtcaccgatccgctggtgtcgctggaagtgtacggtcacgtattcctgcagattggtatcgtcaccgcggttatcgccgccctgatgctgctgaccgcgccgaaactgaatcgtatgactcaggacgacagcgcggacattaaagcacgcgaaaccgcggctgcctga

SEQ ID NO: 2696 - DNA, 324 bp, Klebsiella pneumoniae
cggagaatcgtgatgaatattgtcggagttaccgcctgtacggtggggattgcacacacctatattgctcaaaagaaaattgaaacagccgccaaaaaagccggtcataacgttaaaatcgagacccaagggaccatcggcattgagaatcagttaaccgctgatgagattgccatggcagatattgttctgcttgccgcggatgttaaagtgacgggagaagaacggtttgcgggtaagaaagtggtcaaagtcgccacggaaacggcagtgaaatcccctaataagctaattgaaaaactcagtgaaatagtcaattcataa

SEQ ID NO: 2697 - DNA, 2064 bp, Klebsiella pneumoniae
aaattcgtcgtcgcgcgacggcggaaaaggttttcgtctgcgcccggttctgactacaatagccgccatttcgacccccttatactggataacaacacgcgtatgcgcctgcacaatcatcgtcttgaacttcttagtcctgcccgcgacgccggtatcgctcgcgaagcgatccttcacggcgccgatgccgtttacatcggtggacctggctttggtgcccgccacaacgccagcaacagtctgagcgatatcgccgggctggtgcctttcgctcatcgctttggcgcaaaggtatttgtgacgctgaacaccattctgcatgacgatgaactggagccggcgcagcggctgattaccgatctctacgacgcaggcgtcgatgcgctgatcgtgcaagatatggggatcatggagctggatctgccgccgattgagctgcacgccagcacccagtgcgatattcgcagtgtggaaaaagcgaagtttctctccgacgccggcttcagtcagatcgtgctggcgcgcgaactgaacctcagtcaaatcaaagccatttacgaccacactgacgccaccatcgaattctttatccatggcgcgctgtgcgtggcctattccgggcagtgttacatttcgcacgcccagaccggacgcagcgccaaccgcggcgactgctcgcaggcttgccgcttgccgtataccctgaaggacgatcaggggcgggtggtggcctatgagaaacatctcctgtcgatgaaggataacgatcagaccgccaacctggcggcgctgatcgacgctggcgtacgctccttcaaaattgaaggtcgttacaaagacatgagttatgtgaaaaacatcactgcgcactaccgtcaaatgctggatgccattatcgaagatcgcggcgacctggcgcgcgcctcggctggacgcactgagcatttctttatcccgtccacggataaaaccttccaccgcggcagcactgactactttgttaatgcccgcaaaggcgatatcggcgcctttgattcgccgaaatttatcggcctgccggtaggtgaagttctgaaggtaggcaaagaccatctcgacgttgaagtcagtgaaccgttaaccaacggcgatggtctcaacgtgatgattaagcgcgaagtggtgggcttccgtgctaataccgtggaaaaaaccggcgaaaaccgttatcgggtatggccgaacgagatgccagcggatctgcataaagtgcgcccccatcagccgctcaaccgcaacctcgatcataactggcaacaggcgctgctaaagacctccagcgaacgccgcatcgcggtagatgtgacgttgagcggctggcaggagcagctggttctcaccatgacctgtgaagatggcgtcagcgtgacccacacccttgacggggagttcgccgaagctaaccaggcggagaaagcgctggccaacctgcgtgacggtgtcacaaaactggggcaaaccatctactatgcgcgcgaggtgcaggttaatctgccgccgctgtttgtgcccaacagcctgctcaaccagctgcgtcgggaaactgcggagatgctggatgaagcgcgcctcaacgcctggcagcgcggcacccgcaagccggtctccgtaccgccgccggtctacccggagacccatctctccttcctcgccaacgtctataaccacaaggcgcgggcgttctaccagcgctatggcgtacagctgatcgacgccgcctatgaagcgcacgaagagaagggcgatgtgccggtgatgatcactaagcattgtctgcggttcgccttcaacctctgcccgaagcaggcgaaaggctccatcaagagctggaaagccacgccgatgcagctgatccatggcgatgaggtcctgaccctgaagtttgactgtcgtccgtgcgaaatgcacgtggtcggcaagatcaaaaaccatatcctcaaaatgccgcacccgggcagcattgtggcctccgtcagcccggacgatctgatgaagacgctgccgaagcgcaaaggggcctga

SEQ ID NO: 2698 - DNA, 525 bp, Klebsiella pneumoniae
acagctgccgtggcacatcgcgctcggctatcagaatggcctgagccgggaagaaattgtcgaattgtttacccatctggcgttctatgccggttggccggcggcggccagcgccctgacctgtctgaatgcgcaggaggcgtcatgcccctgacccgaatttcgcttggcaccgcctggcgtcccgcggagtttgctcaattgtcggcgctctttcatgagtgtctggtggcggagttcgacgttccgtcagcagatagatttcagtttatcgaacgggccgccgatgagcagcgcatttacgacccgcactacctcagcgaaggacgcagcgcccgcttcgtgctgtttcatattttcgctggaaaaccgcgcagccgggcgcagaaacagggactctatcgtcggctctgcgcgcggttagacgatgagatggcggtcagcccgcaggacgtgatggtggttatccagtttaaccaactggaggactggagttttagcgcagggaagatggcgggtgaatga

SEQ ID NO: 2699 - DNA, 255 bp, Klebsiella pneumoniae
ctgagcggcgtcgataatcccctcagccagctgctgacgcgcctgtttaatgctgtccgggcgcaaaaaactgccgacgatgtctgcgcggaacggggcctgttgacgttgcatgctgtctccttagcggtgggcgcgttagttgcccaccgtgatagttcattatttgaatttttagacttctggatggctatatgtccagatactggcatgcagagtggtgggtcgcaaacgagaatatttcatggtacatga

SEQ ID NO: 2700 - DNA, 291 bp, Klebsiella pneumoniae
tacggaggcgtaatcgtgccacattcacctgaagataaaaaacgggcgctcagccgcgtaagacgcatccgcggccaggtcgaagcccttgagcgcgcgctggagtccggcgagccctgtatgactattctgcagcagatcgcctcgattcgcggggcggcgaacggcctgatgggcgaaatggtggagatccacctgcaggacgagctggtcagcggcgacaccacccctgagcagcgggccgcgagaatggcagaggtcggtcatctgctacgatcctatttaaaataa

SEQ ID NO: 2701 - DNA, 501 bp, Klebsiella pneumoniae
gctagatcagtagataaattgataaggagcgcgcagatggcaaagcaggaatcacttagaaccagtgaatgtccggtggcgagaacgttggaatcaattggtgaacgctggtgcctgatgattatccgcgaagcatttgacgatgtgcggagattcagcgagtttcaaaaaaatttggggctggccaaaaatatccttgcctcgcggctgaagcatctggttgatatcggtattttcgagattttaccggcatcggatggcagcgcatacaaggaatatgtcctgactgaaaaggggcgctccgtgtttcccattgttgtggcgctgcggcaatggggagagcgttatatgtttgagcaaggggaaacctattcggtcctgctggataacgcgcacggccagccccttcagtatctggatgtgcgttccgctcagggggataaactgcaaccaggcgactgtcatcgccggcgcattgtgtcagatacccgcgccgaataa

SEQ ID NO: 2702 - DNA, 252 bp, Klebsiella pneumoniae
acggccacagtaaaccggtcgccaggagggtcgatgatgaagaaagagtgtcgggtagtgatctataaagaggggctgctgggcagtctgttttttggcgaagccaaggccgaccctgacaaaatgagccactttctcagcagctatacccgtgagggatgggaagtgaaaaccatgtcggtggagcgccgccgtaccgccctgttctggtcgcgggaagcgtatcttttcgtgctcgaacgccccctctga

SEQ ID NO: 2703 - DNA, 483 bp, Klebsiella pneumoniae
ggttgtaaagtcaaaacatcgttcaccttgggagaattatccatgcaaagtgttgatgtcggttttactcatgtcgcctttaccgtccgctgtctggccagcagcatcgatttttatacccgctataccgcgatgaccgtcattcaccagcgcgagcccgacctcccctcggcgcggaaagtggcatggctcagcgaccgcacccggcctttcgccctggtgctggtgcaaagtgacgatccggccgatacgccgctgggaccgttcggccatctcggcgtcgcctgcgccacccaggccgagatcgatgagaaagtggccctcgcacggcgggaaggtgttttacgccgggagccggagcagctgggcgatccggtgggctatttcgctttctttgccgacccggacggtaacaccctggagctgtcgtgggggcagcgggtgggactggaagtcatcctggcgggaaaacccggcgaataa

SEQ ID NO: 2704 - DNA, 1173 bp, Klebsiella pneumoniae
agatctcgagtgtgctgtggttcatatttttcttctcaatacgataataatgttgatcttaccatctttaaaggagatggtaagcctccagcatcgttaatgcatgaggaaaccatgagcaacccgctgctttcgcttcttgatattgattatcccctgattcaggccccgatggcgggcgtctccacccccgcgctggctgccgcggtaagtaatgccggtgcgctgggctcgctggggctgggcgcttcaaccgttgcccaggcggaagcgatgatagtcgccacccgccagctgacggaccgcccgttcaatgtcaatctgttctgccatgcgccgccccggcgcgacgcccggcgggaagccgactgggcaacaacattacgtccccattttgcccgctatggcagtacgccaccggattcgttaagcgagatataccagacatttatcggtcatgcgccgatgctggagctgcttctcgacctgtcgccggcggtggtgagctttcattttggtcttcctgaaggtgagacgatccagcgtctgcggcggcaggggatcgttaccctggcgacagcgacttcgctgcaggaggcgctgctgattgaacagcaggggatcgacgtggtggtcgctcagggctatgaggcgggcgggcaccgggggatctttgctccgcaggcgcctgacgcgcagctgagcaccttcaccctggtgcaacttctgcggcgtcgactaaccatcccggtggtggccgccgggggcatcatggacggagcggggatcgccagcgtgatgcagttgggggcgcagggcgtacagctcggtacggcgtttttactgtgtccggaatcggccgccgacgccggctatcgcgcggcgatccacaacagccttgacgggcgtacggtgctgacctccgcgatatccgggcgtccggcacgctgtctggcgaatgccttctgcgcgctgggggaaggctatccggcgagcgccgtgccggattatccgctggcgtatgatatcggcaaagcactggccgccgccgcgaaagcccagggtgtccatgagtatggcgcccactgggccgggcagggggtggggttgatccgcgagtgtgacgccgccactctggtccgccagctggcggcagagagcggctggaactaa

SEQ ID NO: 2705 - DNA, 246 bp, Klebsiella pneumoniae
tcacaaggagtctttgctatgccgcatgttgatattaaatgttttccccgtgaactgactgatgaacaaaaaaccgcgctggccgccgacattaccgaggtgctgatccgccatctgaacagtaaagagggcgcggtcagcgtcgcactcactcaggttgagccggacgcgtggcaggcggtgtgggacagcgagatcgccccgcagatggcgcagttgattaagcagccgggttatagcatgtaa

SEQ ID NO: 2706 - DNA, 207 bp, Klebsiella pneumoniae
aatatctcggttagctattacttcgtattgtttcatattttcgctggaaaaccgcgcagccgggcgcagaaacagggactctatcgtcggctctgcgcgcggttagacgacgagatggcggtcagcccgcaagacgtgatggtggttatccagtttaaccaactggaggactggagttttagcccagggaagatggcggatgaatga

SEQ ID NO: 2707 - DNA, 1119 bp, Klebsiella pneumoniae
atgaagcaggtgggtattgttggttggcgagggatggtgggctcagtattgttgcaacgcatgatcgaagaaaatgatttcgacgatattacagcgcatttttttagcacctccagtgcgggtgccccgggcccggttattaatggtaaaagcgacaggctgaaagatgcgaattcccttagcgcactcgccgaaatggatatcatcatcacctgtcagggcggggattataccaaagccatctatccggcgttaattaaccatggctggcaaggttactggattgatgcggcttcggcgctgcggatggatgaaaaagcctgcattattctcgacccggtcaaccgcgaaaatatcgatcgtgcggtaaaagcgggaattaaactgtttgtcggcggcaactgctccattacgctgagcctgatggggttggccgggctgataaaagcggatcttatcgaatggatgagcgtgatgacctatcagtctgcctccggggcgggcgccaaacaggtgcgggaattaatcgcacaaagcgcttatatcagtcagcatttatctgcggatgaactgacatcatcaggttccgtgctgccattggtaaataaagtgagtgagctgattaacagcgcgggcatgccggtggagaattttggcgtccccctcatgggcagcatcattccgtggatcgacagcgatctgggcgatggaaacagccgcgaagaatggaagggcgaggcggaaactaataaaattcttggccttgcgccgggtaccatcccggtcaatggtttatgcattcgggtcggggtgatccgctgtcacagcgcggcgattacgctgaaacttaaacgtgaggtcagcgaagcagaatttgctgagttagtcacccattcccatccgtgggtaaactatgtccgtaataataagcaagagagtgtcagtaaattgaccccggctgctattagtggttcgctgcaggtaggtattggccgctacaagaaaatgtcgctaaataatgacccagtctactcggtgttaacggttggcgatcagctattgtggggggcggcggaacccctgcgccgcatgttaaatatcctgctgggcaaaatatag

SEQ ID NO: 2708 - DNA, 372 bp, Klebsiella pneumoniae
aaaccgaaggtccgcaccccatccaccaccgcatcgatgtccgcatcgtcaaaaacgatcactggcgccttaccgcccagctccatgtgggtgcgtttaatcgacgaggcggtatggccaatgatatgggctccggtggcaatcgatccggtcagggagaccattcgcactttaacgtgggcggtcaaggggtcgcccaccgttttaccgcggccaaacagcacgttgataaccccctccgggaagatatcttttgccagctccgccagcttcagcgccgtcagcggggtgatctccgagggttttatcactacgcagttgcccgccgccagcgccggggccagcttccaggccgccatcatcagcggatag

SEQ ID NO: 2709 - DNA, 1323 bp, Klebsiella pneumoniae
ggcaggttattgcgccagcagctcctgagcggtgcgctccaccaggttcagcagaaccttcacgtcatccagcgtcaccaccgggttcagcagagtcagcttcaggcaggtaacgccgttgtgctcggttacgccgacgttagcgcggccggaggccagcagggcgtcgccgacgcgctggttgagcagcgcgatagccgccgcgtcgctcccggccatctgcgccggacgggaacggaacagcacgctcgccagttgcggctgcatcaccagctccagcgtcggctgcgacttcacgtactccgccacgtttttcgccatcgtgacgccgtgatcgatgatcgccgcatactgtttctggcccagcgcttccagacccatccacagcttcagcgcatcgaagcgacgggtggtctgcagcgacttagacaccaggttcggtacgccgtgttcttcatcgaactcggagttcagataggccgcctgataacgcatcagctcgtaatggcgcgcgtccttcagcaggaatgcgccgcagctgatggtctggaagaactgcttatggaagtccagggtaacggaatccaccagctccagaccgtcaaggtagtcgcgatactgctcagacagcagcagggcgccgccccaggctgcgtcaacgtgcagccagatctgatgttccgcagcgataccggcgatgtcgcgcagcgggtcgatagcgcctgcgtcggtggtgccggcggtggcgacgatcgccatgatctgctcgccgttagcctgcgcttgcgcaatcttcgcctgcaggtcggacacgtccatccgcgcgaattcgtcggttttcaccagcgttaccgagcggtagccgaggcccatcagcgccatgttcttctgcaccgagaagtgggcgttttccgagcacaagactttgtacttgcggatatcccccggcagcccatcctgctggatggagtggccctgacgggcgaagaaggcgtcgcgcgccagcatcaggcccatcaggttgctctgggtgccgccgctggtgaagacgccggcgtcgcccgccggaaaaccgacccgggcgcgcagccattcgatcagcttcatctcgataatggttgccgacgggctctgatcccaggagtccatgctctggttggtggcgttaatcagcacttccgccgcctggctaatcaccaggctcgggcagtgcaggtgcgccacgcactgcgggtgatgcaccgacaggctgtctttcaggaagtactcgatcgcacgatcaatcgccgcctggttacccaaaccctgttcgttaaattctag

SEQ ID NO: 2710 - DNA, 924 bp, Klebsiella pneumoniae
ggaaaactattctgtatgcaaataagcagagctgatgttgccgatcttatttatttcatggcgattgcacgtcatcgcagcttcagccgtgcggcaattgaactaggcgtcagtgcatcagcgctgagtcatgccctgaaggggctggaaacccggcttggggttcgcctgcttaatcgcacgaccaagagcgtcacccctacggcagccggcgaggaactggttcagtctgttcttcagcctttcgacaccatagaaggcgcgcttgaatcgcttaaccggtatcgcaatacccctaccggacgtatccgcatcaatgcagccgttgaagcggcaaatcttttgcttgcgccggtcatgcccgcttttatggatcgctatcccgatattgaaatcgatattgtggccagcaaccgtatggttgacgtgactgatgcgggcttcgatgccggcatccgctacggtggcaccgtcccggaggacatggttgcccggcgtttatctgccgatattcgctgggttatcgcggcctcccctgattacctggaacgctacggaacgcctgaacatccggatgatttattacaccatcgctgcatcagcaatcgtctcggtgacgatcgggtttatcgctgggaacttgcgcgagacggcgaaacataccaaatgacagtgccaggctcagtgacggtcaatcatgccgaaacgggtctggtggccgtattgggcggggctggcctgatgtattttccggagcctcttgttgcaccctatgtcaaggatggacggctccgtctggtgcttacggaatggtccccactggaggaaggttttcatatctattattcaagccgccggcaattgccgaccgggcttcgccttctgattgagttcatacaggaggccaggccgctggggttgtga

SEQ ID NO: 2711 - DNA, 498 bp, Klebsiella pneumoniae
cgatcgctattctgtaacctggcagcagtttgtctatccgtaggagtcgctatggaaatggtccttagagccgcagcaatctatctgatcctgttgattatttttaagattgccggcagaagaaccctgatgcaattaaccaactttgacctgatactgttgctgattatcagcgaagccacccagcaggcaatgcttagcacagactattcggttaccgggtcgatgctgactatcgtcaccctggttagtattgatattttgttcggctatattaagaaaaaatttgctcaggcagaaaattttctcgatggtacgccggttatcgtggtggaaaatggtgctgtcatcgacgagaagattaagctcgtcaatatctctgtcgatgatatcctgctggcggccaggcagcaccatggcatttatgaattgaaagcgatcaaattcgctattctcgagcgtaacggccagatatccattattcctgagcaggaatag

SEQ ID NO: 2712 - DNA, 432 bp, Klebsiella pneumoniae
aagacgatattgtcagcgtgccgctcacctttgccgacggtcaggtggcgctgccgcaaacgccgggccttggcgtcgagctggatgaagacaaactgcatttttatacccgccagccgtagcggggaacaggagaaaaaaatgttatttaaagtggagatgaccgtcaatattccgcctggctttcccgccaacgaggcggaggaaataaaacaacgcgaaaaagcctattcgcaacaattacagcgggaaggcaaatggcgacatatctggcgcgttgccggcctttatgccaacgtcagtattttcgatgttcaagatgccgaagaattgcatcaaatattaatgggattgccgctatatccctttatggcgataaaagtggaagccctctgtcgtcatccgtcatcaattcgcgatgacgatcgctaa

SEQ ID NO: 2713 - DNA, 1077 bp, Klebsiella pneumoniae
tttctatcattacgctcattcatagcgacaattaccttgaaaaaaatcgccactaaaatcacccttgccgacattgcgcgtgaagcgcgcgtcggcgtagccaccgtcgaccgggtgctcaataagcgcgcggcggtgaaagagtccacggcgcggcgcgtgctggaggccgcccgccggctgggttttaccctcgagcagccccactatcgcctggctgccggcaaagcgccggtcacgatcagaatgggctttatcctgctgcaggagagccactccttctacctgccgttggcccgggcgctgacgcgcgaggctgccccatggctaccggcgggccaggcgccggtgatactgcattttgccatcgatgcggtggaagcgatggctcaggccattcaccgactcagcgatgaagtggaggtgctcggcctggtggcgctggatcacccgctgattcgccacgcggtggcccgggccgccgcccgcggcgtgcgcgtgttcaccctgctttccgatctgtcggtcccccagcgcagcgggtatatcggcctcgataatcataaagccgggcgcaccgccgcctggtttatcgagcgcttatgccgggggaatggcgaaattggcattatcattggcgataatcgttttacctgccaggaaagctgtgagatcagctttcgctcctgcctgcgagaacagggcaaggggcaacagatccttgagccggttcgcagtcatgaacgggcggatatcgccaggaccgtgacggaacagatgctgactcagtacccggccctgcaggcgatctacgccccctgcggcggcgtcgaagggatcgtcgacgcgctgcgcgacagcggccgtcagcaggagatcgctctggtctgccacggtccgctcagcgacagtgaactggccctgatcgatggcaccatcgacatcatgcttaaccaccggctggatgagtttgccgccgttacgctgcgcgccatggcggacgccgcttcacgcccccatagcgaggtgatttcactccctcagcctttcgatatcatcaccaaagaaaatatgtaa

SEQ ID NO: 2714 - DNA, 1041 bp, Klebsiella pneumoniae
gttaatcaattcccccacaaggagacaggcatgaaggcagctgttgttacccacgaccatcaggttaacgtcacggaaaaaacgctgcgcccgctggaatacggcgaagcgctgttgaaaatggaatgctgcggcgtgtgtcatactgacctgcacgtgaaaaacggcgattttggcgataaaaccggcgtcattctcggccatgaagggatcggggtggtacaaaaagtcggcccgggcgtcacctccctgaagcctggcgaccgcgccagcgtggcgtggttcttcgaaggctgcggccactgcgattactgtaacagcggcaacgagacgctctgccgctcggtgaaaaacgccggctataccgtcgatggcggcatggcggaagagtgcatcgtcaccgccaactacgcggtaaaagttccggacggcctcgactccgccgccgccagcagcatcacctgtgcgggcgtcaccacctacaaagcggtcaaggtctcccacatcaaaccgggccagtggatcgccatctacggcctcggcgggctgggtaacctcgcgctgcagtatgcgaagaatgtgtttaacgccaaagtgatcgctatcgacgtcaacgacggacagctggagctggcggcctcgatgggcgccgacctgaccatcaactcccgcaatgaagatgcggcgaaagtgattcaggaaaaaaccggcggcgcccacgctgcggtagtaaccgcggtggccaaagcggcctttaactcggcggtggatgccgttcgcgccggtggccgcgtggtcgcggtgggcctgccgccggaggcgatgagcctcgatattccgcgtctggtgctggacggcatcgaggtggtcggttcgctggtcggcacccgtcaggatctggtggaagccttccagtttgccgccgaaggcaaagtggtgccgaaagtcaccctgcgtccgctggaagatatcaacgctatcttcaaagagatggagcaaggtcagatccgcggccgtatggttatcgatctgcgtagctaa

SEQ ID NO: 2715 - DNA, 603 bp, Klebsiella pneumoniae
ctatgtcaatttgctggcaaaagccacctggttactggacagcccatgaaaaatgaaccgctttgccacgctccctgccccatcgcccgcagccttggccgcatcggcgacagctggagcatcatgatcctgcgcgatgccttcgcgggctttacccgctttgacgagttccagaaaagcagcaacgtcgcgcccaatattctgtcgcgccgcctgaaggaactggtcgatgacggactgctggagaaggtgtgctacagcagcaccccgccgcgctacgaataccacctcacgccgcgcggccgcgatttccgcatggtgctgctggcgctggcggaatggggtaatcgccacttcgcccccgaagggcgtcagatgcagctggtggaaatggcaacccagcgccacgtggagccagtcatggtggataaagcgacaggggaagagattatcccgggtaaatacgccatggtgccgggccccgccgcctcgccgctgatgaaatatcgtcatgaatatctgctgcgcaaacgcgaaggcgatagcggacaaaaattccagcctgaaccttacagagatgccagcaatgaatccgaccagtaa

SEQ ID NO: 2716 - DNA, 1068 bp, Klebsiella pneumoniae
tccctattttcgaagagccgcaggtgttcgccggcgcgccgtgggtcaaaggcgtcagcttcgaggccgtcggtcgtccgtcgttctacggcgcgtggctggacaagcactaagaggccggttatgagcgcttatcttctgcgacgattcggccaggggctgctggtcctgtgggcggcctttaccctcacctttttcctgctgcaggtcctgccgggggatgcggtgctgatcaagtttcagaacccggacctcggcctgagcccggcgcaaattgcggagatgcggctggcctacggcgccgatagcccactgtggcgccagtacctgcacacgctgctggcgatgctgcacggcgacttcggctattctctgcaggcggggctagcggtcagtagtctgattgccagcaacctgccggataccttaagcctcgcgctgccggccttcctgctggccgtggcgctggcgttcgccctcgctttcgcctcgcggctgccggggctgcgctggctgagcaattttctgcagtcgctaccggtgctgtttatctctctacctaccttttggttgggtatcgccctgatccagctcttctcgtttcagttgcgctggatcccggtaatcaaccccggcccactggaaggactgattttaccggttatcgccgtcgcactgcccatttccgccccactggcgcagatcctgatgcgcagcatggatcaggtggcggttcagcccttcgtcgcggtcgcccgcgccaagggcatgagcgaaacgggcgtcctctggcgccatgtgatggggaatgccctgctgccggcgctgaatattgccgggctgctgctcggcgaactgattgccggggcgctgatcaccgagaccgtcttcggccgcagcggcctcggccagctgacccagcaggcggtcaataaccaggatatcgccctactacaggcggtggtgatgatctccgccctcggtttcgtcctgatcaacctgctggtcgacctggtcatgccgcgactggatccccgactccatttacagaccggaggtgcgaaatga

SEQ ID NO: 2717 - DNA, 660 bp, Klebsiella pneumoniae
cgcaaattttcccgggattttgctgttagtttcctccgcgcgatgaatcaacatcctgcatggaggaatgcaatggacgtcagccgcagaaagttctttaagatctgcgcaggcggtatggccggaactaccgccgccgccctgggctttgcccctaaaatggcgctggctcaggcacgcaatttcaaattgctgcgtgcgaaagagatccgcaacacctgcacttactgctccgtgggctgcgggctattaatgtatagcctcggcgacggtgcgaaaaacgccaaagaagcgatctaccatatcgaaggggacccggaccatccggtgagccgcggcgcgctgtgcccgaaaggggcaggcctgctggactatgtccacagcgaaaaccgtctgcgttatccgcaataccgcgccccgggctcggataaatggcagcgcatctcctgggatgaagcctttaaccgcatcgcccgactgatgaaagccgaccgcgacgccaactttattgaaaagaatgaacagggcgtgacggttaaccgctggctttccaccggcatgctgtgcgcctcggcggcaagcaatgagaccggcatgctaacgcaaaaatttgtgcgatcgctgggtatgctggcggtagacaaccaggcgcgcgtctga

SEQ ID NO: 2718 - DNA, 855 bp, Klebsiella pneumoniae
atcatgaaattatctgcccttgctgttgctaccgccctgttcagcggcgcggtcttcgcggcgcctctgacgctgcaaacttacaacccgcaggaaaaaggactttttgccgtcaactcgaccctcgtttccggtccgcatgaagcggtacttttcgacgcgcagttcagcgtcaaagatggggaaaagctggtggagatgatcaagaaaaacggcaaaccgctatcgcggattgtgatcacctctggcgatccggatttctattttggtcttgagccgctggtaaaagccttcccgcaggcggaggtggtcgccacgccggaggtcgtcaaacatattgcagccaccaaagcggccaaactggcgtactggggcccgcaaatgaaagacggcgcgccgacgcaggtgtatgtcccacaggcgctggaggccaacagctttaccatcgatggcgagaaagtgaccatcatgcagccgcatgactacgcggcgttcgtctggatccgggcgaacaaaacgatcctcggcggcaccggcgtggcgtggggtatgcatctctggaccgccgacacccagacgccggccagtcgtcagcaatggcgtaatacgctggaccagatgatcgccctgcacccgcagcgggtgatcccgggccattatctcggcaccccgccggagggagacagcgcagtgcgctttacaaaaacttatctccagcagttcgagcaggcgctgaagacgcattcggattcggccggggtgatcaaggcgatggaggcacagtggccgggcctggcggagaccagctcgctggagttaagcgccaaagttaataccggtgagatgaagtggtga

SEQ ID NO: 2719 - DNA, 1458 bp, Klebsiella pneumoniae
ccgcttatttcacccttcggggtaattactcctgatgttcatatcaatataaatacaggtgacgacatgttatcattattaaaaaaaggcccgtcggcgaataaagttcctgctgagaaaattcaggcaacctatggtcgataccgtatgcaggcgctgctaagcgtatttctgggatacctggcgtactatatcgtgcgcaataacttcaccttatccacgccctatctgaaagaacagttagacctcagcgccacgcagatcggtttgctcagcagctgtatgctcatcgcctacgggatcagtaaaggcgtaatgagcagcctcgcggataaagccagcccgaaagtctttatggcctgtggcctggtgctgtgcgccatcgtcaacgtcgggttaggattcagtaccgcattctgggtcttcgctgcgctggttgtcctgaacggcctgtttcagggtatgggggtcggcccctcttttattactattgcgaactggttcccgcgccgtgagcgtggccgcgtaggggcgttctggaacatttcccataacgtcggcggcggaattgtcgccccgatcgtcggcgccgcattcgccattctcggcaccgagcactggcagagcgccagctacattgtaccggcctgcgtggcggtggtattcgccattagcgtactggtgctgggtaagggttcgccgcgcgaggaaggtctgccttcgctggcagagatgatgccggaagagaaagtggtgctgaagaccaaacacggccagaaagcgccggagaacatgagcgcatttcagatcttctgtacctacgtactgcgtaacaaaaacgcctggtatgtctcctttgtggatgtgtttgtctatatggtgcgtttcggcatgatcagctggctgccaatttacctgctgacggtgaaacatttttccaaagaacaaatgagcgtcgcattcctgttttttgagtgggcggcaattccgtctactctgctggccggctggctctccgacaagctgtttaaagggcgccggatgccgttagccataatctgtatgacgctaatcttcatctgtctgattggctactggaaaagcgaatctctgctgatggtcacggtattcgcggcgattgtgggctgccttatttatgtcccgcagtttctggcctcggtccagaccatggaaatcgtccccagctttgccgtcggttcagctgtgggtctgcgcggatttatgagctatatctttggcgcatcgttaggcaccagcctgttcggcgtaatggtcgataaaatgggctggcacggcgggttctatctgctgatgggcgggatcgtctgctgcatactcttctgctacctctctcatcgcggcgcgctggaacttgagcaacagcgtaaaatcaccgagcaagaagaggcccgactggcactggctgacgcacagtaa

SEQ ID NO: 2720 - DNA, 714 bp, Klebsiella pneumoniae
acaggaatttcttacccgccacggcgttcaggggaggccattatgcggagtagcatgagctgggaagatttgtggccgttattactcgacggcacgctggatacgctttatatggtgggcctggcggccctgtttaccgtgctgatcgggctgcccaccggcgtgctgttatttatttcccgcgccaacgggctggcgccgatgccgaaactgaacgcgctgttaggcgcggtgatcaacatcggcaggtcgctgccgtttatcgtactgctgatcgccctgatcccctttacccggctgatcgtcggcaccacgctgggcagcaccgccgccatcgtgccggtaaccatcggcgcctttccattctttgcccgtctgacggaaaacgcgctcgacgaggtggactacgggagaattgaagccattctgtcgatgggcggcaacgtctggcacgtcatttttaaatccctgctgccggaagccctgccaacgctgctggccgggatcacgctgaccatcgtgatgctgattggtttctcctccatggccggtgtgatcggcggcggtggactcggcgacctcgccatccgctacggctatcagcggtttaataatgaagtcatgtttggcacagtgctgatcctggtggcgatggtccagggggtgcaaatggccggcgatcggctggtgcgtagcctggcccaccgccgctag

SEQ ID NO: 2721 - DNA, 975 bp, Klebsiella pneumoniae
aatctttattcaatactcagcggcatcccttgtatgaaaaaggaagccgacatgatacatcctatcgctaacgccccctgcagctggggcgtcgatgacccgaaaaaccctaacctccctgcctgggctaccgtactgaaggaggcggcgcaggctggctatcgcagcattgagctcggcccctggggttatctccccaccgatccggccagcctgcgcgcggcgctggagcagcatcagctgtcgctggtcgccggcacgatctttgacgatctggtgagcgaggcccatttccccaccctggtggcgctgacccatcaaatctgccgcaatctgtcgcaggtagccgctgccgaaccgatcccgggccgccctttccagccgccctatctggtgattatcgacttcggcaaccccgaacgggcgcgctttgccgggcgcggcgcgctggctccgcgcctcaatgacaaagactggcagcgcatgatggagcacattatcgcccttagcaccctcgcctggcaggagtacagtgtgcgggcggttatccatccgcacgccgggggcagcattgaattcgcggatgagatcgagcggctggccaacgatatcccgcacgacgtcgccgggttgtgtctggacaccggacatctctattacgcagggatggatccgctcgactggctggatcgctattaccaccgcctggactatctgcacttcaaggatgtcgacccgcaggtttatcagcgtgctatccatgaaggtatcgacttcttcactgcctgcgccgaaggggtgatgtgcccgctcggtagcggcgccattgactatccggctatcaaagactttcttgcccgccgggggtatcagggctggataaccattgaacaagagcgcgacccgcgccatgccgcaggcagcctgcaggcggtcacggaaagtctgcgctatctgcgcgacgtcggattctga

SEQ ID NO: 2722 - DNA, 396 bp, Klebsiella pneumoniae
gctcgacattctgtggtcgatgctcgatgccatgaccatggcctatgccctgcagcgcccgccctatcacacggtcaccgacaaggcggcctggcacacgacccgactggtgtaatcatgcaaaaaacgtccatcgttgcctttcgtcgcggctaccgactgcagtgggaagccgcccaggagagccatgtgatcctctatccggagggtatggccaaactcaatgagaccgccgcggcgatcctcgagctggtcgatggccggcgcgacgtcgcggcgattatcgccatgcttaatgaacgtttcccggaagcaggcggcgtcgatgacgacgtcatcgagttcctgcagatcgcctgtcaacagaagtggatcacctgccgtgagccagagtaa

SEQ ID NO: 2723 - DNA, 906 bp, Klebsiella pneumoniae
gcaacgcattcacaaaagaagaatatcatggacctgactcagctagagatgtttaacgctgtcgccagcaccggcagcattacccaggcggcgcagaaagtgcatcgcgtgccgtccaacctcaccacccgcatccgccagctggaggccgacctcggcgttgagctgtttatccgcgagaaccagcgcctgcgcctgtcgcctgcgggacacagctttttgcgctatagccagcagatcctcgccctggtggacgaggcgcgaatggtggtggcgggcgacgaaccccaggggctgttttctcttggttcgctggagagcaccgcggcggtacggatccccagcactctggcccactttaatcagcgctacccgaaaattcatctggcgctctcaaccggcccttccgggacgatgatcgacggcgtgctggaaggcgccctgagcgccgcgtttgtcgacggcccgctggtgcatccgggcctggaggggctgccggtgttccctgaagagatgatgatcgtcgccccctacggccacgcacccatcacccgcgccagcgaagtgaacggggccaacgtctacgcctttcgcgccaactgttcctatcgccggcattttgagagctggtttcatgccgacagagcgaccccgggcaggatccacgagatggagtcttaccacgggatgctggcctgcgtcatcgccggcgccggcctggcgttgatcccgcgcagcatgctggagagtatgcccggccatcagcaggtttccgcctggccgctggccgaagagtggcgctggctcaccacctggctggtgtggcgccggggcgccaaaacccgccagctggaggcgtttatagcgctgctgaacgaagatcggcaaacagtggtttctccataa

SEQ ID NO: 2724 - DNA, 1455 bp, Klebsiella pneumoniae
gtagtacgttcaggctgcgccagacgggcgcagccttttttcgaaggagaggttatgcagcagtatcagtttccgcaagggttcctgtggggggcggcggcgtccggcccgcaaacggaaggggtcaccaataagcgccatcgttccatctgggacagttggtttgccgaacagccggagcgattttatcagcaggtagggccgcagaccgtgtgtgatacttatcatcagtatccgcaggacgtagcgctgatgaaacagaccggcttcaactcatttcgtacctcgatacagtggtcacgactgatcgctgatttggaaaccggcgcgccggacccggacgcggtgcgtttttatcacgcctatctggatgagatgatcgctaacggcattgagccgatgatcaatctctaccactttgatatgccggaagcgctgcagaaacagtacggcggctttgaatcggcgcacgtagccgagctgtttgcccgctttgcccgcaccgcctttagcctgtttggccataaggttaaatactggataaccttcaacgagccgattgtgccggttgagggaggctacctgtacgacttccactatccatgtaagaaagatggccggctggcggcgcaggtggcgtttaacattatgctggcgcacgccaaagcggtaacggcttatcgtgaactggcgctggcgggcgagatcggcgtggtgctcaacctgaccccgagctataccctcaccgacagcgacgcggataaaaaagcagccgggtatgccgacctgttttttaaccgcagcttccttgacccgctggtaaaacatgaattccccaaagcgctgtgcgagatccttgccgcccacgactgcctgccgacgaccagcaaagacgacgcggcgttgatcctcagcgcggatatcgattttcttggggtaaactattacgtgccgcggcgggtaaaagcgcgtgagagcgaatatgacctcgattatttcaccccggaatactatttcgaaaacgcggtgaacccgcagggccgctttaacccttatcgtgataacaacgagatcctgccgcaggcgatctatgacattgccgccaatattcgcgataactacggcaatattaagtggtatctcgcggaaatcggcatcgcgatggatcgacaatcagagggcgagcccggggcggacggggtgatagacgatactttccgcatccagctgatggaggagcatctggtgcagctgcatcgggcgatagccgacggcgcgaactgctttggcgtgcaccagtggacgtttatcgacaactggtcgtggatcaatgccttcaaacggcgctacggcttctggcgactggatctggagaccggcgagcgacagataaaacgcaatgcgctgtggtttgccgaactggcgaccagcaacggttttaccagcgataaatag

SEQ ID NO: 2725 - DNA, 945 bp, Klebsiella pneumoniae
atactcagttcatttattggtgaactaaatacgatgcatcacgacgccagcctcaatattcgccagctgcaggttttcgaggcggtggcccgcctggagagctacagccgggcccagcaggagctgggtatttcggtctccgccatcagcaatgccatgtcgcagctggagggacagctcggcttcaccctctgccagcgcgggcgcggcggcttttctctgaccgagaaaggtcagcagtttttacagcaggcgatccgcgtactgagcgaactcaatgagctggagcggcagtcggcgctgctcaaaggggagcacagcggcaccctgtgcatctcgacgctcgactccatcgagaccgaaacggcgctctcgctgccggtggttctgcgcagcttcagcgacaaatttccccatgtgcatatcaaactgattatccgcaccccggcggagcaactgaacggcgtgctgaacaaccatatcgacctggctatcggcagctacaactcgcaggtgcataacatcatcagcgagccgctgtaccgtgaacagcactggctctactgcagcgatctgcacccgatgttcttcagccgccagctcgataaagagcagatcagccagtgcccgctggtgacccgcagctactggaacaccagcgatctccgccgtcggggcttcagcaaagggagcgccaccgtcgagaccgtcgacgcccagctgctgctgatcctctcggggaaatatattggctatctgccggagcattacgcctggccgtggatcaaagagaaccgcctgcgggtgctgctgcccaacgagtttggctttcagtcgccgttctcggccatctgtaagcgcgggcgcagcaatgagccctacctgaaagcgttccgcgacctgctgaagaaaaacacggtagcgcggccgaagtggaattattaa

SEQ ID NO: 2726 - DNA, 411 bp, Klebsiella pneumoniae
tcgcgtggttcgtttccggatttatttaccagtaagaggttcctgcagatgactgtgatttaccagaccaccattacgcacatcggcgcctgcgcgacgatggcgctggaagagcaaatgctgatcaccttccgcgagggcgccccggcggatatcgaagagtactgctttattcacaaccacggcgagcttgctggcacgctgcagccgggggcagagctgcagcttggcgaacagcgctacccggtgaccgccgtcggcgaagtcgctgaacaaaacctgcgcgagctgggccacatcaccctgcgctttgacggccatcgtgaagcggagttcccaggtaccgtccatgtggcgggcccggtgccggacgccatcgcgcccggctgcgtactgaagtttgttgcttaa

SEQ ID NO: 2727 - DNA, 537 bp, Klebsiella pneumoniae
ttattcacctctgcggtgccaaaaagaacaagattcaccgcaacccatgacactgccatgttagattaccgcttcccgacagctttgcagatggttctcagcgtagcaatggcggagcagatgggtgaacgttcgacgagtgcgattctggcctacggcctggaagcgaacccgagctttatccgtaaactaatggttccgctaactcgtgacggcattatcgtctccacgcttggccgcatcggctcaattcatcttggccgtccggcggacaagatcaccctgcgtgatatctatctttcggttatcgaagataaaaaactgtgggcgtcgcttcctgacgtcccggcccgctgcgtggtcagcgccaacgcctgctggtacttcaaatcggttgccgacgaagcagagcaggcttcgttaaacgtcctcgctcgccataccgtggccagcgcgctggaggcggtcaaaaacgccgataccagcggctgcgacccggtgccggaaatgatcgcccgctttaaaaaagcgcattaa

SEQ ID NO: 2728 - DNA, 1404 bp, Klebsiella pneumoniae
cgtgagaactcatcaatgaatacagcagaactggaaacccttatccgcaccatcctcagtgaaaagctcgcgccgacgccccctgcccctcagcaagagcagggcattttctgcgacgtcggcagcgccatcgacgccgctcatcaggcttttctccgctatcagcagtgtccgctaaaaacccgcagcgccattatcagcgccctgcgggagacgctggcccccgagctggcgacgctggcggaagagagcgccacggaaaccggcatgggcaacaaagaagataaatatctgaaaaataaagccgctcttgaaaacacgccgggcatagaggatctcactaccagcgccctcaccggcgatggcgggatggtgctgtttgagtactcgccgttcggggttattggcgccgtggcgcccagcaccaacccaacggaaaccattatcaacaacagtatcagcatgctggcggcgggtaacagcgtctatttcagcccccatcccggcgcgaaaaaggtctcgttgaagcttatcgccaggatcgaagagatcgcctaccgctgcagcgggatccgtaacctggtggtgaccgttgccgagccgacctttgaagccacccagcaaatgatgtcccacccgctgattgccgttctggctatcaccggcggccctggcattgtggcgatgggcatgaaaagcggtaaaaaagtgatcggcgctggcgccggcaatccgccgtgcatcgttgatgaaaccgccgatctcgtcaaagccgccgaagatatcatcagcggcgccgccttcgattacaacctgccctgtatcgccgaaaaaagcctgatcgtcgtcgcctccgtcgctgaccgcctgatccagcagatgcaggattttgacgcgctgctgttgagccgacaggaggccgataccctgcgtgccgtctgcctgcccgacggcgcggcgaataaaaaactggtcggtaaaagcccggctgcgctgctggcggcggcgggtctcgccgttccgcctcgcccccctcgcctgctgattgccgaggtggaggcgaacgacccctgggtgacctgcgagcagctgatgccggtgctgccgatcgtcagggtcgccgactttgacagcgccctggcgctggccctgcgcgttgaggagggtctgcaccacaccgccattatgcactcgcagaatgtctcgcggctcaatctggcggcacgcaccctgcagacctccatttttgtcaaaaatggcccgtcttacgcgggaatcggcgtcggcggcgaagggtttaccaccttcaccatcgccacgccaaccggagaaggcaccacctccgcgcggacgttcgcccgcctgcggcgctgcgtgttgaccaacggtttttccattcgctaa

SEQ ID NO: 2729 - DNA, 1740 bp, Klebsiella pneumoniae
gcgccgttatcagcgagatgtctactaatgagcgaaaaacatccggggcctttagtggtcgaaggtaaactgagcgatgccgagcgcatgaagcttgagagcaactacctgcgcggcaccattgcggaagatttaaacgacggtctgaccggcggttttaaaggcgataacttcctgctgatccgtttccacggcatgtaccagcaggacgatcgcgatatccgcgcggagcgcgccgcccagaagctggagccgcgtcatgcgatgctgctccgctgccgtttgccgggcggggtgatcaccaccacccagtggaaggcgatcgataagtttgccgctgaaaacaccatttacggcagtattcgcctgaccaaccggcagacctttcagttccacggcattctgaaaaagaacgtcaagccggtgcatcagatgctgcactcggtggggctggacgcgctggccaccgccaacgatatgaaccgtaacgtgctgtgcacctccaacccgtacgagtcgcagctgcacgctgaggcctacgagtgggcgaaaaagatctctgagcatctgctgccgcgtacccgcgcttatgccgagatctggctggatcagaaaaaggtcgccactaccgacgaagagccgatcctcggccagacctatctgccgcgtaagtttaaaaccacggtggtgatcccgccgcagaacgatatcgatctgcacgctaacgacatgaacttcgtggcgattgccgaaaatggcaagctggtaggctttaacctgctggtgggcggcggtctctctatcgaacatggtaacaaaaaaacctacgcccgcacggcgagcgaattcggttatctgccgctggagcatacgctggcggtggcggaagcggttgtgaccacccagcgcgactggggcaaccgtaccgaccgtaagaatgcgaaaaccaagtacacccttgagcgcgtcggtgtcgaaaccttcaaagcggaagtggagcgccgggcaggcattaagtttgagccgatccgcccgtacgaatttaccggccgcggcgatcgcatcggctgggtgaaggggattgatgataagtggcacctgacgctgtttattgaaaacggccgcattctcgattatccgggtcgtccgctgaagactggcctgctggagattgctaaggtccatcaaggcgaattccgcatcaccgctaaccagaacctgattgtcgccagcgtaccggaagatcagaaggcgcggatcgagaagctcgcgcgggatcatggcctgatgaatgccgtcaccccgcagcgcgaaaactcgatggcctgcgtctccttcccgacctgcccgctggcgatggcggaagccgagcgtttcctgccgtcgtttatcgacaaggtggaagggctgatgagcaagcacggcgtgagcgatgagcatatcgtcacccgcgtcaccggctgcccgaacggctgcggccgcgcgatgctggcggaagtgggactggtgggcaaagcgccgggccgctataacctgcacatcggcggtaaccgcaacggcacccgcatcccgcggatgtaccgggagaatattaccgagtcggaaattctcgactcgctagacgaactggtagggcgctgggcgaaagagcgcgaagcgggtgaaggcttcggcgattttacggtgcgtgcgggcatcattcgcccggtgctcgacccagcccgcgatttctgggaataa

SEQ ID NO: 2730 - DNA, 636 bp, Klebsiella pneumoniae
gggtattcatcacagcgatctggtgacgctgctggcggagtccggcattgccctgcgcgccggacaacactgcgcccagccgctgctggctgccttaggggtcagcggcaccctgcgggcctctttcgccccctacaatacccaagacgatgttgcggcgctggtccacgcggtggatcgcgccctggaaattctggtggattaatgacaactctgcaccccttcggcacaaccattaccgacgctacgctgcgccagatcttcgccccgctgaaccagtgggaggataaataccgtcagctgattttattgggcaaaaagctgccgacgctgaccgacgagcgcaaagcgcaggcccatgagattgccggctgtgagaaccgcgtctggctgggctatgaggaggacgccgagggcaggctgcacttctttggcgacagcgaaggaaggattgtgcgcggtctgctggcggtacttttaaccgccgtagaaggaaaaacccgcgccgggatcctggcgcaggatccgctggcgctgttcgacgagctggggctgcgcggccagctcagcgcctcgcgcagccagggcctcagcgccctgagcgaggcggtgctcgccgccgcccgcgaaaggtaa

SEQ ID NO: 2731 - DNA, 1668 bp, Klebsiella pneumoniae
ttcatgagatcgaaaagatttgaagcactggcgaaacgccctgtgaatcaggatggtttcgttaaggagtggattgaagagggctttatcgcgatggaaagtcctaacgatcccaaaccttctatccgcatcgtcaacggcgcggtgaccgaactcgacggcaaaccggttgagcagttcgacctgattgaccactttatcgcgcgctacggcattaatctcgcccgggccgaagaagtgatggccatggattcggttaagctcgccaacatgctctgcgacccgaacgttaaacgcagcgacatcgtgccgttcactaccgcgatgaccccggcgaaaatcgtggaagtggtgtcgcatatgaacgtggtcgagatgatgatggcgatgcaaaaaatgcgcgcccgccgcacgccatcccagcaggcgcatgtcactaatatcaaagacaatccggtacagattgccgccgacgccgctgaaggcgcatggcgcggctttgacgagcaggagaccaccgtcgccgtggcgcgctacgcgccgttcaacgccatcgccctgctggtgggttcacaggttggccgtcccggcgtcctcacccagtgttcgctggaagaagccaccgagctgaaattgggcatgctgggccacacctgctatgccgaaaccatttcggtatacggtacggaaccggtgtttaccgatggcgatgacaccccgtggtcgaaaggcttcctcgcctcctcctacgcctcgcgcggcctgaaaatgcgctttacctccggttccggttctgaagtacagatgggctatgccgaaggcaaatcgatgctttatctcgaagcgcgctgcatctacatcaccaaagccgccggggtgcaaggcctgcagaatggctccgtcagctgtatcggcgtaccgtccgccgtgccgtccgggatccgcgccgtactggcggaaaacctgatctgctcagcgctggatctggagtgcgcctccagcaacgatcaaacctttacccactcggatatgcggcgtaccgcgcgtctgctgatgcagttcctgccaggtaccgacttcatctcctccggttactcggcggtgccgaactacgacaacatgttcgccggttccaacgaagatgccgaagacttcgatgactacaacgtgatccagcgcgacctgaaggtcgatggcggcctgcggccggtgcgtgaagaggacgtgatcgccattcgcaacaaagccgcccgcgcgctgcaggcggtatttgccggcatgggtttgccgcctattacggatgaagaggtagaagccgctacctacgcccacggttcaaaagatatgcctgagcgcaatatcgtcgaggacatcaagtttgcccaggagatcatcaacaagaaccgcaacggcctggaggtggtgaaagccctggcgaaaggcggcttccccgatgtcgcccaggacatgcttaatattcagaaagccaagctcaccggcgactacctgcatacctccgccatcattgttggcgagggccaggtgctctcggccgtgaatgacgtgaacgattatgccggtccggcaacaggctaccgcctgcaaggcgagcgctgggaagagattaaaaatatcccgggcgcgctcgatcccaatgaacttggctaa

SEQ ID NO: 2732 - DNA, 351 bp, Klebsiella pneumoniae
cggtcgagatcgatctggccactaaccagctggcgtggcagtttaacctcgggcgctgcatcttctgcggtcgctgtgaagaggtgtgcccgacggcggcgattaagctgtcgccggagtatgagctggcggtgtggaagaaagaggatttcctccagcagtcgcgcttcgctatctgccactgccgggagtgccagcgtccgttcgcggtgcagaaggagatcgactacgccatcgcgctgctcaagcataacggcgatacccgcgccgagctgcaccgcgaaagcttcgaaacctgcccggaatgcaagcgccagaaatgcctggtgccgtccgatcgtattgaactga

SEQ ID NO: 2733 - DNA, 1890 bp, Klebsiella pneumoniae
cggtctggatcagctttttgccggagaaactcaggaggaggcctcatgactttcgaacaactactgctggcggcggtggagcagcgtctgctgcggccattggacgtccagtttgccctgatggtggcgcaaaacgacccgccggcggtcaagctggcagcggcgttactaagccgggatgccggcgaggggcacgtctgcctgccgctctcgcggctgagcggcgacgaggcgctgagcggtaaagccggggagatccgcgagcggctgctggccgaagccggcgcgccggaggactggtccgcactgctgctcgcttcgtcggcggtgagctgcggcgatgctccggcgccgatgattttgtgcggcgaccggctctatctcaaccggatgtggcgcaacgagctgaccgtcgcccgcttcttcaatgaagccaaccgggtgctggagatggatgaggcccggctggcgtcaaccctgaatgccctattccctgccaccggcgaaaccgactggcaaaaagtggccgcggcggtggcgctgacccgccgcatctcagtgatctccggcggtcccgggaccgggaagaccaccaccgtggcgaagcttctggcggcgctgatccagattgaagacagcccgcgctgtcgtattcgcctggcggcgccaaccgggaaagcggcggcgcgtctgaccgaatcgctgggcgcggcgctgagaaaattgccgctgaccgacgcgcagaaagcgttgattcccaccgaggccagcacgctgcatcgtctgctgggcgcccagcccggcagccagcggatgcgctatcacgccggcaacccgctgcatctggacgtgctggtggtggatgaagcctcgatgatcgacctgccgatgatgtcgcggcttatcgacgcgctgccggcccacgggcgggtgattttcctcggcgatcgcgaccagctggcctccgtagaagcgggggcggtgctgggggatatctgcgcctgggcgagttcgggctataccgccgcgcgggcgcaggagctgacccggctgaccggttcgccggtgccggcgggcgagggggctatcgcgggcgcgctgagagacagtttgtgcctgctgcaaaagagctatcgcttcggtagtcactccggcatcgggagcctggcgcgggcggtgaacgctggcgcgcgcgcggaggtgaaggccacgctgcgccagccgtttgacgatatcgcgcttcatcccctcagcacaaccgaagagtacgaagccatgctcggcgcggctcagcagggctatgagcgctacctgcagctgcgccgcgagcgggccgaaccgcaggccatgctggccgctttcagtgaattccagctgctgtgcgcgctgcgcgaggggccgtacggcgtgagcggcgtcaatgagcggctggagcagcggctcaaccgccagcgggcgatcgccctgccgcgccactctcgctggtatgatggccgaccgatcatgatatcgcgcaacgacagcgcgctggggctgtttaacggcgatatcggcatcgccctggagcgcaacggcgagctgcgggtgtggttcctgatgcccgacggcgccatcaagtcggtgcagccgagccgtctgccggagcatgataccgcctgggcgatgaccgtgcataaatcgcagggctcggagttcgaacacgcggcgctgatcctgccggcgcgcagcgtcccgctggtgacccgcgaactggtctacacggcgatcacccgcgcgaaacggcggttgtcgctctatgccgacgagcaggtgctctcccaggccattgtgacgcgcaccgaacggcgcagcggcctggcggagattttcgccgggcgcgaaaccccctga

SEQ ID NO: 2734 - DNA, 1791 bp, Klebsiella pneumoniae
cctgagggatctgtaatgaaaaaaatcagcttaccgaagatcggtattcgtccggtaatcgatggtcgtcgcatgggggtccgcgagtcgctggaagcgcaaaccatgaacatggcgaaagccaccgccgcgcttatcagcgagaaactgcgccacgcctgcggcgcccgggtggagtgcgtgattgccgatacctgcatcgccggcatggccgagtcggccgcctgtgaagagaaattcagcaaccagaacgttggcgtcaccatcaccgtcaccccctgctggtgctacggcagcgaaaccatcgacatggatccgctgcgcccgaaggccatctggggctttaacggcaccgagcgtccgggggcggtctatctggccgcggcgctggcggcccatagccagaaagggatcccggcgttctccatctacggacatgacgtgcaggatgccgatgacacgtcgatcccagcggatgtcgaagaaaagctgttgcgcttcgctcgcgccggcctggctgtcgccagtatgaaagggaaaagctacctgtcgctgggcggcgtctcaatgggcatcgccggatctatcgtcgaccacaacttttttgagtcctggctcggcatgaaggtgcaggctgtcgacatgacggagctgcgccggcgaatcgatcaaaaaatctatgatgaaaccgagctggagatggcgctggcgtgggcggataaacacttccgctacggcgaagatcagaacgctgagcaatataagcgcaatgaaacgcagagccgcgcggtgctgaaagagagcctgctaatggcgatgtgcatccgcgacatgatgcagggcaacccgaagctcgcagaaaaagggctggtggaggagtcgctgggctacaacgccatcgccgccggtttccagggtcagcgccactggaccgatcaataccccaatggcgataccgccgaagcgctgctcaacagctcttttgactggaacggggtgcgcgaaccgtttgtcgtcgctaccgaaaacgacagcctcaacggcgtggccatgctgatgggccatcagctcaccggcaccgcccaggtgtttgccgacgtacgcacctactggtcgccggatgccgttgaacgggtcaccgggcagccgctcaccgggcgggcggagcacggcatcattcacctgattaactccggctctgcggcgctggacggctcctgccagcagcgcgacgcgcagggcaatccgacgatgaaaccccactgggagattgagcagagcgaagcggatgcctgcctcgcggcgaccgaatggtgcccggcgatccacgaatacttccgcggcggcggcttctcttcccgcttcctgaccgaaggcggcgtgccgttcaccatgacccgggtgaacatcatcaaaggtctggggccggtgctgcaaattgccgaaggctggagcgtagcgctgcccaaagcgatgcacgaccagctcgacgcccgcaccaactccacctggcccaccacctggtttgccccacgcctgaccggcaagggcccgttcagcgatgtgtactcggtgatggccaactggggcgccaaccacggcgtgctgaccatcggccacgttggcgcagatttcattaccctcgccgccatgctgcgcattccggtctgcatgcacaacgtggaagaggcgaaaatctatcgcccttccgcctgggccgcgcacggcatggatatcgagggccaggactaccgcgcctgccagaactacgggccgctgtataagcgttaa

SEQ ID NO: 2735 - DNA, 1452 bp, Klebsiella pneumoniae
tgccggggatcacctgcactcgttcccggccaaaatgggcaatcagccgggtgccaatgccatagaacagcgggtcgccagaggccagcaccacgacgcggcgcccggtacgggcctcaatccacgccagcagcgccggcatatcggcccccagcgcgaagcgctcgccggcgaagtcgggaaactgctggagatggcggctgccgcccaccagcgcctcagcggcggcgattgcctcgcgcgcggccggggtcagccactgcagccccgccgggcccattcccacgaccgtcaacatgtcagctcccgggcaattgccgccagcggacggctgctgcccagtacctggttatcaaaagaaaacagaaccgcgtcgcaggtgggcggttgctgagtgaagcgcagcatctcaagaacacgctggcagattcgctcagccagatggttatagaggcgctggaatccccaggcgtcgatatgctccattgccgcttcggtagtgtcgcactcgctgaccagcgtcagcagcggcagcggcgcgccaagcagcgccagatgagcgacgagagtttccatccgcgcatcggcgatatggctgtgggtatgaaagatcccggcggcgattttgatcagtttgccgggatggccaatgagcacaatctggtggaaaccgagccgaaccgcctcttcaatcatgtagccgacgaagttgctcatggtgaccaccatctgcgggtcgatgcccatctgctcgcggacaaagcgctcaccgtggttgcccggcaccagcaccacgcgctccagcccggcggcgcgttttatctccagctcgagggagagcgagcgcttccagctctcttccgacatcggggtaacgatccccgtggtgccgataatcgagatgccgccgaggatccccagccgggcgttataggttttttgcgcgcgaagcgcgccttccggggcaaaaatctccacctgcgcgccgcgggtaggacctatcgcttcgcgcacggcggtctcgatggtgtgccgcggagtgcggtttatcgccgggctgcctgtcggcaggccgatccctttgcgggtcaccgtaccgatgccctccccgccctgcaggctaatctctccgctgtcattgagggtgacccgggcaaaaatcagcatgccgtgggtggcgtcgacatcatcgccgccgtctttacggatcgcggcgacagcctgctgcccttcgacgtgcggggactcaacgttcaggcacagggtgacgccggagggggtgacgatcgagacctgatgaatcagatgctggcgcatcaccatcagcgcagccacttttgccgccgctgtggcgcaggagccggtggtgtagcccttgcgcagcgctttgccgtgatgccacaccggggcgtcaaaggtctgatcgctcattgcgcctcccgcaggtggtaa

SEQ ID NO: 2736 - DNA, 507 bp, Klebsiella pneumoniae
tcgcctttgtcgcaagcacgatccgcgatagtcagaaacagaaaacttcagcaattatccccggtggcggctaacgccttgccgggggctacaagagcacgacttgtcgcccggctgcgcagcgctgaccagggaaagccgctactttttcggtcgatatttttccggcagcggcggcaccgggcgcctgtcgtccagcagatggcgaacagtgaggatcgggtggcgccagagcatccgcggcccggcccagcgcataatctgcttcatctcctcgcgcttcgccggctggtagcaatgcaccggacactgcttgcaggccggtttgttctcgccaaacacgcacttatcaaggcgcttgtcagcgtaggcgttcagcgcctgatagtgcgcattatcggcctgcgcctcgggacagcgccgctggtagagggcaatcatccgctgaatcgtcattttttcccgttcgatacgcttccccatctccctgcctttcgtcttttttaa

SEQ ID NO: 2737 - DNA, 828 bp, Klebsiella pneumoniae
ggttctatgtctgttgtaatcagcgatgcctggcgccagcgttttggcggtacggcacgtttatatggtgaaaaagcgctgcaatgttttgccgacgcccacgtctgcgtggtcgggatcggcggggtcggctcctgggcggcggaagcgctggcgcggaccggcatcggggcgatcacccttatcgatatggacgatgtctgcgtcactaacaccaatcgtcagatccacgccctcagcggcaacgtcggactggcgaaagcggaggtgatggcggagcgtattcgcctcatcaacccggagtgtcgggtgacggtggtggatgatttcgtgaccccggaaaacgtggcggaatatcttggcgtcggctttagctatgttatcgacgccatcgatagcgtccggccgaaagcggcgcttatcgcctggtgtcgccgctacaaggtgccgctggtgactaccggcggggcgggtggtcagattgacccaacgcagatccaggtcgcggacctggcgaagaccatccaggatccgctggcggccaaactgcgcgagcggctgaaaagccagtttggggtggtgaaaaacagcaaaggtaagctcggtgtagactgcgtcttctctacggaagcgctggtctacccgcaggcggacggcagcgtctgcgcaatgaagagcacggcggaagggccgaagcggatggactgcgcttccggctttggcgcggcgacgatggtgaccgcgacctttggcttcgtcgcggtgtcgcatgccctgaagaagatgctggcgaaagcgcagcgtgacgctgcggcttccggaaagtag

SEQ ID NO: 2738 - DNA, 1449 bp, Klebsiella pneumoniae
aatccgatgtcgaaaaattatgcagccctggcgcaacagatagtcgcggcaatcggcggggtcgacaacgtcgccgccgttacccactgcatgacccgtctgcgcttcgtggttaaagacgacgaacaggtcgatagctctaccctgaaagggctggccggggtgctcggcgtcgtgcgcagcgataaccagtgccaggtgatcatcggcaacactgtctcccaggcctaccgcgaggtggtgaatctgctgcctggcgacctgcgcccggctgagccgcagggcaaagcgccgctgaccctgaaacgcatcggcgccgggatcctcgacgcgctgatcggcaccatgtcaccgctgatcccggcgattatcggcggatcgatggtcaagctgctggcgatgatcctcgagatgagcggcgcgttgccgaaaggctcgccgacgctgaccctgctggcgcttatcggcgacggcgcatttttcttcctgccgctgatggtggccgcctccgcggcggtgaaattcaaaactaatatgtcgctggctatcgccatcgccggggtgctggtgcatcctgggtttatcgaattgatggccaaagccgcccagggagaacacgttgaattcgcctttattccggttaccgcggtgaaatacacctatacggtgatcccggcgctggtgatgacctggtgcctgtcgtatatcgagcgctgggtggatcgcattaccccggcggtgacgaaaaactttctgaagccgatgctgatcgtgctgatcgccgccccgctggcgatcctgctgattggcccgctgggcatctggatcggcagcgccatttccgcgctggtgtatacgatccacagctatctcggctggctgtcggtggcgatcatgggcgggctgtggccgctgttggtgatgaccggtatgcaccgcgtctttacgccgaccatcattcagaccatcgccgaaaccggcaaagagggtatggtgatgccatcggagatcggcgccaacctgtcgctcggcggctcttcgctggcggtagcgtggaaaaccaaaaacccggagctgcgccagacggcgctggccgccgcggcatcggcgattctggccgggatttccgaaccggcgctgtatggcgtggcggtgcgcctgaagcgcccgctgatcgccagcttaatcagcggctttatctgcggcgcggtggcaggtattgccggactggccagccattcgatggcggcgccggggctgtttaccagcgtgcagtttttcgatccggccaatccaatgaccatcgtctgggtgtttggcgtgatggcgctgtcggtggtgctgtcgtttgccctgacgctgatccttggctttgaggacattcccgttgagcaggccgctgccgacgccagagcgcgccaggcccgggcccaggcatcccacgcctga

SEQ ID NO: 2739 - DNA, 684 bp, Klebsiella pneumoniae
ccccgatcgtcggcatgctgcagggcgtggtggaaaaagggtggcgagctgcgtgtggaagtggcggataccaacgaaagcaaagagctgatgaagttctgccgcaagtttacggtgccgttacgcgcggcgctgcgcgaggcgggcgtgctgaccaactatgaaacgccaaagcgaccggtggtgcatgtgttctttatcgcacccggctgctgctataccggctactcatacagcaacaacaactcaccgttctatatgggcattccgcggctgaagtttccgtccgacgccccgagccgttccaccctcaagctggaagaggcgttccacgtctttattccggcggacgagtgggacgagcgtctggcgaacggcatgtatgccgtcgatctcggcgcctgcccgggcggctggacctatcagctggtgaagcgcaacatgtgggtctcttcggtcgataacggcccgatggcccagagcctgatggataccggccaggtgacctggctgcgcgaagacggtttccgctatcgtccgaaccgcaacaacatctcgtggatggtctgcgatatggtggagaaaccggcgaatgtggccggcgctgatggcgcagtggctggtcaacggctggtgccgggagaccatcttcaacctcaagctgccgatgaaaaagcgctatga

SEQ ID NO: 2740 - DNA, 534 bp, Klebsiella pneumoniae
ctatatgcgtctgcttggccagggcgacagccaggtgctgcgctggctggaggcggagaaagatccgcgtctgaccgagatcgtcacccatctcaaccaggtggtcgagggggcgcgtatccgatgagcgagacggtggtgttcagtcagctgagccgtaaatttattgatgagaacgacgccacgccggatcaggcgcagcaggtggtctattacagcctggcgattggccaccacctcggcgtcatcgactgtctggaggcggcgctgagctgtccgtgggacgcgtatctggcatggatcgccacccttgaggccggaagcgccgcgcggcgcaaaatggagggcgtgccgaagtatggcgaaatcgtcatcgacagcagtcatgtggcgatgctggccaacgcctttgataaagcgcagtccgcgcagaccccgcagcagcaggcgtggagcaaaaccctgctcagcatgctgcatgatattcaccaggagagcgccatctacctgatggtgaggagattacgtgactga

SEQ ID NO: 2741 - DNA, 987 bp, Klebsiella pneumoniae
accggcgcgtcaggtggcgcgggaagccggggcccactacggcggcgtgctgtatgtcgattcgctgagcgccgccgacggcccggtgccgacctggctcgacctgctgcgcgtcaccaccgaaaccatcgtcaacggtatccaggacgggatgaggaagcagccatgaatgcagcgcaagcgggactgtatgtcaaccagctcaccgtcacctggcgcaacggccacactgccctgcgcgacgcctcgttcagcgtgccgcgcggctccattgccgcgctggtaggcgttaacggctcgggtaaatccacgctgtttaaagcgctgatgggctttgtgcgcgtcggccacggcgagatcgccatactcggccagccggtcaaccgcgcgctgcgccagaacctggtcgcctatgtcccgcagtcggaagaggtggactggtccttcccggtgctggtggaggatgtggtgatgatgggccgctacggccatatgggctggctgcggcgggcaaagccgcgcgatcgcgagattgtcgatgccgcgctggcccgcgtgggcatgagcgagttccgccatcggcagattggcgagctctccggcgggcagaaaaagcgcgtctttcttgcccgcgccatcgctcagcagggtcaggtgatcctgctggatgagcctttcaccggcgtcgatgtgcagaccgaagcgcggatcatcagcctgctgcgcgagctccgcgatgagggctgtaccatgctggtctccacccacaacctcgggtcagtgagcgaattttgtgattatacggtgatggtgaaaggcaccgtgctggccagcggcccgacagaaaccaccttcaccgccgagaatctggagcgggctttcagcggcgtgctgcgccacgtcgcgctcacaggcggggaagcgcaggttatcaccgatgacgagcggccgtttatcagccggcgcgcggcgggaggcccacgatga

SEQ ID NO: 2742 - DNA, 312 bp, Klebsiella pneumoniae
caaagtaggtcatcagatccgccagcatggcgcagagaaagaccccgacatcgcgacggatccccgcccgacaggccagcttccacaccagatagccgaccatcgggccgatcaccgccatcgacatcccgttggcgccaagggtggtcaggccgccatgcgccagcagcagcgcctggaacagcagaacgatcgcccccagcaccgccaccacgcccggcccgaagaggatcaccgccagaccgacgccggtcggatgcgagcagctgccggtcaccgacgggatcttcagcgccgaaagaacaaaaataa

SEQ ID NO: 2743 - DNA, 1134 bp, Klebsiella pneumoniae
  unsure (702),(723),(783): Identity of nucleotide at the above locations are unknown.
aaaccgtctccggactgtgccagacacgctgaggcggctatgaaatctgtttttcgtctacttcctttcctctttctgctggggctgagcgcctatcttcccggcgtgcgggctgaaacctgccgcgcaaatatcggccagaccacggtcaatattcctaatatcaagtatttacccacgctgccggtcaatacacagatgaccagcgcgatggcggataacggcagcgggatccctttttcctgcgacctgcagttgccgacggcgagcgccaaacgcatcgtctataagcagctgaaaaccggcggctcgccgatggtgattaacggacagcatgtctaccccagcgctatcgacggcattggttacgccctcagcttccagtgcgccggcggcccgatgcgtgccatcgatggcagccactccgccggcgacgagtcggtggtggtatgcgacagtgcgacgctcccggcgctgatgacgcagcagcaaaccacggtgaggattgcggtaaccttctataaaactggtacggtgcaactggcggacgggacgcataccaactcgccgccgctgccgcaggtgggggagatgaccattgaacagcagaccagcgcaagcgccagctttgtcgccagcgcgccggtcagcatcgatatcgccgccctgaatgtggacattggcagcagcggcagctgccangtagcgacatcgacgatccangtcagtctgggtacggttaaccggggggagtttcatggcaaagggactaccggcggccangcgaagcgcttttcgattccggtcttctgtccgacgccgaccgacgtgcgcatcggctttttcggcgtcagcgtggagagcgataccctggccctgagccaggccagcaacagcgccagcggcgtcggcgtgaagctgacctacggcaataaccccggtgcggcagtgcccgacggcaccagcgttaagatcaatgaggccagcaacttgccgatcctgaaaagggtgaccggcgccagcgccggtaccgccgaggcgatcaatttcaacgcccagtatgtgcagactgacgccacggtgggagccggtacggccaacagcatggtgactttcgccctggagtataactag

SEQ ID NO: 2744 - DNA, 348 bp, Klebsiella pneumoniae
tccgctcatccaacctcatcaggagcggtaattatgaaaaaaattatgttgtgttgttcagcaggcatgtccaccagcctgctgatgaaaaaaatgattgcggaagccgaacagcggggcctgccggtagagatcaacgcatatggcgtagcggagttcgccgaacaggtcggccattatcaggtggtgctgttggggccgcaggtgaaatacatgcagcaggatctgcaaaaacaggcggataaatacggtatccgcgtcgaacccatcaatatgatggactacggcatgcaaaaaggcgccgcggtccttgatttcgccctttcccttatcgaaaacaagaactaa

SEQ ID NO: 2745 - DNA, 366 bp, Klebsiella pneumoniae
acttatcatccccttttgctgatggagctgcacatgaacccattcaaaggccggcattttcagcgtgacatcattctgtgggccgtacgctggtactgcaaatacggcatcagttaccgtgagctgcaggagatgctggctgaacgcggagtgaatgtcgatcactccacgatttaccgctgggttcagcgttatgcgcctgaaatggaaaaacggctgcgctggtactggcgtaacccttccgatctttgcccgtggcacatggatgaaacctacgtgaaggtcaatggccgctgggcgtatctgtaccgggccgtcgacagccggggccggtcttcaccacggggctggaaggatccgcggtag

SEQ ID NO: 2746 - DNA, 486 bp, Klebsiella pneumoniae
agggggcgtccagccagcgcttctgaaagtagtcgcggatgcggatggtgggcgacagcagctggcagtagcctttgtcggtggagacgatggtggcctgatggcccgcctgggccaccttcaccgccagggtggcggcgagatcgtctgcttcgctgcccggcgaggcccagcagcggatcccccgctgttcgaaggcggcccgcagcgccggcatctcggccaccagcgtctccggcatcggcgcgcggccggctttgtactccggcaggtgctggtggcgccagccgtgggcgcgatcctcatcatcgaacaccgccaccgcgtgggtgggctgactgtggacaatcagctgctccagggcatgcaggcaggtatcgacgcagggtgaaccctgcaccgcgtggatgcggcggattagatttaacgcgtcgacgattaacagatgaacagccacagatacccccttattctcagcgtctttag

SEQ ID NO: 2747 - DNA, 297 bp, Klebsiella pneumoniae
tgcgaatcccctgctgagcgattcgtggtctcgctgccagcgctacgggctggatcccgccaccgaggattttccccgcctcggcgccggcgagctggcggaccggctcgccagccaccgcggcctgcagcagctggcgcagccggtggtggaagccctgtcgcgccaggtcgcagacctgcagtcggtggtgatcctttccgaccccgacggcctggtgctgcatactctcggcgatacccaggcgctgcaaaaggcccagcgcgtggcgctggctcccggcaatctgtggagtga

SEQ ID NO: 2748 - DNA, 441 bp, Klebsiella pneumoniae
agaccggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccaaacattcttcgtctattttattctcgcctgagagaataaataatccctgtttggtaatgactccaacttattga

SEQ ID NO: 2749 - DNA, 399 bp, Klebsiella pneumoniae
tttcattgccctcctggcgcaccgtctccagcagcgacggcagcgcatggcgatccacgcggcaggcgaggtcgtcgctcaccagacggaaggcctgctggcgggaaagctgatatttacgcagcagaccgaagaactggtgaacgtcggtcatcgcgcgccagtcgttctccagggcggcgccatcggcggtatcggcatatttcaccggctccagcgggcgcagggtcagcggtgccggcgccgccacccgatattccgcgatcagggtctcccaggccgccatgtcggtctgcgtggtcgcatagactttcagcagggcgtcgccgtggtggtcgaaaaactggatgctctgacggccattatcgttcagatggaaggcgctggcccactggctga

SEQ ID NO: 2750 - DNA, 1212 bp, Klebsiella pneumoniae
acaccatgcccgctcgattggcctgaacacccgcggcctgaaactgctgttctttaccctgctggccgcctgcaccgtggcggcgctgcagaccgtcggcgcctttctggtcatctgcctggttgtgactcccggggccaccgcgtggctgttaaccgaccgctttccgcgcctgctggccatcgccgtgtctatcggcagcctgacaagtttcttcggcgcctggctcagctactatctcgacggcgccaccggcggcattatcgtggtcgcgcaaacgctgctgttcctcatcacctttatcttcgcgccgaagcacggcctgctggccagccgccgccgcgccagggaggccgcatgctgaacctgttcctggccccgttccagtttccttttatggtcaatgcgatagcgatatcgatcgtcgtcgccattccctgcgcgctgctgtcggtgtttctggtgctcaaaggctgggcgctgatgggcgacgccatgagccacgcggtctttccgggcgtggtgctggcctacattatcggcatccccttcgccatcggcgcgtttatcgccggtctgctgtgcgccgtgacgaccggttttctcgacgataacagccgactcaagcgcgataccatcatggggattgtcttctccggcatgtttggcgccggactggtgctgtacgtagcgatccagtccgatgttcatctcgaccatatcctgttcggcgatatgctgggaatatccctccgcgatattgggcaaacgacggcgatcgcactggtgattgcgttgattatcggtctcaaatggcgggattttttgctgcacgccttcgatccaacgcaggctaaagccagcggcctgcgcggcggactgctgcactacggcctgctgtgcatgatcgccctgaccatcgtcgcgacgctgcagtcggtagggattattctgtcgatttcgctgctgattgcccccggggcgatcgcgctcctgctggtacggcgctttatccacgccctgctgctggcggtagcggtggccatcggctgctcggcgggaggggtgtggctggcgttttatctcgatagcgcgccagcgccgactatcgtggtgctgtttaccgcgctgtttgtagtcgcctttgtcgcaagcacgatccgcgatagtcagaaacagaaaacttcagcaattatccccggtggcggctaa

SEQ ID NO: 2751 - DNA, 270 bp, Klebsiella pneumoniae
cctcgccgccctgtgggccgaccgcatcctgctgctccaccagggacatctggtcgcccagggcacgccgcaggaggtgatccagcagccggttatccatcgctggtacggggcggatgtccgcctcgtccagcacccggacaacgcggtcccccaggtttatctggcgccgtaacccccgcgcggcgcaactggaatccggatcgcgccgcgcgctttcgtcggtttccctcacctgcccatctccgttattatgtctcatccatgtga

SEQ ID NO: 2752 - DNA, 633 bp, Klebsiella pneumoniae
ggatcgcgcccacggctggcgccaccagcacctgccggagtacaaagccggccgcgcgccgatgccggagacgctggtggccgagatgccggcgctgcgggccgccttcgaacagcgggggatccgctgctgggcctcgccgggcagcgaagcagacgatctcgccgccaccctggcggtgaaggtggcccaggcgggccatcaggccaccatcgtctccaccgacaaaggctactgccagctgctgtcgcccaccatccgcatccgcgactactttcagaagcgctggctggacgcccccttcatcgccagcgagttcggcgtcaccccggagcagctggcggattactgggggctggcggggatcagcagctcgaaggtgccgggcgtggcgggcattggacccaaaagcgccgcccagctgctgaacgagtttcaggacctggaggggctgtacgcccgtctggccgaggtcccggagaagtggcgcaaaaagctggccgcgcatcaggagatggccttcacctgccgggaggtggcccgcctgcagaccgacctccagctggacggcaatctgcagcagctgcggctgacgcgctgaccttcgttaagaggtgcgccggtgcagggtga

SEQ ID NO: 2753 - DNA, 1128 bp, Klebsiella pneumoniae
agtgacagcccctgggcccagtattcattaaccatgtctggagttctcccgacgaaagaccagccacagaaaccagggggcgcccagcaggctggtgagcagaccgaccggtatctccgccggcgccgccacggtgcgggccagggtgtcggccagcagaagcaggatcgcgccggccagcagcgagccggggatcagtccgcgatggtcaggtcccagccacaggcgcatcaggtgcggcaccaccaggccgataaagccgatgactccgctgatggccaccgcgacggccaccagcaccgcgctgcacagcagcagccagcgctgcagcgcctgcacgttgaccccaagatagtgcgcctcttcatcgccaagctgcagcagattgaggcgggacgccatccaccacaccgccagcgccgccgggataatcaaggtcgcggccaccagcagcgtcggccattcggcctggcccagactgcccattccccacagcgacagctggcgcagctgggcgtcattgctcagccaggacaggacgccgaccagcgcgccgcacagcgcgttgatggcgatccccaccagcagcaggcgcgacagcgaaccctcctccgcccgactgaggatgaaaatcaccaccatcaccgccaggctgccaataaacgccgccagcatcggcatatacagagcgatcagccccgcagcggagaacgggagcaccagccagctggccaccgccagcgcggcgccgctgctgatgcccagcaggcccgggtcggcaagcgggttgcgaaacagcccctgcatcacgcagccggagagggccagcgccgcgcccaccagcagggccagcagcacccgcggcagacggatggtcagccagatatggcgcagcatgtcatccccggaaggcagcaggttgaccagcggcaagcgcatggcgccgagggtggtggcaaacaacgtcagggagaccagcagcagcgtcatcagcagcaaacggcgagcgagggcagggcgcatcagggcaactgctccgctttgtttctcagcgcgattatcgcctgcggtgtgcgcggcccgaagcccagcagggccatatcgtcgatcgtcagcagctgtttatga

SEQ ID NO: 2754 - DNA, 630 bp, Klebsiella pneumoniae
cagcaaagcccagctataatagtctttataatcaatatattaaaaacttggaacgtattatgcatactccggcgcgtaaccttcttactgctggagaaatggatgaaccgtttcattatcgccgatgcgagcaaatgtatcggctgtcgcacttgcgaagtggcctgcgtggtatcccatcaggaacatcaggactgcgcctccctgacgcctcacacctttcagccgcgtattcacgtgatcaaaggggtcaatgtttccacggcgaccgcctgccgtcagtgtgaagacgccccctgcgccaatgtctgcccgaacggcgccatcagccgcgataaaggctttgtccatgtgatgcaggagcgttgcatcggctgcaaaacctgcgtcgtcgcctgcccgtacggggcgatggaggtggtggtgcgcccggtgatccgccatagcggcgccggattgaacgtcgtggcggaaaaagccgaagccaacaagtgcgatctctgcttccaccgcgagagcggcccggcctgcatggaagtgtgcccgacgcacgccctcgtgtgcgttgaccgcaacaaacttgagcagatgaatatcgagaaacgtcgccgtacggcgctggcctggtaa

SEQ ID NO: 2755 - DNA, 1152 bp, Klebsiella pneumoniae
gcaagagtaccgcgaggggaccctgcgcgaaaaactgttcggcggcggcccgcgtctggccgcgcctcacccgggcgccagctaccgccgcgatgcgcgcacggcggcatcggtagaggagaaggtgacatgatcgctattgatgacctgtataaaagttaccgcacggcggatggccggctcagcgcggtgctgaaagggctgtcgctgcaggtgcctgagcgctccatcaccgcggtggtggggccgagcggcgccggtaaatcaaccctggcgcgctgcatcagcctgctggagcaaccggacagcggcagcattcgtatcaatggccaggatctgtcagcgctgtccggcgaggcgctgcgccgggaacggcgggcgattggcaccgttttccagtcttcggcgctgttgagccgcaggaccgcctgggagaatgtcgcactgccgctggcgtggcttggtgtggtggagcgcgatatcaaggcgcgggttggcgagctgctggagagcgtcggcctgagccacaaagcggatgcctggccggcccagctctcaggcggccagcgccagcggatcggcattgcccgcgcgctggcgctgcgcccgtccgttctgctggcggatgaagccacctccggcctcgatcctcaggccacggcctcggtgctggctctgctcaagcggctgcgtgatgagtaccagctggcgatcgtcctgattacccatgaaatggacgcggtgcgcacggcggcggatgcggtggcggagatccgcgacgggacgatcgtccagtacgggcggatcgaagatctgctggcgcgtcccgattctctgctcggccagcagctgttgccgctgacgccggcggcagctacccacagcgatctgctgctgcgtctgagctaccgctgggatgtgccggtggccaccgactggatcagccgcctgagccagcagtgggcgctgcagatcgatctccttggcggtcacgtcgaggtgattaatggtcggctggccggtcgcctgcaggccggagtgcgctttcagggcgaacgcctgtcgcccgcgcgactgcagggcctgctggcgcagctcggcataacggcggagatcctcgacagcgcgccgttgctcagggaggcggtatga

SEQ ID NO: 2756 - DNA, 480 bp, Klebsiella pneumoniae
tgcgcttcaccgcctgcccaattacccggacctgagcccatgaaacgcctgatgcttatcggacccagccagtgcggcaaaacttcgctgacccaggtattgcgcggcgaaaccctgcgctatcagaaaacccaggccatcgtctggacgccggccgcgatcgatacccccggggaatatctggaaaatcgctgcctgtacagcgcgctgttaaccagcgcctgcgaggccgatgtcatcgcgctggtactgaatgccgatgcgccctggtcacccttttctccggggtttaccgccccgatgaaccgcccggtcatcggggtgatcactaaagccgatttggccgccccgccccgtctgcaacaggtccgggcatggctcgaggcggcgggcgccggacatatctttatcaccagcgcgttaaccggcgacgggcttgatgacctgttcgcctgcctgaatgcagaggaatatcaatga

SEQ ID NO: 2757 - DNA, 246 bp, Klebsiella pneumoniae
caatcaccaccagcaccgccagctcaaccagcgcgatcccgcgcagcagcgccggcgccgaggccgattgccagcccggcaccagacgcaccggattcagccagtgacgcagcttcagcagcggcgcaaaggcctctttcaccggcatggcaaagccgtgggccgttaccaccatcgactgctcgtggtcgtaaccgcagacccacgccgcgccgcgcgagcgcgccgccaggcgatcgcctttaa

SEQ ID NO: 2758 - DNA, 300 bp, Klebsiella pneumoniae
atgaccacacctgaagacctgcaggcccgcgccggagaagccgccgcgctgatgaaagcgatgagcaatcctcaccgattgctgatcctgtgcatgctgtgcgatgcgcccagggcaagcgccggcgaactcgcccgggctacagggctgagcccctccgccacctcgcaacacctcgcgcggatgcgtgacgaggggctgatcgacagcgagcgcgacgcccagcgtatccactatttcatcacccaccctgcggtacagcaggtgatcaatacgctgaaaacgctctattgcccgtga

SEQ ID NO: 2759 - DNA, 558 bp, Klebsiella pneumoniae
agagagaaaccggtggaccatcagacagcagaagcgctacgcgcttttacccaacgatattgcgccctctggcagcagcagcgccacagcctgccgcgcagtgaagagctttacggcgtcccgtcgccttgcgttgtcgacacccagggcgaggccgttttctggcagccgcagccgttttcgctggcgcaaaatatcagcgcggttgaacgcgccctcgacattgtggtacaacagccgcttcattcttattataccactcagtttgccggcgatatgtccggccggtttgccggcgaaaccttgacgctgctgcagacctggagtgaagaggatttccagcgggtgcaggaaaatttaatcgggcacctggtggtgcagaagcggttgaagctgtcgccgacgctgtttatcgccaccctcgagagtgaactggatgtgatatccgtctgtaatctcagcggcgaggtagtcaaagagaccctcggcaccgccaaacgcattacgctttctccctcacttgcgggtttcctcaaccaccttgagccagttctgtaa

SEQ ID NO: 2760 - DNA, 519 bp, Klebsiella pneumoniae
cgaatgccgttgttagatagtttcacagtcgaccatacccgaatggaagccccagcggtgcgtgtcgcgaagaaaatgaacacgccgcatggcgatgaaatcaccgttttcgatctgcgcttctgcgtaccgaaccaggaagtgatgccggaacgcggtatccacaccctggagcatctgttcgcgggctttatgcgcgatcatctgaacgggaatggcgtggaaattatcgacatttcgccaatgggctgccgcaccggcttctatatgagcctgattggtacgccggacgagcagcgcgtcgctgacgcctggaaagcggcgatggccgatgtgcttaaggtgaaagatcagaaccagatcccggagctcaacgtctaccagtgcgggacttacaccatgcactcgctggaagaggcccaggacatcgctcgccatatcattgagcgcgatgtgcgcatcaacagcaacgacgaactggcgttgccgaaagaaaaactgcaggaactgcacatctag

SEQ ID NO: 2761 - DNA, 1560 bp, Klebsiella pneumoniae
ccgaccatgccgctgacgtggcggcgcaagcgttactcacgctcgggatcccgcaggactcccgatgtcctgcgtactgaatacctctctttcttttccctgattcattttgccgcgtgcgccccggcgacgggccgcgctatggagattgctatgtcatcacaacgtgaaattcgtcttaacgctttcgatatgaactgcgtcggccatcagtcgccgggcctgtgggcgcatccccgggatcgctcctggcagtataaagatctggagtactgggtggatctggcgcggctgctggagcgcggcaagttcgacgggctgtttatcgccgacgtgctggggatctatgacgtgctgaacggcagcggcgatgcggcgatccgccaggcgacgcaggttccggtcaacgatccgctggctctgatcaccccaatggcgctggtgacggagcatctgggcttcggcctgaccgcctcgctgtcgtttgagcatccttaccccttcgctcgtcgtctgtcgacgctcgatcatctgaccaaagggcgggtgggctggaatatcgtcacctcctatctggagagcggggcgcgcaatatcggccagcagacccagaccgaccatgacacccgctatgactatgccgatgagtatttgcaggtgatctataagttgctggagggaagctgggaggatggggcggtgctgcgcgacagagagcggaagatcttcagcgatccgcggaaaatccatcccattaaccatcagggacagttcttttccgtgccggggatccacctctgcgagccatccccgcagcgcacgccggtgctgtatcaggcgggggcgtccagccgcggcaaacagttcgccgccggccatgccgaatgcgtcttcgtcgcagcgccgtcgaaggtgctgctgaagaagacggtggcggatattcgccgccgggcagctgaggcggggcgcgatccgcacagcatcctgatcttcaacctgcagacggtgattgtcggcgacaccgaccgcgaggcacaggcgaagtggcaggaatataagcagtacgtcagctatgaaggcgcgctggcgctgctctccggctggacggggatcgatttcggccagtatcagccggatcaggtgctgaagtatctgcacaccaacgccattcagtcggcggtggaggccttttcgaccgctgatccgaaccgccagtggacggtgcaggccctggccgattgggcggggatcggcggcttcggtccgctggtggttggcagcgcgcaaaccgtggcggacgaactgcagtcctgggtcgaagagacggacgtcgatggctttaacctcgcctatgccgtcactcacgaaaccttccgcgacgtcgtcgagctgctggtgcctgagctgcaaaagcgcgacgtctttaagcaagagtaccgcgaggggaccctgcgcgaaaaactgttcggcggcggcccgcgtctggccgcgcctcacccgggcgccagctaccgccgcgatgcgcgcacggcggcatcggtagaggagaaggtgacatga

SEQ ID NO: 2762 - DNA, 1047 bp, Klebsiella pneumoniae
ttaccgatgccgatattgacccgggattccagcgggcgctggaagccaaaggtattgaagtcattattactggagaacatcatgagtaactttttgttagaggccggacgccagaccctgatgcttgagctgcaggaggcgagccgcctgccggagcgcctgggcgacgacttcatccgcgcggcggaaaccattatccactgcgagggcaaactgattgtctccggtatcggtaaatccggccacatcggtaaaaagctggcggcaaccttcgccagcaccggcaccccggcctttttcgtccatccggcggaagccctgcacggcgatctcggcatgctcgatagccgcgacgtgatgctgtttatctcctactccggtagcgcgaaagagctggatctcatcgtgccgcggctggaagaaaaaggcattccgctgctggcgatgaccggcaaatccacctcgccgctggcgctggcggcgaaagcggtgctggatatcgccgtggagcgcgaggcctgcccgatgcatctggcgccaacctccagcaccgtcaacacgctgatgctgggcgacgcgttggcgatggcggtgatgcaggcgcgcggtttcaatgaagaggatttcgcccgttcccacccggcgggcgccctcggcgcgcggctgctgaacaaagtgcatcacctgatgcgtcgtgatgaagaagtgccgcgggtcaataccgaggctaacgtcatggacgccatgctcgaactaagccgaaccggactcggcctggtggcggtctgcgatgaagccaaccgcgtgcagggcgttttcaccgacggcgacctgcgccgctggctggttgctggcggtacgctcaacgatggcgtcactcgggcgatgacccgcaatggcgtaacgctgcaggcggatagccgcgcggtggaagccaaagagcgactgatgaaacacaaaatcagcgccgcgccggtagtggatgagaacggccaactggtcggcgccattaacctgcagaacttttaccaggcggggatcctttaa

SEQ ID NO: 2763 - DNA, 798 bp, Klebsiella pneumoniae
actgacccgccacatgagggaggccagctgatgagcactttacttggcccgcgcgatgaaaacggtattcccgtgccgatgacggtggatgaatccatcgccagcatgaaggcctcgctactgaagaagattaaacgttcggcctacgtctaccgcgtcgactgtggcggctgcaacggctgcgaaatcgaaattttcgccaccctttcgccgctgttcgacgctgaacgcttcgggattaaggtggtgccttcgccgcgccatgccgatattctgttgtttaccggggcagtgactcgcgcgatgcgctccccggcgctgcgcgcctggcagtcggcgccggatccgaagatctgtatctcctacggcgcctgcggcaacagcggcggcatcttccacgacctgtactgcgtctggggcggtaccgataaaatcgtaccggtcgacgtctatattccgggctgcccgccgacgccagccgccacgctgtacggcttcgccatggcgcttggcctgctggagcagaaaattcatgcccgtctgccgggtgagctcgacgaacagccgaccgagctgctgcatgccgatatggtgcagcctctgcgggtgcgcatcgatcgcgaagcgcggcgtctggcgggctaccgctatggacggcagattgccgatgactatatgcgtctgcttggccagggcgacagccaggtgctgcgctggctggaggcggagaaagatccgcgtctgaccgagatcgtcacccatctcaaccaggtggtcgagggggcgcgtatccgatga

SEQ ID NO: 2764 - DNA, 513 bp, Klebsiella pneumoniae
ccgtcaccgcccccgcgccggtgcagaaagccggtagcgaacacagcatcagcgcccgggagctggagaataaaggcgctaacgatttcggctcaatcatgcgctatgagccgctcatcagcgccaccggggccagcggcggctccggcaacggcaaaagcggcttcgaccgcggaggttacaccggctacaacattcgcggtatggagagcaaccgcgtcggcatcgacgtggacggtatcgcgcaacccaacgccaccggccgcggctacgtcggccgcgccgggctcaacaccttcggcatcggccgcgattatatcgacccgtatatgtacggcagcgtggatatccagtccggcgccacctcgacggaaacggccaacagcgctatcggggggaatgtctccttccgcccgaaatcagcggatgattacctgcgcccgggcaagaccagcgccttcggctaccgcagcggttacgactctgcggatcgcagctggcacaacggggtga

SEQ ID NO: 2765 - DNA, 1083 bp, Klebsiella pneumoniae
ccgggccagccctggcagggattctgtatgcaaaatttaaacacggttctgcgggcgatccccgcgccggacgccgacgccatggcgcgggcacagcaacacatcgacggcttactcaagccccccggcagcctcgggcgtctggaggcgctggcggtgcagctggcgggaatgcccggcctgggcggccagccgcaggtggcgaaaaaggccttgctggtgatgtgcgccgaccatggagtgtgggacgaaggggtggcgatttcgccgaaggcggtcaccgccatccaggcggcaaatatgacccgcggcaccaccggcgtctgcgtgctcgccgcccaggccggggcgaaagtgcatgtaattgatgtcggtatcgatagcgaaccgctccccggcgtggtgaatatgcgggtggcgcggggctgcggcaatattgcccgcggtccggcgatgagccgtgagcaggggcaggagctgttgctggaggtgatgcgctacacccgcgcgctggcccaggagggcgttaccctgtttggcgtcggcgaactggggatggccaataccacgccggcggcagcgatcgtcagcgttttgaccggcagcgatgcgcaggaggtggtcgggattggcgccaatctgccgctggcgaaggttggcaacaaggtggaggtggtgcggcgggctatcgccgtcaatcagcccgacccgaatgatggcctcgacgtactgagcaaagtcggtggtttcgatctgctggggatgaccggtgtcatgctgggggcggcgtcctgtgggctgccggtggtgctggatggctttctctcctacgcggcggcgctggcggcgtgtcagatagcgccggaggtgaaaccgtatctgatcccgtcccactattcggcggagaagggggcgcgtatcgcgttggcgcacctgggtctcgaaccgtatctcaatatgggcatgcgtctgggagaaggcagcggcgcggcgctggcgatgccgatcgtcgaggcggcctgcgcgatgtaccatcgcatgggcatgctggcggcaagcaatattgtgttaccgaaggggtaa

SEQ ID NO: 2766 - DNA, 1434 bp, Klebsiella pneumoniae
gcgcgatggcccgccgcagccctgctactgcggcaaaacgaactgcatcgaaagctttctctccggtaccggcttcgcccgccgctatggggaacaagcccgtgcggaagccattgtcgccgcggcgcaaaacggcgatccgcgcgcgctggcccactggcgacactttatcgatgcctttgcccgcagcctggcgtcggtgatcaatattctcgacccgcaggtgattgtgctgggcggcggtctgtccaacgtcagccagatctatcgcgatctgcctgccgccatcgtgccgtggatcttctccgacacctgccgcacgcagatcaaaccggcccgtttcggcgacgccagcggcgtgcgcggcgcggcctggctgccccggcttcccggcgccgcgcaagggcagcggtagacacttttttcagcaggtatgttaagctaggcgaaaatgttcagacagaaaaagccatgccaacgattgatgatgtttcaagattagcgaatgtctcaagagcgacggtatcccgcgtgctgaccggcacccggggcgtgcgcgaagagagccgggaagctgtgctgcgggccgttgaagaactcaactatcgcccgagctttgccgcgcaaaacctcgccagtcagacatccagccacgttggtctggtgatttccgcgcaggacgaaagccacggcgcacgtctgctgccgctgctctctcaggcgctgaaagggctgaataaaagcctgctggtccagtacgtcagcgacccggtagagcaggcggcggtaatcgacgatctgcagcgccagtgcgtggcggtggtggtgctgggcgccgttgccgccgacgcgccgcgcaacgttatcgcctttgaccgcttcggcgtcgccgggagcaacagccagggctatgacttcgcctttgccaccgaaagcgcctgccgctatgtgattggcaagggacaccgcaacatcgccctgctggtggacagcgatagcgacgatgccagccgtcagatgctggaaggctaccgcaacgtcctgcagaactactccattccttttaaccgtcagctggtgctgacggccaacgatgacgtcgagcaggcgctgctgaccttaattaacagcttcagtaaatactcagtcattatcgttaaacgcgaccgctacgcggctgaggcgatgcgtctgctgcgcgaattcaccatcgccgtcccgcaggaggtctccctgctgagccttgaggattccccgctcgcctcgctgctctacccgccgctgacctgcatctcctggccactggaggcgctgctggataactgtattcagcgtattcgcagcctgattgacgaccggccaaccttcgccaccgagggccgctcgctggctggccgcctgatcccgcgccagtcggtcgccgatatctcttga

SEQ ID NO: 2767 - DNA, 1518 bp, Klebsiella pneumoniae
atacagcggccatatcagcaacgtcttcgtggtgattatgggcctgattgccatctccgcgatcttctactctctgttcagctaattcattcaacgcctccccccgcgccgctttacggcggcgcgctttccgacagcacgggaatacatatgatcagcgtattcgatatctttaaaatcggcattggcccttccagctcccataccgttggaccgatgaaagcgggcaaacaattcactgacgacctgatcgcgcgcggcctgctggccgaggtgagcaaagtcgtcgtcgacgtctacggctccctctccctgaccggtaaaggccaccataccgatatcgcgattatcatgggactcgccggcaacctgccggacaccgtcgacatcgacgccattccgggctttattcaggatgttaatacccatggccgcctgatgctggccaacggtcagcacgaagtggacttcccggtggatcagtgcatgaatttccatgccgacaacctgtcgctgcatgagaacggcatgcgtatcaccgccctggccggcgacaaggtgctctacagccagacatattactctatcggcggcggctttatcgttgatgaggagcacttcggccagactaccgaggcgccggttgccgttccttacccttacaaaaacgccgccgacctgcagcgtcactgccgtgaaaccgggctgtcgctctccggcctgatgatgcagaacgaactggcgctgcacagcaaagaagcccttgagcaacacttcgccgcggtgtgggaagtgatgagcgccggtatcgagcgcggcatcaccaccgaaggcgtcctgccgggcaaactgcgcgtcccgcgccgcgccgccgcgctgcgccgtatgctggtgagccaggacaccaccaacagcgatccgatggcggtggtcgactggatcaatatgttcgccctggcggtgaacgaagagaacgccgccggcggccgggtggtgaccgcgccaaccaacggcgcctgcggtatcgtgccggcggtgctggcctactacgacaagtttatccgcaaggtgaacagcaactccctggcccgctatatgctggtcgccagcgcgattggttcgctgtataagatgaacgcctccatctccggcgccgaagtcggctgccagggtgaagtgggggtcgcctgctcgatggcggcggccggtctggcggaactgctgggcggcagcccgggtcaggtgtgcatcgcggcagagatcgctatggagcataacctcggcctgacctgcgacccggtcgccggccaggtgcaggtgccgtgcatcgaacgcaacgctatcgctgccgtgaaagcggtcaacgccgcgcgaatggcgctgcgccggaccagcgagccgcgagtgtgtctcgataaagtgatcgagaccatgtacgaaaccggcaaagacatgaacgccaagtaccgggaaacctcccgcggtggtctggcgatgaagattgttgcctgcgattaa

SEQ ID NO: 2768 - DNA, 462 bp, Klebsiella pneumoniae
gcgatcgggccgtttaccgcagcaacagctttggttacgcctttacccaggaaacgggatttgtcgccatcgcgcagttccagcgcttcgcgggaaccagtagaagcacctgacggagcagctgccataccgacgaaaccaccttccaggtgtacttcggcttcaacagtcgggttaccacgggagtcgatgatttcacgaccgatgactttaacgattttggacattaggttttcctcagtacaagttaaactaaaactccagacaaacaatgcacccggatgggtgcattgccgttcaaactctttttacttcgcctggcgtttctggtactcgctcgcggctttcacaaagccggcaaacagcgggtgtccatcacgcggcgtcgaagtaaactccgggtggaactggcaggccacaaaccacggatggttcggcacttcgatgatctcgaccaactga

SEQ ID NO: 2769 - DNA, 1485 bp, Klebsiella pneumoniae
caaaaagagttatgcaggacgatggcccgacacgccgacgcgtggcgggccagcaggttaatcgcaggcaacaatcttcatcgccagaccaccgcgggaggtttcccggtacttggcgttcatgtctttgccggtttcgtacatggtctcgatcactttatcgagacacactcgcggctcgctggtccggcgcagcgccattcgcgcggcgttgaccgctttcacggcagcgatagcgttgcgttcgatgcacggcacctgcacctggccggcgaccgggtcgcaggtcaggccgaggttatgctccatagcgatctctgccgcgatgcacacctgacccgggctgccgcccagcagttccgccagaccggccgccgccatcgagcaggcgacccccacttcaccctggcagccgacttcggcgccggagatggaggcgttcatcttatacagcgaaccaatcgcgctggcgaccagcatatagcgggccagggagttgctgttcaccttgcggataaacttgtcgtagtaggccagcaccgccggcacgataccgcaggcgccgttggttggcgcggtcaccacccggccgccggcggcgttctcttcgttcaccgccagggcgaacatattgatccagtcgaccaccgccatcggatcgctgttggtggtgtcctggctcaccagcatacggcgcagcgcggcggcgcggcgcgggacgcgcagtttgcccggcaggacgccttcggtggtgatgccgcgctcgataccggcgctcatcacttcccacaccgcggcgaagtgttgctcaagggcttctttgctgtgcagcgccagttcgttctgcatcatcaggccggagagcgacagcccggtttcacggcagtgacgctgcaggtcggcggcgtttttgtaagggtaaggaacggcaaccggcgcctcggtagtctggccgaagtgctcctcatcaacgataaagccgccgccgatagagtaatatgtctggctgtagagcaccttgtcgccggccagggcggtgatacgcatgccgttctcatgcagcgacaggttgtcggcatggaaattcatgcactgatccaccgggaagtccacttcgtgctgaccgttggccagcatcaggcggccatgggtattaacatcctgaataaagcccggaatggcgtcgatgtcgacggtgtccggcaggttgccggcgagtcccatgataatcgcgatatcggtatggtggcctttaccggtcagggagagggagccgtagacgtcgacgacgactttgctcacctcggccagcaggccgcgcgcgatcaggtcgtcagtgaattgtttgcccgctttcatcggtccaacggtatgggagctggaagggccaatgccgattttaaagatatcgaatacgctgatcatatgtattcccgtgctgtcggaaagcgcgccgccgtaaagcggcgcggggggaggcgttga

SEQ ID NO: 2770 - DNA, 876 bp, Klebsiella pneumoniae
attatgtgtacaacatgcggctgtggcgaaggcaacctctatattgaaggagacgaacgaaacccgcattccgcgttccgcagcgcccccttcgcgcccgccccacgccagacgatgaccatcacccgtgtcaaaactgaccacttcgcccccacccgcacgccagagggcgacctgcattacggccacggcgaagcgggtacccacgccccggggcagagccagcggcgaatgctggaagtggagatcgacgtgctggataaaaacaaccgcctggcggcacgcaaccgcgcacgcttcgcagcaaaacagcagctggtgctaaatctggtttccagccccggctccggcaaaaccaccctgctcaccgaaaccctcacccggctgaaaggacgcgccgactgcgcggtgattgaaggcgatcagcaaacggtcaatgacgccgcccgcattcgcgccaccggcaccccggcgattcaggtcaataccgggaaaggctgccatctcgacgcccagatgatcgccgacgccgccccgcgcctgccgctggctgaccgcggcattctgtttatcgaaaacgtcggcaacctggtctgcccggccagctttgatctcggcgagcgccataaggtggcggtgctgtcggtcaccgaaggcgaagacaaaccgctgaagtatccgcatatgttcgccgccgccagcctgatgctgctcaacaaagtcgacctgctgccgtatctcaatttcgacgttgagcggtgcctggcctgcgcccgcgaggtcaatccgcatattgaaattattcttgtctccgccaccagcggcgaaggcatggagcaatggctcacctggctggagacgcagcgatgtgcatag

SEQ ID NO: 2771 - DNA, 1368 bp, Klebsiella pneumoniae
ttcaggagtacaacaatgagttcattaagtcaggcggcgacggcggctgaaaagcgcaccaacgcccgctactggatagtggtgatgctgtttatcgtcacctcttttaactatggcgaccgggcgacgctgtcgatcgccggttcggaaatggccagggatatcggccttgatccggtggggatggggtatgtgttctccgccttctcatgggcttatgtcatcggccagatcccgggcggctggctgctcgaccgcttcggctcgaagcgcgtctatttctggtcgatcttcatctggtcgatgtttaccctgctgcagggcttcgtcgatatcttcagcggctttggcattatcgttgcgttgtttaccctgcgcttcctcgtcggccttgccgagtcgccgtcattccccggcaacagccggatcgtcgccgcctggttcccggcgcaggagagggggacagcggtatcgatttttaactccgcccagtactttgccaccgttattttcgcgccgatcatgggctggctgacgcatgaggtgggttggtcgcatgtgttcttctttatgggcgggctggggattgtgatcagctttgtgtggctgaaagtgatccacgatccgaacaaccacccgggcgtgaaccagaaagagctggactatatcgccgaaggcggggcgctgatcaacatggatcagaagagcagcgcgcagaaagtgccgtttagcgtcaaaatgggacagatcaagcaactgatcggctcgcggatgatgatcggcatctatatcggtcagtactgcatcaacgccttaacctacttctttatcacctggttcccggtttatctggtgcaggcgcgcggcatgtcgatcctcaaagccggctttgtcgcctcgattccggcggtgtgcggctttgtcggcggggtgctgggcggggtgatctccgactggttaatgcgccgcaccggctcgctgaacattgcgcgcaaaacgccgattgtgctggggatgctgctctccatgaccatgctgatgtgtaactatgtcaacgtggagtggatggtgatcggctttatggcaatggccttcttcggcaaagggatcggcgccctcggctgggcggtgatggcggataccgcgccgaaagagattagcggtctctccggcggtctgttcaatatgttcggcaatatctccggcatcgtcaccccaatcgccatcggctatatcgtcggcaccaccggctcgttcaacggcgcgctgatctacgtcggtatccatgccctggtggcggtgctgagctatctggtgctggtgggcgatatcaaacgtatcgaactgaaacctgtagcgggacgttaa

SEQ ID NO: 2772 - DNA, 954 bp, Klebsiella pneumoniae
gaatatatcaccatgacacagaacaatattctattaatttcaggcgctatattaccggtcatcattaccgtcatcatcggctatattagcggtaaacgaaaagactttaactggcagcaggcgggagacatcaataaaattgtgatgctctacgcattgccgctaagtattttcagcaatatggtgatgacgccgcgacacatcgtcatgaccatgggcccggtcgccgtggctatcatcctggcgctgattctcagcttcgtcattcccttactggtcgcccgctatctgtttcgacgcgacctcgccctcagtacgctgcaggcgctggccatcggctcgccggcagtcccgtttatcggcacctcagtgctggcctttttatttggcaccgtcagcgcgtcgctgatcaccgtgtccagcatcacgcaaaacgtcttccagctgccgctggtgatgatactgatgtcggtcgccaccggcgataagagccagcatatttcctttggcgcacgggtggtgaacgccattaaacaacccgtggtctggtcgccggtgatcgccctgatcatcgtgctggcggatatccatattccgcagactatctcgatgtcgctgggtctgctgggcaaagcctctggcgggctggcgctgtttgccgccgggatcgtgctctatacgcgcagcattgttatcaccaccgctaccattatcaccgttatcgcccgcaatattctggtccccggcgcctgctatctcattttattaaaaatgggcttcagcatggagcaaataaaggaagtcgtattgacgatggctatcccggtaggctccatcgcgataattattgctatgcagtataaaaccggcgagcaggaaatggcctcgacgatggcgctgagtattattgcctccatcattacgatgggcggatttattttcttaaccttttaa

SEQ ID NO: 2773 - DNA, 3537 bp, Klebsiella pneumoniae
atgaccgacaccgctgagtctttggatcccctgcgcttgcccctgatcggcgagcgcctgatagaagcctctgcgggcaccggaaaaacctttaccatcgccgcgctgtatctgcggctgctgttggggctgggcggtgaggccgcctatccccgcgccatcagcgttgaagaactgctggtggtgacctttaccgaggcggcgaccgaagagctgcgcggccgtatccgcagcaacatccacgaactgcgcatcgcctgcctgcgcggcgaatccgacaatccgctctacagcgcgttgttggcggagatcgccgataaagacgacgccgcgaagacgcttctgctggctgaacggcagatggacgaggcggcggtattcaccatccacggcttttgccaacggatgctgagccttaacgccttcgagtcgggcatgctgttcgagcaacagctgatcgaggatgaatcccgcctgcgctatcaggcctgcgccgatttctggcgccgccactgctatcccctgacccgcgatatcgcggcggtgatccacgacgtctggaaagggccgcgcgatctgctgaagtcccttgaccgctggctgcagggcgaagcgccgcagcttaagtcgccgccagcccctaacgagacgctggccgaacgccatcagcagatcatcgcccgcattgactcgctcaagcagcagtggcgcgagcaggtgggcgagatcgaaggcgtgctggaaaattccggccttgaccggcggaagtttaatcgcggcaaccagggcaagtggatggagaaagtgaacgcctgggcgcaggaagagacgttaagctaccaactgcccgacgcgctggagaaatttgcccagtcgtttctgctcgagcgcaccaaagccggtggcgaaccgccggtgcatcccctgtttagcgccgtagagtcgttgctggcctcctcgctgacgctcaccgatctggtgctggcgagagcgatggtcgagatccgcgatgcggtcgcccgcgaaaagcgccgccgcggcgagctggggtttgacgatatgctcagccggcttgacgaggcgctgcgcggcgacagcggcgagacgctggccagcgccattcgccagcgttttccggtggcgatgatcgatgaatttcaggacaccgaccctcagcagtaccggatttttcgccgcatctggcgccggcagccggagacggctctgctgctgatcggcgatccgaagcaggccatctacgcctttcgcggcgccgatatctttacctatatgaaagcgcgcggcgacgttgccgcgcactacaccctcgataccaactggcgctcctcgccgggcatggtgggcagcgtcaatcggctgttcagcctcagcgataaccccttcatgttccacgagatcccgttcctgccggtgaaggcggcggcgaagaacaaggggctgcgctttaccgttgacgcggcggacgtaccggcgatgaacgtctggctgatgcccggcgacactgtcgggtctggcgattatcagacctttatggcgcagctctgcgccacgcagatccgcgactggctgagcgccggtcagcgggggcgcgcgctgctgtggcgcggggaaacctcgcgcccggtacaggcttcggatattaccgtgctggtgcgcaaccggctggaggcggcgcaggtgcgtgaagcgctgcagacgctgggtattccctcggtctacctctccaaccgcgacagcgtttttgagacgctggaggcccaggagctgctctggctattgcaggcggtgctggccccggagcgggaaaataccctgcgcagcgcgctggcgacgtcgatgtttggcctgaccgcgctggatattgaaaacctgaaccaggatgagcaggcgtgggacgcgctggtggaagagttcagcgaataccgccagatttggcggcagcgcggagtgatgccgatgctgcgggcgttgatgacagcccgacatatcgccgagaatctgctggcgacccgcggcggcgagcggcgcttaaccgacattctgcacatcagcgaactgctgcaggaggcggccagccagctggaaagcgagcatgcccttgtgcgctggctggcgcagcatatcgccgagccggacagcaacgccgccagccagcagatgcgtctcgaaagcgataagcacctggtgcaaattgtcactattcacaagtcaaaagggctggaataccccctggtctggctgccgtttatcgcccggtttcgtaaacaggaccaggcgttttaccacgatcgcgagacgttcgcggcggtgctggatttgggccaggatgaggccagcctcgagctggcggaggcggaacgactggcggaagatctgcgcctgctgtacgtggccctgacccgcgcggtctggcactgcagcctcggcgtggcgccgctcagcagccggaaatccggcaacagcgatttccacctcagcgcgctgggacggctgctgcaggcgggcgaagccatggacgccgccgggctggctgcgcggctggcggacttctgtcatggcgatattgcattacagagaccgggcgaactggatctcaccccgtggcaggcgcccgcggcgaccatcccgcgattgtcggcgcgcgagctgcagcgccgcatcgccgacgactggcgggtgaccagttactccggactgcagcagcatggtttcagcggcgggcaggatttgctgccgcgtctggatgttgatgccgccggcgtcggcgaagtcgtggaagagccgcagctgactccgcaccagttcccgcgcggcgccgcgccggggaccttcctgcacagcctgtttgaggagctggacttcacccagccggtgccggaagggtggatggcggagaagctgcagctgagcgggtttgacgcgcagtgggcgccggtgctgaccgactggctgggcggcgtgctgaagacccgcctgccggggccggatatcgcgctcaatcagcttgcggcgcgggataaacaggtggagatggcattttacctgcccatcgcccagctgctgacggcggaacgccttgacgcgcttatccgccagtacgatcccctctctgccgacacgccgccgctggatttccgccgggtgcgcggcatgctgaagggctttatcgatctggtcttccgtcacgaaggccgttattacctgctggattacaaatccaactggctgggggaagatcgcgaggcctacacccggccggcgatggagcaggcgatgcgtgcccaccgctacgatctacagtatcagctgtatagcctggcgctgcaccgctatctgcgccaccggctggccgattatgactatgaccgccacttcggcggcgtgatttatcttttcctgcgcggcatggacgggcaggagggggggcaggggatcttcaccacccggccggtgcgaccgctgattgacggtctggatcagctttttgccggagaaactcaggaggaggcctcatga

SEQ ID NO: 2774 - DNA, 1518 bp, Klebsiella pneumoniae
aaagttggcacgcaacttgatataagccagtcaactgagtttaaacacactgtattgattgaggttgctatgtctattgtggtgaaaaataacattctttgggttggccaacgtgactgggaagtgcgtgatttccacggcaccgaatataaaacgctgcgcggcagcagctacaacagctatctcatccgcgaagagaaaaacgtgctgatcgataccgtcgatcataaattcagccgcgagttcgtacagaacctgcgccgcgaaatcgacctcgccgacctcgactatatcgtcattaaccacgccgaagaggaccatgccggcgcgctgaccgaactgatgatgcagatcccggatacgccgatctactgcaccgccaacgccatcgactcgatcaacggccaccatcatcatccggagtggaacttccacgtggtgaaaaccggcgatactctcgacatcggtaacggtaaacagctgatcttcgtggaaacgccgatgctgcactggccggacagcatgatgacctacctgaccggcgacgcggtgctgttcagcaacgacgccttcggccagcactattgcgacgaacatctgttcaacgatgaagtggaccagactgaactgtacgaacagtgccagcgctactacgccaacatcctgacgcccttcagccgcctggtgacgccgaaaattactgaaatcctcggcttcaacctgccggtggagatgattgccacctcccacggcgtggtctggcgcgataacccgacgcaaatcgtcgagaaatacctcgagtgggcggcggattatcaggaagatcgcatcaccatcttttacgacaccatgtccaataatacccgcatgatggcggacgccattgcccaggggatcaccgaggttgacccacgggtagcggtgaaaatctttaacgtcgcccgcagcgacaaaaacgacatcctcaccaatgttttccgctcgaaaggcgtacttgtcggcacgtccaccatgaacaacgtgatgatgccgaaaatcgccgggctggtggaagagatgaccgggctgcgttttcgcaataaacgcgccagcgcctttggctcgcacggctggagcggcggcgcggtagaccgcctgtccacccgcctgcaggatgccggctttgagatgtcgctgagcctgaaagccaaatggcgcccggatatcgacgcgctggagctgtgccgccaacacggtcgcgacatcgctcgccaatgggccctctcgccgctgccggttgctgaagcagcgacaacgccggaaccacaggactgcgcctgtgccgcggccgcggccgccgatctcggtcccatgatgcagtgcagcgtgtgccagtgggtctatgacccggcgaaaggcgaacctaatcaggatgtacagccgggtacgccgtggagcgaagtgccggacaatttcctctgccctgagtgttctcttggcaaagatgtctttgacgtactggcgacggaggcaaaatga

SEQ ID NO: 2775 - DNA, 1653 bp, Klebsiella pneumoniae
cttctcaggttcagcatgacaacgaactatatttttgtgaccggcggggtcgtatcctctctgggtaaaggcattgccgcagcctccctggcagccattcttgaagcccgtggtctcaacgtgaccatcatgaaactggatccgtatatcaacgtcgatccgggcaccatgagcccaatccagcatggggaagtgttcgttactgaagacggcgcagaaaccgatctggacctgggccactatgagcgttttatccgcaccaagatgacgcgccgcaataacttcaccaccggccgtatctactccgacgtgctgcgcaaagagcgccgtggcgactacctgggcgcgaccgttcaggttatcccgcacatcaccaacgctatcaaagagcgcgtactggcgggcggcgaaggccatgacgtcgtgctggtggaaatcggcggtaccgtaggcgatatcgaatccctgccgttcctcgaagcgattcgtcagatggcggtagagatcggccgcgagcataccctgttcatgcacctgactctggtgccgtacatggccgccgcgggcgaagtcaaaaccaagccgacccagcactccgtgaaagagctgctctccatcggtattcagcctgatattctgatctgccgctccgatcgcgcggttccggccaacgaacgagccaaaattgctttgttctgtaacgttccggaaaaggctgtgatttctctgaaagatgtcgattccatttataaaattccgggcctgttgaaatctcaggggctggacgattatatttgtaaacgattcagcttaacttgtccggaagcaaacctggccgaatgggaacaggtaatctatgaagaagctaatccggcaggcgaagtcaccatcggtatggtcggtaagtacattgaactgccggatgcctacaagtcggtgattgaagcgctgaaacacggcggtctgaaaaatcgcgttaccgtcaacatcaagctgatcgattcgcaggatgtggaaacgcgcggcgtcgaaatcctcaaggatttagacgctatcctgatcccgggcggcttcggctaccgcggcgttgaaggcaagatcgccaccgcgcgctatgcgcgtgaaaacaatattccttatctgggcatctgcctgggtatgcaggttgcgctgattgagttcgcgcgtaacgtagcgggtatggaaaacgccaactcgacggaatttgtgccagactgtaaatacccggtcgtggccctgattaccgaatggcgtgacgaagatggcaacgttgaagtccgctctgagaagagcgatctgggcggcaccatgcgcctgggcgcgcagcagtgccagctgagtgatgattctctggtacgccagctttacggcgagccgaccatcaccgagcgtcatcgtcaccgctacgaagtcaacaacatgttgttgaaaccgattgaagctgccggtctgcgcgttgcgggccgttccggggatgatcagttggtcgagatcatcgaagtgccgaaccatccgtggtttgtggcctgccagttccacccggagtttacttcgacgccgcgtgatggacacccgctgtttgccggctttgtgaaagccgcgagcgagtaccagaaacgccaggcgaagtaa

SEQ ID NO: 2776 - DNA, 231 bp, Klebsiella pneumoniae
cgcagaaggttatcgccaggcccgggggaaggcctgctgccggcccgcgtccaggcgccttcaccagcgcctgacgtcgccgtgacggaggagaacacggccctcacagacgccccctcccactctacggagcgggtgacctgcaacctgtgcctggacccacactgcccacgacaaaaaggcgatccccgctcgcagtgcctgcacgccggtaaacgaggtgacgcgtaa

SEQ ID NO: 2777 - DNA, 285 bp, Klebsiella pneumoniae
tggagattaaccatgcgctggcaaaatagcgtaatttactatcgtccatcactctatctccctaaagaggtgcgacgtttatttttttattggaatatcaacaacggcgccgtaatcattaatatatttcattttatgcaagcgctgcatgctggcgatattgacagcgtggtgactgtacggcagcaacataaagtttttcagaggatagattttgcctttgttgtcgatcgcctcggcattaataaccgtaatatgcagtgggctgttgttagtaaaagataa

SEQ ID NO: 2778 - DNA, 930 bp, Klebsiella pneumoniae
gccagaataaccatgtcgaagcgattaccacctctgaatgcattacgtgtttttgatgcagccgcacgtcatctcagcttcactcgggcagccgatgagctttttgtgacgcaggccgcagtcagccatcaaatcaagtctctcgaggattttctgggccttaagctgttccgtcggcgcaatcgttcgctgctgttaacggaagaagggcagagctattttcaggatattaaagagattttttcgcaactgacggaagcgacgcgtaaactgcaggcgcgcagcgccaaaggggcattaacggtcagtttattgccaagtttcgccattcagtggctggtgccaagactcacaagctttaactcagcttatccgggaatcgatgtcaggatccaggcggtggaccgtcaggaggataagctggcggacgatgtcgatgtggcgattttttatggtcgcggcaactggccgggcctgcgtgtggaaaaattgtacgccgagtatctgctgccggtctgttccccgctcttgctcaccggcgacaaagcattgaaaacgcctgccgatctggcgcaacataccctgcttcacgatgcgtcccgccgcgactggcaaacttatacccgtcagcttggtctaagccatattaatgtgcagcaggggccgattttcagccatagcgcgatggtgctgcaggcggccattcacgggcagggcgtggcgctggccaacaacgtcatggcgcagtccgaaattgaagccggtcgtctggtgtgtccgtttaatgatgttctggtcagtaagaatgcgttttaccttgtttgccatgacagtcaggcagaactgggtaaaatagccgctttccggcagtggatcctggcgaaagcggcaagtgaacaagaaaaattccgctttcgttatgaacaataa

SEQ ID NO: 2779 - DNA, 1071 bp, Klebsiella pneumoniae
ttaggagtaacaatggcgatcgacgaaaacaaacagaaagcgttggcggctgcactgggccagatcgaaaagcaattcggtaaaggctccatcatgcgcctgggtgaagaccgcaccatggatgtggaaaccatctccaccggctcgctttctctggatatcgcgctgggcgccggcggtctgccaatgggccgtatcgtcgagatctacggtccggaatcctccggtaaaaccaccctgacgctgcaggttatcgccgcagcgcagcgcgaaggtaaaacctgtgcgttcatcgatgctgaacatgcgctggatccggtctatgcacgcaaactgggcgtcgatatcgacaacctgctgtgttctcagccggacaccggcgagcaggcgctggagatctgtgacgcgctggcgcgctctggcgcggttgatgttatcgtcgtcgactccgtcgcggcgttgacgccgaaagcggaaatcgaaggcgaaatcggcgactctcacatgggccttgcggcgcgtatgatgagccaggcgatgcgtaagctggcgggtaacctgaagcagtccaacacgctgctgatctttatcaaccagatccgtatgaaaattggcgtgatgttcggtaacccggaaaccactaccggtggtaacgcgctgaagttctacgcctctgtgcgtctggacattcgccgcatcggcgcggtgaaagagggcgacaacgtcgtcggcagcgaaacccgcgtcaaagtggtgaaaaacaagatcgccgcgccgtttaaacaggccgaattccagatcctctacggcgaaggcatcaacttctacggcgagctggtagacctcggcgtgaaagagaagctgattgagaaagcgggtgcctggtatagctacaacggcgacaaaatcggtcagggtaaagcgaacgcgatcacctggctgaaagagaacccggcggcggcgaaagagattgagaagaaagtgcgcgaactgctgctcaacaatcaggatgcgaagccagacttcgttgttgacggcaacgacgcagaagaaaccgaacaggatttctga

SEQ ID NO: 2780 - DNA, 2205 bp, Klebsiella pneumoniae
ggagagacaacgatgaagccgatgaaaaacctgctgctgatggggctgctgtccgcgctgggggccggcggggcgctggccgccgagcgctcgcactttacgcactttatcactcgcgacggcgccaccctcaaggacggcgacaaggtgtttcgtttcgccgggatccacgcgccggagctacaccgcattgaagacgacgcccgcggcccctgcagggcagacccgcgcggctgggggcaatactttaaatggccaacggcccaggagcagcaaaactggatccaggcgatggtgcaaaccggggcgaaagcccagcgcgtctacgtgctgtcggtgcagcaggaatttgataaggcctgcgggcgtgagacccatattctggcgccggaaacggcggacggcatgccgcggctgaatgagaaagccatgcgggtgtatgacaacatgattgccgaagcggataaacagggattgcgtctgatcctgccgtttatcgaccactggtggtggtggggcgggcgcgagcagcttgcggcgttctatcatgaaaaagcggaagacttttatcggaccgatagcaagaccttcaaagcctatctggatgtgatccgccaggttatcacccggacaaatactgtcaccggccgcgcctattatgatgaaaaggcgatcatggcctgggaaaccggtaacgagctggaggataccaacgccgatttcctgcatcagaccgcggcgtggattaaaaagtgggcccctcatcagctggttgtggatggcacctataagaaaattaatccgtttgcgttgaccgaccccaatgtggatatcgtcagcaatcactattacaccaatgccgataataaccatcccgggcaggtgacgcaggatctgcgcgccgtcggcggacaaaaagtctatctcgtcggcgagtttggcctgctgccggcggatcaactgaacgccattatgcagtcgattgttcacagcgacgtcaacggggcgcaagccgccggcgggcttatctggggcttccgcggccatcgtcacgacggcggcttctactggcataaggagtcgaccgggcactacagctaccacctgccggggtttgccaaagaaggcgaagcgaaccaggagcaggcggtggtcgatctggtgcgcaccgccgcggcgcagatggccgggcagcagacgatggcgccgctgccgaagccggaggcgcctttgctgcgcgagaccacctcgcccttcgcgatcaactggatgggcgctgcggtgggacgcagctacgatgtcgaacgcgccgcctcaccgaacgggccgtggacggtggtgggccggggtatctccgatggcgttaacgaatggaatccagaaaccatggttctgttccgcgacgattatcgtcagcttcagctcgggcacacgtattactaccgggtgacggcgaaaaacgagagtggtcgttcggccccttccaatgtgattagcgtgcagcatagcgaggagaatcagccgccggttgtcacgctggaaccggccctaaccaccacgcaggaccagggcgtcgagcttacggccagctggcaggacgatggcctgccgtcgcgagaggttaaggtgggctggcagcacgccggcgatggccaggtgcatttctgccatgccgatcgggctcaaacccgggcctggtttacggcgccaggcacctatgcgctgacgttcacggcggacgatgggctgttgaaaagcagcaaaaccgtgaccgtgacggtgggcgaggcggcggggaaagcgccagcggatttctgtcgttatcacggcgaagtttatggcgtggctgaggggcggctgacggtgatgaagagtgataaagacgcgctgacagttggcgaggacggcttcctcggcccatttgccaacgagggggataaggtcagctggcaggtgcaggcgccgtggagcggtcagttcctgctcaatgtgaccttcaacggcaaatggggcggtaagcagaactcgtttgtcgtcaacgggggcgctccgcagaccgtggccttcccgcagacggatgagcagggccagcagctgcggataccggtgacgcttaaagccgggagcaatcagattgacttcggccgcttcgccggcgactggggctatatgttcattaaatcgatcgaagtggtcgctgagtag

SEQ ID NO: 2781 - DNA, 516 bp, Klebsiella pneumoniae
atgaaagggttgagtttgccgacgacagcggtcaggatgaagagaataaggtcaatccagggagataatagcatggcggaagtcggaatttttgtcggcaccatgtacggcaactcgctgctggtcgcggaagaagcggaagcgatcctcagcggactgggacacaaggctaccgtgtatgaggatccgcaggtcaacgactgggaatcctacacgggtaagtatgtgctggtggtcacctccaccaccgggcagggcgatctgccggacagcatcgtcccgctgtatgagggcatcaaagatatgtatcagcctcacctgcggtacggcattatcgcgctcggcgacagcacctatgccaacttttgcggcggcggcctgaagttcgatcagctgctgcaggagcagggcgcgaagcgcatcggcgagatgctgaagattgacgccagcgaagacccggagccggagagcgtctccaatccgtgggttgagcagtgggccaccctgctcgcataa

SEQ ID NO: 2782 - DNA, 672 bp, Klebsiella pneumoniae
gatatgaaaacgctgctggcagtgatcataggcgctttggcttttcagacccaggcggccattaccatcgatgcctcacgggttatttattcgggcaaagataaatcggccagtctgaaaattaacaaccgaagcagcaaaaactatatcgtccagacctggcttgatacgggtccggagacccccagcagcggcttacccattgtggcaacgccgcccctggtcaaattacgccccgagcaatcggcacaactgcgctttatttactcaggaaccggtcttcctgccgacagggaaagtctgttttgggtgaatattcaggaggtccctcctgcacctgaggaaaataacatcctgcagttcgcaattcgcacccgattaaaactattttatcgcccgcaaggaattgccacatcgctgcccaaagccgttgaaaatctgcagtggcagcaaagcgctaacacgttatcttttactaacaacagcccactgcatattacggttattaatgccgaggcgatcgacaacaaaggcaaaatctatcctctgaaaaactttatgttgctgccgtacagtcaccacgctgtcaatatcgccagcatgcagcgcttgcataaaatgaaatatattaatgattacggcgccgttgttgatattccaataaaaaaataa

SEQ ID NO: 2783 - DNA, 324 bp, Klebsiella pneumoniae
agaatggaaaccaaaccgaactggctggtcagacatattaatctcatcaccaccgcggtcgccctctatccgtggttgctgatgatactgctcctctgggataaccagcgccatcatcagcatggctatgccgcgctcggcgccgccatcgcgatattatttctgctggccctgacgtccggcatgaatcttctcatctcctcgctggtgattttttgtgcccgctgttccaccccaccgctggccggcggcgcagcagtccgctttttcgcgatgaactcgatctcggcgctctggcttatccctctgttctttagttactga

SEQ ID NO: 2784 - DNA, 783 bp, Klebsiella pneumoniae
gccggacgaacgcagtgtcgtccggcaaaacaggcaaacgaggttcatatgtccgtactcgatctaaacgcgcttaatgcattgccgaaagtggaacgcattctggcactcgcggaaaccaacgcccaactggaaaagcttgacgccgaagggcgtgtggcgtgggcgctggaaaatctgccgggaaactatgtgctgtcgtcgagctttggcattcaggcggcggtaagtttgcatctggtgaatcagatccgcccggacattccggtgatcctcaccgataccggctacctgttcccggaaacctatcagtttattgacgagctgacggacaagctcaagctgaacctgaaggtctaccgcgcggctgaaagcgcggcctggcaggaggcgcgctacggcaagctgtgggagcagggcgttgagggcattgagaaatacaatgagatcaacaaggttgagccgatgaaccgggcgctgaaagagctcaacgcgcagacgtggtttgccggtctgcgccgcgagcagtcgggcagccgggctacgcttccggtgctggcggtccagcgcggggtgttcaaggtgctaccgattatcgactgggataaccgcacggtgtatcagtacctgcaaaagcacgggctgaagtaccacccgctgtgggatcagggctatctctcggtaggcgatacccacaccacccgcaagtgggagccgggcatggcagaagaagagacccggttcttcgggcttaaacgcgagtgcggattgcacgagggttaa

SEQ ID NO: 2785 - DNA, 993 bp, Klebsiella pneumoniae
aagatcagaaccagatcccggagctcaacgtctaccagtgcgggacttacaccatgcactcgctggaagaggcccaggacatcgctcgccatatcattgagcgcgatgtgcgcatcaacagcaacgacgaactggcgttgccgaaagaaaaactgcaggaactgcacatctagtgcttccgccacggcccgacgcctgtcgccgggccgctcttctgacgccgcgatgacgacgacgctttccttctcctttcagcaccgcccactggtgccctttgcccatgattatgcccacggtgaccaggaagactggcatcagcatgactgcgcccagctgctgcatatactaagcggcgtggtgcgggtcgcgacgccggtaggctactgggtggtgccgcccgggcgcggcgtctggctgccggcgggaacgccgcacgcgctgcgcatgaccggcaacgtggcggcgcgcaccctgtttatcgatccgctggcgcgcgccgatcttccggcgggctgccagatcgtacagatcacgccgctgctgcgggaactgatcgtgtcatccctggcgctggcggaacgctatgcccccgccagccgcgacgaaagaatttatgaactgatcctcgatgagatccgcgggatggcgatcctgccgtttggcctgccggagccgcaaagcgaaacgctgcgtcggctgtgccagcaggtacgcgaggcgccgggcgaggcctggagcagcggccaggcggcgaaggcgtgcagcatgagcgagcgaaccctaaaccgccattttcagcagcagactagcctgacgtggagcgagtgggtgcgccgggcgaagctaatggaagcgctggtgcgcctggcgcagggccactccgtgctgcgggtggcgctggagctgggctacggtagccacagcgccttcagcgccatgtttcgtcgggtgatgggcgtcgcccccagcgactattttcgccccccggcctga

SEQ ID NO: 2786 - DNA, 915 bp, Klebsiella pneumoniae
atatttttgacaatcatccggacgacgatgcttaatcttcagcgcgtggccatgtttatcgccgtggtagatgccggcagtttcaccctggccgcagcggcgctggggcagaccaaggcggtggtcagctttaacgtacggcagctggaaaatgagctgggggtgacgctgctgctgcgttcgacgcggcgtttgcggctcactgacgccggggtgctgttctatcagcgcggggtggcgctcctgaacgcggcggaaaatctccaggatgaagtgcgggccagccatagcggcttaagcggggagctacggatcaccaccacgccggagtatggcgcgcaggttatcattccagcgctggccgcgttcgcccgtcgtcatccggcgctgcgggtgcgccacgttctctcctcccatcatgccgacctcatttcagaacgatttgatgtggcgatacgcctcggtacgctggccgattcccgctatcgggcgacgcggatagccagtttcgcgatcctgcccgtcgcctctccggcctggctggcaagccatccggtgcagacgctgtccgatctggcgcaagctgagtggattattcacgagcgcctgccgacgccgctgcgctggcagctgcgcacggatcaccagacagaggtggatttcgcgatagccagcgcgccgcggttttctgctgatagcgctacggcgctgatgagctttgctctggcgggatgcggcgtcgccttgctgcccgcatggctggtagccaaaaaggtggcgcagcgggagctggtgccgctcctgccggaataccatttcccacagcagggcgtgtatgccctttatcccgactcgcagcatttgccgacccgggtgcgggcatttattgacttcctgcgcgagaaggtcggttaa

SEQ ID NO: 2787 - DNA, 1314 bp, Klebsiella pneumoniae
ccctctttgaccgacgtggagtcacattcggacaattccacaggacgcagagaccttgtcacgcccggcaaattgcgcgacgatcgcggtattgatacgaggaattccatgaacgcattcaacccggcgcactttcgcgcgcagtttccggctctggccgatgccggcgtctatctcgacagcgcggcgacagcgctcaaaccgctggcggtgatcgacgccagcgaccagttttatcgcctgagcgccggcaatgtccatcgcagccagttcgccgccgcccagcggctgaccgagcgctacgaggcggcccgcgatcgcgtggcggcgtggcttaacgccccgtccggcaaagatatcgtctggacgcgggggaccaccgaggccatcaatatggtggcgcagagctacgtccggccgcgcctgcagcctggcgatgaaattatcgttagcgaagccgagcatcatgccaacctcgtgccctggctgatggtggccgggcagaccggcgccagagtggtcaagctgccgcttggcgccgaccgcctgccggatatcgccagcctcagcgcgctgattaccccgcgcagccgggtgctggccatcggtcagatgtccaacgtcaccggcggctgcccggacctggcccaggctatccgccttgctcacgccgccgggatggtggtgatggtcgatggcgcccagggagcggtgcatttccccgctgacgtgcaggcgctggatatcgatttttacgccttttccggccataagctgtatggcccgaccgggatcggcgccctgtacggcaaaagcgagctgctggcagcgatgtcgccctggctcggcggcgggaaaatgatcgccgaggtcagctttgacggctttacgccgcagccggccccctatggcctcgaggccggtacgccgaatgtcgccggggttatcggcctcagcgccgcgctggagtggctggcgcagagcgatatcggccaggcggaaaactggagccgcagtctggcgagcctggcggaagaggaactggcgaaacggccgggcttccgctctttccgctgccagcagtcaagcctgctggcctttgaatttgagggtattcatcacagcgatctggtgacgctgctggcggagtccggcattgccctgcgcgccggacaacactgcgcccagccgctgctggctgccttaggggtcagcggcaccctgcgggcctctttcgccccctacaatacccaagacgatgttgcggcgctggtccacgcggtggatcgcgccctggaaattctggtggattaa

SEQ ID NO: 2788 - DNA, 297 bp, Klebsiella pneumoniae; identical to SEQ ID NO: 2022

SEQ ID NO: 2789 - DNA, 882 bp, Klebsiella pneumoniae
tcccgctcgacaggttgggtgacccacgccatcgactggatcgtgctgcacttccgtccgctgttccaggggatccgcgtgccgatcgactacatcctcagcgccttccagcagctgcttttggggatgccggcgccggtggcgattatcgtcttcgcgctaatcgcctggcagatctccagcctcggcatgggggtcgccactctggtatcgctgattgccatcggcgccatcggcgcgtggtcgcaagccatggtcactctggcgctggtcctcaccgccctgctgttctgcatggttatcggcttgccgctggggatctggctagcgcgcagcccgcgggcggcgaaaatcatccgcccgctattagatgccatgcagaccacgccggcgttcgtctatctggtgccgatcgtgatgctgttcggcatcggcaacgtaccgggcgtggtggtgacgattatcttcgccctgccgccgatcgtccgtctgaccatcctcgggataaaccaggtgcctgcggatctgatcgaagcgtcgcgctcatttggcgccagcccgcgccagctgctgtttaaggtgcagctgccgctggccatgcccaccattatggccggggttaaccagaccctgatgctggccctgtcgatggtagtgatcgcctcgatgatcgccgttggcggcctcggccagatggtgctgcgcggtatcggccgcctggatatgggcctggcgaccgtcggcggggtggggatcgtgatcctggcgattattcttgaccgcctcacccaggccgtcggtcgcgacgcccgcagtcgcggcaaccgccgctggtacaccaccggcccgctggggcttatcactcgccctttctgtcgataa

SEQ ID NO: 2790 - DNA, 1845 bp, Klebsiella pneumoniae
atatccccgaccggcgggccgggggcaggtgcgttattattcgggcaatcagaagtcgacgttgacgcccagctgccaggtgcggcccggcatcaccgccagcgctttatcgttggcgtcctggttggtgccggtctcgatattgcggctgctcaggtaatcccagtatttacgatcggtgaggttgtagaccccgccattgaggcgcacgtttttcgccacctgccagtacgcggtccagtccagcatgccgtagcccggcacgcgcatatagtcgctgctggcatcggtgatggcggatccgctgttgctgtagctttcgcggttggtggcggtcgcctgtttccctttgacaaaggtcgccgtcagggcggtgccgtagcgtttcgccggatcgtcccacgccacgccgacgatggctttcattggcgccacgctgtcgaggtcgacgtatttatcgccgctgtagctggatttcgatttcccttcgctatagccgagggcgagggtggcgctcaggccgtccacctgctcaaaccaggtgccaaagttaaatttggtgctaatctcaccgccgtagatataggctttatcgcggttttccgcctgataaatggtgtagatgttcgacggcacattcgtgaactggcccggattgttggcgcgggtatagcgggtataggcgataaagttcttatagctgttgtagaacagcgccgtgcgcagggtgatgccttcggtaacttcccctttcagcccccactcgagattatcgctggtttccgtcttcagatcggtattgccgatcagggcatactgctggctgccggcgtagctggagccgaggttccaggagccatacagctggctggcgttggggaactgcgccccgcgctggtactgcaggtaggtcatcaggcgcggggtgaggtcgtactggaaggtcaacgacggcagaacctgggtatcgctgtttttgccgtacagattcgccaccgacgattcgctcagcacgctgctgttggcggcgagatcggacagattttccggcttagtcgattgatgcaccacgcgcacgccgggaataacggcgaagttgtggctgtcgagatcgaagttgatcttatcctggacaaagccgccgagggtgtagctgcggctgtctgcctccggctgcatgatctcgctgtaaacgctggggatcggcgactggctgaacggccgctgggttttgctggtgctggcgttgaaaccggcgctcagatcgtggcggcccagggttttcgccagcgcggtctgcaggccccaggtgtcggtatcgtagttagagttcaccgtctgcattttgcgggtgacgctgtccggcatataagtccagtcatgggcttcggtatgctggtagtagatttttgtggagacgctgtcgaggtagtcgttcatcggcgtccagtcatccttcaggctcaggccccagcgccgggtctggctggtctggttggcggtgccgatggtgctgttgccgctggagtcccaggtatcgtagtgggtgtggttggttttatggtaatagtcgaaggtgctggtcagcttgtgctcatcgttaggctgccagatcccggaggccagaaaagcatcggagtgccagttcgccgggtaggcgtcgacggtgccgctgttgttttcggtttcctggccgtcacggcggctatagaccaaaatcccgcgcaggaactcatcgccgccggcgacggtcaccccgttgtgccagctgcgatccgcagagtcgtaaccgctgcggtagccgaaggcgctggtcttgcccgggcgcaggtaatcatccgctga

SEQ ID NO: 2791 - DNA, 2229 bp, Klebsiella pneumoniae
ggcttgccgacttcggcaggccggtcccttaaggagaggacaatggttgcggtaagaagtgcacatcttaataaagctggtgaatttgacccgaagaaatggatcgcgagtctgggaatttccagccagcagtcgtgtgagcgcttagccgaaacctgggattattgtcgcgaaaaaacgcaaggacacccgcaggcggacctgctgctgtggcggggcgtcgaaatggtggagatcctctccaccctaagtatggacatcgatacgctgcgcgcggcgctgctgttcccgctggccgacggcgaagttgtcagcgaagaggtgatgcaggagagcgtaggtaaatcggtcgtgaccctgattcacggggtgcgggacatggccgctatccgccagctgaaggctacccataccgactcggtctcttccgagcaggtggataacattcgccgtatgctgctggcgatggttgacgatttccgctgcgtggtcatcaaacttgctgagcgtatcgcgcatctgcgcgaggtcaaggacgcgccggaagatgagcgcgttcttgcggcgaaagagtgcaccaatatctatgctcccctggcgaaccgcttaggcatcggccagctgaagtgggagctggaagattactgcttccgctatctgcacccggcggaatacaagcgcattgccaaactgctccacgagcgccgtatcgaccgcgagcattacatcgaagagtttgtcggccacctgcgctcagagatgaaagccgaaggcgtcaaggcggaagtctatggccggccgaagcatatctacagtatctggcgcaaaatgcagaaaaaacacctcgctttcgacgagctgtttgacgttcgcgcggtgcgtattgtggctgagcgtttgcaggattgctatgccgcgctggggatcgtccatactcactaccgccatctgccggatgaattcgacgactacgtggccaacccgaaacccaacggttaccagtctatccataccgtggtgctggggccgagcggcaagacggtggagattcagatccgcacccggcagatgcatgaagacgccgagctgggcgtggccgcgcactggaagtacaaagagggcgcgggagccggcaccagcggcggccgcggctatgaagaccgtatcgcctggctgcgtaagctgattgcctggcaggaagagatggccgactccggcgagatgctcgacgaagtgcgcagccaggtcttcgacgaccgggtgtatgtctttacgccgaaaggcgacgtggtggacctgcctgcggggtcgacgccgctggactttgcctatcatattcacagcgatgtcggccatcgctgcatcggcgccaaaattggcggccgcatcgtgccgttcacctaccagctgcagatgggcgatcagatcgaaattattacccagaagcagccgaacccgagccgtgactggctgaaccctaacctcggctatgtgaccaccagccgcggacgctcgaagatccacgcctggttccgtaagcaggatcgcgacaagaacattctcgccggtcggcagatcctcgacgacgagctggagcatttgggcatcagcctgaaggatgcggaaaagcacctgctgccgcgctataacttcaacgagctcgatgaactgctggccgccatcggcggtggcgatatccgtctcaaccagatggtcaacttcctgcaggcgcagttcaataaacctagcgccgccgagcaggatgcggccgcgctgaagcaactgcagcagaaaacctacacgccgcaaaatcgcaccaaggacaatggccgggtagtggtggaaggggtaggcaacctgatgcaccatattgcccgctgctgccagccaatcccgggcgacgagatcgtcggctttatcacccaggggcgcgggatctccgtgcatcgcgcggactgcgatcagctggcagaactgcagtcgcatgccccggagcgcatcgtcgatgcggtatggggcgaaagctactcggcgggctactcgctggtggtcagagtggaagcgaacgatcgcagcggtttactgcgcgatatcactaccatcctcgccaatgagaaagtgaacgtgctgggcgtcgccagccgcagcgatacccgtcagcagctggcaaccatcgatatgaacatcgagaattacaacctgcaggtgctgggccgggtggctcggtaa

SEQ ID NO: 2792 - DNA, 954 bp, Klebsiella pneumoniae
ggagaacagacaatgtccaaccgattccgccccgcctggctgctggtcctcgccgccctctctacctccgcgctggccaaagcgccggaaaccgtcaacatcggctatcaaaaggcgaatatcttcgcgctgctgaagtaccgcggcacgctggatgagagcctgaaaaaacagggcattgccgtacgctgggtcgaattccccgccgggccgcaaatgctggaggggctgaacgtcggtagtatcgatctggccgcgaccggcgatgcgcctccggcctttgcccaggcggcgcaagccgatctggtctaccttgcccactcccccgctaacccgaaaacggaagcgattgtggtgcctgaacagtcggcaatccacagcgtggccgacctgaagggcaagcgcgtggggttgaacaaggggtctgacgtcaactacctgctggttgccgcactggaaaaagcgggcctcagctataaagacatcactccggtctatctgccgccggcggacgcccgcgccgctttccagcgcggggcgattgatgcgtgggtgatctgggatccgttcctcgcagaagtggaaaccaacgcgaaagcccgacagatccgcaatgccgaggggctggtgccgcactacaccttctatctcgccagccgcaagtttgcagatacctacccggagacagcaaagcaggtggtggatgagctgggtaaactcagcgcgtgggcgaacagccatcaggacgaggccgccgggctgctgtcgacctcaaccggactggataaagccatctggctgaagaccctggcccgcctgccctacggtgccgaacgcatgaccccggcggtgtataacgaacagcaggcgctggcggatacctttacgcgcatcggcctgctgccggtgaaagtcgacgtgcgcagcgccacctggtcgctggataaaccttga

SEQ ID NO: 2793 - DNA, 1368 bp, Klebsiella pneumoniae
  unsure (850),(859),(878),(928),(939): Identity of nucleotide at the above locations are unknown.
aaaaagcagaccataatggaagcaattaacctcccgctttatcagcgtatcgcccgccagttgaaatcggcgattgaacgtggcgaactgaccccgggcagccgtttgcccgccagccgggtgtacgctcaggagcagggcgtctcccgggcgaccatcgaaaacgcctggggagagctggtcgcccagggatggctcgagcggcgtgggcaggcggggacctttgtcagcgagcggctcagcccgcgccagctggcgccggtaccgccagtgcaaccggccgcgccgacggagccgctgccgtttcagatggggctgccggcgctggatctctttccgcgcgggcagtgggcgcgggtgatggggcgtcggctgcggacgcagtcgcggttcgatcttgcacccggcgatcccggcggcgatccgcttctgcgccaggctatcgtcgattatctacgcctgtcgcgtagtatcgactgtcagccggatcaggtgttgatcaccggcggctatgccgcctccatgaaccttatcctgcgtaccctggcgcagccgggacagcatatgtggatggaagatccggggtatccctttatccggccggtcgtcgaggctgggcagctggcggtggatgcgattcccgtggacgacgaagggatggacgtcggctggggccagcgtcatcacccgcaggcgcgatttgccctgctcacaccagcccatcagagtccgctgggggtcgcgctgtcgcttccccgacgccgccagctgctggcgtgggccgcggaacgcgacgcgtggatcattgaggacgattacgatagcgagtctcgctatcacggcaaaccgntgccgccgntgaaaagccttgatgcgcngcagagggtcatttacgcgggcaccttcagtaagtcgatgttcccggcgntgcgcaccgcntggctggtggtgccgaccccgctggtggcgcgttttcaccagaccgcggagcgccagtcctgcaccgttcccaccctgtggcagcagacgctggcggattttatccagcagggacatttttggcgtcatttgaagaaaatgcgtgccagctatagccagcgtagacagtggctggagtcggctctgcaggcgcagggctttcaggtcacgccgcagctggggggaattcaactggttatgtcggtcagcggcgacgatcggctgctcgcgcggcgggcggttgtggccgggctggcggtgcaggcgctgagcgactggcggattcgccacgcgggcgaggggggattattgatgagttttaccaatatacgttcgccggcgatggctgacggacttgcccgacggctgagagaggcgattgcgatttga

SEQ ID NO: 2794 - DNA, 204 bp, Klebsiella pneumoniae
acaggagggacagctgatagaaacagaagccactggagcacctcaaaaacaccatcatacactaaatcagtaagttggcagcatcaccgcctgtttttacacaaaatgcaagttttattgttacatttaaatccacgccgggatcgcggttttttatctccccctggaccgcacataaagtgcaacaattattcttgcacttag

SEQ ID NO: 2795 - DNA, 183 bp, Klebsiella pneumoniae
attatgtttgctgtcggcgatctggtacaaccccgagcgggcggaccaaaactgaaagtggtggaagtgcaaggggagcaactggtggtggttcaggccgcacaggagcagggagagcgctattcgctgaagtcggacgaggtcacgccgtatcaggaagagggagacttcggcgtctgctaa

SEQ ID NO: 2796 - DNA, 441 bp, Klebsiella pneumoniae
cgtgcgtttgctgtgagcgacgcgctgtcactcacctcgctgtttgccagtagctttttaagcgccacgctgctccccggcaattcggaggttgtgctggtggctatgctacttgcaggggtcagtcatccgtggtggttagtattaatagcaacaatcggcaatagccttggaggggtaactaacgttattctggggcgcttgtttccgctgcgcaaaacctcgcgctggcaggagcgggcggccggctggcttaagcgctacggcgcggtcacgctcttactgagctgggcgccggttgtcggcgatttactgtgtttgctggcgggatggatgcgcatttcctggggaccggtactctttttcttatgccttggtaaggcgctgcgctatatcgctattgcggcagcgacgcttcagggcatgacgtggtggcactaa

SEQ ID NO: 2797 - DNA, 492 bp, Klebsiella pneumoniae
gtaacgcttgcgccgccacgtcagcggcatggtcggctacctgcggcaggcccatcagttcgccaaaacgcccgcgggcggccggaccggccaccagcaccggcagcgcctcaacgtgcggctcagccactgcccgggaacggctgtccacctccaggcccatgccgagggcatcggcgcgaatcaggccgcggcgggcgaggtcctgtaaaaatggctggctgtcggtcagggcgcggtgtgcgggtccggtggtcaggatcaggtgatcgacgctcagcgtctgcacgccgccgccgcgccgcgccagcgtcagacgcagcgtttcgccttcaccgcttatcgacagtagcctggccgcctgcacctgcagactgcccgtgcgctggcgcgcctccagcacctcggcgacctgcggcgccacgcggtagcggtggacatcccagtaatggcgcagatggcgcagaaaacgctggcgatcggcgacgctga

SEQ ID NO: 2798 - DNA, 1368 bp, Klebsiella pneumoniae
ggagggtctgcaccacaccgccattatgcactcgcagaatgtctcgcggctcaatctggcggcacgcaccctgcagacctccatttttgtcaaaaatggcccgtcttacgcgggaatcggcgtcggcggcgaagggtttaccaccttcaccatcgccacgccaaccggagaaggcaccacctccgcgcggacgttcgcccgcctgcggcgctgcgtgttgaccaacggtttttccattcgctaaccgggggcgccatgcataccttttctctgcaaacgcgcctctacagcggcccgggcagccttgccgcgctgcagcgctttagccatcagcacatctggatcgtctgcgacggcttcctggcgcgctcgccgctgcttgaccgactgcgcgccgcgctgcccgccagcaaccgcgtcagcgtgttcagcgatattacaccggatccgaccattcacaccgtggcgaaagggatagcgcagatgcaggccctgcgtccgcaggtggtgatcggcttcggcggcggctcggcgatggatgccgccaaggctatcgtctggttcagccagcagggcggtctgcctgtcgacacctgcgtggcgatccccaccaccagcggtaccggttcggaagtgaccagcgcctgcgtcatcagcgacccggaaaaagggatcaagtacccgctgttccatgaggcgctctgtcccgacatggcgatcatcgacccgacgctggtggttagcgtaccgcccaccatcacagcccataccgggctggacgcgctgacccacgccctggaggcatgggtctcgccgcaggccaccgattttaccgatgcgctggcggaaaaggccgccaggctggtgtttcgcgccctgcccgttgcgattcgtcagggcgactgcattgcgacccgcagcaaaatgcacaatgcatcaaccctcgccggtatggcctttagccaggctggccttgggctcaatcatgcgatcgcccatcagcttggcggccagtttcacctcccccatggcctggccaatgcgctgctgctgaccgcggtgatccgcttcaatgccggcgagccgcgagcggctaagcgctatgcgcgcctggccagggcctgccgcttctgcccgcccgcagctggcgaacaggaggctttccaggcgctgcttaccgcggtggaaacgctgaaacagcagtgcgccattcccaccctcaaggacgcgctgcaggaaaagtatccccttttcttatcgcgaattcccgccatggtgccggccgcgctgaccgacgccaccctgcgcaccaacccgcgtccggtcgatggcgcggccatcgcgcaactgctggagaacctgcaatga

SEQ ID NO: 2799 - DNA, 372 bp, Klebsiella pneumoniae
ggtacgcctgcgcctcggcgggcgccagcgccggaaagcgccactctccctctttccgcacaaacagccggctctcgccggtgccgccgctggcgcagtagacaaggtgttccagccaaagttgcatcccctgggagacgctcagcagcgaaggccgccagcgcagcagaccgtccggctgcacctgctgcagccagccggtcaggttcacgccgccgcactgcagatcgatctccatgctctgcgcctgctggcgctcggccatcacccgctcggccagcgcctgcatctccaggcgctgcgtctcccagaccagctcgccaaaggcgccatacggcagctcgccggcggcgcgaaagcggcggaacatag

SEQ ID NO: 2800 - DNA, 612 bp, Klebsiella pneumoniae
aatcagcctgcgattagcaagaaaaataacatgctgaaggagagaacaatgattgacgtcgtgacccacggcgcggagtggtttatcggcctgtttcagaaaggcggcgaggtatttaccggcatggtgaccgggatcctccccttgctgatcagcctgctggtgatcatgaacgcgctgatcaactttatcggccagcagcggatcgagaagctggcgcagcgctgcgccggaaacccaatctcccgttacctgctgctaccctgcatcggcaccttcgtgttttgtaacccaatgacgttaagcctcggtcggtttatgccagagaagtacaagcccagctattacgcggcggcgtcgtatagctgccactcaatgaacgggctgtttccacatatcaaccccggcgagctgttcgtctatctcggcatcgccaacggcctcactaccctcggcctaccgctcggtccgctggcggtgagctacctgctggtcgggctggtgactaacttcttccgcggctgggtcaccgacctgaccacctcgattttcgagagaaaaatggcgattcagctttcccagaaagtgcatctgtcaggagcgacatcatga

SEQ ID NO: 2801 - DNA, 234 bp, Klebsiella pneumoniae
tcacgatatgcggttctgcactcatcgctgccctcctccggtatgctgtctcatggtcgcgctccgggccatcagctggcgctgacctggcgcaccgggcgcttatcgccgccgatggtttcgccaaacggaccggtgttcacgctacgcgccttcgacgaggccccgttttccagcggcaacagaggcatcaccagctcagcaaagcggtgcgcttcttccagatgtgggtag

SEQ ID NO: 2802 - DNA, 969 bp, Klebsiella pneumoniae
gctggcggtgctggtggtgattgtcatttcgcgaggagcctgagaatgagtctgttaattgcattgctacaggcgctggtgctgtttgccgtcgcgccgctgttgtccgggatcgttcgcgtcgcccgcgcgcggctgcataaccgccgtggaccgggggtactgcaggagtatcgcgatatcctgaaactgctgggccgccagagcgtcggtcctgacgcctcgggctgggtgtttcgcctgacgccgtacgtcatggtgggcgtgatgctgaccatcgccaccgcgctgccggtggtgacggtagactccccgctgccggtgctgggggatctcatcaccctgatctacctgttcgccatcgcccgtttcttctttgccatttccggtctggacaccggcagcccgtttaccgcgctgggcagcagtcgcgaagcgatgctcggcgtgctggtggagccgatcctgctgttgggcctgtgggtggcggcgcaggtcgccggctcgacccatatcagcgccatcaccgataccctttaccactggccggcggcgcgcagcattccactgattctggcgttatgcgcctgcgccttcgccacctttatcgagatgggcaaactgccgttcgatctggcggaagcggagcaggagctgcaggaagggccgctgtcggaatacagcggcagcggctttggcatcctgaagtggggcatcagcctcaaacagctggtggtgctgcagatgtttgtcggggtcttctttccgtggggccagatgaccagtttcagcgtcggcggcctgctgctggcgctggtggtcgccatcgttaagctggtggttggggtgctaattatcgcgctgtttgaaaacagcatggcgcgtctgcgtttttgtgccacctcccgcgtcacctgggccgggtttggtttcgcctttttagctttcgtctccttgctggtggcgtga

SEQ ID NO: 2803 - DNA, 651 bp, Klebsiella pneumoniae
acatttcccgcactgggacgcccgcgacctgctgggaggcaaataatggcccagcatgacgaaaacgtcgtctggcatgcccaccctgtgacccaacagcagcgggaacagcatcacggccatcgcggcgtggtgctgtggtttaccggcctttcggggtcgggtaaatccaccgtcgccggggcgctggaggaggccctgcatgagcgcggcgtcagcacctatctgctggacggcgataacgtgcgccatggcctgtgcagcgacctgggattcagcgatgaggatcgcaaagagaacattcgccgcgtcggcgaagtggccaggctgatggtcgatgccgggctggtggtattgacggcatttatatctccgcaccgtgcggaacggcagatggtgcgcgagcgcctcggggaaggacgctttatcgaagtgttcgtcgataccccgctggccatctgcgaggcgcgggatccgaaaggattgtataagaaagcgcgggcaggggaattacgcaatttcaccggtatagactcggtctatgaggcaccggaaaaggcggaaattcatctggatggtgaacaattggtaacaaatttggtgcaccaactattagacctgctgcaacagagcgatattatcagatcctga

SEQ ID NO: 2804 - DNA, 1248 bp, Klebsiella pneumoniae
tctgccaccgccccgcatcgccgggcgataccatgtttttataggaaaccggttccacaaaatcatggtgagtttcagttaatttcacaagaaataaaaaaatatgatctcaattttgtgattttgatcgctaagcgtcgccgtgagccggatcgcgttggtgaacaggggagtgctgtaaaagcgggaaacgtgcagtacactgcctgcaacttttgcaacaggaagaatcacatggcaacgatgctggaggtcgcaaagcgcgcgggggtatcgaaggcgaccgtttcgcgggtgctgtcgggcaacggctatgtcagccaggagaccaaagaccgggtgtttaaggcggtggcggagagcggctaccggccaaatctgctggcgcgcaacctggcgaccaaaaccacgcaaaccctcggcctggtggtgaccaataccctgtaccacggcgtctattttagcgaactgctgtatcacgtggcgcggatgacggaggataaagggcggcagctgatcctggccgacggcaagcacagcgcgcaagaggagcgggaggcgatccagtacctgctggatctgcgctgcgatgcgatcatcatctacccgcgctttctcaccgttgatgagatggacgagatcgttgagaaccactcgcagccgatcatggtgcttaatcgccgcctgcgccgccacgccagccactgcgtctggtccgatcaaaaagcctcggcgatgcgggtagtggagcggctgattgcgcttggccatcgcgatatcgcctttattaccggctcccttgactctcccaccggcgtcgaacgcctcgccggctacaaagacgcgctggctggccacggcatcgccctgaacgaggcgcttatcgccgaagggcgctggacgccggaaaccggggcggcgggggtggagagcctgcgtcagcgcggggttacctacagcgcgctggtggcgagcaatgacgatatggccatcggggcgatgaagcagcttcaccagctgggcgttaaggtgccagaacaggtctcggtggtggggtttgacgatattgctcttgcgccgtatatggtgccgtcgctcgccagcgtccgggtgccggtgacggagatgattaaagagagcatcaatcggctgatctttatgctggatggcggggaattcaactttcagcaaagctttcccggagcgctgattgaacgcgagtcgctggtggcgggcccctgtgcctga

SEQ ID NO: 2805 - DNA, 1083 bp, Klebsiella pneumoniae
acaggaaccgcagccatgaccgccgtgaagcacgcttttactgaactcccgaccatcgatatccgcgatctggccggcgatgacctcgccaggcgtcaggcggtggccgacgccatcggccgcgcggcgcgcgaggtgggctttttctacatcaccggccacggcatcgacccggcgctgatcgccggcgtccgcgaggcggcgaagcagatcttcgccctgccgatggaggagaagatgaactattacatcggccactccaaaagccataagggctacgttccggaaggagaagagatctacggctccggcaagccggaccataaagaggctttcgatatcggcttccaggcagcggatgaccatccgctggtgctcgccggtacgccgctgatcggcgccaacgagtggcccgatctgccggatttccgcgcgcgggtgctggcctactacgacgcggttttcgccctcggccaccgtctgttcgacgctttcgccctcgcgctcggcctgccggaagggtatttcaaaccgatggtgacctgcccgccggctaagctgcggctgatccattacccgttcgacgccagcgtcgaagatgttcccggaattggtgcacacaccgactatgagtgcttcaccctgctgctcgccgaccagcccggccttgaagttctcaatgaagaaagcgtgtggatcgatgcacctcccgtcaaaaacgccgcaggagaagaggcgttcgtgatcaatatcggcgacatgctggaagtgctcagcgctggcacatttgttgctacagcccaccgggtgcgcaaagtgccgcaggagcggtactccttcccgctgtttttcgcctgcgattaccacacgctgatccgcccgctgccgacctttctcgccgccggcgaagccggtgaatatcaggagctcagcatcggggagcatatgtggagccaggccctgcaaacctatcgctacctgcgcgaaaaggtcaatcgcggtgaacttcagctaccggagcgcgcgcgcggcaccaatacgtttggccatttgaaaaaacaggcacagcaaaaaaccccctaa

SEQ ID NO: 2806 - DNA, 1176 bp, Klebsiella pneumoniae
tgccgcaacgctaacaggagagccacgatggcaaacagaatgatcctcaatgaaacggcatggtttggccggggggcgataaacgcattaaccgatgaagcggtgcggcgcggctatcgtaaagcattgatcgtcaccgacagcactctcgcccgctgcggcgtggcggcgaaagtcaccgacaaactggatgccgccgggctggcatgggatatgttcagcgacgtgatctctaacccgaccatcgccgtggtccagcaggggctgcaggcctttcaacgcagcggggcggattacctgatcgccatcggcggcggttcgccgcaggatacctgtaaggcgatcggtattattcagcgtaacccggtattcgccgatgtccgtagcctcgaggggctgtcgcccacccgtcagcccagcgtgccgatcttcgcggtgccgaccaccgcgggtaccgcggcggaggtgacgattaactatgtcatcaccgatgaagaacagcggcgcaaatttgtctgcgtcgatccgcatgatatcccgcaggtggcctttatcgatgccgatatgatggacgctatgccgccggcgctgaaggcggctaccggcgtggacgccctgacgcatgctatcgaagggtacctcactcgcggcgcctgggctttgaccgatgctctgcacctcaaggccatcgagatcatcgccggcgcgctgcgcggctcggttgccggcgacgccggcgcgggggaagctatggcgctcggccagtatgtggcggggatgggattttccaacgttgggcttggcctggtacacggtatggcgcatccgctcggcgctttttacaacacgccgcacggcgtggcgaatgccatcctgctgccgcacgtgatgcgctttaatgctgaggcgaccggggaaaaatatcgcgacatcgcccgggcgatgggcgtcagggtggaagcgttaagcctgaccgccgcgcgcgaggcggcagtagaggcgatctgccagcttaaccgcgatgtcggtattcccggccatctgcgcgaggtgggcgtcaggaaagaggatattccggcgctggcccaggcggcgctggcggatgtgtgtaccggcggcaacccgcgcgaggcgagcctggcggatatcgtcgggttatatcaggcggcctggtga

SEQ ID NO: 2807 - DNA, 339 bp, Klebsiella pneumoniae
cctggctgcgcgaagacggtttccgctatcgtccgaaccgcaacaacatctcgtggatggtctgcgatatggtggagaaaccggcgaatgtggccggcgctgatggcgcagtggctggtcaacggctggtgccgggagaccatcttcaacctcaagctgccgatgaaaaagcgctatgaagaggtgtcgcacaatctggcctatattcaggcccagctggacgagcacggcgttaacgcccagatccaggcgcgtcagctgtatcacgatcgtgaagaagtgaccgttcacgtgcgccgcctgtgggccgccgtcggcggacgtcgcgacgagcgttaa

SEQ ID NO: 2808 - DNA, 1620 bp, Klebsiella pneumoniae
gcgctatgcgcgcctggccagggcctgccgcttctgcccgcccgcagctggcgaacaggaggctttccaggcgctgcttaccgcggtggaaacgctgaaacagcagtgcgccattcccaccctcaaggacgcgctgcaggaaaagtatccccttttcttatcgcgaattcccgccatggtgccggccgcgctgaccgacgccaccctgcgcaccaacccgcgtccggtcgatggcgcggccatcgcgcaactgctggagaacctgcaatgagtgaagcgatagggccactatcaagcattgatgcagcggagatccgcgaacgcgttcgggccgctggcgtcgtaggagccggtggcgcaggctttccgacccacatcaaactgcaggcccgggtggacaccgtgctggtgaacgccgccgaatgcgaaccgatgctgaaggttgaccaacagctgatggcgcagcaggctgaccgactgattcgcggcctgggttacgcgatgaccgccactggcgcccgggaagggatcattgccctgaaggcgaaatatgctccggcgattgcggcattaaccccacgactcccggaatgggcccggctgcatattctgcctgacgtctatccggccggggatgaggtgctcactatctggctggcgacgggacgccgcgtaccacctgccgcgctgccggtcagcgtcggcgtggtggtcaataacgtgcagacggtgctcaatatcgccagagccgtggaacagggttatccggtaactcgccggacgttgaccgtcaatggcgccgtcgcccgtccgctgacgctggccgtaccactgggtatatcgctgcgcgaggtgctggatctggccggcggcgcgacggttgacgatccggggtttatcaacggcggtccgatgatgggctcgcttattacctccctcgagacaccggtcaccaaaaccaccggcggcctgctggtgctcccgggcaaccatccattgatccagcgacggcggcaggatgaacgaacgctgctcgccatcgcccgcaccgtctgtgaacagtgccgtttatgcacagatttatgcccccggcacctgatcggccatgagctttcccctcatctgctggtgcgggcggtgaactatcgccaggcggccaccccgtcgctgctgctcagcgccctgacctgttcggagtgcaacgtttgcgagagcgtcgcctgcccggtgggtatttcccccatgcgcatcaaccgtctgctgaaacgtgagctgagggcgaaaaacctgcgctacgacggaccgctgcgtccggcggacgagatggcgaagcaccgcctggtgccggtcaagcggctcatcagcaaactgggacttgatccctggtatcaggaagcgccgctgacggcggtggagccggaggtggcctgcgtcaccctgcccctgcgccagcatatcggcatcagcgccgtgccctgcgtcgcgccgggagagcgggtaacgcgcggccagctactggcggatatccccgccgacgccctcggcgcgccggtgcacgccagtattgacggcctggtctccgccatcacggagcaggccattacgcttgtaagaggttaa

SEQ ID NO: 2809 - DNA, 360 bp, Klebsiella pneumoniae
caacgcggcgcaaaccgcttaacgctaacgattcagaggataatcatggaattagaagaacaggtgatggggatcatcatcaatgccggccagtcacgtagcctgtgctacgaagcgctgcacgccgctaaagcgggtgatttcgccaccgccgacgccaaaatgcaggaagcggcgcactattcccgcgaagctcaccttgtacagacccagcttatcgaagctgacgaaggcgagggaaaaaccaaaatgacgctggtaatggtccatgctcaggatcacctgatgacatccattctggcgaaagagctgattgccgaactgattgcgatttaccgcgcgcagccgcttcacgcctag

SEQ ID NO: 2810 - DNA, 1083 bp, Klebsiella pneumoniae
gacgctccagcagtggcagggaggatggcagtccggcagcgcctttgccagctatctccatgtccattttgcccagcgtcccaccatgctcaaccactggttgcgggcagcaaggagggcgctatgacccttctcgcctggtgtgtagcctggatacttgatgtcgtcattggcgatccgccgcactggccgcatccggtgcgctggataggtcgcctgatcgccgtcagccagcgtgtagtgcgacgcgtctgccatagcgaccgggcgctgcgcatcggcggcggggtgatgtggctggtggttatcggcctgacatggggcgtggcctggggcgtactggcgctggcgcacgggatccacccctggcttggatggctggtggaagtgtggatgatcttcaccgcgctggcgggacgctgtctggcacagtcggcgatggcggtggcccggccgctgcaggccggagatctcgccgaaagccggcataagctctcctggattgtcgggcgcgatacctctcagctccagccagcgcagatcaaccgtgcggtggtggagaccgtggcggagaacacggtagatggcattatcgcgccgctctttttcctgctcctcggcggcgcgccgctggccatggcctataaagcggtcaacaccctcgattccatggtcggctataaacacgaaaaataccgggcgatcggcatggtcagcgctcgtcttgatgatgtagccaacttccttcccgcccggctgagctggctgctgctcagccttgccgcagtgctatgccgggaagatggcgcccgggcgctgcgtacgggctggcgcgatcgctatcagcacagcagtcctaactgcgcctggccggaagcgaccgtcgccggcgcgctggggatccgccttggcggcccgaacgattacttcggccagcgcgttgaaaagccctggataggcgacgccgtccgcgacatcgcggtggacgatatttcccgaaccattcgattaatgtgggtggcgtcaagcctggcgctggcgctgtttatcggcgtgcgctactggctggtcggcgcggcctga

SEQ ID NO: 2811 - DNA, 1308 bp, Klebsiella pneumoniae
agcgctgcagcgcggcaaggctgcccgggccgctgtagaggcgcgtttgcagagaaaaggtatgcatggcgcccccggttagcgaatggaaaaaccgttggtcaacacgcagcgccgcaggcgggcgaacgtccgcgcggaggtggtgccttctccggttggcgtggcgatggtgaaggtggtaaacccttcgccgccgacgccgattcccgcgtaagacgggccatttttgacaaaaatggaggtctgcagggtgcgtgccgccagattgagccgcgagacattctgcgagtgcataatggcggtgtggtgcagaccctcctcaacgcgcagggccagcgccagggcgctgtcaaagtcggcgaccctgacgatcggcagcaccggcatcagctgctcgcaggtcacccaggggtcgttcgcctccacctcggcaatcagcaggcgaggggggcgaggcggaacggcgagacccgccgccgccagcagcgcagccgggcttttaccgaccagttttttattcgccgcgccgtcgggcaggcagacggcacgcagggtatcggcctcctgtcggctcaacagcagcgcgtcaaaatcctgcatctgctggatcaggcggtcagcgacggaggcgacgacgatcaggcttttttcggcgatacagggcaggttgtaatcgaaggcggcgccgctgatgatatcttcggcggctttgacgagatcggcggtttcatcaacgatgcacggcggattgccggcgccagcgccgatcacttttttaccgcttttcatgcccatcgccacaatgccagggccgccggtgatagccagaacggcaatcagcgggtgggacatcatttgctgggtggcttcaaaggtcggctcggcaacggtcaccaccaggttacggatcccgctgcagcggtaggcgatctcttcgatcctggcgataagcttcaacgagacctttttcgcgccgggatgggggctgaaatagacgctgttacccgccgccagcatgctgatactgttgttgataatggtttccgttgggttggtgctgggcgccacggcgccaataaccccgaacggcgagtactcaaacagcaccatcccgccatcgccggtgagggcgctggtagtgagatcctctatgcccggcgtgttttcaagagcggctttatttttcagatatttatcttctttgttgcccatgccggtttccgtggcgctctcttccgccagcgtcgccagctcgggggccagcgtctcccgcagggcgctgataatggcgctgcgggtttttag

SEQ ID NO: 2812 - DNA, 633 bp, Klebsiella pneumoniae
cctgcagcagcgggcgctgctggcgcaaaccgccagcgaaacgcaggcgatccgcgatacggcgatagcccattccgcgctgcagtggggaaaacagcaggtctggtcggcgcaggtggcgctggcctgccgggagcaggcgccgcagggctggcgcgcctgtctgcgtatcttcggcgacggttcactggtgctcagcagcgccagcggcgaggtgcaggtctggcagtccggcgaggtgcgcggcgggcaggtgcgtttttccgcccacggctggagcgatttttgcccgctcagggaggcgagcttatgtcaaatgccctgaagcgtcagcgggggtttagcctgccggagaccgtgctggcgatggcgctgatggtgctgacggtcaccgcgctgggcggctatcagcgcggaatggcgcaaggaattgtccagttgaaccagacccgtcaactgtggcgcgacgcgtggcgctatagccagctctccgcgccgccgtcgccggcacgcgggcaggtaagccgtatgcagacatcgaggcaaagatgtgtcagcatcacggtaacgatcagtagacccgttgcaaagcgggtgcagatgacccggctgcattgcccggtcagccagtag

SEQ ID NO: 2813 - DNA, 711 bp, Klebsiella pneumoniae
atgaaagcagcccgccagcaggcgatcgtcgatctcctgatcacccacagcagcctgaccaccgaaacgttgtcaaaacagctcaacgtcagcagggaaactattcgccgcgatctgagcgagctgcaggcgcagggcaaagtgctgcgtaaccacggccgggccaaagtgatccaccagcgcagccaggacagcggcgatcctttccacatgcgcctgaaaagccattacgcgcataaagccgacatcgcccgcgaagcgctggcctggattgacgaagggatggtgatcgccctcgatgccagctccacctgctggtatctcgcccgccagctgccggaccgcccgctgcacgtctttaccaacagccagcccatctgccaggagctggccaaacgcgaccagatcacgctcacctgctccggcggcactctgcagcggaaatatggctgctacgtgaacccggcgctgatttcccagctgaaatcgctggagatcgatctgtttattttttcctgcgaaggcatcgacccgcagggcgcgctgtgggactccaatgcgttcaatgccgacttcaaatcgatcctgcttaagcgggcggcgcagtcgctactgctgatcgacaaaagcaagttcaaccgctccggcgaggcgaggattggtcatctggatgacgtgacgcatattgtgtcggatgcgccgcagccttaa

SEQ ID NO: 2814 - DNA, 1344 bp, Klebsiella pneumoniae
cgacgggaagcactacgcctcccgtcgccgacaggcttaccccgccgttttctcaccattgcctatctgccagataaaggtgggcgcttcaccgttcaccagccagttaccgatattacgtgccttataaatcaccggattatgcgaggcaaccgtccgcgcattgcgccagtggcgatccagcgcaaggcgagttcgcgtatccgacgccccgagggcattaaacagctccgtcgccgcccgcgggatccagtcgctggcgatcacctgcgcctgcgccgcttccacttccgccagctggttacaccgggcaatcaatgcttcgtcgtcgctgacgtgcgccacataggcctgctgcagcgattccgcggcctgcaggaccgcggcccgggtcgcccatgcccagctgctgatctgcccaacgacctgcagaacctgggcgtcatcgcgcggcacggcggcgttgccgtggctgtacatccgggagcgatgtttgacgccctgcgcggcatcccgctcaaccgccaggccaatgcccgcgagggtcgccagcagcacatgctggtagaaggcggtctgatagcgaaagcgctgggcaaaatcatagacatgttcggtttccacccgagcgccggtaaagcgggtggtcccgctgccggtcaaccgctggccaaagccatcccagtcatcttcccgcaccacgccggtctgctgggtgctgaccagggctatcacatcgctggcggtatcactgcgccgggcaaacacatcgatccagtcggcgtacagcgcgccggtgctgtaaaacttctcgccgtcgagtcgccagccgccctctgccggcgtcactctggtgttcacctctcccagcttaaccgcgccgatctccgtccagccgctgcccaccagctcaccgtcgaggaagcgacgaaaccagcggtcgcgcccggcggaatccggctgattcagctgatcttccacaaaggcaaagtgcgcgcgcagggcctgcggcaggttagagtccgcttgcgccagctcgatcagcagcgcgctgagctgcggcagcgaagcgccccagccgcccttctcgcgcgggatacgcagcgtgccgaagcccgcttctttcagccagcggatcggctcatcgggcagaatgcgctgctgttcgcgctccgcagcgccctgggcgatacgggtgaatatcgggcggaaggcggccgccagcgcgtcataatcggtgccagtagagagcagggtcattgtcagttccttattcatgaagtgcgtcgatatcttctcgcgtcggttcatgacggaccgccagcaggaagaaaatgggaataa

SEQ ID NO: 2815 - DNA, 1836 bp, Klebsiella pneumoniae
aaccggcgagcaggaaatggcctcgacgatggcgctgagtattattgcctccatcattacgatgggcggatttattttcttaaccttttaattaccgcgattacaccgcgtgaatacggagagaatatggcctctatcacattatcggctgctgaactgttactgcatcggctacaggcgctggacgtggcgtatatttttatcaactcgggcaccgattatcctccagtcattgaagcctgggcaaaggcccgggcgaccgggcaaaaggtaccggagttagtgatctgcccgcatgaaaacgccgccatcggcatggcccatggctattacctcggcaccggcaaggtgcaggcggtgatggttcacaccaacgtcgggctagccaacgccgcctgcggcgtcatcaatctggcgaacagcaatatcccggtgctgatttttggcggccgcacgccgataagcgaacattcccacttcggctgccgcaatacgccgattggctacggccaggagatgcgcgaccaggcggcgctgatccgcgaatccgtgaagtgggattttgaactgcggctggccgatcagatcggcgagcatgttgaccgggcctgggcgatcgccagctccctgccgaaagggccggtctacctgagcttaccgcgtgagccactgtgcgaaacctttgccgtcgatgagaccgcgctgcaggctggcccttcgcagcagccggtccgctatgcgccagtccgggaagatatcgcccgcgcagccgaggcaatcgcctgcgccagacacccggtcatcttcgcccagcgcggcgcccgaacggcggaaggctttgcgcgcctcgatagtctggtgcgcgaatgggcgatccctctggtggaatactggggcaccgaggtgaccctgagcgccgataatcccctgctcgccggggctgatcccagcgtctggctcgctgacgccgatgtgattctggtggtcgactcgcaggcgccatggatgatcgccgagggcgactgtcgccaggactgcaccgtgatccagatgggccccgatccgctcttctcccgctacccggtgcgcggctatcgcgcggacatcaacctggcgggcgagaccgatgaagtcttcagcctgctggaagaggcgctgcgcccgctgcaggccgcccgccagcagcatgtggcggagcgggcggcatatacgcagaaccgcatccagcaacagaaaaaccagcgcgacgcgcttctccatgccagccagaccggggccattaccaaaccctggctcagctactgcctcggccatctggctaatcaacaccgcggccggatcgtttctgaactgaccacgctgccgcagtttgccggactgacccatgccgagagctattaccaggaagcgctggccggcggcctgggcgaagccctgcccatcgcgctggggctgcagcttgcgcgccgggaagagctgattattgccgccgtcggcgacgggtcgtacctgttcgccaaccctgcggtctgccaccatattgcggaggtaatgaagcttcctgtcctcgtcgtggtcggaaataacggcgggtggggcgccgtcgcgggcggcaccaaagcgctctacccggacggctacgcggcccgcgcggaaaccattccagccaccgcctttaccacctcgccggatttcgccgcgatcgccgcctccagccgcgcggcggccctgtcggtttcccgggccgaagatctccccggcgtgctggaagaagcggtatccctcatacgcacccgccgacaaagcgtgctggttgacgtgcagttagcccgctaa

SEQ ID NO: 2816 - DNA, 1158 bp, Klebsiella pneumoniae
attcggttggcgctggcgtcggcgagctggtgctgctctgcagcggctcgagcgcacgccacgttttcagcggcccgaatgaggccatcgatcttgccgtcgtgggcattgttgactcactttcacgctaagggggcgcctgtggctatctatacccgaaccggcgatgccggcagtacatcactctttaccggccagcgggtcagcaagacgcatccgcgcgtcgaagcctacggcaccctggatgaactgaacgctatgctgagcctgtgcgtctgcgccgtcgctgaagaggaacagcgcaccctgctcgaagccctgcagcagcacattttttggttcagcgccgagctcgccagcgacagcgaacagccatcaccgggtaagcgctatatcagcagcgaagagattgccctgctggagcagaccatcgatcgcgagatggcccgcgtgccggcgctgcaccagtttgtattgcccggacgctgtgaagccgccagccgtctgcacctggcccgcaccgttgccagacgggcggagcgccggctggtcgagctggcggcagaggttactatccgtcagatactgctgcgttatctgaaccgcttatctgactgcctgtatgccctggcgcgcagcgaggatcatgccgctcaccagcgccgccttgtgacggagatcgcggcccgctatctggccgccagcgggtcgcctgcgcccgacgcgcccaaagcccaggccgggtcgctctcctttcacgagctgcatcagctcatccgtcaggccattgaacacgcccgccagctgcaggtgccggtggtggtcagcatcgttgacgcacacggcaccgaaaccgtgacctggcgaatgcccgatgcgctgctggtcagcagcgagctggcgccgaaaaaagcctggaccgccgtcgccatgaaaaccgccacccacgagctcgcgacgaccgtacagccaggcgctgcgctgtacggtctggagagccatctgcagggcaaagtcgtcacctttggcggcggatatccgctgtggcgcgatggccagctaatagccggcctcggcattagcggcggcagcgtcgagcaggatatggctattgcacagactgccatggcggccattaacgtgagaactcatcaatga

SEQ ID NO: 2817 - DNA, 597 bp, Klebsiella pneumoniae
gtacgcctggctattagcttcccagggtcacaacagaaggaattggctatgaaaatgaaatcactttgcctggcaatggcactcgtcggcttgacctcacactatgcctccgcggcggacggtacgctgtatttttcaggtacaattgtcaactcaacttgcaaactggcaagcggcaataatgacggtctcattgaagttaagatgggcgctgttccgctatctaaattaaaaaatgataccaatggcaccgggccagaagttggggtcaatattagcgtcaaagattgtgacgagggcacgtactatattgtgctcgacggtgcatcagccaccgaggcgcctatcactaacgtactggctctcgatgcgggtaatcctacagctaaaaaagtcggcattaagctaaccgaccgcaataataccccggtcacgctcgataaacctttcgatcccaccgtcgacccgcgtattacggtcaatgccgatggcaccggtaccttcaacctgaaagcctattactatacctgggataaagacaacgccgaagctggcgacggcaatgcgaccgccaggtttaccattatacagcaataa

SEQ ID NO: 2818 - DNA, 1122 bp, Klebsiella pneumoniae
tcctggtcggccccttcctcggcgatgagtatcactactcaaaactgtacgcagcggattttagccatgaataccgtaaagcctgaatccattgccctgttttgcctgacgcccggcggcgtgcggctggcaaaacggctggcggccatgctgccgcttacctgttacaccagcgaagcgctgcaggaagaggggtttatccccttcaacggcggctttgccagcgctgcccgcgaggcgttcagcagcttctcggcgctgatttttatcggcgccaccgggattgccgtgcgggtgctggccccgctggtgaatgacaagctcagcgacccggcggtggtggtgattgatgagcgcgcccggcacgtcatcagcttgctctccggccatgccgggggggccaatgcgctaacccgctatctcgccgggatgctcgacgccgacccggtgatcaccaccgccaccgacgtcaacgagctggccgccctcgacacgctggccttccagctgaacgctcggatgaccgattttcgcgcggcggtgaaaaccgttaaccagatgctggtgagcggtaagcgggtggggctgtggtgcgacggcgaattcaccggggcgctaagccgctgcgaccggcgcgggtttatcctggtaagcgacctggcgagcttgccggcgctcgacgccctgatctgcgtcaccctgcgccggtcgctgccgccgctgccggtgcctcactggaagctggtgccccagcgggtggtggcggggatcggctgtcggcgcgacaccccctgcgcgctgctcagtacgttgctggatcgccagcttgccgctcagcgtcttgacccgctggcgctgaaagcgatcggcagcgtgagcctgaaggcaaacgagccggggttgcgccagctggctcaccgctgccgggtgccgttcgaaaccttcagcgccgaggcgctgcgcgagcacgagcaccgctttccggcctcgtcttttgtccgggagacggtcggcgtcggcagcgtctccggcccggtggcctggctgctgagtcagggaaacctgtccggcgaaaccctgcgtgagcagggcgtgaccattactttgggagtaacacactga

SEQ ID NO: 2819 - DNA, 552 bp, Klebsiella pneumoniae
gccctaccggcaacattcgcgacatcccgttcgtggtgctggtgggcggctcgtccctcgatttcgagatcccccagctggtcaccgacgcgctggcgcactaccggctggttgccgggcgcggcaacatccgcggctgtgaaggcccacgcaatgcggtcgccagcggattactcctttcctggcaaaaaggaggcacacatggagagtagcgtagtcgcccccgccatcgtcattgccgtcactgacgaatgcagcgaacagtggcgcgatgtcctgctgggcattgaagaggaaggcattccttttgttctgcagccgcagaccggcggcgatcttatccatcacgcctggcaggcggcgcagcgttcgccgctgcaggtaggcatcgcctgcgaccgggaacggctcatcgtgcactacaaaaatttacccgcatcaactccgctgttttcgctgatgtatcaccagaacaggctggcccggcgaaacactggcaacaatgcggctcgtctcgtcaaagggatcccatttcgggatcgccatgcttaa

SEQ ID NO: 2820 - DNA, 516 bp, Klebsiella pneumoniae
ccagcaacggcgccgatctcgactaagcgtcctcgcccacgcgcgcccattccccgcgataaacgggggacgggcgtcggctgtctgttgcatccattacatgcttttttctcgagcctgattccagtttctggtttgccacctgtttacaataactggtattttatccagtacttttaccggggtatcttcagcaaggagcacatcatgagcgcacagcaccctaccgcagccagagggatagccagggccattcgccagttaaccgtgggatatgtcagaaaacgccatgaggaccgcaaaacgcgggagacgcggcgctacacccgccacgcggcattaagcttaaacggcgactggctggagcaggcggggtttccggtcggcacgcaggtcagagtctcggtgtcgcccggtaaattagtgatagagaatcttgagctggcagcgccgggaacggggctcccgtccggccagtcgtgcgccggcggagagcccggttcgccgcagggctag

SEQ ID NO: 2821 - DNA, 1218 bp, Klebsiella pneumoniae
ttagtggcggccgaaaacgggacgtttgcggtcgaatgtccagccggggatcaggtactgcatcgggcccgcgtcgttgcgcgcgccgcccggcagcgctttataggcctcatgggctctgcgcacctgctcccagtcaagttccacgccgagtcccggcgcgtctggcacggcaatgctgccgttaataatctgcagcggatttttggtcaggcgcgcgtcgccctcctgccagatccagtgggtatcgatggcggtggggttgcccggcgcggcggcgccgacgtgggtaaacatcgccagggaaatatcaaagtggttgttggaatggcagccccaggtgagcccccagtcgtcgcacagctgcgccacccgcaccgcgccggagagcgtccagaagtgcgggtccgccagcgggatatcgacggcgttgagcatcaccgcatggcccatttcgcgccagttagtggctatcatattggtggcgaccggcagcccggtggcgcggcggaactcggccatcacctcccggccggagaaaccctgctcggcgccgcacggatcttcggcgtaggtcagaacatcctgcagccctttacacagcgcgatggcctcatccagcagccaggcgccgttagggtcgacggtgatgcgcgcatccgggaaacgctttttcagcgcccgcgcggtgtcaatctcctgctcgccgggcagcacgccgcctttgagcttaaagtctttgaaaccgtagcgatcctgggcggcttccgccagacgcactatcgcctcgctgctcaacgcctgctggtggcgcaggcggtaccattcgtgatcgcccggcgtatggtccagataaccaaggtcggttttctgccgatcgccgatatagaacaggtagcccagcacggtgacggcatcacgctgcttacccgggcccagcagctcgcagaccggcacattaagcacctggccgagcaggtcgagcagcgccgcttccagcgccgccaccgcgttaaccttcagttcgaaggtccacgcccctttgccgaaggtgtcgaaatccgccgcctgattgcctttgtgcacctgctgcaccacgcgattgagtcgggcgacctcctggcccaccacctgcgggatcgccgccagcagcgtctggtagatgacctctccgccgggcgcttcgccgacgccggtatggccggcgttatcggttaa

SEQ ID NO: 2822 - DNA, 297 bp, Klebsiella pneumoniae
cgccttcgggccagcgccaggccggtggtgagagacccaccggcctggccttatgactttaagcgaggggctttagcagacgccgaagtctccctcttcctgatacggcgtgacctcgtccgacttcagcgaatagcgctctccctgctcctgtgcggcctgaaccaccaccagttgctccccttgcacttccaccactttcagttttggtccgcccgctcggggttgtaccagatcgccgacagcaaacataattcactcctcactgttaacaccatggataaacctaaaccatag

SEQ ID NO: 2823 - DNA, 816 bp, Klebsiella pneumoniae
cccgcccgggcgaaaccttctatcgtctggtaccggatgcgtctaaacgcaatcaggcatcggggcaacagcagaacaatcgataaccaggcccaggattacaacatggcagccacttttccgggcgtttgcgccgtggtgccggcagccggtttcggccgccgcatgcaaacggaatgcccgaaacaatatctctcaatcggtaacaaaacgattctcgaacacgcggtcgccgcgctgctggcggatgcgcgcgtccagcgggtggtgattgccgtcagccccggcgatcgccgcttcagccagctgccgctggcgcagcatccgcaaattaccgtggtggatggcggcgccgagcgcgccgattcggtactcgccggcctgcaggcgttgccggaggcgcagtgggtgctggtgcatgacgccgcgcgcccctgcctgcatcaggacgacctcagccgcctgctgtcgctctgcgaaaccagccgcgtcggcgggatccttgcggcgccagtgcgcgacaccatgaagcgcgccgagccgggcaaaaccgctatcgcccataccgtcgaccgcaatgacctgtggcatgcgctcaccccgcaatttttccctcgcgagctgctggtggattgcctcactcgcgcgctaaacgagggagccactatcaccgatgaagcctcggcgctggagtactgcggcttccatccgcagctggtcgccggacgcgcggataatattaaagtgacgcgcccggaagacctggcgctggctgaattttacctcacccgttcccgacaccaggagaaagcttaa

SEQ ID NO: 2824 - DNA, 441 bp, Klebsiella pneumoniae
aacgtaagggcgttgttcatgaataaggttgtcctctattgtcgccctgggtttgagaaagagtgcgcagcagaaattaccgataaggcagcccgccttgaggtgtttggttttgcccgggtcaaagaagactctggctatgtaatttttgaaggttatcagcaggacgacggcgagaagctggtgcgcgatctgccgttcagctcgctgattttcgcccgtcagatgtttgtggtcggcgaactgctgcgcgacctgccgccggaggatcgcataaccccgatcgtcggcatgctgcagggcgtggtggaaaaagggtggcgagctgcgtgtggaagtggcggataccaacgaaagcaaagagctgatgaagttctgccgcaagtttacggtgccgttacgcgcggcgctgcgcgaggcgggcgtgctgaccaactatga

SEQ ID NO: 2825 - DNA, 237 bp, Klebsiella pneumoniae
tcgcgaagggcgaggtggtctcgcgcagcaaaggcgcctccggcttcggcagcggcgccatcgtctgctgcccggccatctgcgccgcggcggtgcgcaccagatcgaccaccgcctgctcctggttcgcttcgccttctttggcaaaccccggcaggtggtagctgtagtgcccggtcgactccttatgccagtagaagccgccgtcgtgacgatggccgcggaagccccagataa

SEQ ID NO: 2826 - DNA, 237 bp, Klebsiella pneumoniae
tcctgccattttttattaaccacggcggcgagtttggcggctcggacggcgaagcggagagccagatccaggtggtggcgccggattatcaaccctggttccagccgctatatgaaccggcgagcggcgagattgagagtctgctgtttacccctgcagggctcgctgggcgcggcggtgattttttacattctcggatatgcgaggggcagacagcgccgtgatgaccgggtttga

SEQ ID NO: 2827 - DNA, 531 bp, Klebsiella pneumoniae
tggcctctttatccagagcaaagcggggcgataatgaccgattcagaattaatgcagctaagcgagaagattggccgggcgctgaaggcgcgtggggcgacggtgaccacggcggaatcctgtaccggcggctggattgcgaaagcgatcaccgatattgccggcagctcggcgtggtttgaacgcggctttgtcacctacagcaacgaagctaaatcgcaaatgatcggcgtcagcgaagcgacgctgcgcgacaacggcgcggtaagcgaaccggtggtggtggagatggcgattggcgcgctgcgcgcggcgcgtgcggattatgccatctccgttagcggcgtcgccgggccggatggcggcagcgtcgaaaagccggtcggcacggtatggttcggcgtcgccagcgtgagcgggcaaggggtgacgcggcgggaatgctttgccggagaccgcgaagcggtgcgtcgtcaggcgacggcctatgcgctaaatctgctctggcaacaatttctacaaaacacttga

SEQ ID NO: 2828 - DNA, 960 bp, Klebsiella pneumoniae
attattcttcttcggcgactttacgccgcccgatttccgcaggatgccaacactttgccgctgccggtttctatagtgggcctcgccgtacccaacgagccagcggatggttggctggcctggacacgaacttcgtcacgaggtgtcacaatgaatggttctttacgcgcgcaatgtatcgccgagtttttaggcaccgggctgtttctgttttttggtatctgctgcctgagcgccctgaaactgaccggcgccagcctggggctgtgggagatctgtattatctggggactgggtatttctctggcggtgtacctgacggccggcatttcggggggacatctgaaccccgcggtcaccgtcgccctgtggctgtttgcctgcttcccgggcagaaaagtggtgccctatatcgtggctcaggtcgccggcgcgtttggcggcgccgtgctggcctggatactttacagcaccctgtttacgcaatttgaaacggtgcatcatatggtgcgcggcagcctggaaagcctgcagctggccagtatattcagtacctacccggcgcctgagctcagcatctggcatgcggcgctggtggaggtggtgatcacctcgatgctgatggggatgatcatggcgctcaccgatgatggcaacggcgtacccaagggcccactggcgccgctgttgattggcattctggtggcggtgatcggcgcctcgaccgggccgcttaccggcttcgcgatgaatccggcacgcgattttggcccgaaattgttcacctggttcgccgggtggggcaatatcgccatgaccgggggaagagatattccctattttatcgtgcccattatcgcaccgttgttaggggcctgcctcggcgccgcaatttatcgttttcttatcgccaataatctgccctgtcatacctgcgtggaggaagaaaatacgcgttag

SEQ ID NO: 2829 - DNA, 420 bp, Klebsiella pneumoniae
tcgggcgattatccatcgcctgcacaccactctggagaagtcatgaatccttatctgcaggaagtcctcgatgcccatgtccttatcgaacgctggttaagccatggcgaaggaagcgctgaggcgctgatgaagcgttttgccgccgattttaccatgatccccttgagcggtgagaagatggactacccaacggtgagccgttttttccaccacgccggcggcagccgtccggggttagatatcgtagtggatcagatggaaatcatcagcgagtggcacgacggcgccgcagtgctatatcgtgaaagccaaacgctggcggatagcagtcagaacgttcgctggtcgacggcgatttttcagcaagcggaagggaaaattgtctggcgccatctgcaggaaacccgcctcggctag

SEQ ID NO: 2830 - DNA, 450 bp, Klebsiella pneumoniae
acgacagattatcgacaacgtctccgtcgcgctgcgcggcggcgagatgacggcgcttatcgggccgaacggcgccgggaaatccactctgctgcgcctgttgaccggctatctgactccggacagcggcacccgccatcttgcaggcaagccgctggaggcctggtctcccgaggcgctgtcgcgccggcgggcggtcatgctgcagcgaacggccctgcaggccgactggacggtggaaacggtcattgccatgggacgctcaccgtggggcgcgacggcggatccggcggtgctggcggcggtgatggccgtcaccggctgcgatggccttgccggtcgccgctatcccggcctctccggcggcgagcagcagcgggtacagctggcccgctgtctggcgcagctatggcgcgacggcgcgccgcagggctggctgtttctcgatga

SEQ ID NO: 2831 - DNA, 429 bp, Klebsiella pneumoniae
cagttttgttacggagtattcatggagttacgaaacgaagcattccacctgctgcgccagctttttcaacagcataccgcccgctggcagcaggcgttgccggacctgactaaacctcagtatgcggtgatgcgctcggtagcggagcaccccgggatcgaacaggtggcgctgattgaagcggcggtcagcaccaaggctacgctggcggagatgctcagccgaatggaagcgcgcggcctggtgcgccgggagcacgatccggccgataaacgccgccgttttgtctatctgaccgacgaaggcgaggcgttgcttaaccgttccattccgcagggcaatgaggtcgatgacgagtttctcggccgcctgagcgatgacgagcgcgagcagttctcccggctggtgcacaaaatgatggcgccctga

SEQ ID NO: 2832 - DNA, 1221 bp, Klebsiella pneumoniae
caggaacttctctattgcatggcaattaaattagaaatcaaaaatctttataagatatttggcgagcatccacaccgtgctttcaaatatattgagaaaggactcaacaaagcgcaaatactggaaaaaacggggctgtcgcttggcgtcaaagacgccagtctggccattgaagaaggcgagatattcgtcatcatggggctctccggctcggggaaatccaccatggttcgccttctcaatcgcctgattgaacccacccgcggccaggtgctgattgacggggtcgatatcgccaaaatgtcggatgccgagctgcgcgaggtgcgtcgcaagaaaattgcgatggtttttcagtcctttgcgctgatgccgcacatgagcgtgctcgacaacacggcgtttggcatggcgcttgccggcgttcccgccgccgaacgagagcaaaaagcccgggaggcgctgcgtcaggtggggctggagaattatgcccacgcctggccggatgaactctccggcggcatgcgccagcgcgtcggtttagctcgcgccctggcgattaatcccgatattctgttaatggatgaagccttctctgcgctcgatccgctcattcgtaccgaaatgcaggatgagctcatcaaattacaggcgaagcatcaacgcactatcgtctttatttcccatgaccttgatgaagccatgcgaattggcgatcgtatcgccattatgcaaaatggcgaagtggtccaggtcggcactccggatgaaatattaaataatccggccaatgattatgtgcgcaccttcttccgcggcgtggatattagccaggtattcagcgcgaaagatattgcccgccgcagcccggttggcctgattcgtaaaacgcctggttttggcccccgttcggcgctgaaattattacaggatgaagaccgggaatatggctatgtcatagagcgcggtaatcgctttgtcgggattgtctcgattgattctctgaaaacagccctcagcgccgggcaggggatcgaggcggcgctgattgacgccccgctggcggtggaagcgcaaaccccgctcagcgatctgctctcccacgtcggccacgctccgtgcgccgtgccggtagtggatgaagaacaacaatatattggcatcatttccaaacggatgttgctccaggctttagatcgcgagggggtgaatcatggctga

SEQ ID NO: 2833 - DNA, 798 bp, Klebsiella pneumoniae
tggcgatgttaccctaaagacgctgagaataagggggtatctgtggctgttcatctgttaatcgtcgacgcgttaaatctaatccgccgcatccacgcggtgcagggttcaccctgcgtcgatacctgcctgcatgccctggagcagctgattgtccacagtcagcccacccacgcggtggcggtgttcgatgatgaggatcgcgcccacggctggcgccaccagcacctgccggagtacaaagccggccgcgcgccgatgccggagacgctggtggccgagatgccggcgctgcgggccgccttcgaacagcgggggatccgctgctgggcctcgccgggcagcgaagcagacgatctcgccgccaccctggcggtgaaggtggcccaggcgggccatcaggccaccatcgtctccaccgacaaaggctactgccagctgctgtcgcccaccatccgcatccgcgactactttcagaagcgctggctggacgcccccttcatcgccagcgagttcggcgtcaccccggagcagctggcggattactgggggctggcggggatcagcagctcgaaggtgccgggcgtggcgggcattggacccaaaagcgccgcccagctgctgaacgagtttcaggacctggaggggctgtacgcccgtctggccgaggtcccggagaagtggcgcaaaaagctggccgcgcatcaggagatggccttcacctgccgggaggtggcccgcctgcagaccgacctccagctggacggcaatctgcagcagctgcggctgacgcgctga

SEQ ID NO: 2834 - DNA, 537 bp, Klebsiella pneumoniae
gcagcccttttgctttgtgagattatcgaggtgcctgtgactgaaccttcatcacgccgctccggctacgcccgcctgctggaccgtgctatccgcattctggcgatgcgcgaccacagcgagcaggagctgcgacgcaagctggtcgctccggtgatgagcaaaaacggtcctgaggcgctggacgccacccccgacgagctggagcaggttgtcgcctggtgtatcgaaaaccgctaccttgacgacaaccgcttcgtcggccagttcatcgccagccggagccgcaaaggctatggtccggcgcgcattcgccaggagctcagccagaaaggcattgcgcgccaggtcgttgaccaggcgatgcgcgaatgcgatatcgactgggtgagccttgccagggagcaggcacagcgtaaatacggcgaaccgttaccttccgcctttactgaaaaagtgaaagttcagcgattcctgctttaccgcggctacctgatggaagatatccaggaaatctggcgaaattttgcagattga

SEQ ID NO: 2835 - DNA, 360 bp, Klebsiella pneumoniae
tcatgtgttcttcatttaaactgcactttgtttacaatttgccctttcagacttagcgagacgacgatgaactcaaaagcggccatcaccatcacctactgttcccagtgcaactggatgctgcgcgccagctggatggcgcaggagctgttacatactttcagcaccgacatcgcctcggtgacgctggtgccggggaccggcgggatcttcacgatcgatgtcgacggtcagcagatctgggagcgcaagcaggatggcggttttccggatgcggccgagctgaaacgccgggtgcgcgatgtctgcttcccggagaagccgctgggccatgtggataaaggtgaccagaaggggtga

SEQ ID NO: 2836 - DNA, 1206 bp, Klebsiella pneumoniae
accatgacctaccgccaccgcgttgccaccgtttttctgttcggtttttttctcgatttgatcaatatgtttatcgccagcatcgcctttccggcaatcagccgcgcgctggcggtttccgtctcgcaactggcgtgggtcagtaatgcctatattctcagtctgacggtcgttgtgccgttcagcgcctggctcagcgagcgctggggggcgaaacggctgtttttactctcgctggggctgttcagcctcggcgcgctggcggcaggacttgccaacagcctgagcgaactgattttatggcggacgctgcaggggatgggcggcgggctgttaatccccctcggccaggcgcttacgtggccgctgtttcagccgcatgagcgggcgaagctgtcggcggcggtgatgctggtcggcctgctggcccccgcctgctcgccggcgatcggcggcctgttagtcgaggcgttcagctggcgctgggtctttttcgccagcctgcctgtcgctctgctaacctttgtgctggcggtgcgatggctgaacgacacccccggtccggttcgcccgactcgctttcttccactgtcgctgctggccgatcccctgctgcgcttcgcgatgctgatctacctctgcgtgccggggatgtttattggcgtcaacgtggtggggatgttctacctgcaacgcgtcaccgggatggcgccgggggcaatcggtgccctgatggtgccctggtcgctggcctcgtttgccgccatcacctttaccggcagatatttcaaccgcttcgggccccggcctctggttgtcatcggctgcctgcttcaggcgatggggatcatgctgctgctgaagatcgatgcggacagcccgctggcgctgttgattctggcctttacgctgatgggcggcggaggcagcttatgcagcagcaccgcgcaaagcagcgctttcctgcatacgcctgccgaagagatgcctgacgccagcgcgctatggaatcttaaccgccagctcagcttctttgccggcagcgccctgctcgccctgctgctgagggtattcccgccggcctacgcctggcagggggtatttatcagcgccgccgtcattaccctgttgccgctgctgttttgcctgcggctgaataatcgggcgattatccatcgcctgcacaccactctggagaagtcatga

SEQ ID NO: 2837 - DNA, 2289 bp, Klebsiella pneumoniae
gcagatgaatatcgagaaacgtcgccgtacggcgctggcctggtaagtcaaggcatgaacggggtgcaaatccgcattcgcggtaaagtgcagggggtggggttccgcccctttgtctggcagctggcccgggcgcaggcccgctgcggcgatgtctgtaacgacggcgacggcgtactggtgcggctggtcggaggcgacgacggttttactgccgctctggctgaccactgcccgccgctggcgcggatcgacagtaccgcctgcattccctatcgctgggcggccacgccgcaggatttcaccatccgcgagagcggggcgggacggatgcgcactcagattgtgcccgatgccgcgacctgcccggcgtgcctcgcggagatgaacgatccccgggcacgccgctaccgctacccctttatcaactgtacccactgcggcccgcggttaaccattattcgcgccatgccctacgaccggcccttcaccgcaatggcgccgttcccgctctgttccccttgtgaagcggaattccgcgatcctgccgatcgccgttttcacgcccagccggtggcctgccccgactgcgggccgcgactggaatggcgggcagagggggaagcgctggacggcgaggcggcgctgcaggcggctatcgcccggctggcggcgggcgacatcgtggcgataaaaggcatcggcggctttcatctggcctgcgatgccggtaaccccgcagccgttgccatgctgcgggcgcgaaaacaccgcccggcaaaaccgctggcggtaatgctgccgacggcaacgggcttacccgccgccgctgcggcgctgatgggctccccggcggcgcccatcgtactgattgccaaagcgcaggtctccggcctgtgcgacgaaatagcgccagggcttgcggaagttggggtgatgctgccgtctaatccgctgcagcatttgcttctgcaggggctggcgcgccccatcgtaatgacctccggcaaccttagcggccgtccgccggcgttaagtaatgctcaggcgctcaatgatttagccgacattgccgacggctttctcttgcataatcgcgacatcgtacagcggatggatgattcactggtgcgctcaagcggtgaaatgctgcgccgcgcccggggctacgtcccggacgcgctgccgctgccgccggggctaggagacatcccgccgctgctggctctcggcgcggatatgaaaaataccttctgcctggcgcgcggcagcgaagcggtgctgagccagcactttggcgatcttggcgaggaaggtgttgaacagcagtggcgcagcgccctgcagctgatgcagagcatttacgcgtttgtgccgcagcgggtggtggttgatgcccatcccggctatcgctcaacgcagtgggcggcctccctgcccctgccgctggagacagtgctgcatcaccatgcccacgccgcggcgtgcctggcggagcaccgctggccgcttgacggcggggacgttatcgccctgacactcgacggtattggtatgggggagaacggcgcgctgtggggcggggagtgcctgcgggtcaactatcgcgaatgcgaacatcttggcgggctgccggccgtcgcgctgccagggggggacctggcggcacgccagccgtggcgaaatttgctggcccactgtttggcctttgtccctgactggcaggattatccgcaggccgccaccctgcgccagcgcaactggccgctgctggcgcaggccatcgagcgcgggattaacgcgccgcgcgcctcatcctgcggacggctgtttgatgccgttgcctgcgccctggattgcgcgccggagagtctgagctatgaaggcgaagcggcctgtcggctggaggcgctggccgccagctgccccggcgtcagccacccggttacgctgccgttgcgcgacgacgcgctggatttagcgaccttctggcggcaatggctgagctggcaggcgactccggcgcagaaagcctgggcattccacgacgccctggcctgtggactggcggcgatggcccgcgactgcgccaccgtccgcggcatcgacacgatggtctgcagcggcggggtgctgcataaccgcctgctggcggcgcgattgaccttttatctggcggattttactctgctgtttgcacagcagttgccggccggcgacggcgcaatcgcctatggtcaggcggtgatcgccgccgcccgcgggcaggctcaaggaatacaaccatga

SEQ ID NO: 2838 - DNA, 846 bp, Klebsiella pneumoniae
ttttcacctctaaggataagtatgcttgccacaaccgatctctggtttcgctatcaggatgagccggtacttaaagggctgacgctggatttttcccgccatgcggtgaccggcctggtgggggccaacggctgcggaaagtcgacgctgtttatgaacctgagcggcctgctgcgcccgcagcagggggcggtgctgtggcagggagaggcgctgaattacagcaagcgcggtctgctggcgctgcgccagcaggtggcgacggtgtttcaggatccggatcagcaaatcttctataccgatatcgacagcgatatcgcttttagtctgcgtaacctcggggtggcggaagaggagatcgcccgccgggtggatgaagcgttgaccctcgtcgatgccctggggtttcgccagcagccgatccagtgcctcagccatgggcagaaaaaacgggtggcaatcgccggggcgctggtgctgcaggcgcgctacctgctgcttgacgagcccaccgcgggcctcgatccacgcgggcgggcgcagatgatcgccatcatccgccgcattgtcgggcaggggcggcgcgtggtgatctccagccacgatatcgatctgatctatgaggtgagcgacgccgtttacgtgctgcgtcacggcgaagtactggccgcgggggatcccggcgaggtatttgcctgcgcggagacgatggacagggcgggattgacgcagccgtggctggtgaaacttcatagcgaactggggctgccgctgtgtaaaaccgaggcggagttttttcagcggatgcacaacaacgcgataggcgcgataaaggaggcgtcatga

SEQ ID NO: 2839 - DNA, 966 bp, Klebsiella pneumoniae
ccgtctcgatacctcttacaaagactaacgcctatgtctgatatcactatcgtggtggattgtaacgacgcggatttcgcccgcgatatttgcgccgccctgcagcagtttcccgacgtcacggcgcttctgccccatcaccaggcggcgcgcgacgcccagtacgccagctgctggttcccggacccgcagctgttgacccgttcgccggggctgaagctgatccaggccgcgtccgccggggtcgatcatctgccgcccgcgctgttcgccagcgagatcccgctgtgccgggtgatcgatgaagattttcgccacggcatgttcgaatatgccctgtggagcgtcctgtggtttcagcgccatttcgaccgggcgctggcccaccagcggacccaaacctggaagctctatccccagcgcgccgccgccgacttccatatcggcattatggggctcggcgaaattggcggctatatcgccgaccagctggcccgcctcggctatcgggtctccggctggtcgcgcagtgaaaagcagctggctggcgtcacctgctatcgcggcgaggaggcgctcgacagcttcctcgggtcgcttgacgggctgattaacctcctgccgctcaccgcgcagacccggggtatcctcgccgcgccgctgttcaaccggctacccgccggggcggtgttgatcaactgcggccgcggggagcatatggtcaatgaggatgtgctggcggcgctggagagcggccagctcgccggagcggtgctcgacgtcttcccgcaggagccattgccggcggacgatccgctgtggcgccatccgcaggtggtcatcaccccacatatggcctctgcggcctctgccgaggtgatcgcccgccagctgctggagaacattcagcgccagcgccgcgggctgccgctgaaaaacctggtcaataagcacgccggttactga

SEQ ID NO: 2840 - DNA, 1599 bp, Klebsiella pneumoniae
aatagtcgatatgacaatgcgtattgtcaaaatgacaatggagcggcaatgagtttttccgtcgacgagctggcgagaatcgccatagatttacaaagcgatattggtcacaccgaccgcttttcgcgcctgattactaccctgcggcaaattcttggctgcgatgcctcggcgctgctgcgctatgaggcgcatcagtttgtgccgctggcgatcgatggcctggcgcaggatgtgctcggtcggcgctttgccctggaaggacacccgcggctggaggcgattgcgcgcgccggggatgtggtgcgcttcccggcggatagcgacctgcccgacccctatgacgggctgatccccggtcatgagagcctcaaagtccatgcctgcgtgggactgccgctgtttgccgggcagacgctgattggcgcgctgaccctggacggcatggatgccgatcgtttcgatagcttcagcgatgaagagctgcggctgattgccgcgctggtggccggggcgctgaataatgcgctgcttatcgcccgccttgaagcgcaaaacgtcctgccggcgcaggcggtgaattacccgctgccggagcgccaggagatcatcggcctgtcggggcccatgctgcagctgaaaaaagagatcgatatcgtcgccgcctcggatttaaacgtgctgatcagcggcgaaaccggcaccggcaaagagctggtggcgaaggcggtgcatcaggggtcgccgcgagccgccaaccctctggtgtacctcaactgcgcggcgctgccggaaagcgtagcggagagcgagctgttcggccatgtgaaaggggcatttaccggggctatcagcaaccgcagcggtaaatttgagatggcggataacggcaccctgtttcttgacgaaatcggcgaactgtcgctggcgctgcaggccaaactgctgcgcgtgctgcagtatggcgatattcagcgcgtcggcgatgaccgcagcctgcgggtcgatgtgcgggtgctggcggcgacgaaccgcgatctgcgccaggaggtggtggaagggcgctttcgcgccgatctgtaccatcggctgagcgtcttcccgctgtcggttccgccgctacgcgagcgggaaagtgacgtggtgctgctggcgggctatttctgtgagcagtgccgcctgcggatggggctggcgcgggtcattttggctgaggcggcgcgaaaccggctgcagcagtggtcctggccgggcaacgtgcgcgaactggagcatgctatccatcgggcggtggtgctggcgcgggccacccaggccggtgatgaagtggtcctggagccgcagcatttccagtttgcggtggcggcgccgatgttgccgactgagacggcggcagcggcgcccgcgacgggaaacatcaatctgcgcgaggcgaccgactcttttcagcgagaagccattagccgtgcgctggaggcgaaccagggcaactgggcggcgaccgcccgagcgctggaactggacgtcgccaacctgcatcggctggcgaaacgtctgggtcttaaaggatccccgcctggtaaaagttctgcaggttaa

SEQ ID NO: 2841 - DNA, 966 bp, Klebsiella pneumoniae
aagcgcagatacgccggtcggcgtagtcaaatccgccggacgcaaaaagcaggagaaatggctgaccaccctcggggagatggattttgccccagtggatatgaccagtctggtgatcgttggcaacaaagcgacttacatcgacaacggcctgatgatcaccccgcgaggctacgcgctgtgaatcacggcgacgtgctggttatcgggggcaccagcgatgcgcgggcgatctgccagcagctggacgccgccgacgtgcgctacaccctgtcggtggcgacccctaccggcgagcggctggccggcgatatccgcgggcagatacgctgcgggcgaatggagtggcagcagatggcggagtggctcagagcgcagcgcacccgctgggtgatcgatgcctctcacccctacgccgaggtggtcagccagaatattgtgcgcgcctgcgctagcgtcggggttctgctcagccgctatcaaaggccggagcagctgagcgatctgcgccatccgctacttcacgtggtcggcgatctgaacgaggcctgcgcggtggctcgtcgcttcggcgagcggatcctgctgaccaccggcagcaaagatctggcggcctggcgggcgggactggcggagaaaacgctgctcgcccgggtgctgccggtgccggaggtggttcagcactgtagcgatctggggtttggcgtcggggagatcttcgccctctgcgggccgttcagcgccgaatttaacgccgccttttatcgccagtgccgggccgatgttgtggtgacgaaagcctcgggggcggaaggaggctatcaggaaaaagtacaaccctgtcttgatgcggggatcccctgcatcgtcattacccgtccggcgccgctggtgacgggcgatgaactactgcaaagccaggccgatttcactgcgcggctgacgcgctggctgtcggcgacttga

SEQ ID NO: 2842 - DNA, 2076 bp, Klebsiella pneumoniae
gcaatgtcgtatacaccgatgagcgatctcggccagcaggggctgttcgatatcacccggcttttattacagcagcccgatctggccgcgctaagcgaaaccctgacccgtctggtgcaacagtccgcgctggccgatgaggcggccatcatcctgtggaacgcgggtaatcaccgcgcggccaggtacgcctgcgatgaggccggccatccggtaagctacgaggatgaaaccgtcctggcccacggtccggtgcgtcgcttactctcccggccggatgccctgcattgcgatcatgaaacctttgccgatacctggccgcagcttatccgcagcggactgtatcgtccgttcggttactactcgctgctgccgctggcggcggacgggcggatctttggcggttgcgaattcctccgccgtgacaaccggccgtggagcgagaaagagttccagcggctgcataccttcgcgcagatcgtcgccgtcgtcaccgaacagattcagaaccgggtcagcaataacgtcgattacgatctgctgtgccacgagcgcgacaactttcgcatcctggtggcgatcaccaacgcggtgctctcgcgactggatatcgacgagctggtcagcgaggtggcgaaagagatccatcgctacttccggatcgacgccatcagcgtggtgctgcgcagcgaccgcaaggggaagctcaacatctattccacgcattatcttgacgccagccacccggttcacgaccagagcgaggtggatgaagccggcaccctcaccgagcgcgtgttcaaaagcaaagagatgctgctgcttaatctgcacgaacatgacactctcgcgccgtatgagaaaatgctcttcgagatgtggggcaataagatccagaccctgtgcctgctgccgctgatgtccggcaataccctgctcggggtgcttaagctggcgcagtgcgacgaacaggtcttcaccaccaccaatctcaagctgctgcggcagatcgccgagcgggtgtcgatcgctatcgataacgccctcgcctaccgcgaaattcagcgcctgaaagagcggctggtggatgagaacctcgccctcaccgagcagctcaataatgtcgagagcgaattcggggagattatcggccgcagcgaggcgatgaacaatgtgctcaagcaggtagagatggtggcgcacagcgacagcaccgtgctgatcctcggcgaaaccggcaccggcaaagagcttatcgcccgcgctatccacaacctcagcggacgcaacggtcggcggatggtgaagatgaactgcgccgcgatgcccgccgggctgctggagagcgatctgttcggccacgaacgcggcgcgttcaccggggccagcgcccagcgtatcggccgcttcgaactggcggacaaaagctccctgttcctcgatgaagtgggcgatatgccgctggaactgcagcccaaactgctgcgcgtcctccaggagcaggagttcgaacgtctggggagcaacaagctgattcagaccgacgttcgattgatcgccgccaccaaccgcgatctcaagcagatggttatcgacagggaattccgcagcgatctctactaccggctcaacgtgttcccgatccacctaccgccgctgcgcgaacgtcccgacgatatcccgctgctggtgaaggcgtttacctttaaaatcgcccgccgcatggggcgcaatatcgacagcattccggcggaaaccctgcgcactctgacgcgtatggagtggccgggcaacgtgcgcgagctggaaaacgttatcgaacgggcggtattgctcacccgcggcaacgtactgcagctctccctgccggagcgggatatcgtggaagccccgcggacgccggcggtcctgcctgaggaaggtgaggatgaatatcaactgatcgtccgggtgctgaaggagagcaacggcgtggtggccgggccgaaaggcgccgcccagcggctggggctcaagcgcaccacgctcctgtcacgcatgaagcggctgggtattaataaagacgaactggtgtaa

SEQ ID NO: 2843 - DNA, 279 bp, Klebsiella pneumoniae
actatgcatctggcacgcgtgaccggcgccgtcgtctcgacgcaaaaatcgccctctctgaacggcaaaaaactgctgctggtgcgccgggtaagcgcggacgacgatcgtccgattctccccacgagcggcgatgaagtggcggtagattcggttggcgctggcgtcggcgagctggtgctgctctgcagcggctcgagcgcacgccacgttttcagcggcccgaatgaggccatcgatcttgccgtcgtgggcattgttgactcactttcacgctaa

SEQ ID NO: 2844 - DNA, 246 bp, Klebsiella pneumoniae
tatcatattcataaagttagaatatattcctttcacacattacagcataacgtgacgatcatcacacatgcgatccgccgactgatgaaagatcgagcaatgtcgattttatccacagattacgcgcaggccaccggcagattttctctaaaaattcgattttcgtcgcacgtcaaggctgtaaatcgaaccagtagtgagtcttttccccagttatcccacttttctgtggataacatggtgtaa

SEQ ID NO: 2845 - DNA, 519 bp, Klebsiella pneumoniae
attttacctcacccgttcccgacaccaggagaaagcttaatgcgaattggacatggttttgacgtacacgcttttggcggtgaaggcccaatcatcattggcggggtacgcattccttatgaaaaagggctgctggcccactccgacggcgacgtcgcgctgcatgcgctgaccgacgcgctgcttggcgccgcggcgctgggcgatatcggcaagctgttccccgataccgatccggcgtttaaaggcgccgatagccgcgaactgctgcgcgaagcatggcgccgcattcaggccaagggctatacgctcggcaacgtcgacgtcacgattattgcccaggcgccgaaaatgctgccgcatattccgcagatgcgcgtctttatcgctgaggatctcggctgccatatggacgacgtcaacgtgaaagcgaccaccaccgagaagctcggcttcaccggccgcggggaagggatcgcctgcgaagcggttgcgctgctgcgtaaggccgacaaatga

SEQ ID NO: 2846 - DNA, 513 bp, Klebsiella pneumoniae
ttcgccgatctcgtccagcagcagcgtccccccttccgcggcttcaaaccagccgggctgtccctgctgcgcgccggtgaaggcgcctttctcatggccgaacagttcggcttcggcgaggctctcggtcagcgcgccgcagttaacggccagaaacggctgctggcgacgggcgctgtgatgatggagatagcgggccaccacctctttgccggtgccggtttcgcccacgatcagcacggtcgcctccgttggcgcgagtttgtccagcaggctctggaaggccttcgacgccgggtcgatcagcgcgggagcggtggaaggggattctgggttcagcatagcgggcctccgatcgttgacgctctgaacttatcctgcggcggccgcagaaaccagagggggaaggcccgcggctgttgcaaatgcgccagcggatgcgcggcggctgcgcgatttgcaacagcgcggcgcggcgaagccgttttcagtgcattgattttaaaagattaa

SEQ ID NO: 2847 - DNA, 1278 bp, Klebsiella pneumoniae
cgagccgctcaacggcggcgtgactcagcagcgggaaagcgatcaagagcagtaaccagcgcatcatgcgggctgcccttcacgggtcaggcggtctacctgctggcgccattgcgtctgctcggggtgcccctcgctgcgctggccgtagagctgggcaatctgggtgccgtctttagcgaacagttcgacgctggtgacgtgtccgtccgaagtcggcttgcgggtcacccacacttcatcgacgctctcttcgcgcagatgcagggtaaaagtagtattgaagatattcagccagccgcgcatgggggccagcttttccagggcgccggtaaagatctgcacgcagccgcgattgccgacgaaaatcatgatttcattgccctcctggcgcaccgtctccagcagcgacggcagcgcatggcgatccacgcggcaggcgaggtcgtcgctcaccagacggaaggcctgctggcgggaaagctgatatttacgcagcagaccgaagaactggtgaacgtcggtcatcgcgcgccagtcgttctccagggcggcgccatcggcggtatcggcatatttcaccggctccagcgggcgcagggtcagcggtgccggcgccgccacccgatattccgcgatcagggtctcccaggccgccatgtcggtctgcgtggtcgcatagactttcagcagggcgtcgccgtggtggtcgaaaaactggatgctctgacggccattatcgttcagatggaaggcgctggcccactggctgaggaacagacgcaggtcgagcgcgcgcgggttcagcaccagcccggcgtggccgctgaggtgctggtgcgtgaactggcccacctgctcatgcacggcatactcgttgcggcagatgcatttggtttcgccgacgcgctccagggcggcaatcagcgcccgggcgtcatcgctcaggcgcacggcatcatggccgaggcgggcggcggtcagctcggcttcgctgatccccatttccgcggcgatatcgcgggcatatttcgcggtactggccgctttggtggcctggtagcgctgccacaggtcagggtgtgcatttggcataatcatatccttctcgacgatgaatatccccgaccggcgggccgggggcaggtgcgttattattcgggcaatcagaagtcgacgttgacgcccagctgccaggtgcggcccggcatcaccgccagcgctttatcgttggcgtcctggttggtgccggtctcgatattgcggctgctcaggtaa

SEQ ID NO: 2848 - DNA, 1500 bp, Klebsiella pneumoniae
cgatgccatcactcattttgcctccgtcgccagtacgtcaaagacatctttgccaagagaacactcagggcagaggaaattgtccggcacttcgctccacggcgtacccggctgtacatcctgattaggttcgcctttcgccgggtcatagacccactggcacacgctgcactgcatcatgggaccgagatcggcggccgcggccgcggcacaggcgcagtcctgtggttccggcgttgtcgctgcttcagcaaccggcagcggcgagagggcccattggcgagcgatgtcgcgaccgtgttggcggcacagctccagcgcgtcgatatccgggcgccatttggctttcaggctcagcgacatctcaaagccggcatcctgcaggcgggtggacaggcggtctaccgcgccgccgctccagccgtgcgagccaaaggcgctggcgcgtttattgcgaaaacgcagcccggtcatctcttccaccagcccggcgattttcggcatcatcacgttgttcatggtggacgtgccgacaagtacgcctttcgagcggaaaacattggtgaggatgtcgtttttgtcgctgcgggcgacgttaaagattttcaccgctacccgtgggtcaacctcggtgatcccctgggcaatggcgtccgccatcatgcgggtattattggacatggtgtcgtaaaagatggtgatgcgatcttcctgataatccgccgcccactcgaggtatttctcgacgatttgcgtcgggttatcgcgccagaccacgccgtgggaggtggcaatcatctccaccggcaggttgaagccgaggatttcagtaattttcggcgtcaccaggcggctgaagggcgtcaggatgttggcgtagtagcgctggcactgttcgtacagttcagtctggtccacttcatcgttgaacagatgttcgtcgcaatagtgctggccgaaggcgtcgttgctgaacagcaccgcgtcgccggtcaggtaggtcatcatgctgtccggccagtgcagcatcggcgtttccacgaagatcagctgtttaccgttaccgatgtcgagagtatcgccggttttcaccacgtggaagttccactccggatgatgatggtggccgttgatcgagtcgatggcgttggcggtgcagtagatcggcgtatccgggatctgcatcatcagttcggtcagcgcgccggcatggtcctcttcggcgtggttaatgacgatatagtcgaggtcggcgaggtcgatttcgcggcgcaggttctgtacgaactcgcggctgaatttatgatcgacggtatcgatcagcacgtttttctcttcgcggatgagatagctgttgtagctgctgccgcgcagcgttttatattcggtgccgtggaaatcacgcacttcccagtcacgttggccaacccaaagaatgttatttttcaccacaatagacatagcaacctcaatcaatacagtgtgtttaaactcagttga

SEQ ID NO: 2849 - DNA, 1131 bp, Klebsiella pneumoniae
gcgaagcatcagctaacaggcgccagggcggtgtctacgttcctctcgcagagagggcaggggaaatcgtccaggcgtcgtttgttgatgtgccgtggaaggtgctttgctcagggatcacgggtaggagccacctttatgagtcagaatacgctgaaagttcatgatttaaatgaagacgcggaatttgatgagaacggaattgaggttttcgacgagaaagccttagtagaagaggaacccagtgatagcgatctggctgaggaagagctgctgtcgcaaggcgcaacccagcgcgtacttgacgccactcagctttatcttggagagattggttattccccactgctgaccgcggaagaggaagtctatttcgcgcgtcgcgcactgcgtggtgatgtcgcttcacgccgtcgcatgattgaaagtaacctgcgtctggtggtgaagattgcccgtcgttacagcaatcgtggtctggcgctgctggatctgattgaagaaggtaacctcggcctgatccgcgccgttgagaagtttgacccggaacgtgggttccgtttttcgacctacgcgacctggtggatccgccagactattgaacgggcgatcatgaaccaaacccgtacgatccgtttgccgatccatattgttaaagagctgaacgtctatctgcgtaccgcgcgcgagttgtcccataagctggaccacgagcctagcgcggaagagatcgccgaacagctggacaaaccggtcgatgacgtcagccgtatgctgcgtctgaacgagcgcatcacctccgtggatactccgctgggtggcgattcagaaaaagcgctgctggatattctggccgatgagaaagagaacggcccggaagacaccacgcaggacgatgatatgaagcaaagtatcgtcaaatggctgttcgaactgaacgccaagcagcgtgaagttctggcacgtcgttttggtctgctgggttatgaagctgccacgctggaggatgtgggccgtgaaattggcctgacccgcgaacgcgtgcggcagatccaggtggaaggtctgcgtcgcctgcgggaaattctgcagggacaggggctgaatatcgaagcgctcttccgcgaataa

SEQ ID NO: 2850 - DNA, 438 bp, Klebsiella pneumoniae
gaggttaatcatgacccaggctatcggaattttagaactgaccagcatcgccagggggatggagctgggcgacgtcatgctgaaaagcgcgaacgtacagctcctgctctgcagaaccctttgccccgggaaattcctgctgatgctcggcggcgacgtcggcgccgtgcagcaggcaatcgccgccggcaccgcgcgcgccggggagatgctggtggacagcctggtgctggccaacattcaccccagcgtactaccggcgatcagcggtctcaacgtggtcgggcagcggcaggcggcggggatcgtcgaaacctggagcgtggcggcgtgcatcagcgccgccgaccgcgcggtgaaagcggccaacgtcaccctggtgcgggtccatatggcgtttggtatcggcggcaaatgctacatggtggtggcgggtga

SEQ ID NO: 2851 - DNA, 1404 bp, Klebsiella pneumoniae
cgatcatgtcaccttctcctctaccgatgccgccgtgcgcgcatcgcggcggtagctggcgcccgggtgaggcgcggccagacgcgggccgccgccgaacagtttttcgcgcagggtcccctcgcggtactcttgcttaaagacgtcgcgcttttgcagctcaggcaccagcagctcgacgacgtcgcggaaggtttcgtgagtgacggcataggcgaggttaaagccatcgacgtccgtctcttcgacccaggactgcagttcgtccgccacggtttgcgcgctgccaaccaccagcggaccgaagccgccgatccccgcccaatcggccagggcctgcaccgtccactggcggttcggatcagcggtcgaaaaggcctccaccgccgactgaatggcgttggtgtgcagatacttcagcacctgatccggctgatactggccgaaatcgatccccgtccagccggagagcagcgccagcgcgccttcatagctgacgtactgcttatattcctgccacttcgcctgtgcctcgcggtcggtgtcgccgacaatcaccgtctgcaggttgaagatcaggatgctgtgcggatcgcgccccgcctcagctgcccggcggcgaatatccgccaccgtcttcttcagcagcaccttcgacggcgctgcgacgaagacgcattcggcatggccggcggcgaactgtttgccgcggctggacgcccccgcctgatacagcaccggcgtgcgctgcggggatggctcgcagaggtggatccccggcacggaaaagaactgtccctgatggttaatgggatggattttccgcggatcgctgaagatcttccgctctctgtcgcgcagcaccgccccatcctcccagcttccctccagcaacttatagatcacctgcaaatactcatcggcatagtcatagcgggtgtcatggtcggtctgggtctgctggccgatattgcgcgccccgctctccagataggaggtgacgatattccagcccacccgccctttggtcagatgatcgagcgtcgacagacgacgagcgaaggggtaaggatgctcaaacgacagcgaggcggtcaggccgaagcccagatgctccgtcaccagcgccattggggtgatcagagccagcggatcgttgaccggaacctgcgtcgcctggcggatcgccgcatcgccgctgccgttcagcacgtcatagatccccagcacgtcggcgataaacagcccgtcgaacttgccgcgctccagcagccgcgccagatccacccagtactccagatctttatactgccaggagcgatcccggggatgcgcccacaggcccggcgactgatggccgacgcagttcatatcgaaagcgttaagacgaatttcacgttgtga

SEQ ID NO: 2852 - DNA, 921 bp, Klebsiella pneumoniae
ccgtctggtcaaccgtttacgccacacgcaggggaaccttgtatgacaacagagcaatttgagttacgtaaagcgcggcgctggccctggctggcggcgctggcggtgattatcctgctcgccatcgccttctggtggtggcggggacatacccaaagccagcaggtggtcttcggcagcacgttaaaaattcactacgagccggcgatggccggcgagcagcggatcattgagtatattaatcagcatattgcgcccgattacggtctgaaactggaggcggtgggggtgcaggatccggtccaggctgaccgcgcggtagcggaaggtcagtatgccgggacgatctatcagcatcagtggtggcttaaacaggtggtggacgctaacggctttgcgctgtcgaccacggtgccggtgttccagtgggcgtttggcatctattccgaccgctactcgtcggtacaggcgttgcccaacggcgcgaccattgtcgtgcctgacgatggcgccaatcaggggcaggccctgtggctgctccagcgcattgggttgatctcgctcgacccggcggtggagccgcgcacggcgaagctgaaaaatattgtcggtaacccgcatcagtttgtctttaaagagctggatctgctgaccatgccgcgggcgttaaattcggtggatgccgccatcggctatgtctcgcaatttgacgccgggaaagtgccgcgtgagaaaggcatattattcccgccggcgccgcgcacctttgcttcgcaattagtgattggtacaccgtatttatcgcaggaaaatatcgtcaaattaaaacaggctttttctgacccgcggatccagacgtggttaaaaaccaccgatgacccgctggtaaaagacgtattagttccagtgtccgcggaataa

SEQ ID NO: 2853 - DNA, 1614 bp, Klebsiella pneumoniae
cagttcatccattacaattatgcttattcaaacgatttcgacaggcgggaggtcaaattgatcccggacgtatcacaggcgctggcctggctggaaaaacatccgcaggctctgcagggtattcaacgtggtctggagcgggaaacgctgcgcgtgaacgcagacggcacccttgcaacgaccggtcaccctccggcgttaggctcagcgctgacgcataaatggattaccaccgattttgccgaagctttacttgagttcattacgccagtagatggcgatattgagcatatgctgacctttatgcgcgatgtccatcgctatactgcgcgtcagcttggcgacgagcggatgtggccgctgagcatgccatgctatatcgcccccggtcaggatattgagctggcgcagtacggcacctctaacgtggggcgcctgaaaacgctatatcgcgaggggctgaagaaccgctatggcgcgctgatgcagactatctccggcgtgcactataacttctccctaccgatggccttctggcaggcaaaatgtggtgtggaagatgccgagagtggtaaagaggccatttcggcgggctatttccgctcaattcgtaactactatcgctttggctgggtgatcccctatctgtttggcgcctcgccggcgatttgctcctcattcctgcaaggcaaaccgacaacgctgccctttgaggaaacgggcaacggcatgtattacctgccgtatgccacctcgctgcgcctcagcgaccttggttataccaataagtcgcaaagcaatctcggaattacgtttaacgatctgcacgagtatgtggcaggattgaagcgggcgattaaaacgccgtcggaagagtacgctaaaatcgggctgcagaaagacggcaagtatctgcagatcaacagcaacattctgcagattgaaaatgaactttatgcgccgatccgcccgaaacgcgtcacccgtcggggcgaaaccccgtccgatgcgctgttgcgcggtggtattgagtatatcgaagtgcgttcgctggatatcaatccgttctcgccgatcggcgttgacgcccagcaggtgcgtttcctcgacctgtttatggtctggtgcgcgctggccgacgcgccggagatgagcagcgatgagctgctgtgcacccgcaccaactggaatcgggtgattctggaagggcgtaagccgggcttaacgctggggattggctgcgaaagcgcgcagttcccgctggctcaggtgggcaaagatctgttccgcgatttacgccgcgtggcgcagaccctggacagtatccacggtggccaggcatatcagcaggtctgcgacgagctgctggcctgctttgacgatccggaattaaccttctcagcccgcattctgcgttctatgattgaagaaggcattggcggtaccggccgtgcgcttgccgatcgttaccggacgcagctgcgcgaagagccgctggagatcctgagcgaagacgattttatcgccgagcgcgacgcgtcggtggcgcgacagaagaaagtggaagctgaagacagcgagccgtttgaggcgctgctggcgcggcatgcgtag

SEQ ID NO: 2854 - DNA, 1578 bp, Klebsiella pneumoniae
tacacggtccagacccctttcaccggcgaggtcgccatgacttcaatcttttcatcggcgcaacgtggacaaatcatcttcttctccttatttacggttggccagcatagcggtcagtttttcagcccagactttggtttccggcagatcctgcaccggctggctgtagtggccgcgaaggtccggcgcaaccggggtggtggcgtcgataatcagtttgtcggtaatgcctgccgggctggagcctgggtcaagttcaaggaccgacatgttcggcaactgcaccaggtctcccgccgggttaaccttcgaggagagcgcccacatcacctgcggcaggttgaacgggtcgacgtcttcatcaaccatgatcaccatcttcacatagccgaggccgtggggagtggtcatcgcccgcaggcccaccgcgcgggcaaaaccgccgtagcgttttttggtggagatgatcgccagcagaccatgggtgtacatggcgttgaccgcctgcacctccggaaattcggccttcagctgctgatacagcggtacgcaggtcgccgggcccatcagatagtcaatctcggtccacggcataccgaggtagagcgattcaaaaatcggtttgctgcgataagagactttgtcgatacgcactaccgtcatgttacgaccgccggagtagtgaccggtaaattcaccgaacggcccctcgatctcacgcttacgcccttcaatgaccccttcgaggatcacttccgaaccccagggcacgtcaaagccggtcagcggcgcggtagcgatgggatacgggctctcgcgcagcgcgccagccatctcatattcagactgatcgtatttcagcggcgtggcgcccatcagggtaataatcgggtcgttaccgagggtaatggcgatcggcagatcttccccacgctcttccgctttgtgcagatgcagcgcgatatcgtgcatcggtaccggctgcaggccgagcttgcgcttgccttttacttccatgcggtagataccgacgttttgcttaccgaagttatctttatccagcggatcgcgcgaaacgacacaggctttatcgaggtagaaaccgccgtcaccatcgttgaggcggaacagcggcagaatatcgaacaggttgatatcatcgccatcaacagtattttctgcccacgccgggttggcgcggcgctctggcgtcaccgggaagttatcccagcggcgaatgaactcatcaatctgctttttcaccggcgtgttaggcggcaggcccagcgagatggcatggttctgccacgagccgatggtgttcatcgtcacgcgagcgtcgttaaagccgcgaatattatcgaaccacagcgccggggcaccgtcgccgatgcgtccggtcgcattggcggccgccgccagatcgggctcagcgttcacctcttcactgattttcagcagttgtccctggtcatccagcgcctgcaaaaagctgcgcaaatcatcaaaagccattattcgatctcctgtgcaaattgttctgccgtgcgcaagccgttccagcggcgcgctttgtga

SEQ ID NO: 2855 - DNA, 543 bp, Klebsiella pneumoniae
ggtcatacccaaatggatagttcgtttactcccattgagcaaatgctcaagttccgcgccagccgccatgaagatttcccgtttcaggagatcctgttaactcgtctttgcatgcatatgcaaggtaagctgctggaaaatcgcaataaaatgctcaaagcgcagggaattaacgagacattatttatggcgctgattacgctggagtcacaggaaaaccacagcatccagccgtccgagctgagctgtgcgctgggctcgtcacgtaccaacgccacccgtatcgctgatgaactggaaaaacgcggctggattgagcgccgcgagagcgataacgatcgtcgctgtttgcatctgcaactgaccgaaaagggccatcagtttttgcgtgaagtcctgccgccgcagcataactgcctgcatcagctgtggtcttcacttagcaccagcgaaaaagatcagctcgaacacatcacccgcaaactcctgagccgccttgatcagatggaagaagaaggcgtgctagcggactctctacgctaa

SEQ ID NO: 2856 - DNA, 1500 bp, Klebsiella pneumoniae
agcaccgcccaggtcgtgccacagggtggcgataaaggtttccagcgccggccactcgcgcagcggaggcagcgccagggcgtattcccgcaggcgccacagcagatcttcacggaattctccggcgctgacccgctgggtcaggttgcggtgggtggcgcagatcaaggcgaaattcaccggcacgctgcggctggcgcccagcggagcgacctctttctcctgcaggacgcgcaggaggcgggtctgcagcgccagcggcatatcgccgatctcatcaagaaacagcaccccgccgtcagcctcgcggattttaccgatatagccatttttgctggcgccggtaaacgcccccggctggtagccgaagagctcggattcgatcagcgattccggaatggcggcgcagttaatggcgacaaatttaccgctgcgccagcggctgtgccggtgcaacgtgcggctgacatactctttgccgctgccggtttctccttcaatgcacagggcgatgccggcgttgagcagccgcagcagcttttcgccttcgcgcgggctggtaaaggggagatgcatggccggcggggcgcttaccgccacccggcggcgggtgggctcccgcaggcgatagtggtagcggccctgcggcgtggtcagcggcagcgggacgctgaccgccgtttgcgtcagcgtcggaaaaagcgaggcaaaggtgagctggccaaactgcgccgcgctcaggccgaactcgcgcatcgccagccggttgccggcggtgaggacgttgtcggaaaagaccagcagcagctcctcgacgctgtcgagtttgtccacctgccggtgcaggctcatcagccactgctcaggatgcagactctgtttcacccacagatattcaatttgctttgccgccgcttttacccagccaaaggtgtgctggtggggaaaattcgccgggccggagatatccagcaccccggcgatgcttccgtccggtcgctggagcggcatcgccgcgcagtacagattctggttgcgggtaagaaagtgctgacggccatcgatctcgcagccatcgtcaatcgccagcgcggtgccgatggcgttggtcccgcgcccgctttcactccacagattgccgggagccagcgccacgcgctgggccttttgcagcgcctgggtatcgccgagagtatgcagcaccaggccgtcggggtcggaaaggatcaccaccgactgcaggtctgcgacctggcgcgacagggcttccaccaccggctgcgccagctgctgcaggccgcggtggctggcgagccggtccgccagctcgccggcgccgaggcggggaaaatcctcggtggcgggatccagcccgtagcgctggcagcgagaccacgaatcgctcagcaggggattcgcattaacctctggtgcgagaagaaagggattgcctgccacagggcacctctgggtcgatgttgctgtgttgcaatattgtag

SEQ ID NO: 2857 - DNA, 1545 bp, Klebsiella pneumoniae
cgatatcaccaatcatatcgtcacccgggtgctggatcagtttggcctcgactatcacaaagcgcgccgctggaacggcttgcgcacggcagaacaatttgcacaggagatcgaataatggcttttgatgatttgcgcagctttttgcaggcgctggatgaccagggacaactgctgaaaatcagtgaagaggtgaacgctgagcccgatctggcggcggccgccaatgcgaccggacgcatcggcgacggtgccccggcgctgtggttcgataatattcgcggctttaacgacgctcgcgtgacgatgaacaccatcggctcgtggcagaaccatgccatctcgctgggcctgccgcctaacacgccggtgaaaaagcagattgatgagttcattcgccgctgggataacttcccggtgacgccagagcgccgcgccaacccggcgtgggcagaaaatactgttgatggcgatgatatcaacctgttcgatattctgccgctgttccgcctcaacgatggtgacggcggtttctacctcgataaagcctgtgtcgtttcgcgcgatccgctggataaagataacttcggtaagcaaaacgtcggtatctaccgcatggaagtaaaaggcaagcgcaagctcggcctgcagccggtaccgatgcacgatatcgcgctgcatctgcacaaagcggaagagcgtggggaagatctgccgatcgccattaccctcggtaacgacccgattattaccctgatgggcgccacgccgctgaaatacgatcagtctgaatatgagatggctggcgcgctgcgcgagagcccgtatcccatcgctaccgcgccgctgaccggctttgacgtgccctggggttcggaagtgatcctcgaaggggtcattgaagggcgtaagcgtgagatcgaggggccgttcggtgaatttaccggtcactactccggcggtcgtaacatgacggtagtgcgtatcgacaaagtctcttatcgcagcaaaccgatttttgaatcgctctacctcggtatgccgtggaccgagattgactatctgatgggcccggcgacctgcgtaccgctgtatcagcagctgaaggccgaatttccggaggtgcaggcggtcaacgccatgtacacccatggtctgctggcgatcatctccaccaaaaaacgctacggcggttttgcccgcgcggtgggcctgcgggcgatgaccactccccacggcctcggctatgtgaagatggtgatcatggttgatgaagacgtcgacccgttcaacctgccgcaggtgatgtgggcgctctcctcgaaggttaacccggcgggagacctggtgcagttgccgaacatgtcggtccttgaacttgacccaggctccagcccggcaggcattaccgacaaactgattatcgacgccaccaccccggttgcgccggaccttcgcggccactacagccagccggtgcaggatctgccggaaaccaaagtctgggctgaaaaactgaccgctatgctggccaaccgtaaataa

SEQ ID NO: 2858 - DNA, 1233 bp, Klebsiella pneumoniae
aaaaaatgccagcccgaaggctggcatgattatttcacaaggacaggattaagcctgacctttgatctctttacgaccgttgaacggcgcttgctcacccagcgcttcttcgatacgaatcagctggttgtatttagcaacgcggtcagaacggctcatagaaccagttttgatctggcctgcagcggtaccaacagccaggtcggcaatggtagcgtcttcagtttcgccagaacggtgagagataacagcggtgtagccagcgtctttcgccatcttgatagcagccagagtttcggtcagagaaccgatctggttgaacttgatcaggatggagttagcgatgcctttttcgatgccttctttcaggatcttggtgttggttacgaacaggtcgtcaccaaccagctggattttgtcgcccagtactttagtctggtaagcgaaaccttcccagtcagattcgtccagaccatcttcgatggagacgatcgggtactgtttggtcagctcttccaggaagtgagtgaactcttcagaggtgaacgctttgttgccttcgccagccagaacgtatttaccgtctttgtagaattcagacgccgcgcagtccatcgccagggtgatgtctttgcccagctcgtagcctgcagctttaaccgcttcagcgataacagccagcgcttcggcgttggaacccaggttcggcgcgtagccgccttcgtcaccaacggcagtgttcatgcctttggacttcagcactttcgccaggtgatggaacacttcagaacccatgcgtactgcttctttcagggtcggcgcgccaaccggctgaatcatgaattcctggatgtcgacgttgttgtcagcgtgctcaccgccgttgatgatgttcatcatcggaaccggcatggagtatttgcccggagtgccgttcagttcagcgatgtgcgcgtacagcggcaggcctttggacgcagctgctgctttggcgttcgccagaaaaacggccaggatagcgttcgcaccgaagttagatttgttttcagtaccgtccaggtcgatcatgatcttgtcgatgccagcctgatctttagcatctttgcccaggattgcctgagcgatcgggccgtttaccgcagcaacagctttggttacgcctttacccaggaaacgggatttgtcgccatcgcgcagttccagcgcttcgcgggaaccagtagaagcacctga

SEQ ID NO: 2859 - DNA, 1392 bp, Klebsiella pneumoniae
tttttccgccagcccgggcgacggctgcagcattttccatcgcccggactcggcgtctcagggggtttcgcgcccggcgaaaatctccgccaggccgctgcgccgttcggtgcgcgtcacaatggcctgggagagcacctgctcgtcggcatagagcgacaaccgccgtttcgcgcgggtgatcgccgtgtagaccagttcgcgggtcaccagcgggacgctgcgcgccggcaggatcagcgccgcgtgttcgaactccgagccctgcgatttatgcacggtcatcgcccaggcggtatcatgctccggcagacggctcggctgcaccgacttgatggcgccgtcgggcatcaggaaccacacccgcagctcgccgttgcgctccagggcgatgccgatatcgccgttaaacagccccagcgcgctgtcgttgcgcgatatcatgatcggtcggccatcataccagcgagagtggcgcggcagggcgatcgcccgctggcggttgagccgctgctccagccgctcattgacgccgctcacgccgtacggcccctcgcgcagcgcgcacagcagctggaattcactgaaagcggccagcatggcctgcggttcggcccgctcgcggcgcagctgcaggtagcgctcatagccctgctgagccgcgccgagcatggcttcgtactcttcggttgtgctgaggggatgaagcgcgatatcgtcaaacggctggcgcagcgtggccttcacctccgcgcgcgcgccagcgttcaccgcccgcgccaggctcccgatgccggagtgactaccgaagcgatagctcttttgcagcaggcacaaactgtctctcagcgcgcccgcgatagccccctcgcccgccggcaccggcgaaccggtcagccgggtcagctcctgcgcccgcgcggcggtatagcccgaactcgcccaggcgcagatatcccccagcaccgcccccgcttctacggaggccagctggtcgcgatcgccgaggaaaatcacccgcccgtgggccggcagcgcgtcgataagccgcgacatcatcggcaggtcgatcatcgaggcttcatccaccaccagcacgtccagatgcagcgggttgccggcgtgatagcgcatccgctggctgccgggctgggcgcccagcagacgatgcagcgtgctggcctcggtgggaatcaacgctttctgcgcgtcggtcagcggcaattttctcagcgccgcgcccagcgattcggtcagacgcgccgccgctttcccggttggcgccgccaggcgaatacgacagcgcgggctgtcttcaatctggatcagcgccgccagaagcttcgccacggtggtggtcttcccggtcccgggaccgccggagatcactga

SEQ ID NO: 2860 - DNA, 582 bp, Klebsiella pneumoniae
aatttacgccatcatgcgccaacatcaggagcccctatgctgactctggttaccggcggcgcgcgcagcggcaaaagtcgccatgccgaggcgctgattgccgatgcgccgcaggtgttatatatcgccacctcgcaaatctttgacgacgagatggccgcaaggatccagcatcatcgcgacggcaggcccgcccactggcgcaccgccgagcgctggcagcagcttgatgaactgatcaccccggctatcgccccagcggaggcgattttgctggaatgcatcaccaccatggtcaccaacctgctgttcgcgctcggcggcgacagcgaccccgacggctgggattacgccgccatggaacgggctattgatgacgaaattggcgtgctgattgccgcctgtcagcgctgtccggcgcacgtcgtgctggtgaccaacgaggtggggatgggcattgtgccggagaaccgcctggcgcggcattttcgcgatattgccgggcgggtcaatcagcgcctggcggccacggcggatgcggtctggctggtggtttccggcatcggcgtcaaaatcaaataa

SEQ ID NO: 2861 - DNA, 297 bp, Klebsiella pneumoniae
gggcggagccatcgtcgacaaacgccagatgcgcgccggggtacggcgcatcggcatggtcttccagagcttcaacctgttcccccaccgcacggtgctcgacaacgtgatgctggccccgcgctatcaccagctgctggaccagccggtcgcccgcgagcaggccctggcgctgctcgaccgcgtcggcctgctggcccatgcccacaagtaccccggacagctctccggcggccagcagcagcgcgtggcgatcgcccgggcgctggcgctgaagccggacattatgctgtttga

SEQ ID NO: 2862 - DNA, 609 bp, Klebsiella pneumoniae
cggcctggtctccgccatcacggagcaggccattacgcttgtaagaggttaatcatgacccaggctatcggaattttagaactgaccagcatcgccagggggatggagctgggcgacgtcatgctgaaaagcgcgaacgtacagctcctgctctgcagaaccctttgccccgggaaattcctgctgatgctcggcggcgacgtcggcgccgtgcagcaggcaatcgccgccggcaccgcgcgcgccggggagatgctggtggacagcctggtgctggccaacattcaccccagcgtactaccggcgatcagcggtctcaacgtggtcgggcagcggcaggcggcggggatcgtcgaaacctggagcgtggcggcgtgcatcagcgccgccgaccgcgcggtgaaagcggccaacgtcaccctggtgcgggtccatatggcgtttggtatcggcggcaaatgctacatggtggtggcgggtgatatcgccgatgtcgacaacgccgtcacggtggccagcgacagcgcaggcgagaaaggattactggttcaccgggcagtgatcccgcgaccgcacgatgcgctgtggcaacagctgatggagggataa

SEQ ID NO: 2863 - DNA, 942 bp, Klebsiella pneumoniae
aagtcaaaacaaccagcaagcttacagcgagaaagaggattaattaacgttttgccccacgtcgggttgtatgtcccggtgtttaaaaataggatgaatgccctggctcgcgcggcggatactgtgactgatgcggccggtcactctggcatgaaaaacgataactttaaggatggcgaaatgagactgacggtggggctggcgctgacgctggcgataatgacctgcggcgcccaggcgcgcgatatgcaatccatcgagcacagcggtgaactgaaggtgggcgtgccgggcgattacgcgccgctggcgtttcgcaatgccgccggcgaactgcagggctatgacgtggacatggcccgcgatctcgggcgcacgctcggactcaaggtgagcttcgtctacaccagctggcccgcgctcgccgccgatctgcaggcggacaagtttgatattgcgatgggtggggttaccgagaccccggcgcgggcgcaagccttcgccctcagccatccggtggtggcgaacggaaaaatcgccttagccaactgccaggccgccccgcggctaggttcgctggaaaaaattgaccgcccggacgtgaaagtggtcgtcaaccctggcggcacaaaccagagctttgtcgatgagcacatcaagcaggcgcaaattatccgcgtgcagaacaatgtcgataacctgcaggcgctgcggcagaaaacggccgatatgatggtgaccgatctgattgaaggcgactattaccagagcaaagagcccggcgtgttctgcgttgccaacgaaacgccattcgccggcaccgccagcaacaaggtgtatatgatgagtaaagataacccggcgctgctgaagaaagtgaatcagtggctggatagccaggacaaagaggttctcaaacggaagtggaaaattcgcggttaa

SEQ ID NO: 2864 - DNA, 726 bp, Klebsiella pneumoniae
cgctcactttttaaccaaaggtattgccctatgcccgctatcgctccgctcgcctcaccgccgcaaagtcaggaacagctgttggcccaggcccgccagctggccggctattcgctgggcgagctggcggcgctggcggggatccccattccgcgcgatctgaagcgcgataaaggctggacgggcattctgctggagctgtggctgggcgccagcgcaggcagtaaacccgagcaggatttcgccgcgctgggggtcgagctcaaaacgatccccatcgacagccggggacgcccgctggagaccaccttcgtctgcgtcgccccgttaaccggcaatagcggcgtcacctgggagagcagccatgtacggcataagctgcagcgcgttctgtggatcccggtggagggtgaacgcaccatcccgctggcggcgcggcgcgtcggcgcaccgctgctgtggagcccggacgaagacgaggagcgccagctgcgcatggactgggaagagctgatggatctcattgttctcggtgaggtagagcgcattaccgcccgccacggcgaggtgctgcagttaagaccgaaagccgccaacagtaaggcgctgaccgaagccatcggcgcccgcggggagacaatcctcacgctgccgcgcggtttctatctgaaaaagaattttaccgccgctctgcttgcccgccatttcttgttacaacacgattaa

SEQ ID NO: 2865 - DNA, 564 bp, Klebsiella pneumoniae
ttgccacttttaatgcagagatatactctacgcacatcaaaacaggcagcccaaaaacgctataccaacgcgcatttttcggcgttaatgacttcattttcgaggagcactccgatgttctctgcgcactcccgcttgcggcatgcggttgcagacacctttgcgatggtggtttactgcaccgtcgtcaacatgatgatcgaaatttttctctctggtatgacgtttgagcagtcgttatcgtcgcgtctggtggcgatcccggtcaacattattattgccgtaccctatgggatttatcgcgatttcgccatgcgtcaggcccggcgcatcagcccggccaggtggatgaaaaatatggccgacgtgctggcctacgtcacctttcagtcgccggtgtatgtcgctattctgtggagcgtgggtgctgactggcaccagattgtcgccgcggtgagctcgaacctggcggtatcgatgatgatgggcgccgcctatggctacttcctcgactattgccgccgcctgttccgcgtggcgccctatcagcaggcgaaggcctga

SEQ ID NO: 2866 - DNA, 552 bp, Klebsiella pneumoniae
gtcatttcgcatcggggtggtgtgaaagcaggatgcacgtgtttatggatgaacatggtcaggagacctcaggaaaagttttcaaggacgagcagggagcaccaatgtagcgggactgctgcaaaacgaaccgggagcactgtttatacagtgctccctttttttatttctcctgcggatttgctatcctgcgcccggtttttaactcatcgaggtttccccatgactcttcacgatagcgtgcgcgatcgcctgcgcgccattgaagccctgctgcgcgaaacggagcactggcaggagacggcgccggacagcagcgccttcgccagcgataagccgttttgcctggataccctggagccgctggagtggctgcagtgggtcctgatcccgcgtatgcaccagctgctggagagcggccagccgctgccgcaaaattttgccgttgcgccttattacgaaatggctctggatcaggcccacccggtccgcgaatccatgctggcggaacttctgctgttagacgcgctgtttgccggtgagcaggcctga

SEQ ID NO: 2867 - DNA, 279 bp, Klebsiella pneumoniae
cagcgatcgcaccagcattcagcctgttgttcggcgatatgcagttcgcacccctccgccagcgtgccgcggcagaccagctcaaagcagaaggtcagggcgctggcttccacgcaggaaaatgcgccgaccttgagccacacgccggtaacccgccgcgcgccggcctgctgcgcctgttgttcaataatttccagcgcccgctggctgagggtgatttcgtgcatagtcgcctccgtatcgcgatgcgccttctatgcaataacgatgccagaatga

SEQ ID NO: 2868 - DNA, 1176 bp, Klebsiella pneumoniae
ataatgacgcagcaagctcccgacaagatcaatgtcttctggttcttacctacccacggcgatggccgttatctgggtaccaccgagggtggacgcccggtcgatttaccttatctgcagcaggtggcgctggcagccgacagcctgggctactacggcgtgctgatccccaccggtaaaagctgtgaagattcgtggctggtggcctcggcgctggcgccgttgacccgccgtctgcgctatctggtggcggtcaggccgggcctgcagccgccaaccctggcggcgcggatggcggccaccctcgaccgtttatcggaaggtcggctgctgatcaacgtcgttaccggcggcgacccggtggaaaacaaaggcgacggtatcttcctcagccacagcgagcgctatcaggtgacccgcgaatttcttgatatttacacccgcctgctgcgcggggaaaaagtggattatcacggcgagcatattcacgtggaaggcgctgaggtcttgttcccgccggtgcaggagaatggcccgccgctctatttcggcggctcttctgatgcggccattgatgtggcggccgagcagatcgacagctatctgacgtggggcgaacccccggaactggtggcggagaagctggcggtggtgcgcgagcgcgccgcggcccgcggacgcaccctgcagtacggcattcgtctgcacgtcattgtgcgcgaaacggaagaagaggcatgggccgccgccgaccggctgatcgcccatcttgacgacgataccattgcccaggcgcaaaagatcttcgcccgcatggactcggccggccaggcgcggatgagcgccctgcatcagggatcgcgcgataatctgcgcattgcgcccaatctgtgggccggcgtcggactggtgcgcggcggcgcgggtaccgcgctggtaggtaatccgcagcaggtagcggaacgcatccgcgaatatcaggcgctcggcatcagcaactttatcttctccggctacccacatctggaagaagcgcaccgctttgctgagctggtgatgcctctgttgccgctggaaaacggggcctcgtcgaaggcgcgtagcgtgaacaccggtccgtttggcgaaaccatcggcggcgataagcgcccggtgcgccaggtcagcgccagctga

SEQ ID NO: 2869 - DNA, 1551 bp, Klebsiella pneumoniae
gacaataagcactgcgcaacaggagtcagtatggcgttcgattggggatactttttttcattgtttagcattggggcattctggcaggcgtgcgtgaccgtcatcgtaatcagcaccttgtcctgggggatcggcctggtggtcggttttctgttagcctgcgcgaagctctcggcgccgcgctgggtcaagatccccgtcgaactctatatctggttttttcgcagcgtgccgctgatggtgctgctggtgtttgtctacaacctgccgcagctgtttccggtgacccagccgctgctcggggtgccgtttatcgccgggctggtgtcgatgaccgtcaccgaggcggcctatatggcggagatccaccgcggcgggctgctgtcggtggccaaggggcagagcgaggcaggccatgcgctgagcttcagctttatcggcatccagcggctgatcgtgatccctcaggcgtttcgcatctcgctaccgacgctgatcaatgaatacatcaccatcattaagctgagctcgattctgtcggtggtctccttacccgagctgctgctcaccggccagcgcttgtatgcgcagaatttccttgtgatggagaccctgctggcggtagcggtgtactacgtgatggtggttaccgtcttcacctggctgttccgggcgctggaaaatcgtctcgatattcagcgtaagcgtccgcaaaccctcagcgaggcggaatgccaggcgctgcgccagagcctgccggcgctgagcgaagagagcaacaccccggccgtcaacggcgcgccgccggcgctcgatctgcggggcattcacaaatcctggggtcagcatgaggtgctgaaaggcatcgatctgcaggtggagaacggggaggtgatcagcatcatcggcccgtccggctccggcaaaaccaccctgatccgcaccatcaacgccctcgaaagccttgatggcggggagatcattctctacggcgaggactatcttaagggcggagccatcgtcgacaaacgccagatgcgcgccggggtacggcgcatcggcatggtcttccagagcttcaacctgttcccccaccgcacggtgctcgacaacgtgatgctggccccgcgctatcaccagctgctggaccagccggtcgcccgcgagcaggccctggcgctgctcgaccgcgtcggcctgctggcccatgcccacaagtaccccggacagctctccggcggccagcagcagcgcgtggcgatcgcccgggcgctggcgctgaagccggacattatgctgtttgacgaaccgacctcggcgctggatccggagctggtaggcgaagtgctgaaggtcattcagtcgctggcccgcgaaggcatgaccatgctgattgtcactcacgagatggacttcgccctgtcgatttccgaccgcgtggtgctgatggagaacggcgtggtgcaggccgatatcgccccgcaggtgatccgcagcccgctggaggcgccttctctgcaacgaatccgtgaatttatgggagtacgctaa

SEQ ID NO: 2870 - DNA, 1569 bp, Klebsiella pneumoniae
ggccttgagcaggccctgcacgctgtataccgataccaccatggcgctgtccgggatcaacaaaaccctgctggcccgctttggcggcgaatgccgctgctatatcagcgacccgcgggtggtgcgcgaggcgcaaagccgggggatgacccgctcgatggcggcggtggatattgcggtgcaggagcccggggagaaagtgttcgtcttcggcaatgcgccaaccgcactgtttcgcctgctggaacatcgcgagaccgccatcggcggcgtggtgggggtgccggtcgggttcgtcggcgccgcggagtcgaaagcggcgctcagcgagagcggcctgccggccatcgccgcgctcggccgcaaagggggaagcaacgtggcggcagcgattgtgaacgctctgctttaccacctgcgggaggcgcaatgagcgatcagacctttgacgccccggtgtggcatcacggcaaagcgctgcgcaagggctacaccaccggctcctgcgccacagcggcggcaaaagtggctgcgctgatggtgatgcgccagcatctgattcatcaggtctcgatcgtcaccccctccggcgtcaccctgtgcctgaacgttgagtccccgcacgtcgaagggcagcaggctgtcgccgcgatccgtaaagacggcggcgatgatgtcgacgccacccacggcatgctgatttttgcccgggtcaccctcaatgacagcggagagattagcctgcagggcggggagggcatcggtacggtgacccgcaaagggatcggcctgccgacaggcagcccggcgataaaccgcactccgcggcacaccatcgagaccgccgtgcgcgaagcgataggtcctacccgcggcgcgcaggtggagatttttgccccggaaggcgcgcttcgcgcgcaaaaaacctataacgcccggctggggatcctcggcggcatctcgattatcggcaccacggggatcgttaccccgatgtcggaagagagctggaagcgctcgctctccctcgagctggagataaaacgcgccgccgggctggagcgcgtggtgctggtgccgggcaaccacggtgagcgctttgtccgcgagcagatgggcatcgacccgcagatggtggtcaccatgagcaacttcgtcggctacatgattgaagaggcggttcggctcggtttccaccagattgtgctcattggccatcccggcaaactgatcaaaatcgccgccgggatctttcatacccacagccatatcgccgatgcgcggatggaaactctcgtcgctcatctggcgctgcttggcgcgccgctgccgctgctgacgctggtcagcgagtgcgacactaccgaagcggcaatggagcatatcgacgcctggggattccagcgcctctataaccatctggctgagcgaatctgccagcgtgttcttgagatgctgcgcttcactcagcaaccgcccacctgcgacgcggttctgttttcttttgataaccaggtactgggcagcagccgtccgctggcggcaattgcccgggagctgacatgttga

SEQ ID NO: 2871 - DNA, 1212 bp, Klebsiella pneumoniae
actggtcttaataaagccctgaacgggccccttttttatttaattgtcgtttacttttgcccgcctagaatcccgcagaccaaccataatgagatagcgtttatgaccacattattaattaccggcgttacggggtttctgggcggtgccgcgttagagaaaatactccatcaggaaacccggttagatctgctgctgctggtacgtgctgatagccccgaggctggcctcgaacgggtcaaagagaacatgcgtaagttcaacatcgccgaggagaagctggcgatgttgcgccagcagcatatcctgctgggcgatctcgcctctccggagcattttcttaacgatccgcgcctcgatcaggtcacgcacatcctcaactgcgccgctgtcgcttcatttggcagcaacccgcttatctggaaggttaacgttgagggcacgctgcgcctggcgcaacgtatggcgcaggtgacgggtctgcagcgctttctgcacgtcggtacggcgatgtcatgttcgcctgaaccggattcactggtcgccgaaagcgcggagtttcgggaacgcgctgagcacctggtggaatatacccactcgaagtcgaccatcgagcagctgatgcagcagcagtgccctacgctaccgctggtaattgcccgcccctctatcgtggtgggtcatacccatcacggctgccggccttccagcagtattttctgggtgttcagcatggggctgatgctgcagaaattcatgtgctccatggaggaccgaattgacgttatcccggtggactactgcgccgacgccctgctaatgctgcttaaccagcctctggctcacggcgaggtggtgcatatctctgctggcgaagagaacagcgtgaagtttgccgaaatcgaccgggcgatggctcaggccctggagcaggcgccggtgggggataagtacgcccaggtgagctatgaaacgctggtcaaaatgagacgcgaactgaaagggatatttgggccatgcaatgagcggctgatgctgaaagccatgcgcttatacggcgcattcgccacactgaacgtgcgctttagtaacgacaagctgctgagcatggggatgccaaaaccgccgcgctttaccgattacatcgaccgctgcgtggaaaccacccgcgggttgtcgatccctcagcaaatggccgtcgactttaaataa

SEQ ID NO: 2872 - DNA, 1068 bp, Klebsiella pneumoniae
attatccttaatctgcacagtaaccccctcgaggtaattatgcgccgacttagcgatacgttatttctgacatggctttccgttctgttcatgctgagcgccttcccggcgcaggcgctgacctgcaagaccacctcgtccacgatcagcgaagtcgtgaatatcgagagcatcattaaagtctccagcagcgagcttattgccaataaaaagatatgggtctccagccctattaccgccaccttcagttgcgaagataccgataattttccgaacggtgaaagcgcctatttctggctggatccggaaaataaagccagcagcttgcccaactttatccaggtaggcattacttacaacggcatcgactatctgctacaaaataaaaaatcggtggagattggcccggcgacgctgtgtgataaaagcgggaatacctgtaagtccccggccatagggcagacattcagcctggtttaccaggtctatatcatctcgacgggccgcagcgtgaccggggatggtaaaatagacgataacctaaaattgtcgctttttcaggtagatggccaaggcggtctacgtaacggcaccgctggcgccaactataatcttttcattaccggcctgaaccgtatcagaacaatggcctgcgtccccacggtatctatttcgccaagcgaaattaactttggcgatattcctgccggtaacgcccgaccgggctactatgaaaaaacacgcccctttaccgtcacctatggtctggtcaagcagggtaacggcagtgattgcgggaccgaagctatgcttgctacgtttagcaccactaatacgatacaggagagcgccattattttgccgcagccggacagcggcttcggcattgtcatctcgccaaacgccagtatgcttccacgtattgagatgaatgctccgattcactttacgctggcaacgggaacgaccctcgcgagcacctatacggcggggctgctctggttgtcgagaacgccgaagctggggcctttttccgcgaccgccaaaatcaccgtgacctttgaataa

SEQ ID NO: 2873 - DNA, 3180 bp, Klebsiella pneumoniae
ctgatccctaatcagagaatccaagacatggacttttcccgcttttttatcgacaggccgattttcgccgcggtgctgtcgattttaatttttatcaccgggttaatcgctatcccactgctgccggtgagcgaatatccggatgtcgtcccgccgagcgtccaggtgcgcgcggagtatcccggcgccaacccgaaagtgattgccgagaccgtggcgacgccgctggaggaagcgatcaacggcgttgaaaacatgatgtacatgaaatcggtcgccggctccgacggcgtgctggtcaccaccgtcaccttccgcccgggtaccgacccggatcaggcgcaggttcaggtgcagaaccgcgtcgcgcaggccgaagcgcgtctgccggaggatgtacgccgtctggggatcaccacccagaagcagtctccgacgctgaccctggtggtgcatctgttttcgccaaacggtaagtacgactcgctgtatatgcgcaactacgccacgctgaaagtgaaggatgagctggcgcgcctgcccggcgtcggccagatccagatttttggctccggtgaatatgcgatgcgcgtctggctggatcccaataaggtcgcggcccgcggtctgacggcctcggatgtggtgacggcgatgcaggagcaaaacgtccaggtgtctgccggacagcttggcgccgagccgctgccgcaggagagcgatttcctgatctccattaacgcccagggccgtctgcataccgaagaagagtttggcaatatcattctgaaaacggcgcaggatggctcgctggtccgcctgcgcgacgtggcgcgcatcgagatgggttccggtagctatgcgctgcgctcccagctcaacaataaggatgcggtcgggatcggtatcttccagtcccccggcgctaacgccatcgatctgtcgaacgcggtacgcgccaaaatggccgagctggccacccgcttcccggaagatatgcaatgggcggcgccgtacgacccgacggttttcgtccgcgactccatccgcgcggtggtgcagacgctgctggaggcggtagtgctggtggtgctggtagtgatcctgttcctgcagacctggcgcgcgtcgattatcccgctgatcgcggtgccggtatcggtggtgggtaccttcagcattctctatctgctgggcttctcgctgaataccctgagcctgttcgggctggtactggctatcggtatcgtggtggacgacgccatcgtggtggtggagaacgtcgagcgtaatatcgaagaagggcttgcgccgcttgccgcggcgcatcaggcgatgcgtgaggtctccgggccgattatcgccattgcgctggtgctgtgtgcggtgttcgtgccgatggcgtttctctccggggtcaccggacagttctacaaacagttcgcggtgaccatcgccatctcgacggtgatctcggccatcaactcgctgacgctctccccggcgctggcggccctgctgttaaagcctcacggcgcgaagaaagacctccctacccggctgatcgatcgtctgtttggctggattttccgtccgtttaaccgctttttcctgcgcagctcgaacggctatcagggactggtaggcaaaaccctcggacgccgtggcgcggtgtttgcggtgtatctgctgctgctctgcgccgctggggtgatgtttaaagtcgtccccggcgggtttattcccacccaggataagctgtatctcattggcggcgtgaagatgccggaagggtcgtcgctggcgcgcaccgacgcggtgatccgcaaaatgagcgagatcgggatgaataccgaaggggtcgactatgcggtcgctttcccggggcttaacgcgctgcagttcaccaacacgccgaataccgggacggtcttttttggcctgaaaccgttcgaccagcgcaaacacacggcggcggaaattaacgcggagatcaacgccaaaatcgcgcaaatccagcagggctttggcttctccatcctgccgccgccgattttaggactgggtcagggttccggctactccctgtacatccaggatcgcggagggctgggctatggcgcgctgcaaagcgcggtgaatgcgatgtccggggcgattatgcagacgccggggatgcacttcccgatctcgacttaccaggctaacgtgccgcagctggacgtgcaggtcgatcgcgataaggcgaaagcgcagggggtatcgctaaccgagctattcggtacgctgcagacctatctcggctcgtcttatgtcaatgactttaaccagttcgggcgtacctggcgcgtgatggcccaggctgacggaccataccgcgaaagcgtggaagatatcgccaatctgcgcacccgcaataatcagggcgaaatggtaccgatcggcagtatggtgaatatcagtaccacctacgggccggatccggtgatccgctacaacggttatccggcggcggacctgattggcgatgccgatccgcgggtcctctcttcttcacaggcgatgacgcatctggaggagctgtcgaagcagatcctgccgaatgggatgaatattgagtggacggatctcagcttccagcaggccacccagggcaacacggcgctgatcgtcttcccggtggcggtgctgctggcgttcctcgtgctggccgcgctgtatgaaagctggacattgccgctggcggtgatccttatcgtaccgatgacgatgctctccgcgctgtttggcgtctggctgaccgggggcgataacaacgtcttcgtgcaggtgggtctggtggtcctgatgggcctggcctgtaaaaacgccattctgatcgtcgagtttgcccgcgagctggagatccaggggaaaggcatcatggaagccgcgctggaggcgtgccgcctgcgtctgcgcccgatcgtgatgacctccatcgcctttatcgccgggaccattccgctgatcctcggccacggcgcgggggcggaagtccgcggcgtcaccgggatcacggtgttctccgggatgctgggcgtgacgctcttcggtctgttcctgacgccggtgttttacgtgacgctgcggaaactggtgacccgcaggaagccggtccaggaggatctgcccgcctag

SEQ ID NO: 2874 - DNA, 2397 bp, Klebsiella pneumoniae
gccgatactaataacgatcaaggcgtggcgactatgtacaaatcgactccgtcagcagcatggtgtaaaaaacgcctgctggtgacctctttgtttgcagcaatttatcagacttctgccatcgcagcagatacttccgccgttagcggcgaggcggtggatgacacctcggaacaaatgaccgtcaccgcccccgcgccggtgcagaaagccggtagcgaacacagcatcagcgcccgggagctggagaataaaggcgctaacgatttcggctcaatcatgcgctatgagccgctcatcagcgccaccggggccagcggcggctccggcaacggcaaaagcggcttcgaccgcggaggttacaccggctacaacattcgcggtatggagagcaaccgcgtcggcatcgacgtggacggtatcgcgcaacccaacgccaccggccgcggctacgtcggccgcgccgggctcaacaccttcggcatcggccgcgattatatcgacccgtatatgtacggcagcgtggatatccagtccggcgccacctcgacggaaacggccaacagcgctatcggggggaatgtctccttccgcccgaaatcagcggatgattacctgcgcccgggcaagaccagcgccttcggctaccgcagcggttacgactctgcggatcgcagctggcacaacggggtgaccgtcgccggcggcgatgagttcctgcgcgggattttggtctatagccgccgtgacggccaggaaaccgaaaacaacagcggcaccgtcgacgcctacccggcgaactggcactccgatgcttttctggcctccgggatctggcagcctaacgatgagcacaagctgaccagcaccttcgactattaccataaaaccaaccacacccactacgatacctgggactccagcggcaacagcaccatcggcaccgccaaccagaccagccagacccggcgctggggcctgagcctgaaggatgactggacgccgatgaacgactacctcgacagcgtctccacaaaaatctactaccagcataccgaagcccatgactggacttatatgccggacagcgtcacccgcaaaatgcagacggtgaactctaactacgataccgacacctggggcctgcagaccgcgctggcgaaaaccctgggccgccacgatctgagcgccggtttcaacgccagcaccagcaaaacccagcggccgttcagccagtcgccgatccccagcgtttacagcgagatcatgcagccggaggcagacagccgcagctacaccctcggcggctttgtccaggataagatcaacttcgatctcgacagccacaacttcgccgttattcccggcgtgcgcgtggtgcatcaatcgactaagccggaaaatctgtccgatctcgccgccaacagcagcgtgctgagcgaatcgtcggtggcgaatctgtacggcaaaaacagcgatacccaggttctgccgtcgttgaccttccagtacgacctcaccccgcgcctgatgacctacctgcagtaccagcgcggggcgcagttccccaacgccagccagctgtatggctcctggaacctcggctccagctacgccggcagccagcagtatgccctgatcggcaataccgatctgaagacggaaaccagcgataatctcgagtgggggctgaaaggggaagttaccgaaggcatcaccctgcgcacggcgctgttctacaacagctataagaactttatcgcctatacccgctatacccgcgccaacaatccgggccagttcacgaatgtgccgtcgaacatctacaccatttatcaggcggaaaaccgcgataaagcctatatctacggcggtgagattagcaccaaatttaactttggcacctggtttgagcaggtggacggcctgagcgccaccctcgccctcggctatagcgaagggaaatcgaaatccagctacagcggcgataaatacgtcgacctcgacagcgtggcgccaatgaaagccatcgtcggcgtggcgtgggacgatccggcgaaacgctacggcaccgccctgacggcgacctttgtcaaagggaaacaggcgaccgccaccaaccgcgaaagctacagcaacagcggatccgccatcaccgatgccagcagcgactatatgcgcgtgccgggctacggcatgctggactggaccgcgtactggcaggtggcgaaaaacgtgcgcctcaatggcggggtctacaacctcaccgatcgtaaatactgggattacctgagcagccgcaatatcgagaccggcaccaaccaggacgccaacgataaagcgctggcggtgatgccgggccgcacctggcagctgggcgtcaacgtcgacttctga

SEQ ID NO: 2875 - DNA, 639 bp, Klebsiella pneumoniae
tttaaatataaagttcgtacacgaacaaaagtaatgaggtctggaatgaaactgattattgggatgacgggggccaccggggcaccgcttggggtggcattgctgcaggcgctgcgcgatatgccggaggtggaaacccatctggtgatgtcgaaatgggccaaaaccaccatcgagctggaaacgccctggacggcgcgcgaagtggccgcgctggcggacttttcccacagcccggcagaccaggccgccaccatctcatccggttcatttcgtaccgacggcatgatcgttattccctgcagtatgaaaacgcttgcaggcattcgcgcgggttatgccgaagggctggtgggccgcgcggcggacgtggtgctcaaagaggggcgcaagctggtgttggtcccgcgggaaatgccgctcagcacgatccatctggagaacatgctggcgctgtcccgcatgggtgtggcgatggtcccgccgatgccagcttactacaaccacccggagacggttgacgatatcaccaatcatatcgtcacccgggtgctggatcagtttggcctcgactatcacaaagcgcgccgctggaacggcttgcgcacggcagaacaatttgcacaggagatcgaataa

SEQ ID NO: 2876 - DNA, 186 bp, Klebsiella pneumoniae
gaaatagataatgacgcagcaagctcccgacaagatcaatgtcttctggttcttacctacccacggcgatggccgttatctgggtaccaccgagggtggacgcccggtcgatttaccttatctgcagcaggtggcgctggcagccgacagcctgggctactacggcgtgctgatccccaccggtaa

SEQ ID NO: 2877 - DNA, 447 bp, Klebsiella pneumoniae
acaattggtaacaaatttggtgcaccaactattagacctgctgcaacagagcgatattatcagatcctgaaacggcagcggcatcgaggggtgccggttgcccggtctacaggattcgatatgcgcaatacccagaacctcagtattattcgttcagaaccgcctccggcgatcggcgacgagaccacctggtctttgtcgggcgctgccgtgggctttatttcgtggctgctggcgctgggtattcccttccttctctatggcagtaatacactcttctttctcctctacacctggccattcttccttgcgttgatgccggtggcggtggtggtcggtattgcgctgcactctctgctcaatggcaaactgctctatagcgtcagcgcgaccatcctgaccgttgggctgatgtttgcgctactcttcctctggctgttgggataa

SEQ ID NO: 2878 - DNA, 303 bp, Klebsiella pneumoniae
gcgatgacaaataccttagggtataagcagtcatggcatcacattctgttaaacctaagtttagccgatatacacaatttcaacccgactttatcgttatcagtgtttctgacgcaaggtgccgtaaccctctggttatggcacctatacccctcatacttcaagttgcatgtgtgttggctttcctcgctcaccccagtcacttacttgagtaagctcctggggattcgctgcgtcgccgccttcctgcaactcgaattatttagggtaaatgcgtttatagttattacagttttgcgctga

SEQ ID NO: 2879 - DNA, 312 bp, Klebsiella pneumoniae
ccctcaaaaaaggagcaccgcgtgaagcaatcactgggattacttgaggtcagcggtctggccctggccatcacctgcgccgacgctatggcgaaagcggccgccatcacgctgctcgccctggaaaagaccaacggttccggctggatggtggtgaagatcgccggtgatgtggcctctgtccaggcggcggtgatgaccggggccgaactcgccgaacggcagcaggggctggtagcgcagaaggttatcgccaggcccgggggaaggcctgctgccggcccgcgtccaggcgccttcaccagcgcctga

SEQ ID NO: 2880 - DNA, 585 bp, Klebsiella pneumoniae
ataatgaaaaaacaacctcgctttataaccatcctcataggagcgctgctttctggcgtagccttgcaggctaccgcggccaacactatcaatcctgactcgggcaccagttcggaaggcgccggcgggcaggtcatcttcaatgggtcaataaccgacagctcttgcaacgtcgatagtagttctaatggccagaaggttgatctgggcaaatgggccagcaactattttaccggcactggttttgaaaccaccaaaacccccttccatatcaaagtgaaagattgcccggccagcgtgactacggtcgccgtgctgtttgacggcgcgcgcgatcagtctgataactccctgctggccatcaacggcggcgccagcggcgtagcgattaagctgtatgagcacgatcggtcgacggctgtcagcctcggtaaaacgtcagccaaacagacggtcacaccgggtaccagcggcggcaccggctctgccgacctcgagttttacgccgactatatctccaccgcggcgaccgtgacggcaggtaaagccgacggtacagctaatttcaatatgatttataactga

SEQ ID NO: 2881 - DNA, 1353 bp, Klebsiella pneumoniae
cgtgggaaaaaaataatgataaagctgaaacactcaatacctctggctctcctctcgctggcaggggccagcagcccggcctgcgccgatccgaagtatgattttgcgctgcatggctatatccgctccgggatcctggcgaactccgatggcaaccgcgcggactccgtcggcctgatgccggacggtaagtggcgactgggcaacgaagaagacaccaagatcgaactgatccccaccgtgacgctgacggcggacagcggcgtggtggcgaaagtgcaggccaacctcactcaccagtcgaaatgcacctccgactggaactgtcaggatgacgatggccatgacgtacagtttcgtgaagggttcgccgagctgagcaatctggattttgcaccggagatgaccttctgggccggtaagcgctatagcagctccaacacctccagccatcagttcgactgggagtacattcagtacaacggcaccggcggcggcttcgacaacatggatctcggcttcgcccgcttcgacgccggggtgtacgccttttcacccaccgatgaaaccaaagcctacccggtggataagggagatcagggctacccggatgactattccctcaacctgtggctgaaaaagatcgcggggacaggcttcgatctggagctgatcggccaccacatgaaccgtaacgaaaaccatccaacttccgccgagaagggctatggcgtgaccggtatttataactttgacggcttctatggtctgaccggaggatactcccgcctcgcattgcagtacgggaaagggctggcggcgggtgactcgctgggtaaaaacggctggggctgggccaacctggaaaacacccagtcctggcgagtggtgctggatagcgtggcctcgatgggcgacctggagatctcgaccttcgctttctggcagaaagataaaaactaccgctggtggacagaagatgaaaatggctggggacgctcgatgtgggtcgctggtatccgcccttatcatcagatcacccgcaactttgccatgcagtacgagctgggctacgaatacctggatgacaaaaactacaaaggagtaaacggcaaaggcaaaggcggcctgaccaaagtcaccgttgcgccaaccctgacctttgactccggtttctgggcgcgtccgcagctgcgcttcttcgtcacctacgcgaagtgggataaaggtgtctccgatgcattagacggtaactacaactgggataccaataccatcaccgccggcgggtattcccgcagtggctctaccgacaccgttaacttcggcgtacaggccgaggtctggttctaa

SEQ ID NO: 2882 - DNA, 780 bp, Klebsiella pneumoniae
acgcctatgaaaccacgtcagcgccaggcagccattctcgagttcctgcagtcgcagggaaaatgctcggtcgaagagctggcgcaacacttcgataccactggcaccaccatccgcaaggatctggtcacgctggaaaacgccggcaccgtcattcgcacctacggtggcgtggtactcaacaaggatgaagccgatccgccgattgaccataaaacgctgatcaacacccataaaaaagcgcagattgccgaggccgccgtgcgatacatccacgatggcgattcaattatcctcgacgccggcagcaccgtgctgcagatggtgccattgctgagtcacttcaataacatcacggtgatgaccaacagcctgcatatcgtcaacgcgctatcagagttcgataacgagcagaccatcctgatgccgggcggcaccttccgtaaaaaatcggcctcttttcacggccagctggcggaaaacgccttcgaacagttcagcttcgacaagctgtttatgggcaccgacggtatcgatctgaacgccggagtcactacctttaatgaggtctataccgtcagtaaggcgatgtgcaacgccgcccgcgaagtgatcctgatggccgactcatccaagtttggtcgtaaaagccccaatattgtctgcggccttgaacgcgtggataaattgattaccgatgccgatattgacccgggattccagcgggcgctggaagccaaaggtattgaagtcattattactggagaacatcatgagtaa

SEQ ID NO: 2883 - DNA, 1104 bp, Klebsiella pneumoniae
gacaccatgaaaggacgttgggcaaaatatgtagcgacgggtgcaatgctggccatgctcgccgcctgttcctcaaaaccgaccgaccgcggtcagcaatatagcgatggcaagttcacccagccgttttcactggtaaaccagccggatgccgtcggggcgccgatcaacgccggcgacttctccgagcaggttaatcaaattcgtaacgcctcgccacgcctctataatagccagagcaacgtctataacgcgctgcaggagtggctgcgcgccggcggcgacacccgtacgctgcgccagtttggcatcgacgcctggcagatgcagggcgtcgacaactatggcaacgtccagtttaccggctactacacgccggtggtgcaggcgcgccacacccgtcagggcgaattccagtaccccatttaccgtatgccgccaaagcgcggtaagctgccttcccgcgccagcatctatgccggcgcgctgagcgataactatgtgctggcgtacagcaactcgttgatggataacttcatcatggacgtgcagggcagcggctatatcgactttggcgatggttcgccgctcaacttctttagctatgccgggaaaaacggctggccctatcgcagcatcggcaaagtgctgatcgaccgcggggaagtgaagaaagaagatatgtcgatgcaggcgatccgcgagtggggtgaaaagcacagcgaagcggaagtgcgcgagctgctggagcagaacccgtcgttcgtgttctttaaaccgcagtctttcgcgccggtgaaaggggccagcgctgtgccgctgatcggccgcgcctcggtggcctccgaccggtcgattattccgccaggaaccaccttgctggccgaggtgcctctgctggataataacggcaagtttaacggccagtacgaactgcgcctgatggtcgccctcgacgtcggcggggccatcaaaggccagcatttcgacatctatcagggcattgggcctgacgcaggccaccgtgccggctggtataaccactacggccgcgtatgggtgctgaaaaacgccccgggcgcggggaatgtttttagcggctaa

SEQ ID NO: 2884 - DNA, 801 bp, Klebsiella pneumoniae
ggaaccatgaaacagtatcttgatttgatgcagaaagtgctcaccgagggcacgccaaaaaatgaccgcaccggcactggcacgatctctattttcggccatcagatgcgttttaacctgcaggaaggcttcccgctggtgaccaccaagcgctgtcatttacgctccatcatccatgaactgctgtggttcctgcagggcgacaccaacatcgcctatctgcacgagaacaacgtcaccatctgggacgagtgggcggatgagaatggcgacctggggccggtctacggcaaacagtggcgttcctggcctgcgccggacggccgccatatcgaccagatcagcacggtgatgaaccagctgaaaaacgacccggactcccgccggatcatcgtctcggcatggaacgtcggcgagctggataaaatggcgctggcgccgtgccacgccttcttccagttctacgtcgccgacggcaagctctcctgccagctgtatcagcgttcctgcgatgtgttcctcggcctgccgttcaatatcgccagctatgcgctgctggtgcatatggtggcgcagcagtgcgatctgcaggtcggtgatttcgtctggaccggcggagacacccatctgtacagcaaccatcttgagcagaccaacctgcagctaagccgcgaaccgcgtccgctgccgaagctggtcatcaaacgcaagccggcgtcgatcttcgactaccgctttgaagacttcgagattgaaggttacgatccgcacccgggcattaaagcgccggtggcgatttaa

SEQ ID NO: 2885 - DNA, 666 bp, Klebsiella pneumoniae
gtcatgatgaagaaaataattgccgttgcggcttttctgctgtgcaccacggcagcgcaggccggtattgtcatgggtggaacccgtgtgatttatcaggaagggaagcgtgaagccgctatttcagtcaccaatgccgatacccatacgccctatctggtgcagtcgtgggtggaaaattacgcggaaaacgataaggccagggtgcccttcattgtaacgccgcccttgttccgtctcgatccggagcaaaataacgttctgcggattaactttattggcgcctcgctgccccgcgaccgtgaatcggtcttctggctgaacgtcaaaagtatcgccccgacgcctcagggcgaggtgaataagctgcaggtgaatattaaatcgaaattcaaaatcttctatcgccccaacgacctggcgggcgacccggcaaaggcctggcagcagctgaagtttagccagtccggcggtcggctgacggtgataaatcccactccctacttcgtctctttttacgccgtcgaagtgggcgggcaaagcatcgacgatcccggcatggtggctcccttcggcgagaaaacgtggccggtgagcgggcacggcaccgtcaaatggcgggcgattaacgactacggcggcgtcagcgatttcgcccagcagtaa

SEQ ID NO: 2886 - DNA, 576 bp, Klebsiella pneumoniae
tcctcgatgaaagatgagctgtttttgcgcggcgcccaggtgccgatgaccaaagaggccgtgcgcgcgctggcgctggcgaagctggagctgcaccgggcgcgccatctgattgatatcggcgcgggcaccggcagcgtcagcattgaggctgctctacagaacccggcgctgcgggtgacggcgattgagcgtcaggccgacgcgctgcgcctgctggcggagaaccggcagcgctttggctgcgacaacatcgctatcgtggcgggcgttgcgccgctggcggtcgccgacaaagccgacgcgatctttatggggggcagcggcggccacctgacggcgctgatcgactggtcgctggcgcagctgcatcccggcggccggctggtgatgacttttattttgcaggaaaaccttcatagcgccctggcgcacctgcggcagagcggcatccacgaggtggactgccagcagctggcggtctccaccctggctaccctgggcagcggccactacttcaaaccccataatcccgtttttgtcatcgcctgtcagaaggaagaaaaccatggctga

SEQ ID NO: 2887 - DNA, 270 bp, Klebsiella pneumoniae
cgagttacgaatagtataaatagccgtaaggagagaagaatgaaaatgactaaggccgctgcgattatctctgcctgtatgctgactttaggcctgagcgcctgttcctctaactatgtgatgcataccaacgatgggcggaccatcgttaccgacgggaaaccgcaaaccgataatgacactggcatgatctcgtataaagacgcgtggggcaacaaacagcagatcaatcgctctgacgtgaaacaactgggtgaactggacgagtaa

SEQ ID NO: 2888 - DNA, 1842 bp, Klebsiella pneumoniae
cagggtgcgaataacagctttgcttactggaacaaacgacgcatgacgacacaggccccaccttccaacttgctaccgctcaacccggagcaactggcgcgccttcaggcggccaccactgacttcacgcccactcagctcgcctgggtatctggctatttctggggcgtgctgaatcagcagtccggcgcggcggtagccgcccccgccccggccgccgaggtaccgacgatcacgctgatttccgcctcgcaaaccggcaacgcccgccgcgtcgccgaagcgctgcgtgacgatctgctggcggcgaagctgaacgtgaagctggtgaatgcaggcgattataaattcaaacaaattgctgcggaaaaactgctggtggtagtgacgtccacccagggggaaggagagccgccggaagaagcggtcgcattgcataagttcctgttctctaagaaagcgccgaagctggacgggactgcgttcgccgtctttggtctcggcgatacctcttatgaatttttctgtcagtccggcaaagatttcgacaacaagctggccgagctcggcgcggaacgtctgctcgatcgcgttgatgccgacgttgaatatcaggccgcggccgctgaatggcgcgcgcgcgtggttgaggcgctgaaggcccgtgcgccggtcgctgcgcccgctcagctggccaccagcggcgcggtgaacgatattcacaccagcccatataccaaagaagcgcccctgacggcgaccctgtcggtcaatcagaaaatcaccggccgcaattcagaaaaagatgtgcgccatatcgaaatagacctcggtgattccggtctgcgctatcagccgggcgacgccttgggcgtctggtaccagaacgatcctcagctggtgaaagagctggtggagctgctgtggctgaaaggcgacgagccggtgaccgttgagggtaaaactctgccgctgtcggaagccctgcagtggcattttgagctgacggttaacaccgcgactatcgttgaaaactacgccaccctgacgcgcagcgaatcgctgctgccgctggtgggcgataaagctcagttgcagcagtatgccgccgcgacgccgatcgtcgatatggtccgtttctctccggcgcagctggacgccgaggcgttaatcggtctgctgcgtccgctgacgccgcgcctgtattctattgcttcctcacaggcggaagtggagagcgaggtgcatgtcaccgtgggcgtggtgcgctatgaaattgaaggccgcgcccgggctggcggcgcctccagcttcctcgccgaccgcgtggaagaggatggcgaagtccgtgtctttatcgaacacaacgacaacttccgtctgccagccaacccggagaccccggtgatcatgattggcccaggcaccggtattgcgccgttccgcgcctttatgcagcagcgcgctgcggacggagcgcaaggcaagaactggttgttcttcggcaacccgcacttcaccgaagatttcctctatcaggtggagtggcagagctatgtgaaggaaggtctgctgacccgtatcgatctggcctggtcccgcgatcaacaacaaaaaatctatgtgcaggacaaactgcgcgagcagggggccgagctgtggcgctggatcaatgacggcgcccacatttatgtctgcggcgacgccaatcgcatggcgaaggacgtggaaaacaccttactggaagtgattgccgaatacggcgcgatggacgccgaagcggcggacgaatttttaagtgagctgcgcgttgagcgccgttatcagcgagatgtctactaa

SEQ ID NO: 2889 - DNA, 1485 bp, Klebsiella pneumoniae
cgagtcgagaatttccgactcggtaatattctcccggtacatccgcgggatgcgggtgccgttgcggttaccgccgatgtgcaggttatagcggcccggcgctttgcccaccagtcccacttccgccagcatcgcgcggccgcagccgttcgggcagccggtgacgcgggtgacgatatgctcatcgctcacgccgtgcttgctcatcagcccttccaccttgtcgataaacgacggcaggaaacgctcggcttccgccatcgccagcgggcaggtcgggaaggagacgcaggccatcgagttttcgcgctgcggggtgacggcattcatcaggccatgatcccgcgcgagcttctcgatccgcgccttctgatcttccggtacgctggcgacaatcaggttctggttagcggtgatgcggaattcgccttgatggaccttagcaatctccagcaggccagtcttcagcggacgacccggataatcgagaatgcggccgttttcaataaacagcgtcaggtgccacttatcatcaatccccttcacccagccgatgcgatcgccgcggccggtaaattcgtacgggcggatcggctcaaacttaatgcctgcccggcgctccacttccgctttgaaggtttcgacaccgacgcgctcaagggtgtacttggttttcgcattcttacggtcggtacggttgccccagtcgcgctgggtggtcacaaccgcttccgccaccgccagcgtatgctccagcggcagataaccgaattcgctcgccgtgcgggcgtaggtttttttgttaccatgttcgatagagagaccgccgcccaccagcaggttaaagcctaccagcttgccattttcggcaatcgccacgaagttcatgtcgttagcgtgcagatcgatatcgttctgcggcgggatcaccaccgtggttttaaacttacgcggcagataggtctggccgaggatcggctcttcgtcggtagtggcgacctttttctgatccagccagatctcggcataagcgcgggtacgcggcagcagatgctcagagatctttttcgcccactcgtaggcctcagcgtgcagctgcgactcgtacgggttggaggtgcacagcacgttacggttcatatcgttggcggtggccagcgcgtccagccccaccgagtgcagcatctgatgcaccggcttgacgttctttttcagaatgccgtggaactgaaaggtctgccggttggtcaggcgaatactgccgtaaatggtgttttcagcggcaaacttatcgatcgccttccactgggtggtggtgatcaccccgcccggcaaacggcagcggagcagcatcgcatgacgcggctccagcttctgggcggcgcgctccgcgcggatatcgcgatcgtcctgctggtacatgccgtggaaacggatcagcaggaagttatcgcctttaaaaccgccggtcagaccgtcgtttaa

SEQ ID NO: 2890 - DNA, 1380 bp, Klebsiella pneumoniae
aaagagtttgaacggcaatgcacccatccgggtgcattgtttgtctggagttttagtttaacttgtactgaggaaaacctaatgtccaaaatcgttaaagtcatcggtcgtgaaatcatcgactcccgtggtaacccgactgttgaagccgaagtacacctggaaggtggtttcgtcggtatggcagctgctccgtcaggtgcttctactggttcccgcgaagcgctggaactgcgcgatggcgacaaatcccgtttcctgggtaaaggcgtaaccaaagctgttgctgcggtaaacggcccgatcgctcaggcaatcctgggcaaagatgctaaagatcaggctggcatcgacaagatcatgatcgacctggacggtactgaaaacaaatctaacttcggtgcgaacgctatcctggccgtttttctggcgaacgccaaagcagcagctgcgtccaaaggcctgccgctgtacgcgcacatcgctgaactgaacggcactccgggcaaatactccatgccggttccgatgatgaacatcatcaacggcggtgagcacgctgacaacaacgtcgacatccaggaattcatgattcagccggttggcgcgccgaccctgaaagaagcagtacgcatgggttctgaagtgttccatcacctggcgaaagtgctgaagtccaaaggcatgaacactgccgttggtgacgaaggcggctacgcgccgaacctgggttccaacgccgaagcgctggctgttatcgctgaagcggttaaagctgcaggctacgagctgggcaaagacatcaccctggcgatggactgcgcggcgtctgaattctacaaagacggtaaatacgttctggctggcgaaggcaacaaagcgttcacctctgaagagttcactcacttcctggaagagctgaccaaacagtacccgatcgtctccatcgaagatggtctggacgaatctgactgggaaggtttcgcttaccagactaaagtactgggcgacaaaatccagctggttggtgacgacctgttcgtaaccaacaccaagatcctgaaagaaggcatcgaaaaaggcatcgctaactccatcctgatcaagttcaaccagatcggttctctgaccgaaactctggctgctatcaagatggcgaaagacgctggctacaccgctgttatctctcaccgttctggcgaaactgaagacgctaccattgccgacctggctgttggtaccgctgcaggccagatcaaaactggttctatgagccgttctgaccgcgttgctaaatacaaccagctgattcgtatcgaagaagcgctgggtgagcaagcgccgttcaacggtcgtaaagagatcaaaggtcaggcttaa

SEQ ID NO: 2891 - DNA, 1644 bp, Klebsiella pneumoniae
ttatcctctgaatcgttagcgttaagcggtttgcgccgcgttgtcagcctggccgacggcgttttcacgttcctgggcccccagctgtttttcgtaagctttgagaaatggcaggtacatcaccatggcggtggccatacaaatgaggcacaggatcaccgggctaaagccccagttcgccgcccacgaggcgccgataggcgccggcgttgtccacggcgtcatcgacactacgcgactgaccaggtccagcttcagcgcgaagtacgccagggtcgcgttgaccatcggcaccagcacgaacggcaggaaaaacagcgggttcatgatgatcggcgcgccgaacagaatcggttcgttgatgttaaatacgcccggcacgacccccatccggccgatcgtccgcagatgcacggccttgctgcgcagcagcatcagcgccagcggcagggtggagccgacgccgccgatcagcagatagtgatcccagaagccctggacatagatgtgcgggatagcggtgccagcggccatggccgcctgattgaccgacaggttggccatccagaacgggttcatgatcccggtgacgatcagcgcgccgtggatcccggcgaaccacagcacctgacagaccagcaccgacagcaggatcgccggcagcgtatcggaagccgcgaccagcggcttcaccagcgacatgatcgcttccggaatgatcatccccagctgggcttcgataaacaggttcagcggatgcagcgtcagaatgatcgccagcaccgggatcaggatttcaaacgagcgcgccaccccggcaggcacttccggcggcaggcgaatggtgatgttatgccgtttgaggaaggcgtacagctcggtggaatagatggccaccagaatggcggtaaagatcccctgaccggagaagtaggcagtagagatctggccatctttcagcggcgcggctaccagcagaaacgacatcagcgacaacatcccggcggtcagcgagtccagatgatggtgtttggcgaggctggcggcgatcccgacggcgataaacagggtcatcacccccatgctgaagttgaacggcagcatcagcgcatcgcgatgatcgagcgaaaattgcagccaggcgcgggcaaacccccacgtcgtatccggagaaaacggcgggaagataaacaccagcaggaacgagccgacgatcataaagggcagggcagtgataaagccatcgcggatcgaggtgacatatttttgctggccgatcgcgccggccagcggcgtgatctgccgttcgatcacgtcgatcagtttagcgtacagagagctcatgatctttccttagttcttgttttcgataagggaaagggcgaaatcaaggaccgcggcgcctttttgcatgccgtagtccatcatattgatgggttcgacgcggataccgtatttatccgcctgtttttgcagatcctgctgcatgtatttcacctgcggccccaacagcaccacctgataatggccgacctgttcggcgaactccgctacgccatatgcgttgatctctaccggcaggccccgctgttcggcttccgcaatcatttttttcatcagcaggctggtggacatgcctgctga

SEQ ID NO: 2892 - DNA, 885 bp, Klebsiella pneumoniae
agtacgcctgaggaagccgccatggagctgaaatgctttcgcaccctctggggagtgacgaccccctggccgcaaacgctggatgaactgcagcgcgtcggctgctgcggtatcgaagcccgcgtgccgttaacggtggctgagcggcggcagctcgccgaccgcctgcaggcgtcggggctggagtatatcgccattcttttcagcggcggcggggtgctccccgcccagcatgaaacgcccgatcagcatctggcgcgcctgcagacccgcttcgccgaggccagcagcctcaacccgcgctttgtcaatttgctggcgggcaacgatcgctggccgctggcgcagcaggtcgattttctcggcaaggcgcatgagctggccgccgggtttggtttgacctgcagctttgaaacccatcgcgccacctcgctgtacagcccgtggctcaccctggagatcattcagcaactcccccagctgcgctttaccgccgacatcagccactgggtggtggtcagtgagcgcctgctggatgaccccagcgatgacttcagcgcctttatcgaccgcgtgcatcacgtgcaggcccgggtgggctacgaccaggggccgcaggtgccgcacccggcggcgcctgagtatcagccggcgctggcctttgccgagcgcttctggcagcaaatctggcgttcgcagcgccagcgcggctacccgcagaccacgctgaccccggagtttggcgccgacggctatctgcaccatctgccgttcaccaacgttccggtggccgatctctggtcgctcaacgcctggatggccgcgcgccagcaggcccactttcagcagtttttatcgctcactgaacaggaaccgcagccatga

SEQ ID NO: 2893 - DNA, 435 bp, Klebsiella pneumoniae
aggaagcctgagatgctcaaaaccatttccccgctgatatcgccggaactgctgaaagtgctggccgaaatgggccatggggatgaaatcattttttccgatgcccatttcccggcgcacagcatggggccgcaggtgatccgcgccgatggcctgcgagtcagcgatctgctgcaggcgattatcccgctgttcgaattagacagctatgcgccgccggtggtgatgatggccgccgtcgaaggcgatgcgctcgacccgacggtggaacagcgctatcggcaggcgctatcggcgcaggccccctgcccggatatcgtgcggattgaccgctttgccttctacgaccgggcgcaaaaagcctttgcgatcgttatcacaggagagtgcgctaagtacggaaatatccttttaaaaaaaggagtcacgccgtaa

SEQ ID NO: 2894 - DNA, 729 bp, Klebsiella pneumoniae
atggcaactgagcaacacctgcgccagcagctggccgccgcctaccggctggcggcgctgttcggctgggaggataccctctacactcacttctccgtgcgcctgcccggcgacggcgagccgcgttttttaattaatcccttcggcatgatgtttgacgaagtcaccgccagcaacctgatcgtagtggatatgcagggcaaggtcgtagcgggcgacgcgccggctaactcggcgggctttaccatccatagcgcggtgcatatggcccgggaagacgcccactgcgtgatccacacccatacgctaccggggatggcggtggccgcctgcgaggatggcctgctgcagctcaaccagatcagcaccgagttttaccagcgcgtcggctaccatccctatgaaggggtggcctttgacctcgacgaacgggcgcgcatccagcgctcgctggggaataatatcgctatgatcctgcagagccacggcctgctgtcggtgggccgcaccgtggctgacgcgttttacatcatgtactacctgaaccgcgcctgcgagatccagatggccgccgcccagctggcggccctcagcccgatccacaccatcgccccgcaccttagccagcacgcctgcgagcagctgatgggcgtggagcatgaacgtcaacaggtctggcaggcgtggctgcgccgtcttgaccgtctcgatacctcttacaaagactaa

SEQ ID NO: 2895 - DNA, 1095 bp, Klebsiella pneumoniae
acagctgctgacgatcgacgatatggccctgctgggcttcgggccgcgcacaccgcaggcgataatcgcgctgagaaacaaagcggagcagttgccctgatgcgccctgccctcgctcgccgtttgctgctgatgacgctgctgctggtctccctgacgttgtttgccaccaccctcggcgccatgcgcttgccgctggtcaacctgctgccttccggggatgacatgctgcgccatatctggctgaccatccgtctgccgcgggtgctgctggccctgctggtgggcgcggcgctggccctctccggctgcgtgatgcaggggctgtttcgcaacccgcttgccgacccgggcctgctgggcatcagcagcggcgccgcgctggcggtggccagctggctggtgctcccgttctccgctgcggggctgatcgctctgtatatgccgatgctggcggcgtttattggcagcctggcggtgatggtggtgattttcatcctcagtcgggcggaggagggttcgctgtcgcgcctgctgctggtggggatcgccatcaacgcgctgtgcggcgcgctggtcggcgtcctgtcctggctgagcaatgacgcccagctgcgccagctgtcgctgtggggaatgggcagtctgggccaggccgaatggccgacgctgctggtggccgcgaccttgattatcccggcggcgctggcggtgtggtggatggcgtcccgcctcaatctgctgcagcttggcgatgaagaggcgcactatcttggggtcaacgtgcaggcgctgcagcgctggctgctgctgtgcagcgcggtgctggtggccgtcgcggtggccatcagcggagtcatcggctttatcggcctggtggtgccgcacctgatgcgcctgtggctgggacctgaccatcgcggactgatccccggctcgctgctggccggcgcgatcctgcttctgctggccgacaccctggcccgcaccgtggcggcgccggcggagataccggtcggtctgctcaccagcctgctgggcgccccctggtttctgtggctggtctttcgtcgggagaactccagacatggttaa

SEQ ID NO: 2896 - DNA, 381 bp, Klebsiella pneumoniae
gaaagtgctgacggccatcgatctcgcagccatcgtcaatcgccagcgcggtgccgatggcgttggtcccgcgcccgctttcactccacagattgccgggagccagcgccacgcgctgggccttttgcagcgcctgggtatcgccgagagtatgcagcaccaggccgtcggggtcggaaaggatcaccaccgactgcaggtctgcgacctggcgcgacagggcttccaccaccggctgcgccagctgctgcaggccgcggtggctggcgagccggtccgccagctcgccggcgccgaggcggggaaaatcctcggtggcgggatccagcccgtagcgctggcagcgagaccacgaatcgctcagcaggggattcgcattaa

SEQ ID NO: 2897 - DNA, 768 bp, Klebsiella pneumoniae
atcatggctgatcagaccaatccgtggggcagcgccccgtcaaccgacagcgccgcgcaggctgccgatgcctggggtggcgcctctactgccgcgccggctaatggcggcggcgccgactggttgcacagcgcccctgcgccgcagccggaacagttcaatatcatggatccgttccataagaccctgatcccgctcgacaggttgggtgacccacgccatcgactggatcgtgctgcacttccgtccgctgttccaggggatccgcgtgccgatcgactacatcctcagcgccttccagcagctgcttttggggatgccggcgccggtggcgattatcgtcttcgcgctaatcgcctggcagatctccagcctcggcatgggggtcgccactctggtatcgctgattgccatcggcgccatcggcgcgtggtcgcaagccatggtcactctggcgctggtcctcaccgccctgctgttctgcatggttatcggcttgccgctggggatctggctagcgcgcagcccgcgggcggcgaaaatcatccgcccgctattagatgccatgcagaccacgccggcgttcgtctatctggtgccgatcgtgatgctgttcggcatcggcaacgtaccgggcgtggtggtgacgattatcttcgccctgccgccgatcgtccgtctgaccatcctcgggataaaccaggtgcctgcggatctgatcgaagcgtcgcgctcatttggcgccagcccgcgccagctgctgtttaa

SEQ ID NO: 2898 - DNA, 525 bp, Klebsiella pneumoniae; identical to SEQ ID NO: 2057

SEQ ID NO: 2899 - DNA, 762 bp, Klebsiella pneumoniae
gcagggcgtgaccattactttgggagtaacacactgatgttaagcgtaatcggaattggccctggctcgcaggcgatgatgaccatggaagccgtggaggccctgcaggcggcagagatcgtggtgggctacaagacctacacccacctggtaaaagcctttaccggcgacaagcaggtgatcaaaaccggcatgtgcaaagagattgagcgctgccaggcggccatcgagctggcgcaggccgggcacaacgttgcgctgatcagcagcggcgacgccggcatctacggcatggcggggctggtgctggagctggttaataagcagcagctggacattgaggtccgcctgatcccagggatgacggccagtatcgccgccgcctcgctgctcggcgcgccgctgatgcatgatttctgccatatcagccttagcgatctgctgacgccctggccggtgattgaaaaacgcatagtcgccgccggggaagcggacttcgttatctgtttctacaacccccgcagccgcggccgcgaaggacatctggcgcgcgcctttacgctgctggcggccagtaaaagcgcagatacgccggtcggcgtagtcaaatccgccggacgcaaaaagcaggagaaatggctgaccaccctcggggagatggattttgccccagtggatatgaccagtctggtgatcgttggcaacaaagcgacttacatcgacaacggcctgatgatcaccccgcgaggctacgcgctgtga

SEQ ID NO: 2900 - DNA, 630 bp, Klebsiella pneumoniae
ctttcacccgaggatgacccggtgaaccgttttgtaattgctgactccactgtctgtatcggctgccgcacctgcgaagccgcctgctctgagacgcatcgccagcacggcctgcaggctatgccgcggctgcaggtgatgcgtaatgaaaaagaatcggcaccgcagatgtgccaccactgtgaagatgctccctgcgccaccgtctgcccggttaacgccatccagcgcgtcgatggcgcggtccagctcaacgagagcctgtgcgtaagctgcaaactgtgcggcattgcctgcccgttcggcgccattgaattttccggcagccgcccgctggatatcccggcgaatgccaatacccggctggcgccccccgcgccgccggcgccggcgcgcgtcagctcgctgctcgactgggtaccgggcgtgcgcgctattgccgtgaaatgcgacctctgccacttcgatgaccagggcccggcctgcgtgcggacctgtccgaccaacgcgctgatgctggtggatagccgtgatatcgcccaggccagcaagcgtaaacgccagctgacctttaataccgaccttggcgacttgtcgctgttccaggcgcaacagggggagagggaatga

SEQ ID NO: 2901 - DNA, 1248 bp, Klebsiella pneumoniae
cctgttcgcctgcctgaatgcagaggaatatcaatgatctataaaatcatggcgattaacgccggcagctcctccctgaagtttcagctgcttaacatgccgcagggggcgttgctctgtcaggggttgatcgaacgtatcggcctgcccgaggcccgcttcacgctgaaaacgtcggcacagaaatggcaggagacgctgcccatcgccgatcaccatgaggcagtgaccctcctgctggaggcgctgaccggccgcgggatcctcagcagcctgcaggagatcgacggcgttggccaccgcgtcgcccacggcggcgaacgcttcaaagacgccgcgctggtctgcgacgataccctgcgggagatcgagcgcctggcggagctggcgccgttgcataacccggtcaatgcgctgggcatacgtctctttcgccagctgttacccgcggtaccggcggtggcggtttttgataccgcctttcaccagaccctggcgccggaggcctggctctatcccctcccctggcgctattacgccgagctgggcattcgccgctacggttttcacggtaccagccatcactatgtcagcagcgcgctggcggaaaagctgggcgtaccgctgagcgccctgcgggtagtaagctgccatctgggcaatggctgtagcgtctgcgccatcaaaggcgggcagtcggtgaatacctcaatgggctttactccccagtccggggtgatgatgggcacccgcagcggcgatatcgacccgtcgatccttccctggctggtggagaaagaagggaaatccgcccagcagctcagccagctgctgaataatgaatccgggctgctgggcgtctccggcgtgtcctctgattaccgcgacgtcgaacaggcagccgacgccggcaacgaacgggcggctctggcgctgtcgctgtttgccgaacgcattcgcgcgactatcggcagctatatcatgcagatgggaggtctggacgcgctgatctttaccggcggcataggcgagaattccgcccgggcgcgggcgacgatctgccgcaatttgcattttctcggcctcgcgctggacgacgagaaaaaccagcggagcgcgacctttattcaggcggataatgcgctggtcaaagtggcggtgatcaacaccaatgaagagctaatgattgcccgcgacgtcatgcgtcttgcattgccgcaggcgcgcgagctggcggtgtcggcataa

SEQ ID NO: 2902 - DNA, 951 bp, Klebsiella pneumoniae
gcgcagcgcgaccgggggatgacgccggggaggccgcgcttatccccccgttttttcccgtctccatgcctcttgttgacctttgttacatttccgctgactgacgctgatttacattctttcttcgcttcgttattgttatgttataacattaaattgaggcaggggtatgttcacatcgatttttatggcatccggcgcggcgcgcgcggctatcgcaggcgtgctgctggcggcgctatggttagcaacctggtgggcggtgacgctgccatgattgaactggagcagttggtcgccggctatgacggggtagcgatcacccctccgctgagcgggatgatatgccccggcagcctgacggcaattgttggcctcaatggctgcggaaaatcaacgctgctgaaaaccctcgccgggtttcttcctccggtcagtggccgcctgcgctggcagggaaaacggccggtgatcggctggctggcgcagcgccatgccctcgagtcgcagtttcctctcaacgtgcaggatgtggtaagccagggcgcatggcccggcgtgtcgctgctgcgcggtctggggggcggcacccggcgacgcatcggcgcggtgctggagcgggtcgggctggcgggcctggcgaaaacgccgatcgaagcgctctccggcggccagtttcagcgcatgctatttgcccgggtgatggtgcagcaggcgccgctggtgatgctcgacgagcccttcaccggtatcgacgaagcgaccagtcgcgaactaatggatttgatcctcgagatgcaccggcagggacagaccatcctggcggtgctgcatgataaccagcgggtggccgactttttccccgagacgctgctgctgactccccagcgcgcctgctggggcgctacccgggcggtgctcccggccttcagtcatgtgaggtcggcatga

SEQ ID NO: 2903 - DNA, 1155 bp, Klebsiella pneumoniae
cgtactggcgacggaggcaaaatgagtgatggcatcgtcatcatcggctcgggcttcgcggcccgccagctggtgaaaaatattcgtaagcaggatgcgcaaatcccgctgaccctcatcgccgccgatagcatggatgaatacaacaaaccggacctcagccatgtcatcagccgcggacagaaggccgacgatctgaccctgcaaagcgccggcgagttcgccgagcagtacactctgcgtctgtttccccatacctgggtaagcgatatcgacgccgaaaaccggttagtgaagagccacgataaccagtggcgctacgacaaactagtgctggccaccggcgcgacgccgtttatcccgtcggtgccggggcgcgagctgatgctaacgctcaatagccagcgcgaatatggcgcggcgcagagccggctgcacgacgcgaagcgcgtgctgatcgtcggcggcggcctgattggctgcgaactggcgatggatttctgccgcgccggtaaagcggtaacggtagtcgataactccgccagcgtgctggcggcgctgatgccgccggaggccagcagccgcctgcagcatcggctcaccgagatgggcgtacatctgatgctgaaaacgcagctggaggggctggagcaaaccgccgacggcattcgcgtcagtctcgatcgccagcgcgcgataaccgtcgatgcggtggtggccgccgccggcctgcgcccggaaacgtcgctggcgcgccacgccggactgcagattaaccgcggtattgtggtcaatagccagctgcaaaccagcgacccggcgatttatgcgctcggcgactgtgcggaaatcaacggcgtggtactgccgttcctgcagccgattttactcagcgccatgtgcctgagtaaaaatctgctggcgcaggcgggagaactcaagctgccgccaatgctggtgaaggtgaaaaccccggatctgccgctgcatctggccggcgacacccgccgcgacgatctgacgtggaatatcgtggccgccaaagaggggctggtggcgaaaggcgtggatgccgaaaaccagctgcgcgcctttgtggtcagcgaagacaaaatgaaggaagcctttgcgctgctcaaacaactggtaagttga

SEQ ID NO: 2904 - DNA, 363 bp, Klebsiella pneumoniae
atgttgggcgatttcccccccagctcgacggtgcaggggataatattttccgccgcgcaggcgagaatatgccgcccgaccggcgtggagccggtaaacgccagcttggcgatacgcttgctggtggccagcgcctcgcccgcctctttgccgaaaccctgcaccacgttaagcaccccggccgggaacagatcgccgatcagctccagcagcagggtaatgcttagcggcgtctgttccgccggtttgagcaccacgcagttccccgccgccagggccggggccagcttccacgcggccatcagcagcgggaagttccacgggataatctgcccgaccacccccagcggttcatggaaatga

SEQ ID NO: 2905 - DNA, 735 bp, Klebsiella pneumoniae
cccccagcagagataaccaaccggcgcccgatggcgccggtttttttatgcccttcgcaccacccgatgggagcgctttccgttaccaccgggagaaggtcgttttcacctgccccaggccacaggtggttgcggtgggcgaagttgggtagacgttcgcaaaaaaatgttcttctgtcgagtatgcaaagcttttttgcgtatctggccgggaaagctattttccgtcgtcgcgccagggccaatcgccgcggcatactcgacgccatgaacagagaacatggctacaccctgatggaaaccctggtaacgctgacactgatgatgatcctcagcgtcggcggcctgtacggctggcagtgctggcagcagcagcaacgactgtggcaaaccgccgtccaggtgcgggattttctgctctttctgcgcgatgacgccaacgcctacaaccgggaccgcgtgcttcgcgtcggccaggacgaagtgggctggtgcctgagcgcggagggggaggggcctgactgcgcctcggggacatccttcacgctgcgcccgcgctggccggggatcacgctggctggcgttacgcctggtctggggttttatggtctgcgcagcaccgcctgggcggggaatctgcggctgcagagcgcggccggcagctggagcattgtgatctcacactgggggcggattcgtttatgccgcagcgacagcgcaggagggtgtcagtga

SEQ ID NO: 2906 - DNA, 660 bp, Klebsiella pneumoniae
gacaaaaaagacagtgttagtctttgcttctatctttcatttgaggcactcatcatggctaacgttctggttttaaaatccagcattaatggcgaaacatccctgaccaatcaattgattaacgaatttctcgcggcgcgccaggcggcgggacacggcgatcggctcaccgaacacgatctcagcgccatggcgctgccaacgctggatcgccccctgttcgtcgccctgcgcggggcagtggatccgcagcctgctatccgcgaggcggtcgccctctccgaccagcttatcgccgagttaaaggccagcgacctgctggtgatcggcgcgccgatgtataacctcaacgtcccgaccgatctaaaaaaatggttcgacctcgtggcgcgggcgcgggaaacctttcgctacaccgagagctggccgcaggggctggtggagggcgtccgggcggtggtcgtcagcagccgcggcggtattcaccagggagaaactaccgacgccgtcacgccctatctgcgcgcggtactggggctgatggggatccaggaggtggaatttatctatgccgaagggctggacaatcgcccgcatggtcgcgacgccgggatcgccagcgcccgggcgcagattgcccggctcgccgttccggcctga

SEQ ID NO: 2907 - DNA, 1233 bp, Klebsiella pneumoniae
tgcgggcgagatgaaatgttgcagggcatgaaagcacgcaggggaggagccgttgaaggactattttgtctacaaacagattgtcgctttcttgttggtcgtcgcatgctttaccataattatcccttgctgaatttgttaaacggaattcccatgttgaagcgtcgctatctggctttacttcccctttgtgtgctcctcgctgcctgcagcagcaaacccaagacccccgcggaaacggagatggcgagtggaaccggcggctttttgctggaaccgcagcataacgtgatgcagatgggcggcgacttcgccaacaacccggcggcggcgcagtttatcgataagatggtggcgaagcacggcttcgacaggcagcagctgcaggagatcctgtcgcaggcaaagcgcctggattacgtcctgcggctgatggatcgtcaggcgccgaccggcctgccgccaaccgggccgaccggcgcctggctgcgctacaagaaacagttcattaccccggataatgtgcagaacggcgtggtgttctggaatcagtatcaggacgcgctcaaccgcgcttatcaggtttacggcgtgccgccggaaatcatcgtcggcattatcggcgtggagactcgctggggccgggtgatgggcaaaacccggatcctcgacgcgctggcgacgctgtcgtttagctacccgcgccgcgccgaatacttctcgtcggagctggaaactttcctgctaatggcgcgcagcgaaagcgacgacccgctggagctgaaaggctctttcgccggggcgatgggctacggtcagtttatgccgtcctcctataagcagtatgcggtcgattttaacggtgacggacatatcaacctgtgggacccggtggatgctatcggcagcgtggccaactacttcaaacagcatggctgggtgagcggcgatctggtggcggtgcaggcgctggggcaggccccggggctggagaatggtttcaagactaaatacagcgtttcgcagctggcggccgcagggctgaccccgacccagccgctgggtaaccatcagcaggccagcctgctgcggctggacgtcggcaccggctatgagtactggtacgggctgccgaacttctacaccatcacccgctacaaccacagcacccactacgcgatggctgtctggcagctgggtctggcggttgcgcaggcccgcggcggttattaa

SEQ ID NO: 2908 - DNA, 792 bp, Klebsiella pneumoniae
aaggagagagagatgaatcaggttgctgttgtcattggcggtggacaaaccttaggagagtttctgtgccgcgggctggccgccgagggctaccgcgtggcggtggtcgatattcaaagtgaaaaagccagccgcgtcgcccaggagattaacgctgaatatggcgaaggtatggcgtacggcttcggcgccgacgccaccagcgaggccagcgtcaccgccctggcccacggggtggatgagattttttcgcgcgtcgacctgctggtgtacagcgccgggatcgccaaggcggcgtttattagcgacttcgcgctgggggatttcgaccgctcgctgcaggtcaatctggtgggctattttctctgcgcccgcgagttctcgcggttgatgatccgcgacggcattaaggggcggatcattcagatcaactcgaaatccggcaaagtcggcagtaagcacaactccggctacagcgcggcgaagttcggcggcgtcgggctgacccagtcgctggcgctggatctggcggaatatggcattaccgtgcattcgctgatgctcggcaatctgctgaagtcgccgatgttccagtcgttgctgccgcagtatgccaccaagctcggtatcgatgagagcgaagtcgagcagtactacatcgacaaggtgccgctgaagcgcggctgcgaatatcaggatgtgctgaacgtattgatgttttacgctagcccacaggcgtcgtactgcaccgggcagtcgatcaacgtcaccggcggccaggtgatgttttaa

SEQ ID NO: 2909 - DNA, 294 bp, Klebsiella pneumoniae
tccacaggagaacgcagtatgaataacgcactaggactggttgaaacgaaaggcctggttggcgccattgaagccgctgatgcaatggtgaaatccgccaacgtgcagttgattggttacgaaaaaattggctccgggctgattaccgtgatggtccgcggagacgtcggcgcggtcaaagccgccgttgacgccggcagcgcggcggccagcgtggtcggcgaggtcaagtccagccatgtgatcccgcgcccgcatagcgatgttgaggccattctgccgaaatctgtctga

SEQ ID NO: 2910 - DNA, 333 bp, Klebsiella pneumoniae
atgcaaggagagaaatccatgaaatggttcaaagcaatacctgctttttgcgcgacgctgctggtaacgacggccctcgctggctgtgcgggatcggctacaaaggagagtacgggcggctatattgacgataccgtggtgaccaccaaggtgaaaacggcgctctttaacgataaagacattaagtcctcagaaattagcgtccagacctttaaaggccgcgtccagctgagcggatttgtctcctccgcggagagcgctaaacgagccgtagaagtcacacgccgagtgcagggcgtgcgaatggtcgagaacgatctgcgtattaaataa

SEQ ID NO: 2911 - DNA, 1416 bp, Klebsiella pneumoniae
cgcgttctggaagtcagaggaagagagcccgccgggggcaggcgtcaggcgatgccccggcgggagagggggaaatcaggcgatgatttcgtagcaaggaatataggcggtgccgcccggaagcttcatgcggtgctgggcgacgaagccctgcagcagatcgtccatacggcgcatcatctccggatcgccgtgcagtttgtaaggaccgtactgctcaatgacctggatgcccacctctttgacgttccccgcgacaatcccggagaaggcacgacgcaggtcggcggccagcacttccaccggctgatccggggagagtttgaggttggccatgttctcgtgggtcggatcaaacggcatctgcaggtccggcgagatgcgaatcgaccagttaaagctataggcgtcatcggtctcgcgacggctctctttcaccagcggcatcgcttttttcatctgccgcgccacttccgccgggtcgtcaatgatgatccggtagtggcgacgggccgattcgcccagggtatgggtgataaactcgtccagtacgcggaagtagtcggcgctctccttcggcccggtgaggatcagcggcagcacctgcgctttgttgtcggggtgcatcagaatacccagcaggtagagcagctcttcggcagtgccgacgccgcccgggaaaataatgatcccgtgggcgatacgtacgaaggcctccagacgcttttcgatatccggcatgatgatcagttcattgaccagcgggttcggtggttccgcagcgataatggatggttcggtcatgccgataaagcggctgtctttgtagcgctgctgcgcatggccgacggcggcgcctttcatcggcgcctccattgcgccaagcccgcagccggtgcagatattcagttcccgcaggcccagctgcgtaccgacgcggcgggcgtagagatattcgttttcgttgatggagtggccgccccagcagacgatcatgttcggcgcctcgccgacgtgcagcgcgcgggcgttgcgcaggatcgagaacaccaggttagtgatatgaaccgaactttcgagatcgaggttcgggaagcgaacggtattgtggatctggccgtaaacgaacaggatatcgcgcagcacggcgaacaggttggcctgcagggagcggataatccgcccgtcaacgaaggcgtcttccggcgggttgatcagttccagcttcacgccgcgttcgcgccgcagcacgttaatctcgaaattttcgaaacgggacaggagctccttgctgttatcggtcaggctccccgaattgagcacagcaagcgagcagttgcgaaagagttggtacaggtcgctgctggcggtgcgcttaagcatatccacttccagctgcgacagcatatccattga

SEQ ID NO: 2912 - DNA, 324 bp, Klebsiella pneumoniae
ccatgtctggagttctcccgacgaaagaccagccacagaaaccagggggcgcccagcaggctggtgagcagaccgaccggtatctccgccggcgccgccacggtgcgggccagggtgtcggccagcagaagcaggatcgcgccggccagcagcgagccggggatcagtccgcgatggtcaggtcccagccacaggcgcatcaggtgcggcaccaccaggccgataaagccgatgactccgctgatggccaccgcgacggccaccagcaccgcgctgcacagcagcagccagcgctgcagcgcctgcacgttgaccccaagatag

SEQ ID NO: 2913 - DNA, 480 bp, Klebsiella pneumoniae
gctgcgctggagcggcttccgcccggatatgatcaatcgcctgcgcccctcctttacggcggccagcgcatgagcctcatcgtctacttctccagccgttcggagaatacccatcgctttgtgcagcgcctggggctgccggcggtgcgcatcccgctgaacgagcgtgaacatctgcgggtagacgagccctatattctcatcgttcccagctatggcggcggcggcaccgccggcgcggtaccgcgtcaggcgatccgctttttaaacgacgtgcataaccgccagctgatccgcggagtgattgccgccggcaatcgcaactttggcgacggctgggggcgtgccggagatgtcatcgcgcaaaaatgcgccgtgccctatctctaccgcttcgagctgatgggaacccccgacgatatcaacaccgtgcgtaaaggagtcagcgaattttggcaacgacaaccgcagaacgtataa

SEQ ID NO: 2914 - DNA, 639 bp, Klebsiella pneumoniae
cgcgtaatggataaacaacagctggcttcgacagtcaacaaagtgctggatgagatgcgccagcgtcccattccaatcggtatctccagtcgccatatccatttagcggcggctgactatgccaggctttttcccgcgcagcccatccagccgaaaaaagcgctgctgcagccgggacaatatgctgcagagcagacggtgaccctggttggccccaaagggcgattaaacaacgtgcgcctgctcggccctttgcgccagaccagccaggtggaaatctcacgcaccgacgcccggatcctcggtatcgccgcgccgctgcgcatgtccggcaatctgcagggcacgccggggatccgcctgataagcccctttgccgaactgcagctgagcggcgggacgattgttgcccagcgacatattcatatgtcgccacttgatgcgttgatcctgcgcgtctcccatggcgatagcgtcgcggtggcgatcgaaggcagcgacaggcggcttatcttcgacaacgtggcggtccgcgttgccccggatatgcgtcttgagatgcacatcgatactgacgaggccaatgcggcaggcgctgacgctgcgcaagcctgggcaacgctggtgacgaagccatga

SEQ ID NO: 2915 - DNA, 1212 bp, Klebsiella pneumoniae
gccagcccggacaaaggaagtggcgcggcttctcacgctgcgtcttgcccggcggctacatttaccggaataaaaataatgagcctgcaaaaaacctggggaaacattcacctgaccgcgctcggcgcgatgatgctctcctttctgctcgtcggctgcgacgacagcgtcgcgcagaatgctgcgcctcccgccccgacggtcagcgccgctaaggtgctggtgaagtcgatcagtcagtgggatagttttaacggtcgcattgaagcggtggagagcgttcagcttcgccctcgcgtctcgggatacattgataaagtgaattacaccgacggccaggaggtgaaaaagggccaggtgctgttcacgatagatgacagaacctatcgcgccgcgctggagcaggcgcaggcggcgttggcaagagccaaaacgcaggccagcctggcgcaaagcgaggcgaaccgcaccgataaattagtccataccaacctcgtctcccgtgaagagtgggagcagcgccggtcagccgcggttcaggcgcaggccgacattcgcgccgcgcaggcggcggtggatgccgcgcagcttaacctcgacttcaccaaagtgaccgcccctattgacggccgcgccagccgggcgctgatcaccagcggtaacctggtcaccgcgggcgacaccgccagcgtgctcaccaccctggtctcgcagaagacggtgtacgtctactttgacgtcgacgagtcaacctacctccactatcaaaacctcgcccgccgcgggcaaggcgcgtccagcgataatcaggcgcttccggtggagattggcctggttggcgaggaaggttacccccaccagggcaaagtggattttctcgataatcagttaacgccgagtaccggcaccatccgcatgcgtgcgctgctggataactcgcagcgtctgttcacgccggggctgtttgcccgcgtgcgtctgccgggcagcgcagagttcaaagccacgcttatcgacgacaaagcggtactgaccgatcaggatcgtaaatacgtctatatcgttgataaagatggtaaagcacagcgccgcgacattaccccagggcggctggctgaacgtttacccatcgttcaaaaggggttgaatcctggggataacgtcatcctcgacggcttacaaaaagtgtttatgccgggtttgccgggttaa

SEQ ID NO: 2916 - DNA, 810 bp, Klebsiella pneumoniae
aatttccaggattgtcacaggactcaaattgaccgcttgctcggcatcatgcgccgcctgcgcgacccggaaaacggctgcccatgggataaagagcagacctttgccaccatcgccccttacacccttgaggagacctacgaggtcctcgatgctatccagcgggaagattttgacgatctgcgcggtgagctgggcgatctgctgttccaggtggtgttctatgcgcaaatggcgcaggaagagggacgctttaactttgacgatatctgcgccgccatcagcgacaagctggagcgtcgccacccgcatatcttcggcgaggcatcggcgggcaatagcacggaagtcctggcccgctgggagcaaatcaaaagcgcggagcgggcggaaaaagcccagcattcggcactggacgatattccccatagcctgccggcgctgatgcgcgcgcataaaatccagcgccgctgctcggcagtgggtttcgactggacctcgctgggcccggtgctcgacaaagtgcatgaagaaattgatgaagtgatgcatgaagcgcagcaggcggtggtggatgaagcaaaactggaagaggaagtgggcgatctgctgtttgccacggtgaacttatcccgtcatttgggcgtcaaagccgaggtggcgctgcagaaagcaaacctcaaatttgagcgtcgcttccgcgaggtcgagcgtattgtcgccgcccgaggcctggaaatgaccggcgtcgacctcgataccatggaagaagtgtggcaggaagtaaaacgccaggaaactgatctctaa

SEQ ID NO: 2917 - DNA, 1308 bp, Klebsiella pneumoniae
ttcctccaggagatacagatggaaaccactcaaaccagcaccatcgtttcgggcgaaacccgcagcggatggcgtaaaaccgacaccatgtggatgctgggcctgtacggtacagcgattggcgcgggcgtcttgttcctgccgatcaacgccggcgttggcggcatgatccccctgatcatcatggcgattctggccttcccgatgactttcttcgcccaccgcggcatgacccgcttcgtgctctccgggaaaaacccgggcgaagacatcaccgaagtagtggaagaacacttcggcgtaggcgcaggtaagctgattaccctgctttatttcttcgctatctacccgatcctgctggtttatagcgtggcgatcactaacaccgtcgaaaccttcatggcgcaccagctgcacatgacgccgccgccgcgcgccattctgtcgctgatcctgattgtcggcatgatgaccattgtgcgtttcggcgagcagatgattgtgaaagcgatgagcgtgctggttttcccattcgttatcgcgctgatggtgctcgccctgtatctgatcccgcagtggaacggcgcggcgctggagacgctctccctgagcggcgcttccgttaccggcaacggcctgctgatgaccctgtggctggcgatcccggtgatggtcttctccttcaaccactcgccgatcatctcttccttcgcggtagccaaacgtgaagagtacggcgaaggcgctgagaagaaatgctccagtatcctcgctcgcgcccacatcatgatggtgctgaccgtgatgttcttcgtcttcagctgcgttctgagcctctctccggcagacctggcggcggcgaaagagcagaacatctcgattctgtcttacctggcgaaccactttaacgcgccaatcattgcctggatggcgccgatcatcgcgatgatcgccatcaccaaatccttccttggccactatctgggcgctcgcgaaggctttaacggcatggtgattaaatccctgcgcagtaaaggcaaatcgattgaaatcaacaaactgaacaagctgaccgcgctgttcatgctgatcaccacctggattgtggcaaccctgaacccgagcatcctcggtatgatcgagacccttggcggcccgattatcgcgatgatcctgttcctgatgccgatgtacgcgattcagaaagtcccggcgatgcgtaaatacagcggccatatcagcaacgtcttcgtggtgattatgggcctgattgccatctccgcgatcttctactctctgttcagctaa

SEQ ID NO: 2918 - DNA, 894 bp, Klebsiella pneumoniae
tggggtaaggaaatgatgaaacgtagtgcaatagtggtcgcgctggccctcggcctgatggcgcagggggccatggcgaaaacgctgaatgtggtaagcagtttttcggtgttgggtgatatagcgcagcaggtcggcggggagcatgtccatgtggataccctggtcggcccggacggcgatccgcacaccttcgaaccgtcgccgaaggatagcgcgctgctcagcaaggccgacgtggtggtggttaacggcctggggctggaagggtggctggatcgcctgattaaggcctctggttttaagggcgagctggtggtggcatcgaaaggcgtcaagacccatacccttgatgaagagggtaaaacggtgaccgatccccacgcctggaacagcgcagcgaacggcgcattgtatgcgcagaatatcctcgatggtctggtgaaagccgacccggaagataaagcggcgttgaccagcagcggcaagcgctatatcgaccagctgacgtctctcgacggctgggcgaaagcgcagttcagcgccattccgctggccaagcgcaaggtcctgaccagccatgacgctttcggctattttggccgggcttatcacgtgaccttcctcgcgccacaggggctctcttcagagagcgaggctagcgcggcgcaggtggcggcgctgattaagcaaatcaaagcggatggcgtccatacctggtttatggagaaccagcttgacccgcggctggtgaagcagattgccagcgccaccggcgcgcagccggggggcgaactctatccggaagcgctatctaagccgggcggcgtcgccgatagttacgtcaaaatgatgcgtcacaacgttgagcttatcgctaacagcatgaagtaa

SEQ ID NO: 2919 - DNA, 204 bp, Klebsiella pneumoniae
tctttcaaggagcaaagaatgctgattctgactcgtcgagttggtgagaccctcatgattggagatgaggtcactgtgacagttttaggggtgaagggtaaccaggttcgtattggcgtaaacgcccctaaagaagtgtctgttcaccgtgaagagatctaccagcgtattcaggctgaaaaatcccagcagtccagttactaa

SEQ ID NO: 2920 - DNA, 1326 bp, Klebsiella pneumoniae
actgatgaggacgctatgggaaacacaacgataccaacgcaaagttaccgcgccatggagagcgggcagagtaagagctacattattcctttcgctctgctgtgctccctcttttttctgtgggccgtggctaataatctgaatgatattttattaccgcaatttcaacaggccttcaccctgactaacttccaggccggattaattcaatcggccttttactttggctattttattattcccatccccgccgggatgttgatgaaaaaattcagctacaaagccggcatccttacgggtctgtttttatatgcctgcggcgccgcgctgttctggcctgccgccgaagtgatgaattacaccttatttctcattggattatttattatcgctgccgggcttggctgtctggaaaccgcggccaacccgtttgtcaccgtcctcggtccggaaagcggcggtcacttccgccttaatctggcccagacctttaactcattcggcgccattattgccgtggtatttggccagagtcttattttgtctaacgtcccgcatcagccgcaggaggtgctggataaaatgacgccggaacagctcagcgcctggaagcacagtctggtcctgtcggtacaaaccccctatatgattatcgtggccattgtcctgctggtcgccctgctgatcgtctgcacccgcttcccctccctgcaaagcgatgaccacagcgacagcgcgcagagcacttttttcgcctcgctgacgcgcctgatgcgcatccgccactggcgctgggcggtactggcccagttctgctacgtcggcgcgcaaaccgcctgctggagctacctgattcgctacgctatcgaagagatcccgggcatgacggccggtttcgccgccaactacctgaccgccaccatggtctgcttctttatcggccgttttaccggcacctggcttatccgccgcttcgcgccgcacaacgtgctcgctatctatgcgtttatcgccatgctgctctgtttgctctccgccttcagcggcggccacgtcggtctgctggccctgaccctgtgcagcgcctttatgtccattcagtacccgaccatcttctcgctggggattaagcatctgggccaggacaccaaatatggctcgtcatttatcgtcatgaccattatcggcggcgggatcgttaccccggtgatgggctttgtcagcgacgccgccggcaatatcccgaccgccgaactggtcccggcgctgtgcttcgccatcatctttatttttgcccgtttccgttcacaagcggcgacgaactaa

SEQ ID NO: 2921 - DNA, 1386 bp, Klebsiella pneumoniae
gtggatcgggaacacgttgagccggtagtagagatcgctgcggaattccctgtcgataaccatctgcttgagatcgcggttggtggcggcgatcaatcgaacgtcggtctgaatcagcttgttgctccccagacgttcgaactcctgctcctggaggacgcgcagcagtttgggctgcagttccagcggcatatcgcccacttcatcgaggaacagggagcttttgtccgccagttcgaagcggccgatacgctgggcgctggccccggtgaacgcgccgcgttcgtggccgaacagatcgctctccagcagcccggcgggcatcgcggcgcagttcatcttcaccatccgccgaccgttgcgtccgctgaggttgtggatagcgcgggcgataagctctttgccggtgccggtttcgccgaggatcagcacggtgctgtcgctgtgcgccaccatctctacctgcttgagcacattgttcatcgcctcgctgcggccgataatctccccgaattcgctctcgacattattgagctgctcggtgagggcgaggttctcatccaccagccgctctttcaggcgctgaatttcgcggtaggcgagggcgttatcgatagcgatcgacacccgctcggcgatctgccgcagcagcttgagattggtggtggtgaagacctgttcgtcgcactgcgccagcttaagcaccccgagcagggtattgccggacatcagcggcagcaggcacagggtctggatcttattgccccacatctcgaagagcattttctcatacggcgcgagagtgtcatgttcgtgcagattaagcagcagcatctctttgcttttgaacacgcgctcggtgagggtgccggcttcatccacctcgctctggtcgtgaaccgggtggctggcgtcaagataatgcgtggaatagatgttgagcttccccttgcggtcgctgcgcagcaccacgctgatggcgtcgatccggaagtagcgatggatctctttcgccacctcgctgaccagctcgtcgatatccagtcgcgagagcaccgcgttggtgatcgccaccaggatgcgaaagttgtcgcgctcgtggcacagcagatcgtaatcgacgttattgctgacccggttctgaatctgttcggtgacgacggcgacgatctgcgcgaaggtatgcagccgctggaactctttctcgctccacggccggttgtcacggcggaggaattcgcaaccgccaaagatccgcccgtccgccgccagcggcagcagcgagtagtaaccgaacggacgatacagtccgctgcggataagctgcggccaggtatcggcaaaggtttcatgatcgcaatgcagggcatccggccgggagagtaa

SEQ ID NO: 2922 - DNA, 744 bp, Klebsiella pneumoniae
gtaaaaacacttcatgcaacatctttcattaggatttttctaatgatcctgcttatcatcttatttactcccctcctctccagcagtaatacttggttacagaagcagtgtataaggaaatacattatgattattatcatttccgccaataaattttttattaacggcatccggtctctggttaacatgaccatgagtgctcaacgtcggtatagccaaacattgtttctggataatatttctgacgtgaatcataaaagtctaaccatagccagaaccattatcgtggactatagccacccggacattcaacaactagccgcactgctctatcgtaaaaaaaagatcattcatggcaatatcgtttttgtcgttaaaagtgagattcttgccgatccagtcgaaaacattatcataaactctatttcgacgatcgtgcttgattatatagatgttacccaacggctgcagaaatacttacagaatgcgtctgatcatcgctgtattaaagtgttcagaaaatcaattagctcgctggacagttgtgtcaatattaaacttacgaaacaggaggactctcttctcccctatatcatctcaggtttaaataataagaaaattgctcaggccaccgaccttagcaatatgatgatcagtcactatcggagaaacatctaccagaaactcaatgtccgcaatattgcaggcctgtatcatttcctgcactccctggaggggggataa

SEQ ID NO: 2923 - DNA, 234 bp, Klebsiella pneumoniae; identical to SEQ ID NO: 2064

SEQ ID NO: 2924 - DNA, 1323 bp, Klebsiella pneumoniae
ttgagacaactctctacgatggcgcaattctactctgcaaaacggcgtgtgacgacgcgccagatcataaccgttacagtcaacgacctcgatccctttggtcagggtgttgcccgccatcaggggaaggcgttgttcgtgagcggcgtgctgccccacgagcaggccgagctggtgctggtggaagataaaaaacagtacgcccgcgccgaggtgaaacgccgactgaccgacagcccgcagcgccaggcgccgcgctgcccccattttggcgtctgcggcggatgccaacaacaacatgccagcgttccgcttcagcagcaaagtaaacgcgccgcgctggggcgactgatgaagcgcgaggtagatgacgtcatcgccggcgcgccgtggggctaccgccgtcgcgcacgcttgagcttgaattatcagccgaagacccaacaattgcagatgggttttcgccaggccaacgccaaagcgatcgtcgatgtggtgcagtgccctgttttggtgccccaacttgaggcattgctgcccgccgtgcgcgagtgcttaagcgcgctgagcgcattacgccatctcggccacgtcgagctggtgcaggcggacaacggtccgctgatggtgctgcgccataccgcagccctgccggcgacagacagggaaaaactggaacgcttttcgcaaactcacggtctttccctgtacctcgcgccacaaagcgagatactggagcatattcatggcgaagcgccatggtatacctcagacggactacgcttagtgttcagcccgcgggattttatccaggtcaacgacggcgtaaatcagcagatggtgcgtaccgcactggagtggctggatctgcggccagaggaccgggtgctggatctgttctgcgggatgggcaactttaccctgccgctggcgacacgcgccgcccatgtggtgggcgtggaaggggtgccggcgctggtggagaaggggcgggaaaacgctgcccgcaatggtttatcaaatgtcactttcttccatgaaaatctggaagaagacgtcacccgtcaggcctgggcgaagcacggctttgataaagtgctgctggacccggcccgcgccggcgcgccgggcgtgatgccgcatataataaaactggcaccgcggcgggtggtgtatgtttcctgcaacccggcgacgctggcgcgagacagcgaaaccctgttgcaggctggatatcagattcaacgcctggcgatgctggatatgttcccgcataccggccatctggaatcaatggtgttgtttgagcgcaggcttacataa

SEQ ID NO: 2925 - DNA, 927 bp, Klebsiella pneumoniae
ctgaggggttttatcatgatttctgcgagtaccctaaactcagaactcatcaataaaatcgcacaggattttgcgcaagccaccagtctggcggttgtggtcgtcaatattcacggtgatgagatttctgaattgtttaatttcacgccgttttgccagctgatgcgtcagcacccggagcacagcggacgctgtcgcatgagcgaccgctgcggcgggctggaagcctcgaaaaaagaccagctgtgtatctaccgctgtcatgcggggttaaccgatttttccatcccgctggtgatcgccggccacctggtcggcttcgtgctgtgcgggcaggtgcgtctgagcaatgatgttgaactggttgatatcttgaacgtcgatgaccgctggcaggacgatccggcgctggtccaggcgtttcgcgatgtgccggagatggactattcgcgggttatcgcttcggcggatctgctgaagctgatcgtcgagaattgcctgaaaaaacagctcaactttgtggttatcaaagataacccgtcgcagaacgacccggcgcaggccagccgggcgccctcgccgcacgatggcaaaatgaagaaggcgctgcgctatatcgacgcgcatctctccgatgagctgcgtctggaggatgtggcggcgcatgtctatctcagcccgtactacttcagcaaactgtttaaaaagtatcaggggatcggttttaacgcctgggtcaatcagcagcggatggcgagcgcaaaagagctgctatgccacagcgactggagcatcgccagcatcgcgcggaatttaggtttttcgcaaaccagctatttttgcaaagtgtttcgccagacctatcaggtaacgccgcaggcatttcgtcagcaaattaatgccggatcacaaactgagtctttttaa

SEQ ID NO: 2926 - DNA, 948 bp, Klebsiella pneumoniae
cttttattttgcaggaaaaccttcatagcgccctggcgcacctgcggcagagcggcatccacgaggtggactgccagcagctggcggtctccaccctggctaccctgggcagcggccactacttcaaaccccataatcccgtttttgtcatcgcctgtcagaaggaagaaaaccatggctgagacttttgatccccattgcgtgtggttcgtcggcgccggtccgggcgatcgcgaactgattactctcaaaggctaccgtctgctacagcaggcgcaggtagtgatctacgccgggtcgctgatcaacaccgagctactggcctactgtccgccacaggcggagtgccacgacagcgccgcgctgcatctggagcagatcctcgacctgatggaggcgggggtgaaggcgggaaaaacggtggtgcgtctgcagacgggcgacgtctcgctatatggctcggtgcgcgagcagggcgaagagctgacccgccgcgggatccgctggcaggtggtgccgggcgtcagcgctttcctcggcgcggcggcggagctgggggtggagtacacggtacccgaagtctcgcagagtctgattattacccgtctggaagggcgcacgccggttcccgcgcgcgaacagctggaagcctttgccagccatcaaacctcgatggcgatttacctgtcggtgcaacgtattcaccgggtggcggagcggctggtggagggcggctaccccgcgaccaccccggtcgcggtgatctacaaggccacctggccggaaagccagaccgtccgcggtaccctcgcggacatcggcgacaaagtacgcgacgccgggatccgcaaaacggcgctgatcctggtcggccccttcctcggcgatgagtatcactactcaaaactgtacgcagcggattttagccatgaataccgtaaagcctga

SEQ ID NO: 2927 - DNA, 342 bp, Klebsiella pneumoniae
aattattcttgtctccgccaccagcggcgaaggcatggagcaatggctcacctggctggagacgcagcgatgtgcataggcattccgggacaaatttgcgccatcgacggcgtgctggcgaaggtggaagtttgcggtattcagcgcgacgtcgacctgacgctggtcggcgccgttgatgagcagggccagccgcggctcggccagtgggtgctggtgcacgtcggcttcgccatgagcgtcattaatgaagccgaagcccgcgacaccctcgaggcgctgcaaaatatgtttgacgtggagccggacgtcggcgcgctgctgtacggcgaggagcgataa

SEQ ID NO: 2928 - DNA, 1878 bp, Klebsiella pneumoniae
taccgaccttggcgacttgtcgctgttccaggcgcaacagggggagagggaatgagtgtaattggattagtgaatcaggcggtggcgtggtatgccgccagcgccgtactggcctttctgtttgccatgcgcaaaccgctcagcggcgccattgccgggatcggcggcgcggtggccagcgccatgctggtggtcgccggcggcgccgcgctgctgatgccggagcggatccacggcggcatgctgcagtttctccacctgacgatacgggtggggggcgtcaacgcgctgtggctgctggccatcggcctgtcggcgctgccggtgtcattgttcaatattagctggcatcgccacccgcaggtgaaggccaacggcccgctggtcaacctgctgctggccgccgcgacctgcgcggtggtggtgaccaatatcggttcactggtggtgatggcggagatcatggcgctctgcgcggcgtttctcaccggctgcgccgcctccggtaagctgtggtttgcgctggggcgtctcggtactttgctgatggcctggacctgctggctggtgtggtcaacctacggcaccctcgagctggcgcagatcaaccttcaggcggtggatatgatgcagaacccgctgctctggctgccgggtctggtggggttcgccctgctggccggggcgatcccgctgcacggctgggcgccgcaggcccacgccggggccagcgcgccggccgccgcgctgttttccacggtagtgatgaaagtcggtctgtacggcatgctgaccgtttcgctggccggcggcgtgccgccgctgtggtggggcgtgatgctgctggcgctggggatgatcaccgcctttatcggcggactgtatgcgctgatggagcataacattcagcgcctgctggcctatcacaccctggagaatatcggcattatcctgctggggctgggcgccttcgtcaccggcgtggcgacccgcaacagcacgctgatggtgctgggctttatcggcggcatgtatcacctgattaaccacagcctgttcaaaaccacgctgttcctcggtgccggagcggtgtggttccgcaccggtcatcgcgatatcgagaagctgggcggcatcggtaaaaaaatgccgctgatctccctcgccatgctggtggggctgatggcaatggcggccctgccgccgctgaacggcttcgccggcgagtgggttatctatcaatccttcttcaaaatgagcactggcgacctgtttatcggccgtctgctggggccgctactggccgttggcctggcgatcactggcgcactggcggtgatgtgtatggcgaaagtctacggcgtgaccttcctcggcgcgccgcggacgaaagaggcggaaaacgctacctgcgccccctggctgatgaccctgagcgtggtgctggcggcggttttctgcctcgttggcggcatcgccgcgccgtggctgctgccgctggtgagcggcgccttcccggtgcaggctcaggtatcgagcgtggtgtcgcagccgatgatcgcgctgctgcttattgcctgcccgctgctgccgttcctgctgatgatcttctttaaaggcgatcgcctggcggcgcgctcgcgcggcgcggcgtgggtctgcggttacgaccacgagcagtcgatggtggtaacggcccacggctttgccatgccggtgaaagaggcctttgcgccgctgctgaagctgcgtcactggctgaatccggtgcgtctggtgccgggctggcaatcggcctcggcgccggcgctgctgcgcgggatcgcgctggttgagctggcggtgctggtggtgattgtcatttcgcgaggagcctga

SEQ ID NO: 2929 - DNA, 1539 bp, Klebsiella pneumoniae
tcgaaagattgggaagggcgggcgagaacgaggctaagccagaagacctgcctgccggtaactgaccaacaacttcggtgggaagtgggtggcttagcggtgcgtggtcgcaggaccaggcatgcgcgtagctataccctgaccgccagaacaggacagggtatggcaaccaggcgtgcgttcattcttgcgggtaccggcagcggttgtggcaaaaccaccgttacgctcggcctgctcagcttgctccagcagcgcggtatgcgggtgcaaccctgtaaagtcgggcctgactacctggataccgcctggcacaccgccatcagcggcatcgcttcccgcaatctcgacagctttatgcttcccgccccgatactcaacgcgctgtttaccgaacagctacagcaggccgacatcgcggttatcgaaggggtgatgggcctgtatgacggctacggcaccgaccccaactactgcagcagcgcggcaatggctaagcagcttggctgcccggtgattttgctggtggatggcaaagcggtgtcgacctccatcgccgccacggtgatgggttttcaacattttgatccggctctcgacatcgctggcgttatcgtcaatcgggtcaacagcgacgcgcacttccagctgctgaaaagcgccattgagcgctactgtcaggtgccagtgctcggctatgtgccgcgcgtggaaggcgtggcgctgcccgaacgacatctgggactggtgaccgcccgcgagtcggtggtcaatcagcaggcatggcgggattttgccagcctgctggggcgcaccctcgacatagaccggctgctggccctcagcgaactggccgccatgccgatcggcgagtggggagaacagcttgccgccgatgccggcgaaggactgacgctggccctcgccgacgatgaggccttcaatttttattaccccgataacctggcgctgctggcgcgctgcggcgtgaagatggtgcgctttagcccactacgcgatcgccagctgccggcctgccagatgatctggctcggcggcggctatccggagctgcatgcggccgggctatccgctaaccacgagatgctgacacagcttcgcgcggcgcaccggcgcggggtggcgatctacgccgagtgcggcggcctgatgtacctgggcacgaccctggaagtcaccagcggcgagcgctacacgatggcggatattattcccggacacagccgaatggggacgcgtctgacccggttcggctactgcgaagcgcaggcgcagcagcagacgctgctggcagcccctggcgagtggctgcgcggccatgaatttcattactccgatttttctcccgccacccccgccgtactggcctgccgtaaacagcgagacggtaagacgctccagcagtggcagggaggatggcagtccggcagcgcctttgccagctatctccatgtccattttgcccagcgtcccaccatgctcaaccactggttgcgggcagcaaggagggcgctatga

SEQ ID NO: 2930 - DNA, 1431 bp, Klebsiella pneumoniae
gagagttgttgcaccgtggattacttgcccctttttgccgaactgaaacaaaggcccgtgctggtgatcggcggcggcgagattgctgaacgtaagatcaagttcctgctgcgcgcccaggcgcaggtgcaggtggtcgctgaaacgctgtcaccggcgctggccgatctggctgcgcgccaggcactcagctggcgggcgacggaattcagcgactcgctggtggatgatgtctttctggtgattgcggccaccgaggatgaggcgcttaaccagcgggtatttgcggcagctaacgcgcgctaccggttggtcaacgtggtggataaccaggcgctgtgctcgtttgttttcccttctatcgtcgaccgttcgccgctgctggtggcgatctcctccagcggtaaagcgccggtgctgtcgcgcattctgcgtgaaaaaatcgaagcgctgctgccgacgaatctcggtcggctggcggaatcagcaagctactggcgcaaccatctgaaaacccgcctgacgactaccgaagcgcgtcgccgcttctgggagcgcgtctttaccggccgcttcgccagcctgatggtggcgggcaactctgcggaggcggaaaaggcgctgcaggatgagctggataagcccgaacgcgagacgggagaaattattctggtcggcgccgggccgggcgatgccgggctgctgacccttcgcggtctgcaggcgatccagcaggcggacgtggttttccacgaccatctggtgactcagccggttctcgagctggtgcgccgcgatgccgagctgatctgcgttggcaaacgcgccggcgagcactcggtgccgcagcatgaaaccaatcagctgctggtggaggcggcgaaggcggggaaaaccgtcgtgcgcctgaagggcggcgatccgtttatttttggccgcggcgcagaagagctgcaggctgccgccgaggcggggatcccgttccaggtggtgccgggcgtcaccgcagccgccggggcgacggcctacgccggtattccgctgacccatcgcgattatgcgcaaagcgccgtctttgtcaccggccactataagccggacagcgcccccttcgactggtcgctgctggcgaagagccaacagacgttggcgatctacatgggcaccatgaaggcagcggaaatcagcgcgcagctgatcgcccacggtcgcgacagcgacacgccggtggcggtgatttcccgtggcacccgtgacgatcagcagacgataaccggcacattgcaacaactcgaacacctggcgaaagacgccccgatgcccgccctgctggtggtaggcgaagtggtgcagctgcatcagcagctcgcctggtttcaacatacatcatccgccgaggggtttaacgcttcggtggtcaatctggcttaa

SEQ ID NO: 2931 - DNA, 318 bp, Klebsiella pneumoniae
ttccctcactggcacatatcctgcaaggtctttatgcaacaagaagcattaggaatggtagaaaccaaaggcttaaccgcagccatagaggccgctgacgcaatggttaagtcggccaacgttttattagttggctatgaaaggatcggttcaggcctggtgaccgtcatcgtgcgtggcgacgtgggggcagttaaagccgccaccgacgccggtgccgccgcagcccgccacgtgggcgaagtgaaagccgtacacgtcattccccgcccccataccgatgttgaaaaaatcttaccgaaggggaatagccaatga

SEQ ID NO: 2932 - DNA, 843 bp, Klebsiella pneumoniae
ccgttgaactgcgtttctggctgccggcgggcagcttcgccaccagcgtggtcagggagcttatcaatacaacgggtgactatgcgaatattgctgagtaacgatgacgggatccatgcgccggggatacagaccctggcgaaggccttaagggagtttgccgaggtccaggtggttgcacccgatcgtaaccgcagcggggcctcaaattcgctgacgctggaatcgtccctgcgtacgtttacctttgaaaatggcgacatcgccgtccagatgggcaccccgaccgactgtgtctatctcggcgtgaacgcgctgatgcgcccgcgtccggacatcgtggtttccggtattaatgccggccccaacctgggcgacgacgtcatctattccggcactgtggccgcggcgatggaaggccgtcatctggggttccccgcgctggccgtgtcgctgaacggctatcagcattacgataccgccgcggcggtaacctgcaccattctgcgcgccttaagccgcgagccgctgcgtaccgggcggatccttaacatcaacgtgccggatctcccgcttgatcaaatcaagggtattcgcgtgacccgctgcggcaaccgccatccggccgaccaggtgatcccgcaacaagatccgcgcggcaacaccctgtactggattggcccgccgggcgataagcgcgatgccgggccgggcaccgattttgcggcagtggatgaaggctatgtttccgtgacgccattgcacgtcgatttaaccgcccatcaggcgcatgaggtggtcaccgattggctggaacgtgtcggggttgacaggcaatggtaa

SEQ ID NO: 2933 - DNA, 273 bp, Klebsiella pneumoniae
ccgctatgctggccaaccgtaaataaggagaagaagatgatttgtccacgttgcgccgatgaaaagattgaagtcatggcgacctcgccggtgaaaggggtctggaccgtgtatcagtgccagcactgtctttacacctggcgagataccgagccgctgcgccgcaccagccgcgaacactatccggaagcgttccgcatgacgcagaaagatatcgatgaggcgccgcaggtgccgcacgtaccgccgctattgccggaagataagcgttaa

SEQ ID NO: 2934 - DNA, 828 bp, Klebsiella pneumoniae
cgcgctggctgtcggcgacttgaggaagaggatatgaaaaaagcacttctggtggtgagctttggcaccagctatcacgacacccgcgaaaagaacatcgccgcctgcgagcgcgatctggccgccagctgcccggaccgcacgctgttccgcgccttcacctcggggatgattattcgcaaactgcagcagcgcgacggtattcatatcgatactccgctgcaggctctgcaaaagctggccgagcagggataccaggatgtggcgatccagtccctgcacattatcaacggcgacgagtacgagaagatcgttcgcgaagtgcagagcatgcgcccgcgctttcagcgtctgacgctgggcgcgccgctgttgagcggtcatggcgattacgtgcagctgatgcaggccctgcgccagcagatgccaacgctggcggcgacggagcgagtggtgtttatggggcacggcgccagccaccacgccttcgcggcctacgcctgtctggatcatatgatggcggtgcagggttttccggcgcgggtgggggcggtggaaagctatcccgaagtggacatcgtcattaacgaactctcccgccagggcgtgaccggcgtgcatctgatgccgctgatgctggtggccggcgatcatgccattaatgatatggcctccgacgaagacgattcgtggaaaacccgcttcaatgccgccggtatccccgccacgccatggcttaacgggttaggggagaatccggcggtgcgggcgatgtttgtcgcccatctgcagcaggcgctgaacgacacgatggagaaagcagcatga

SEQ ID NO: 2935 - DNA, 1335 bp, Klebsiella pneumoniae
caggttatatgcctttcgttaaagtttctggtcaatctgtttgttttgggtataaatgcgtttttattgcttgggagtggcatgtcgggatacaactctggattaagccgtcgccgtttattgcagggggcgggcgccatgtggttaatgagcgtgagccctgtcgggctggccgccgccgcgcgggtggtcgctgttcgcgtctggccagcatcgacctacacccgcgtcacggtggaatcgaatcatgtgctgaaataccggcagtttgccctcagtaatccggaacgggtagtggtcgatctggagggggttaacctgaactcggtactgaagggcatgggggggcagatccgcgctgacgatccctttattaagtccgcccgggtgggccagtttgatccgcaaaccgtgcgcatggtcttcgaactcaagcagaacgttaagccgcagctgtttgccctcgcgccggtggccggctttaaagagcgtctggtgatggatctctaccccgccaacgctaccgatgttcaggatccgctgctggcgctgctcgaggattacaacaaaggcgatctggagcggcaggtgccgccggcgcaaagcgggccgcagccgggcaaagccgggcgcgaccggccgattgtcatcatgctcgatcccgggcacggcggcgaagactccggtgccgtggggaagtatcgcacccgcgagaaagatgtggtgctacagatcgcccgtcgcctgcgggcgctgatcgacaaagaaggcaatatgaaggcctatatgacccgcaacgaagacgtgtttatcccgttgaaagtgcgtgtcgccaaggcgcagaagcagcgcgccgacctgttcgtgtcgattcacgccgacgcctttaccagccgccagcccagcggctcttcggtgtttgccctctccaccaagggggccaccagtaccgcggcaaaatatctcgcccagacgcagaacgcctcggatctgatcggtggggtcagcaagagcggcgaccgctatgtcgaccacaccatgttcgatatggtgcagtccctcaccatcgccgacagcctcaaattcggaaaggcggtgctggagaaaatgggcaatatcaataatttgcacaagaatcgggtagagcaggcgggctttgcggtactgaaggcgcctgatatcccctccattctggtggagacggcgtttatcagtaacgtcgaagaagagcggaaactgaaaacggccaaattccagcaggaggtggccgagtcgatcctcgccgggattaaagcctacttcgccgacggcgcgacgctggcccgccgcggataa

SEQ ID NO: 2936 - DNA, 477 bp, Klebsiella pneumoniae
tatcgccgatgtcgacaacgccgtcacggtggccagcgacagcgcaggcgagaaaggattactggttcaccgggcagtgatcccgcgaccgcacgatgcgctgtggcaacagctgatggagggataatggaaccgcaaccccctaccgaacgcatgatccaggagtatgtcccgggcaaacaggtcactctggcgcatctcattgccaatcctggcaaagatctgttcaaaaagctgggtctgccggacgcggtctccgccatcggcattcttaccattacccccagtgaagcatcgattatcgcctgcgacatcgctaccaagtccagcacggtggagatcggttttctcgatcgcttcaccggcgcggtggtgttgaccggcgatgtctcagccgtggagtacgcgctcaggcaggtcacccgcaccctcggtgagctgatgcgcttcaccgcctgcccaattacccggacctga

SEQ ID NO: 2937 - DNA, 192 bp, Klebsiella pneumoniae
acagcgtggtggacatcattgactctcaacaggacgaaaaaaaccgccgtagggtaccggaaagtacattttttcgcattaactaaaacggccgtgaacagaaaatggacatgtctatctgctttatttgatttaatctcttatatttcaattgcttatttaatcgattttgttgttaataactacaactaa

SEQ ID NO: 2938 - DNA, 765 bp, Klebsiella pneumoniae
accgggtggtggaggtggtggaaaactgcaaccagatccccgttcacccgcgccacccgtgggcgggaagtctggcttacaccgccttcctccggctcccatcaggatgcgatcaaaaaagggtttgatgcccgtcagcctggcgatccgtggcagatgccctacctgcccattgacccgcaggatataggctgcagctatgaggcggtgatccgcgtcaacagccagtcggggaagagcggcagcgcctggcttatcgaacaaaatcatggtctgaaactgccccgcgggctgcagcaggacttcagccagcacgttcagcaggccaccgatagcgacggcaaagagatgacccaccatgcgctgtggcagctgttccgcacgcgctacgggctgcaggcgcagccggcgctgacgctgctcgattatcagagcgccagccagcaggatggccagctttccctgcaggcaacgctgcgtcaccacggcgaaacccgacgcctgcagggccagggcaacggcctgctctccgccgcagccagcgggctcagcgcgctgtttcggcagccgtttatgatcaaggactatcatgagcataccctcggcgcgcgcagcgacagccggtcggtggcctatatccgctgcgtttttccgcaaggagaaagctactggggcgtgggtatcgataatgacgtggcgcgcgcctcgctgcaggcgctgtgcaatgcgctcagcgccgccgatcaggccggggggcgaaaatag

SEQ ID NO: 2939 - DNA, 1137 bp, Klebsiella pneumoniae
agcctacttcgccgacggcgcgacgctggcccgccgcggataaccacacaggaaagggacatggccttactgaaaagcgcccatggcggcaatatccgcgaggccgccgccctgctgggcatagcccccggcgagctgctggattttagcgccaacatcaatccgctggggatgcctgcctcgctcaggcaggcgatcgttgacaacccaggctgcgccgaacgctaccctgacgtcgagtatcaacagctgcatcaggcgctggctgcccaccatcagttgccggcggcgcatatcctcgccggcaacggcgaaactgaatcgatcttcaccctcgtccacggccttaagccgcggcgggcgatgatcgtcattcccggttttgcggagtaccggcgggcgctgcagacggtggactgtgaggtggtggagtatgccctgcgggagcgcgatggctggcagctgaccgacgcgatcctcgatgccctgactccggcgctggactgcctgtttctctgcaccccgaacaaccccaccggcctgctgccggagcggggcctgctggaagccattgcgcagcgctgccgggcgctgaacatcagcctgatcctcgatgaggccttcctcgactttatccccgaccagccggggtttattcctctgctggcgcagcatccgcacgtctgggttctgcgatcgctgaccaaattttatgccattccggggctgcgtctcggctacctgctgaacgctgatgcccaggcggtggcccgactgcgcgcgcgacaaatgccgtggtccatcaacgcctatgccgccctggccggggaaattattctccaggatcgggcgtatcagcgggccacctggcagtggctgcaggaggagggagcgcgtttctatgcgcagctgcaggagatggccgggctgaccgtatggcccgggcgtgctaactacctgttcttgcgctgcgacagacccgattttgacctgcaatatgccctgctgcgccagcatgtgctgatccgcagctgcgccaactacccggggctggatagccgctatttccgggtggcgatccgcagcgccgaggaaaacgaccagctgctggcggcgttgcgccgggtgctggcctga

SEQ ID NO: 2940 - DNA, 363 bp, Klebsiella pneumoniae
gcaacacttcgccgcggtgtgggaagtgatgagcgccggtatcgagcgcggcatcaccaccgaaggcgtcctgccgggcaaactgcgcgtcccgcgccgcgccgccgcgctgcgccgtatgctggtgagccaggacaccaccaacagcgatccgatggcggtggtcgactggatcaatatgttcgccctggcggtgaacgaagagaacgccgccggcggccgggtggtgaccgcgccaaccaacggcgcctgcggtatcgtgccggcggtgctggcctactacgacaagtttatccgcaaggtgaacagcaactccctggcccgctatatgctggtcgccagcgcgattggttcgctgtataa

SEQ ID NO: 2941 - DNA, 333 bp, Klebsiella pneumoniae
cctcgttctcgcccgcccttcccaatctttcgatcagtggtttttgcggggtcgtcagcatcacagcagcgggggctgcgggggatttacacccccttccctgacaccaaactggtgtcgaacctgtcggtttgtttcgccgatgcgccctgcatcgacgggtattactttatgttttcttttaccgtttcatcactcgtcacaatgacgtcagtgaaggaaagcggtgttgtgataatcagctgtctcgtattaacggacactctatctcatcacaaaaataaaaactggtgtagtttatccctcgaatatcactattttgttgcgctatga

SEQ ID NO: 2942 - DNA, 939 bp, Klebsiella pneumoniae
tccccggctcgctgctggccggcgcgatcctgcttctgctggccgacaccctggcccgcaccgtggcggcgccggcggagataccggtcggtctgctcaccagcctgctgggcgccccctggtttctgtggctggtctttcgtcgggagaactccagacatggttaatgaatactgggcccaggggctgtcacttcaccttggtaaacgacagattatcgacaacgtctccgtcgcgctgcgcggcggcgagatgacggcgcttatcgggccgaacggcgccgggaaatccactctgctgcgcctgttgaccggctatctgactccggacagcggcacccgccatcttgcaggcaagccgctggaggcctggtctcccgaggcgctgtcgcgccggcgggcggtcatgctgcagcgaacggccctgcaggccgactggacggtggaaacggtcattgccatgggacgctcaccgtggggcgcgacggcggatccggcggtgctggcggcggtgatggccgtcaccggctgcgatggccttgccggtcgccgctatcccggcctctccggcggcgagcagcagcgggtacagctggcccgctgtctggcgcagctatggcgcgacggcgcgccgcagggctggctgtttctcgatgagcccacctcggcgctggacctttactatcagcagcacctgctgcgtttgctcaaacggctcaccgccggcgggcaactgcacgtctgcgtggtgctgcatgaccttaacctcgccgccctgtgggccgaccgcatcctgctgctccaccagggacatctggtcgcccagggcacgccgcaggaggtgatccagcagccggttatccatcgctggtacggggcggatgtccgcctcgtccagcacccggacaacgcggtcccccaggtttatctggcgccgtaa

SEQ ID NO: 2943 - DNA, 342 bp, Klebsiella pneumoniae
acttgccatcgctatattgctgaccgcggtcggtcggttttgaggaacaggcggcgagcatggccagcattgcacccgtcgctacatattttgcccaacgtcctttcatggtgtctcatcttttgctgcgaagccttagtgcgtgttgaagataacaaagcgccggagctattgaaatgcgcgatctcatcgatggcacagatttgtgtaaaaaaacaccacaacgtggcgttttataagccaattcttacaaaaatgtcgatttggtcgaaaaaaggttgcatcatctcgctagcggagtatagtgcgcttccacggacgcggggtggagcagcctggtag

SEQ ID NO: 2944 - DNA, 372 bp, Klebsiella pneumoniae
aaggcgcatcgcgatacggaggcgactatgcacgaaatcaccctcagccagcgggcgctggaaattattgaacaacaggcgcagcaggccggcgcgcggcgggttaccggcgtgtggctcaaggtcggcgcattttcctgcgtggaagccagcgccctgaccttctgctttgagctggtctgccgcggcacgctggcggaggggtgcgaactgcatatcgccgaacaacaggctgaatgctggtgcgatcgctgtcagcagtacgtccatcttgtctcgcagcacgttcgccgctgcccgcactgcaataacgaccagctgcagatcgtggcggatgacggcttacagattcagcgtttagaattggagtaa

SEQ ID NO: 2945 - DNA, 924 bp, Klebsiella pneumoniae
ccggcgggtcgccatgccactatgcgccctggcgaaggtaagcggaaaggtgaaaacgtggctgttgcacaatgtcccgcctcgtgcggagaacttatccagggctggatcctcggcagcgaaaagctggtctcctgtccggtggactggtacagcaccgtcgaggtcgagaccggggtaccgcgaaaagacgagcggccgctgtcgcgggcgatggtcgaccagctgctggcccactggggctaccccccagcgctgagccagcagatccgcatcaccctgcactcaacgatcccggtggccaaagggatggccagcagcaccgccgatatcgctgccaccgccgtcgccaccgcccatcatctgggccatctactggatgagccgacgctggcgcgcctgtgcgtcgcgctggagcctaccgacagcaccctgtttcgcgagctgacgctgttcgaccataataccgccgccacgcaaatcgcctgtccccctccgccggcgctcgacctgttagtgctggagagcccgctgacgctgcgcaccaccgactatcaccagctgccgcgcgagccgggcctgttggcaaacgcctcccggctgcagctggcgtgggagaaagtacagcaggcctgccactgcggcagcccgcagcttctgggcgaagcagcaaccatcagcgccattgccagccagcagctgttgcctaagccggggtttgacgtgctgctggacctggtggaaagcgcagggctctatggtctcaacgtggcgcacagcggcagcgtcgtcggcctgctgctggaccgccgtcggcatgacgtcgaatttctgcaatggcggctggcagacagcgacatcgccgcccactggccgcagcagcatctgctggcgatggtgcgcgggggcgtcatcctgcagtag

SEQ ID NO: 2946 - DNA, 1551 bp, Klebsiella pneumoniae
cggtctctccggcggtctgttcaatatgttcggcaatatctccggcatcgtcaccccaatcgccatcggctatatcgtcggcaccaccggctcgttcaacggcgcgctgatctacgtcggtatccatgccctggtggcggtgctgagctatctggtgctggtgggcgatatcaaacgtatcgaactgaaacctgtagcgggacgttaatcatgactactcaatccagcccgattatcacagagatgaaggtcattccggtggccgggcacgacagcatgctgctgaacatcggcggagcgcataacgcatggtttacccgcaatatcgtggtgttaaccgataacgccggccataccggcgtcggcgaagcgcccggcggagaggtcatctaccagacgctgctggcggcgatcccgcaggtggtgggccaggaggtcgcccgactcaatcgcgtggtgcagcaggtgcacaaaggcaatcaggcggcggatttcgacaccttcggcaaaggggcgtggaccttcgaactgaaggttaacgcggtggcggcgctggaagcggcgctgctcgacctgctcggccaggtgcttaatgtgccggtctgcgagctgctgggcccgggtaagcagcgtgatgccgtcaccgtgctgggctacctgttctatatcggcgatcggcagaaaaccgaccttggttatctggaccatacgccgggcgatcacgaatggtaccgcctgcgccaccagcaggcgttgagcagcgaggcgatagtgcgtctggcggaagccgcccaggatcgctacggtttcaaagactttaagctcaaaggcggcgtgctgcccggcgagcaggagattgacaccgcgcgggcgctgaaaaagcgtttcccggatgcgcgcatcaccgtcgaccctaacggcgcctggctgctggatgaggccatcgcgctgtgtaaagggctgcaggatgttctgacctacgccgaagatccgtgcggcgccgagcagggtttctccggccgggaggtgatggccgagttccgccgcgccaccgggctgccggtcgccaccaatatgatagccactaactggcgcgaaatgggccatgcggtgatgctcaacgccgtcgatatcccgctggcggacccgcacttctggacgctctccggcgcggtgcgggtggcgcagctgtgcgacgactgggggctcacctggggctgccattccaacaaccactttgatatttccctggcgatgtttacccacgtcggcgccgccgcgccgggcaaccccaccgccatcgatacccactggatctggcaggagggcgacgcgcgcctgaccaaaaatccgctgcagattattaacggcagcattgccgtgccagacgcgccgggactcggcgtggaacttgactgggagcaggtgcgcagagcccatgaggcctataaagcgctgccgggcggcgcgcgcaacgacgcgggcccgatgcagtacctgatccccggctggacattcgaccgcaaacgtcccgttttcggccgccactaa

SEQ ID NO: 2947 - DNA, 411 bp, Klebsiella pneumoniae
cctgtgatccgccagcgtggaatgtcgtcgctgctgatggtgctcctgttgctgaccctcggcagcctgttactcgaggggcttaacctgcagcagcgggcgctgctggcgcaaaccgccagcgaaacgcaggcgatccgcgatacggcgatagcccattccgcgctgcagtggggaaaacagcaggtctggtcggcgcaggtggcgctggcctgccgggagcaggcgccgcagggctggcgcgcctgtctgcgtatcttcggcgacggttcactggtgctcagcagcgccagcggcgaggtgcaggtctggcagtccggcgaggtgcgcggcgggcaggtgcgtttttccgcccacggctggagcgatttttgcccgctcagggaggcgagcttatgtcaaatgccctga

SEQ ID NO: 2948 - DNA, 1512 bp, Klebsiella pneumoniae
acaccggtccgtttggcgaaaccatcggcggcgataagcgcccggtgcgccaggtcagcgccagctgatggcccggagcgcgaccatgagacagcataccggaggagggcagcgatgagtgcagaaccgcatatcgtgattatcggcggcggctttagcggcgcggcggtggcgattgagctgctgcgcctggcgccgaatggggtgcgcgtgacgctgctggagccgcgccagtcccccggggccggggtggcctactccactgcggagccgacgcaccggattaacgttccggccgctcgcatgcagctggccggcgacgaagagggcgccttcgatcattggtatcgccatcagcctgtctttaccgtcgatgtgcaggcgctgcgtccggacggttccgtctaccctcagcgcggccagtttggtcgctatgtggcgcagcgttttgccgacgccgcggcgtccagcggcggacggcttcgccacctgcgcgatcgggcgctcgcttttcatcaggggacggtgaccaccgacggcggcctgcagcttaaggccgatctgctggtgctggcgatcagtcatccaccgccttcgctgccggcacaggccgaagcctggcgtcatcatccggcgctgattgccaacccgtggcagccaggcgcgctcgatgccatcgccccgcacgcccgggtggcggtgatgggcaccggattaaccatggccgatacggtcgcgacgctggaccggctgggccaccgcggcagtatcgtcgccttttcgcgccatggcctgctgtcgcgcggcaaccttagcggcgcaggggcaacctggcctggcgactatcagcagggcagcctgcgccagcgcctgcgccagatccgcctcgacgtcgcgtatgcggcgcagcagggcctgagctggcaggtggtgctggatgcggttcgtcagcaggggcaacggatctggcaggcgctcagcgtcgccgatcgccagcgttttctgcgccatctgcgccattactgggatgtccaccgctaccgcgtggcgccgcaggtcgccgaggtgctggaggcgcgccagcgcacgggcagtctgcaggtgcaggcggccaggctactgtcgataagcggtgaaggcgaaacgctgcgtctgacgctggcgcggcgcggcggcggcgtgcagacgctgagcgtcgatcacctgatcctgaccaccggacccgcacaccgcgccctgaccgacagccagccatttttacaggacctcgcccgccgcggcctgattcgcgccgatgccctcggcatgggcctggaggtggacagccgttcccgggcagtggctgagccgcacgttgaggcgctgccggtgctggtggccggtccggccgcccgcgggcgttttggcgaactgatgggcctgccgcaggtagccgaccatgccgctgacgtggcggcgcaagcgttactcacgctcgggatcccgcaggactcccgatgtcctgcgtactga

SEQ ID NO: 2949 - DNA, 831 bp, Klebsiella pneumoniae
agggcagcccgcatgatgcgctggttactgctcttgatcgctttcccgctgctgagtcacgccgccgttgagcggctcgtcacactcggcggagatgtcactgagatcgtttatgcccttcacgcggaggagagcctggtggcgcgggacagcaccagcagctggcccccggcggcgcaaaagctgccggacgtcggctacctgcgacagctgaacgccgaggggatcctcgcgttacgcccgcagctggtgttagcgagcgcccaggcgcagccctcgctggtcttacacaaagtgcaggcgagcggggtgaaggtggtgaacgtgccgggcggcgaaagtctgtccgcgatcgataacaaagtggccgtcattgccgaagcgttaggcaaaacggcggcaggcgacgcgctgcgccagcagcttcagcagcagatcgccgccattccaacgcagccggttgctaagcgggtgctgtttattctcagccacggcggaatgaataccctggtggccggacagcataccgcggccgatggcgccattcgcgccgccggattgcagaacgcgatgcagggcttcgaccactatcgcgccatgtcgcaggaaggggtcgccgccagccaggcggatctggtggtgatctccgccgatggtctcaaagggatgggcggcgaagccgggctgtggaaactgcccggcctggcgcagaccccggcggggcgtcataaacagctgctgacgatcgacgatatggccctgctgggcttcgggccgcgcacaccgcaggcgataatcgcgctgagaaacaaagcggagcagttgccctga

SEQ ID NO: 2950 - DNA, 1176 bp, Klebsiella pneumoniae
cacttacgccgaggcgacgcgccacgtcgaccaggggctgtcgctgaccctgttcttcccccgataccgccaccacccgcgatatcaacaaggcgcaaatttacgcctggaagaaaggcatcaagacactctactacatccgtctgcgccagctggcgctggaaggcactgaaattgaaggctgcgtgtcctgcgcgctgtaaggagaacaggatgacccatttaacgcgcgtcagcgcaatcaactggaaccgcattgatgacgataaagatcttgaggtctggaaccgtctcaccagcaacttctggctaccggagaaagtgccgctgtcgaacgacattcccgcctggcaaaccctcagcgcggcggagcagcagttgaccattcgcgtctttaccggattgaccctgcttgacaccattcagaacaccgtcggcgccccggcgctaatggcggacgccttaaccccgcatgaggaggcggtgctgtcgaacatcagctttatggaggcggttcatgcccgctcttacagctccatcttttccacgctgtgccacagcaaggaagtggatgccgccttcgcctggagcgaaagctgcgatcccctgcagcgcaaggcgcagctgatgctgggttactatcaggccgacgagccgctgaagaaaaaaatcgccagcgtgttcctcgaatcctttctcttctactccggcttctggctgccgatgtacttctccagccggggaaagctgaccaacactgcggatctgatccgcctgatcattcgcgatgaagcggtgcatggctattacatcggctacaagtaccagaaaggactggagatcgtcagccccggcaagcgcgaagaattgaaaaatttcgccctcgatctgctgatggatctttacgacaacgaactggcctacagccgggagctgtacggcgagagcggctggttcgacgacgtcagcgctttcctgtgctacaacgccaacaaagcgctgatgaacctcggctacgaggcgctgttcccggcggagatggcggcggtcaatccggcaatcctcgcagcgctgtcgcccaacgccgacgaaaaccatgactttttctccggttccggctcctcctacgtgataggaaaaatggaagagaccgccgacgacgattgggacttttaa

SEQ ID NO: 2951 - DNA, 462 bp, Klebsiella pneumoniae
ggcgttagccgccacccgacaaaaaaaaggcaccgcgggtcgctcgggttaggcgctcgcgccgtgaccagggctgttcccgccccccttaaggagagacctatggttactgcattaatcatcgtcgccgccatcgcctggcttacccagctggcctttggcggctggcagatccgccgcttcaatcgcgcctttgatagcctgtgccagcaggggcgggtgggcgtcggccgctccgccgggcgctttcaaccgcgcgccatcgtcgccatcgccgtcgatgataacgaccgcattagcgacacgctgctgatgaaaggcttcaccattttcgccagtccgcgaaagatcccggctctggcaggcaaacatattgcggaattgcagcctgatgtgatctttccccatgatccgcgctgtcagaatgcactatcattagcgcttaatccgaaacatggataa

SEQ ID NO: 2952 - DNA, 1419 bp, Klebsiella pneumoniae
cagcagggccgccagcgccggggagagcgtcagcgagttgatggccgagatcaccgtcgagatggcgatggtcaccgcgaactgtttgtagaactgtccggtgaccccggagagaaacgccatcggcacgaacaccgcacacagcaccagcgcaatggcgataatcggcccggagacctcacgcatcgcctgatgcgccgcggcaagcggcgcaagcccttcttcgatattacgctcgacgttctccaccaccacgatggcgtcgtccaccacgataccgatagccagtaccagcccgaacaggctcagggtattcagcgagaagcccagcagatagagaatgctgaaggtacccaccaccgataccggcaccgcgatcagcgggataatcgacgcgcgccaggtctgcaggaacaggatcactaccagcaccaccagcactaccgcctccagcagcgtctgcaccaccgcgcggatggagtcgcggacgaaaaccgtcgggtcgtacggcgccgcccattgcatatcttccgggaagcgggtggccagctcggccattttggcgcgtaccgcgttcgacagatcgatggcgttagcgccgggggactggaagataccgatcccgaccgcatccttattgttgagctgggagcgcagcgcatagctaccggaacccatctcgatgcgcgccacgtcgcgcaggcggaccagcgagccatcctgcgccgttttcagaatgatattgccaaactcttcttcggtatgcagacggccctgggcgttaatggagatcaggaaatcgctctcctgcggcagcggctcggcgccaagctgtccggcagacacctggacgttttgctcctgcatcgccgtcaccacatccgaggccgtcagaccgcgggccgcgaccttattgggatccagccagacgcgcatcgcatattcaccggagccaaaaatctggatctggccgacgccgggcaggcgcgccagctcatccttcactttcagcgtggcgtagttgcgcatatacagcgagtcgtacttaccgtttggcgaaaacagatgcaccaccagggtcagcgtcggagactgcttctgggtggtgatccccagacggcgtacatcctccggcagacgcgcttcggcctgcgcgacgcggttctgcacctgaacctgcgcctgatccgggtcggtacccgggcggaaggtgacggtggtgaccagcacgccgtcggagccggcgaccgatttcatgtacatcatgttttcaacgccgttgatcgcttcctccagcggcgtcgccacggtctcggcaatcactttcgggttggcgccgggatactccgcgcgcacctggacgctcggcgggacgacatccggatattcgctcaccggcagcagtgggatagcgattaa

SEQ ID NO: 2953 - DNA, 261 bp, Klebsiella pneumoniae
atggaaatacgaatcatgcgcattattatttacactcgaaatgactgcgtgcagtgccatgccacccggcgagccatggagagccggggactggcctttgaaatggtcaacgtcgaccagcagccggatgccgccgacaccctgcgcgagcagggatttcgccagctgccggtggtgatcgccggtgagctgcgctggagcggcttccgcccggatatgatcaatcgcctgcgcccctcctttacggcggccagcgcatga

SEQ ID NO: 2954 - DNA, 447 bp, Klebsiella pneumoniae
tggcctcgacgtactgagcaaagtcggtggtttcgatctgctggggatgaccggtgtcatgctgggggcggcgtcctgtgggctgccggtggtgctggatggctttctctcctacgcggcggcgctggcggcgtgtcagatagcgccggaggtgaaaccgtatctgatcccgtcccactattcggcggagaagggggcgcgtatcgcgttggcgcacctgggtctcgaaccgtatctcaatatgggcatgcgtctgggagaaggcagcggcgcggcgctggcgatgccgatcgtcgaggcggcctgcgcgatgtaccatcgcatgggcatgctggcggcaagcaatattgtgttaccgaaggggtaagcaggagatgggggcggcaatggccgttcccgttttcggcagaggttttgccggcggcagaaacaaaaaaacacccttga

SEQ ID NO: 2955 - DNA, 699 bp, Klebsiella pneumoniae
tccccattgcgtgtggttcgtcggcgccggtccgggcgatcgcgaactgattactctcaaaggctaccgtctgctacagcaggcgcaggtagtgatctacgccgggtcgctgatcaacaccgagctactggcctactgtccgccacaggcggagtgccacgacagcgccgcgctgcatctggagcagatcctcgacctgatggaggcgggggtgaaggcgggaaaaacggtggtgcgtctgcagacgggcgacgtctcgctatatggctcggtgcgcgagcagggcgaagagctgacccgccgcgggatccgctggcaggtggtgccgggcgtcagcgctttcctcggcgcggcggcggagctgggggtggagtacacggtacccgaagtctcgcagagtctgattattacccgtctggaagggcgcacgccggttcccgcgcgcgaacagctggaagcctttgccagccatcaaacctcgatggcgatttacctgtcggtgcaacgtattcaccgggtggcggagcggctggtggagggcggctaccccgcgaccaccccggtcgcggtgatctacaaggccacctggccggaaagccagaccgtccgcggtaccctcgcggacatcggcgacaaagtacgcgacgccgggatccgcaaaacggcgctgatcctggtcggccccttcctcggcgatga

SEQ ID NO: 2956 - DNA, 273 bp, Klebsiella pneumoniae
agcaatctgcggttagcctgcgaagtaaattttctgatttcacgggcaaaggcggggcaaacacagattccccttcgtaccgttttatttaacgcaaacgccatcctttgttccgctagccgcgccctgtcgccccgcgacctgtccacaccagcggcgcctaaccctgtggataacctggaggcagttgcctggcagccgcagcccgggcgggctaccggctgccgttcgttttttgaacagggaaaactcccccgccgggcagcgcgctaa

SEQ ID NO: 2957 - DNA, 1080 bp, Klebsiella pneumoniae
cttcttccgcggctgggtcaccgacctgaccacctcgattttcgagagaaaaatggcgattcagctttcccagaaagtgcatctgtcaggagcgacatcatgacccttattcgtatagagaaaggcaccggcggctggggcggcccgcttgagctcgacgccgtcgaaggcaaaaagatcgtctatatcaccgccggcacccgcccggcgatcgttgaccgcatcgccagcctgaccggctggcagccggtggacgggtttaaagagggggaaccagcggaaagcgagatcggcgtggcgattatcgactgcgggggcaccctgcgctgcgggctctatcctaagcgccgcatcccgacggtgaatatccatgccaccggcaaatcagggccgctggcccagtacatcacggaagatatttatgtctccggcgtcaaagaggacaacatccagtgcatcgctcccgacagcgcaggggtttccgagccgccggcggaaaacaagagcgcgggtcgcgattacgacaccagcaagaagattactgaacagagcgatggcctgctggcgaaggtcgggatgggcatgggttcggtggtggcggtgctcttccaggccgggcgcgacaccattgatacggtgctgaaaaccattctgccatttatggctttcgtctcggcgctgatcggcatcatcatggcctccggcatcggcgactggatcgcccacggcctggcgccgctcgccagccatccgctggggttggtaaccctggcgctgatttgctctttcccgctgctgtcgccgtttctcggccccggcgcggttattgcccaggtgatcggcgtgctgatcggcgttcaaatcggcctcggcaacattccgccgcacctcgccctgcccgccctattcgccattaacgcccaggccgcctgcgattttattccggtaggcctgtcgctagccgaagcccgccaggataccgtgcgcgtcggcgtgccgtcggtgctggtcagccgctttctgaccggcgcaccaacggtgctgatcgcgtggttcgtttccggatttatttaccagtaa

SEQ ID NO: 2958 - DNA, 399 bp, Klebsiella pneumoniae
gattggccgcggcacgtccacctacgacgggctatcgctggcgtgggcctgtgcggaaaatctggccaacaaaatcaaggcgctgaccctgttcgccacccactacttcgagctcacccagctgccggagaaaatggaaggcgtcgccaacgtccacctcgacgcgctggagcacggcgataccatcgcctttatgcacagcgtgcaggacggcgcggccagcaagagctatggcctggcggtcgccgcgctggcgggggtgccgaaagaggtgatcaagcgcgcgcggcagaaactgcgcgagctggagagtatctcgcccaacgcggcggcgacccaggtcgacggcacgcagatgtcgctactcgccgccccggaagagacctcgcctgcggttga

SEQ ID NO: 2959 - DNA, 1257 bp, Klebsiella pneumoniae
cgcaatcagcgcggtctggcgcatataggtacttttaccgcccatgttcggcccggtgataatcagcatccgccgctgcggcgccagctgcagcgggttagcgataaacggctctttcagcacctgctcgaccaccggatggcggccttcgctaatgcgaatgcctggcttatcgctaaaggtcgggcagcagtagttcagggtttccgcacgttccgccaggttgaccagcacgtccagctcggccagcgcgctggcgctggtttgcagatcggcgagatgcggcagcagcaggtcgaacagttcgtcataaagctgtttttccagcgccagcgctttgcccttggaggtcagcaccttatcttcgtattccttcagctcaggaataatgtagcgttcggcgttcttcagcgtctggcggcgcacgtagtggatcggcgcgaggtggctctggccgcggctgatctggatgtagtagccgtggacggcgttgtagccgactttcagggtatcgaggcccagccgctcgcgctcgcggatctccagtttatcgagataatcggtggcgccatcggccagcgcccgccactcgtccagctcttcgctatagcctggagcgatgaccccgccgtcgcggaccagcaccggcggcgcgtcgatcaccgcgcgctccagcagttcgcgcagttcggtgaactcgcccattttctcgcgcaatttttgcaccggctgactgtcaacgtcggccagcagctcacgcagcagaggcagttgctgcagggcatgacgcatgcgggcaagatcgcgcggccgggcggtacgcagcgccagacgcgccagaatacgctccagatcgccgacctggcgcagcaccggctgcagctcggtatagcgctcctgcagcgcgccgatggtctgctggcgctccaccagcacggcggtatcgcggaccggcatatgcagccagcgcttgagcatccggctacccatcggcgtcaccgtacagtcgagtaccgaggccagggtgttgtcggtgccgccggccagattctgggtgatctcgaggttacggcgggtggcggcatccataatgatgctgtcctgctggcgttccatggtgatggagcggatgtgcggcagcgaggtacgctgggtgtctttgacatactgcagcaggcagccggcggcgcacaggccgcgcggggcgttttcgacgccgaagccgaccagatcgcgggtgccgaactgcaggtttag

SEQ ID NO: 2960 - DNA, 2127 bp, Klebsiella pneumoniae
aggagtcagcgaattttggcaacgacaaccgcagaacgtataaccgccgccgtggattttcacgccctcaacgcgatgctgaatttgtacgacagcgagggccgcatcccgtttgaaaaagatcgccaggcggttgaggcctttatggcgacccaggttcagcccaacgccctcaccttccccagccaggaggataagctcagctggctcgtcagcgagggctattacgatccgcaggtgctggccggctatgaccgcgggtttgtgctggcgttgttcgcccatgcccggcgcgctccgtttcgctttcagaccttcctcggcgcctggaagttctataccagctatgcgctgaagacctttgacggcaagcactacctcgaggatttcgccgaacgcagcgtgatggtggccctgacgctggcccggggcgatgaacagcaggcgcggcagctgacggaggagatactcagcggccgctttcagcccgccacaccgaccttccttaacgctggcaaacagcagcgcggggagctgatctcctgcttcctgctgcgtattgaggataatatggagtccatcggccgggcggtgaactcggcgctacagctgtcgaagcgcggcggcggggtggcctttttactctccaacctgcgcgaggccggggcgccgatcaagcgcatcgaaaaccagtcttctggggtggtgccggtgatgaagatgctggaggacgccttctcctatgccaatcagctcggcgcccgccagggggcgggtgcggtctggctgcatgttcaccatcccgatattttacgctttcttgatacccggcgtgaaaatgccgatgagaaaatccgcatcaaaaccttgtcgctgggggtggtgatccctgatatcaccttccagctggcgaaagaagatgcgcagatggccctgttctcgccttatgacgtcgaacggctgtacggcaaacctttcgccgattgcgccatcggcgacctctatccgcagctggtggccgacgagcgggtccgcaagcgctggatccgcgcccgcgacctgttccagcgcctggcggagatccagtttgaatccggctacccgtacatcatgtttgaagacaccgtgaaccgcgccagtccggtggccgggcgggtcaccatgagcaatctgtgttcggagatcctgcaggtcagtacgccgtccgcctataatgaagacctcagctatgcgcatatcggggaagatatctcctgcaacctcggctcgctgaacatcgcccataccatggactcgccggatttcggccgcacaatcgccaccgcggtgcgcgccctgaccgccgtgtccgacatgagccacattcagtcggttccctcggtggcggccggcaacgcggcctcccacgccatcggcctggggcagatgaatctgcacggttacctggcgcgggagggcattgcctacggcagcccggaggggctggacttcaccaatatctacttctacaccgtgacctggcacgcgctgcacacctcgatgcagctggcccgcgagcgcggccagcgcttcgccggcttcgagcagtcgcgctacgccagcggggcgtacttcgacaaatatctgcaggaggagtggcagccgaaaaccgaacgggtgcgcacgctgttcgcccgcgccggcatctctctgcccgaccgggaaagctggcgccagctgcgcgacgatgtcatgcgctatggcatctacaatcgctatctgcaggcggtgccgcccaccggctcgatctcgtacatcaaccatgccacctccagcattcacccgatcgtctcgaagattgagatccgcaaagaggggaaaaccgggcgggtgtactaccccgcgccatttatgaataacgacaatctggccctctaccaggatgcgtatgagatagggccggagaagatcattgacacttacgccgaggcgacgcgccacgtcgaccaggggctgtcgctgaccctgttcttcccccgataccgccaccacccgcgatatcaacaaggcgcaaatttacgcctggaagaaaggcatcaagacactctactacatccgtctgcgccagctggcgctggaaggcactga

SEQ ID NO: 2961 - DNA, 717 bp, Klebsiella pneumoniae
tgtgggtggcgtcaagcctggcgctggcgctgtttatcggcgtgcgctactggctggtcggcgcggcctgaggagaacctgatgcagtacatccaacaaccgcaggcgatcgaggcgaaaagcttcgacatcatcagcgagatcatcgccgaaacgcgaccggactaccgtttcgccagcccgctgcacgaggcgattatcaagcgggtgatccacaccaccgctgacttcgactggctggatattctgtggttttctccggatgccctgatcgcgctgagtgaggccttgagcaggccctgcacgctgtataccgataccaccatggcgctgtccgggatcaacaaaaccctgctggcccgctttggcggcgaatgccgctgctatatcagcgacccgcgggtggtgcgcgaggcgcaaagccgggggatgacccgctcgatggcggcggtggatattgcggtgcaggagcccggggagaaagtgttcgtcttcggcaatgcgccaaccgcactgtttcgcctgctggaacatcgcgagaccgccatcggcggcgtggtgggggtgccggtcgggttcgtcggcgccgcggagtcgaaagcggcgctcagcgagagcggcctgccggccatcgccgcgctcggccgcaaagggggaagcaacgtggcggcagcgattgtgaacgctctgctttaccacctgcgggaggcgcaatga

SEQ ID NO: 2962 - DNA, 1467 bp, Klebsiella pneumoniae
tctacccggcgctctcctatcctactgccattcgcgccaccggggtcggtttcagccgggcactctccgggatcggcagcgcgctggcgttgtttattctgccgctgctgcaggcctccctcggcacgcagatgttctgggtggtctcgcttgccgccattattcccattttcttcctgctggcggtccgtcatgaaccgacgcgagaagatatcgacgcacttcatgaataaggaactgacaatgaccctgctctctactggcaccgattatgacgcgctggcggccgccttccgcccgatattcacccgtatcgcccagggcgctgcggagcgcgaacagcagcgcattctgcccgatgagccgatccgctggctgaaagaagcgggcttcggcacgctgcgtatcccgcgcgagaagggcggctggggcgcttcgctgccgcagctcagcgcgctgctgatcgagctggcgcaagcggactctaacctgccgcaggccctgcgcgcgcactttgcctttgtggaagatcagctgaatcagccggattccgccgggcgcgaccgctggtttcgtcgcttcctcgacggtgagctggtgggcagcggctggacggagatcggcgcggttaagctgggagaggtgaacaccagagtgacgccggcagagggcggctggcgactcgacggcgagaagttttacagcaccggcgcgctgtacgccgactggatcgatgtgtttgcccggcgcagtgataccgccagcgatgtgatagccctggtcagcacccagcagaccggcgtggtgcgggaagatgactgggatggctttggccagcggttgaccggcagcgggaccacccgctttaccggcgctcgggtggaaaccgaacatgtctatgattttgcccagcgctttcgctatcagaccgccttctaccagcatgtgctgctggcgaccctcgcgggcattggcctggcggttgagcgggatgccgcgcagggcgtcaaacatcgctcccggatgtacagccacggcaacgccgccgtgccgcgcgatgacgcccaggttctgcaggtcgttgggcagatcagcagctgggcatgggcgacccgggccgcggtcctgcaggccgcggaatcgctgcagcaggcctatgtggcgcacgtcagcgacgacgaagcattgattgcccggtgtaaccagctggcggaagtggaagcggcgcaggcgcaggtgatcgccagcgactggatcccgcgggcggcgacggagctgtttaatgccctcggggcgtcggatacgcgaactcgccttgcgctggatcgccactggcgcaatgcgcggacggttgcctcgcataatccggtgatttataaggcacgtaatatcggtaactggctggtgaacggtgaagcgcccacctttatctggcagataggcaatggtgagaaaacggcggggtaa

SEQ ID NO: 2963 - DNA, 186 bp, Klebsiella pneumoniae
gtgtttcagctttatcattatttttttcccacgttatgtttgttaacacgaaccgataacggaggggaaatttacggatcaaaaacggaaatgtacatccacttacggaaagcgctttccataattgcctatctggttcacaaaattagctctgcggcgaatatattcgtgagaatgatcacataa

SEQ ID NO: 2964 - DNA, 492 bp, Klebsiella pneumoniae
aaaatgcttagagcatgcatctcatgctacggagaaaccgatatgactatttgggaaataagtgaaaaggcggattacatcgccgaccgtcaccggcagcagcaggagcagtggcacatctactgtaactcgctggttcaggggatcaccttgtcgaaggcccgcctgcatcacgcgatgagctgcgcgccggacaaagagctgtgcttcgtgctgttcggccattttcaggtgttcgtcgccctcgcggaaggcttcaacagccacaccatcgagtactacgtcgaaaacaaaaacggcggtgataagtatctgattgctcaggccaccctcgcaatggatggcacggtggacggccgcatcagcaaccgctcccgcgaccaggtgctggagcactatctggcgattatcgccaccgtctatgaccgtctgtatgacgccatggaacaagaccaaccggtggatttaagccatctggcgctgacccactga

SEQ ID NO: 2965 - DNA, 879 bp, Klebsiella pneumoniae
cagatgaatagtggctacctgcattttccggagttcgatccggtcattttttctctaggcccggtctccctccactggtacggtttgatgtacctggtgggctttgtctttgcgatgtggctggccacccgtcgggcgaatcgtccgggcagcggctggacgaaaaatgaagtggaaaacctgctctacgcgggcttcctcggcgtcttcctgggcggccgtatcggctacgtgctgttttacaacctgccggtatttcttgccgatccgctgtatctgttccgcgtctgggacggcggcatgtcgttccacggcggcctgatcggcgtgatcctggtgatgattatcttcgccagacgcaccaaacgcaccttcttccaggtctccgattttatcgcgccgctgatcccgtttggtcttggcgccgggcgtctgggcaactttatcaacggcgagctgtggggccgcgtagacccgagcttccactacacgatgattttcccgggctcccgtgccgaagacctggcgctgctgccgacgcatccggaatggcaatcgctgttcgatacctacggcgcgctgccgcgtcacgcgtcgcagctgtacgagctggcgctggaaggcgtggtactgttcctgatcctcaacctgtttatccgtaaaccgcgcccgaccggctccgtttccggtctgttcctgattggctacggcctgttccgcatcatcgtggaattcttccgccagcccgacgcccagttcaccggcggctgggtgcagtacatcagcatggggcagattctttcgatcccgatggtgcttgcgggtatcattatgatggtttgggcttaccgccaccgtccgcagccacagaattcttga

SEQ ID NO: 2966 - DNA, 2646 bp, Klebsiella pneumoniae
cttgatttcaggataattatgagcaagagcaccgctgagatccgtcaggcgtttctcgactttttccatagcaagggacatcaggtagttgccagcagctccctggtgccgcacaacgatccgaccctgctgtttaccaatgcagggatgaaccagttcaaggatgtcttccttggtctcgacaaacgtaattattcgcgtgcgaccaccgcacagcgttgcgtgcgtgcgggtggtaaacacaacgatctggaaaacgtcggttacaccgcgcgtcaccacaccttctttgaaatgctgggcaacttcagctttggcgattacttcaagcaggatgccatcaaatacgcgtgggaactgctgaccggtgagaactggttcgcgctgccgaaagaaaaactgtgggttaccgtttacgagaccgatgacgaagctttcgacatctgggccaatgaagtaggcgttccgcgcgagcgtattatccgcataggcgacaacaaaggcgcgccgtttgcttctgacaacttctggcagatgggcgacaccggtccgtgcggcccgtgcaccgaaatcttctttgaccacggcgatcacatctggggcggccctccgggaagcccggaagaagatggcgaccgttacattgagatttggaacatcgtcttcatgcagttcaaccgtcaggctgacggtaccatggagccgctgccgaagccgtccgtcgacaccggtatgggtctggagcgtattgccgcggtgctgcagcacgttaactccaactatgacatcgacctgttccgcgatctgatcgccagcgtggcgaaagtcaccggcgcgaccgatctgacgaacaagtcgctgcgcgttatcgccgaccacattcgctcctgcgccttcctggttgccgacggcgtgatcccgtcgaatgaaaaccgcggctacgtgctgcgtcgtatcattcgccgcgcgatccgtcacggcaacatgctgggcgcgaaggacaccttcttctggaaactggttgccccgctgatcgatgtgatgggctccgccggcgacgagctgaagcagcagcaggctcaggttgagcaggtgctgaaaaccgaagaagagcagtttgcccgcaccctcgagcgcggcctggcgctgctggatgaggagctgtcgaagctgaaaggcgacaccctggacggcgaaaccgccttccgtctgtacgacacctacggcttcccggtcgacctgaccgccgatgtgtgccgcgagcgcaacatcaaggttgatgaagctggttttgaagccgcaatggaagagcagcgccgccgcgcgcgcgagtccagcggtttcggcgccgactataatgcgatgatccgcgttgacggcgcctctgaatttaaaggctacgatcatctggagctgaacggcaaggttaccgccctgtttatcgacggcaaagcggtggatagcgttagcgctggccaggaagcggtggtgatccttgaccagaccccgttctatgcggagtccggcggccaggtgggcgataaaggcgaattaaaaggcgcgggcttctctttcgcagttagcgacacgcagaagtacggccaggctattggtcatatcggtaaagtcgccagcggcacactgaaagtgggtgacgcggtgcaggccgacgtagatgaggctcgccgtcagcgtatccgtctcaaccactccgcgacgcacctgatgcacgcggcgctgcgccaggtgctcggcacccatgtggcgcagaaaggttcgctggtcaatgataaagcgctgcgctttgacttctcgcattttgaagcgatgaagccggaagaaattcgtgcggtggaagacctggtcaacgcgcagatccgtcgtaacctggctatcgaaaccaacattatggatatcgatgccgcgcgcgcatccggcgccatggcgctgtttggcgagaaatacgacgatcgcgtgcgcgttctgcggatgggcgacttctccacggagctgtgcggcgggactcacgcggcgcgtaccggcgatatcggcctgttccgcatcacgtcagagtctggcaccgctgctggcgtgcgccgtatcgaagcggtgactggcgaaggcgcgatggccatcctgcatgcgcagagcgatcagcttaatgatatcgctcagctgctgaagggtgacagccacaatctcggcgagaaggttcgcgccgcgctggagcgtacccgtcagctggaaaaagagctgcagcagctgaaagagcaggctgcggcgcaggagagcgcaaacctctccagcaaagcggaagagattaacggcgttaagctgctggtcagcgaactgaccggcgttgagccgaaaatgctgcgtaccatggttgacgatctgaagaaccagctcggttcgacgatcgttgtattagctacggtagcggatggtaaggtttctctgattgcaggtgtgtctaaggatgtgacagaccgcgtgaaagcaggggagctggttggtatggtcgctcagcaggtgggcggtaaagggggcggtcgtccggatatggcgcaggccggtggtaccgatgcgtctgctctccctgcagcgttagccagtgtgaaaggctgggtcagcgcaaaactgtaa

SEQ ID NO: 2967 - DNA, 225 bp, Klebsiella pneumoniae
atgaccttcagcacttcgcctaccagctccggatccagcgccgaggtcggttcgtcaaacagcataatgtccggcttcagcgccagcgcccgggcgatcgccacgcgctgctgctggccgccggagagctgtccggggtacttgtgggcatgggccagcaggccgacgcggtcgagcagcgccagggcctgctcgcgggcgaccggctggtccagcagctggtga

SEQ ID NO: 2968 - DNA, 375 bp, Klebsiella pneumoniae
cgaggaatcagtatgtatttaagacccgatgaggtggcgcgtgttcttgaaaaagccggcttcaccatggatgttgtgacgcaaaaagcgtacggctatcgccgcggcgataattatgtttatgtgaaccgcgaagcgcgcatggggcgaacagcgttagttattcatccggcgttaaaagagcgcagcaatatgctggccgaaccggcttcagatatcaaaacctgtgatcattatgaacagtttccgctgtatttagccggggatgcgcaacaacattatggtattccgcatggatttagctcacgcatggcgcttgagcgttttctgaatgggctatttggcgaagcccagccggcaatgtcgacgaattaa

SEQ ID NO: 2969 - DNA, 1839 bp, Klebsiella pneumoniae
accaaatggctacaatattgcaacacagcaacatcgacccagaggtgccctgtggcaggcaatccctttcttctcgcaccagaggttaatgcgaatcccctgctgagcgattcgtggtctcgctgccagcgctacgggctggatcccgccaccgaggattttccccgcctcggcgccggcgagctggcggaccggctcgccagccaccgcggcctgcagcagctggcgcagccggtggtggaagccctgtcgcgccaggtcgcagacctgcagtcggtggtgatcctttccgaccccgacggcctggtgctgcatactctcggcgatacccaggcgctgcaaaaggcccagcgcgtggcgctggctcccggcaatctgtggagtgaaagcgggcgcgggaccaacgccatcggcaccgcgctggcgattgacgatggctgcgagatcgatggccgtcagcactttcttacccgcaaccagaatctgtactgcgcggcgatgccgctccagcgaccggacggaagcatcgccggggtgctggatatctccggcccggcgaattttccccaccagcacacctttggctgggtaaaagcggcggcaaagcaaattgaatatctgtgggtgaaacagagtctgcatcctgagcagtggctgatgagcctgcaccggcaggtggacaaactcgacagcgtcgaggagctgctgctggtcttttccgacaacgtcctcaccgccggcaaccggctggcgatgcgcgagttcggcctgagcgcggcgcagtttggccagctcacctttgcctcgctttttccgacgctgacgcaaacggcggtcagcgtcccgctgccgctgaccacgccgcagggccgctaccactatcgcctgcgggagcccacccgccgccgggtggcggtaagcgccccgccggccatgcatctcccctttaccagcccgcgcgaaggcgaaaagctgctgcggctgctcaacgccggcatcgccctgtgcattgaaggagaaaccggcagcggcaaagagtatgtcagccgcacgttgcaccggcacagccgctggcgcagcggtaaatttgtcgccattaactgcgccgccattccggaatcgctgatcgaatccgagctcttcggctaccagccgggggcgtttaccggcgccagcaaaaatggctatatcggtaaaatccgcgaggctgacggcggggtgctgtttcttgatgagatcggcgatatgccgctggcgctgcagacccgcctcctgcgcgtcctgcaggagaaagaggtcgctccgctgggcgccagccgcagcgtgccggtgaatttcgccttgatctgcgccacccaccgcaacctgacccagcgggtcagcgccggagaattccgtgaagatctgctgtggcgcctgcgggaatacgccctggcgctgcctccgctgcgcgagtggccggcgctggaaacctttatcgccaccctgtggcacgacctgggcggtgcttcacgccgggtgacgctttcaaacgcgctgctggttcacctcagccagctgccatggccgggaaacgtacgccagctgcagagcgtcctgaaggtaatgctggctctcgccgatgagggcgacacgctgacgcccgacgcgctgccggaggcgtatcgcgccgcgcctgcgccgttgccgcgcgggggattgcaggcccatgatgagcagttgattgtcgataccctggccagggtcaacggcaacgtcagccgggcggcgcagatgctgggtatcgcccgcagcacgttgtaccgccgtgccgcccgtgccggacggcctcgtcgctga

SEQ ID NO: 2970 - DNA, 204 bp, Klebsiella pneumoniae
tcgtcggccagcgcccggctcaacggactgagacaaaacatcatcgtcggcaccgtcgccagcgccaccgcccgcccggcggtaacgggcaacaaggcatactcccgcaccctggctgttgttattcttttcatgctggcgccgtccggtaagctcatcaaaaaggggaattactgctgggcgaaatcgctgacgccgccgtag

SEQ ID NO: 2971 - DNA, 2463 bp, Klebsiella pneumoniae
atgccccgcagtttatggttcaaggtttttgttgtgctggccgccctctgggcgccgtttagtcaggccgacaccggatggcagccgattcaggagacgatccgcaaaagcgaaaaagatacgcgtcagtatcaggcgatccgccttgataacgacatggtcgtgctgctggtttccgatccgcaggcggtgaaatcgctgtcggcgctggtggtgccggtgggatccctgcaggatccggcagatcatcaggggctggcgcattttctggaacatatgacgctgatggggtcgcaaaaatatccccagcctgacagccttgcagagtttcttaagctgcacggcggcagccataacgccagtaccgcgccctaccgcaccgcgttttatcttgaagtggaaaatgatgcgctggacggggccgtatatcgcctggccgacgccatcgccgcgccgctgctggataaaaaatatgccgaccgcgaacgtaacgcggtcaacgccgagctgacgatggcccggacgcgagacgggatgcgcatggcccaggtcagcgcggagaccatcaacccggctcacccggcggcccacttctccggtggcaacctcgagacgctcagcgataagcccggcagcccggtgcttgatgcgctgcacaccttccgcgatagctggtactccgccaatctgatgaaagcggtgatctacagcaacaagccgttgccggcgctggcgcgcatggctgcggacacctttggccgcgtgccgaatcgtcagatcagcaggccggaaattaccgtcccggtggtcacggatgcgcaaaaaggcatcattattcactatgtgccggcgatgccgcgtaaagtgctgcgcgtcgagtttcgcatcgacaacaacagcgatcgcttccgcagcaaaaccgatgagctggtcacctatcttatcggcaaccgcagcccgggcacgctctctgactggttgcaaaaacaaggtctggcggaaggtatccgcgccgattccgatccggtggtaaacggcaacagcggcgtactggcgatctcagccaccctcaccgacaaaggcctggcgcaccgcgatgaagtgacggcggccattttcagctacctcggcctcctgcgtactcagggcatcgataaacggtacttcgacgaactggcgcatgtactggcgctggatttccgctatccgtcgatcaaccgcgacatggactacgtggaatggctggcggataccatgatccgagtgccggtcgagcatgcgctggacgtggtgaatattgccgaccagtacgacccgcaggcgatcaaagaccggctggcgatgatgaccccgcagaacgcccgtatctggtatatcagcccccaggagccgcataacaagacggcctactttgtcgatgcgccgtatcaggtggataagattagcgagcagacgttcgctgactggcagcacaaatcgcaggccatccagctgcagctgccggcgctcaacccctatattccggatgacttcacccttatcaaaagcgataaagcctggccgcatccgcagctgatcctggatgaaccgacgctgcgggtggtgtatgccccgagccagtattttgccagcgagccgaaggcggacatctccctggtgctgcgtaaccctcaggcgatggacagcgctcgccggcaggtgatgtttgccctcaacgattatctcgccggcatcgccctcgaccagctcagtaaccaggcggcggtcggcggcatttcgttctctaccggcgctaataacggattaatggtcaatgccaacggctatacccagcatcttccggcgctgttcagcgatctgttgcagggatacttcagctatacgccgactgaggagcagctggagcaggccaaatcctggtatgcgcagatgatggattccgccgagaaaggcaaagcctacgatcaggcgataatgccgatccagatggtctcgcaggtgccgtacttccagcgcgaagtgcgccgggcgctgctgccctccattacccttaaagaggtgctcgactaccgcgccaacctgaaaaccagggggcgtcctgaactgatggtgatcggcaatatgaccgccgatgccgccacgaccctggcccgccagatccagcagcagctgggcgctgatggcaacgaatggtgccgcaataaagacgtggtggtgaaccggcagcagctggcgatcttcaacaaagcgggcaatagcaccgactccgcgctggccgcggtgttcgcgccgcccaatgttgatgagttcagcagcaccgccgccagcaccctgctgggacagattattcagccgtggttctacaaacagctgcgtaccgaagagcaactcggctacgcggtctttgccttccccgatgaacgtggggcgccagtggggcatgggtttcctgctgcagagtag

SEQ ID NO: 2972 - DNA, 294 bp, Klebsiella pneumoniae
ttgacgcggctcacaaaaaataatcatgaaaattcccctttgaatattcaggttgatgatgaagaccattattcaccctatcccacggtagccgacgatatttctgttgccctgccgttgatggatgatgagtcaccaaaagaggaacgcaatggaaagaaacagactggcccggcagattatcgatacctgcctggaaatgacccgcctggggttaaatcaggggaccgccggcaatgtcagcgtgcgctatcagggaggaatgctgatcacccctaccggtatcccatatga

SEQ ID NO: 2973 - DNA, 669 bp, Klebsiella pneumoniae
accggcagcagctggcgatcttcaacaaagcgggcaatagcaccgactccgcgctggccgcggtgttcgcgccgcccaatgttgatgagttcagcagcaccgccgccagcaccctgctgggacagattattcagccgtggttctacaaacagctgcgtaccgaagagcaactcggctacgcggtctttgccttccccgatgaacgtggggcgccagtggggcatgggtttcctgctgcagagtagcgataagcagccggctttcatttggcagcggttccaggctttcttccccaccgcggaggcgaagctgcgggcgatgaagccggaagagtttgctcagctccagcaggcggtgataagccagatgctgcaggcgccgcagacgctgggcgatgaagcctcgaaactgagcaaagatttcgatcgcggtaatatgcgttttgattcacgtgataaagtagtggctcagattaaactgctgacgccgcaaaaacttgccgacttcttccatcagacggtggtggatccgcagggcatgacgatcttgtcccagatttccggtagccagaatggcaaagcggactatgcccagccgaaaggcggcaaagtgtgggaaaacgtcagcgcattgcagcaatccttacccctgatgcgagagaatgaatga

SEQ ID NO: 2974 - DNA, 816 bp, Klebsiella pneumoniae
ccaatgagcagcaatgagctggttgaacagatcatggcgcaagtcatagcccgtgtggcgacgccagagcagcaggcgcttcccgataccccccatcccacaggagagacggctatggcagagaaaagctgcagcttaacggaatttgtcgggaccgccattggcgacaccctcgggctggtcatcgccaacgtggatgccgcgttgctggaggcgatgaagctcgaaaaacgctatcgctctatcggcatcctcggcgcccgcaccggcgccgggccgcacatcatggccgccgatgaagcggtcaaagccaccaacaccgaagtggtcagcattgagcttcctcgcgacaccaaaggcggcgccggccatggctcgctgattgtgctgggcgggaatgatgtttccgacgtcaaacgcgggattgaggtcgcgctgaaagagctggaccgtaccttcggcgatgtctacggcaacgaagcgggtcatattgagctgcagtataccgcgcgcgccagttatgccctggaaaaagcgttcggcgccccactgggccgcgcctgcggcattatcgtcggcgccccggcgtccgttggcgtgctgatggccgataccgcgctgaaatcagccaacgtcgaggtggtggcttactgctcaccggcccacggcaccagtttcagcaacgaagccattctggtgatttccggcgactctggcgcggtgcgccaggcggtgatctccgcccgggaaatcggcaaaaccgtactggcgacgctgggcgccgaaccgaaaaacgatcgcccctcctacatttaa

SEQ ID NO: 2975 - DNA, 273 bp, Klebsiella pneumoniae
ctcgtcgggctcataacccgaaggtcgtcggttcaaatccggcccccgcaaccaatcaaatttgacaaagtgaagcagtacggtgacgcggggtggagcagcctggtagctcgtcgggctcataacccgaaggtcgtcggttcaaatccggcccccgcaaccaacattacaaacaccctcaagggtgtttttttgtttctgccgccggcaaaacctctgccgaaaacgggaacggccattgccgcccccatctcctgcttaccccttcggtaa

SEQ ID NO: 2976 - DNA, 528 bp, Klebsiella pneumoniae
cgctgcgcaagcctgggcaacgctggtgacgaagccatgaaccacgcgatgctgcagcgtatcgtcgaagaggtcgccgcccgtctgctccgtcgcgccctcagcacggccacgctcagcgtggcccagctcggcgaagcggatatccgcagcctgctgtgccagcacgcttcgctgcgcatcgtgcaggtggatttaccgctgctggagcagcttgccggccagcgtgcgctggcggcagccggttgcgcactgcatgaggcgatggcctggggcgttcgggtacagctaacgctgcttcccgccctgctccccgcgctggcggtaaaaaaactcgcccgcttgccgctgacgttcagcgatccgcttggccagcccgtcaggcttcacgccgcgtcggtgctcacctatgccgacgtagcccgtttcagtggcggctatctggtgctgcgccgccgtcccattatcaccgccctcgcccgcgaagcggccgtcgcgcggcatgttcaattgattaagcaggagtga

SEQ ID NO: 2977 - DNA, 1605 bp, Klebsiella pneumoniae
cccctgcaaagtgagaagcgttcggcggcaaatttaaaaaatcaatatgccgctgcgtctcaaccctacagaaggagatttgcgatgcgttatgcacatcctggccagcccggcgccgaggtttcatttaaatcggcttacggcaactttattgacggtagatttgtcgagccgctgagcggtgaattctttatgaatacttcgccggtcgacggcagcaacattgcgcagtttccccgctcggatgccagagacattgacttcgccctcgacgccgcccatcgcgcggcgccggcgtggggtaaaacctcagtgcaacagcgctccaggctgctgctgcaggtcgccgatcgtattgaacagcatctggaatatctggcggtggcggagagctgggacaatgggaaaccgatccgcgaaaccctgaatgctgacctgccgctggcggtggatcattttcgctacttcgccggctgcctgcgcgctcaggagggaagcaccgccgagattgacgaaaccacggtggcctatcatttccatgaaccgctgggggtggtcgggcagattatcccgtggaacttcccgctgctgatggccgcgtggaagctggccccggccctggcggcggggaactgcgtggtgctcaaaccggcggaacagacgccgctaagcattaccctgctgctggagctgatcggcgatctgttcccggccggggtgcttaacgtggtgcagggtttcggcaaagaggcgggcgaggcgctggccaccagcaagcgtatcgccaagctggcgtttaccggctccacgccggtcgggcggcatattctcgcctgcgcggcggaaaatattatcccctgcaccgtcgagctgggggggaaatcgcccaacatctacttcgccgacgtaatggacggagaagaggaatttattgagaaggcggtggaggggctggtgctcggcttcttcaaccagggtgaggtctgtacctgcccgtcgcgggcgctgatccatgaatccatctatgagccctttatggcacgggtcatggagaaggtggcgcagatccgccgcggcgatccgttagataccgacaccatgatcggcgctcaggcttcccgccagcagttcgacaagatcctctcctatattcagattgcccgggaagagggtgggcaaattctgaccggaggcgagcgggcggctatcgcgccggcgctggataatggtttttatattcagcccacgctgattaaaggtcgcaacgatatgcgctccttccaggaggagatctttgggccggtgatcggggtgaccacctttaaggacgaagcggaagcgctggctatcgccaatgagacccagtttggtctcggcgccggggtgtggacgcgggataccaacctcgcctatcgcatgggtcgcggcattaaagccggtcgcgtgtggaccaactgctatcatgtctatccggcgcatgcggcgttcggcggctataaacagtccggcgtcgggcgggaaacgcacaagatggcgctggatgcctatcagcaaaccaaaaacctgctggtgagctacggcaccgcgccgctgggcctgttctga

SEQ ID NO: 2978 - DNA, 1014 bp, Klebsiella pneumoniae
agtatgaaaagcgtccagttagcccacggtagcgggggacaggcaatgcagcagctgatcggcgacctgtttatgcaggccttcgccaacccctggctggcggagcaggaggatcaggcgcgcctcgatctggcggcgctcgccgcccagggggaccgcctcgccttctccaccgacagctacgtgattgacccgctgttctttcccggcggcaatatcggcaagcttgccgtctgcggtaccgccaacgatgtggcggtcagcggcgccatcccgcgctatctttcctgcggctttattctcgaagaggggctggagatggccaccctggaagcggtggtcgccagcatggccgacaccgcccgggcggcagggatcgccatcgtcaccggcgacactaaagtggtgccgcgcggcgcggcggataagctgtttattaacaccgccggcatcggcgccatcccggcggacattcgctgggggacgcagcagattagcgccggtgatgtgctgctggtcagcggcacgctgggggatcatggcgccaccatccttaacctgcgcgagcagatggggctggacggcgcgctgtccagcgactgcgcggtgctgacgccgcttatccagaccctgcgcccgctgagcggagtgaaagccctgcgcgacgccacccgcggcggggttaacgcggtcgcccatgagttcgccgccgccagcggctgcggcatcgaactgcaggaggcaacgctgccggtcaacgacacggtgcgcggcgtctgcgagctgcttggtctggacgccctgaacttcgccaatgaaggcaagctggtgctcgccgtcgcccgcgacgaggcggaaaacgtgctggcgcatttgcggtctcacgcgttaggacgcgatgcggcgataatcggcgaagtggtcgcccgcccgggcgtacgttccgttgggctgtacggcgtgaagcggacgctcgctcttccccacgccgaaccgctgccgagaatttgttaa

SEQ ID NO: 2979 - DNA, 1722 bp, Klebsiella pneumoniae
gagagtttgagcatgtctgaagaaaaaataggtcaacactaccttgcggcgctgcaccaggcctttcccggcgtggtgctggatgaagcctggcagaccaaagaccagttaaccatcaccgtgaaggtcaattacctgccggaagtggtggagtttctctactaccagcagggcggctggctgtcggtgctgttcggcaacgatgaacgtaagctcaacggccactacgcggtctattacgtgctgtcgatggagcagggcaccaaatgctggatcaccgtgcgcgtggaagtggacgccaacaaaccggaatacccgtcggtgacgccgcgcgtcccggcggcggtatggggcgagcgcgaagtgcgtgatatgtacggcctggtgccggtcggcctgccggacgaacgccggctggtgctgccggacgactggccggacgaactctatccgctgcgcaaagacagcatggattatcgccagcgtccggcgccgaccaccgacgccgaaacctacgagtttattaacgagctcggcagcaagaaaaacaacgtggtgccgattggcccgctgcacgtcacctctgatgaacctggccacttccgcctgttcgttgacggcgagaacattatcgacgccgactaccgcctgttctacgtccatcgcggaatggaaaagctggcggaaacccgcatgggttataacgaagtgaccttcctgtcggaccgggtgtgcggcatctgcggcttcgcccacagcaccgcttacaccacctcggtggagaacgcgatgggcatcgtggtgccggagcgggcgcagatgatccgcgccattctgctggaggtggaacgcctgcactcgcacctgctgaacctcggtctggcctgccactttaccggctttgactccggctttatgcagttcttccgcgtgcgcgaaacctcgatgaagatggcagagatccttaccggcgcgcgtaaaacctacggcctgaacctgatcggcgggatccgccgcgacctgctgaaagaggacatgatccagacccgtcagctggcgcagcagatgcgtcgcgacgtgcaggagctggtggatatgctgctcagcacgccgaatatggaacagcgtaccgtcggtattggccgtctggacccggaaatcgcccgcgacttcagcaacgtaggcccgatggtgcgcgccagcggccacgcccgcgacacccgcgccgaccacccgtttgtcggttacggcctgctgccgatggaagttcacagcgaacagggctgcgacgtgatatctcgcctcaaggtgcggatcaacgaggtttacaccgcgctgaatatgattgatttcggtctcgataacctgccgggcggcccgctgatggtggaggggttcacctatattccgcaccgcttcgcgctgggcttctccgaggcgccgcgcggcgacgatatccactggagcatgaccggcgacaaccagaaactgtatcgctggcgctgccgggcggcgacttacgccaactggccgaccctgcgctatatgctgcgcggcaacaccgtttccgatgcgccgctgatcatcggcagcctcgacccgtgctactcctgtactgaccgcatgaccgtggtcgatgtacgcaagaagaagagcaaagtggtgccatacaaagagctggagcgctacagcatcgagcgtaaaaactcgccgctgaaataa

SEQ ID NO: 2980 - DNA, 2568 bp, Klebsiella pneumoniae
caccccatgagcacaattgacaatctcgacgcccacacgccgatgatgcagcagtatctcaagctaaaggcgcaacatcctgacattctgctgttttaccggatgggggatttttacgagctattttatgacgatgcgaaacgcgcctcgcagctgctcgatatctcgctgaccaagcgcggcgcctccgcgggcgaaccgatacccatggccggcatcccccaccacgccgtagagaactacctcgccaaactggtcaatcagggcgagtcggtggccatttgcgagcagattggcgacccggccaccaccaaggggccggtcgagcgtaaagtggtgcgtatcgtcaccccaggcaccattagcgatgaagcgctgctgcaggagcgccaggacaacctgctggccgccatctggcaggacagcaagggcttcggctacgcgacgctggatatcagctccgggcgctttcgcctgagcgaaccggccgaccgcgaaaccatggcggcagagctgcaacgcaccaacccggcggaactgctgtatgcggaagattttgccgaatcgtcgctgatcgagggccgccgcggtctgcgccgtcgcccgctgtgggaatttgaaatcgacaccgcacgccagcagctaaacctgcagttcggcacccgcgatctggtcggcttcggcgtcgaaaacgccccgcgcggcctgtgcgccgccggctgcctgctgcagtatgtcaaagacacccagcgtacctcgctgccgcacatccgctccatcaccatggaacgccagcaggacagcatcattatggatgccgccacccgccgtaacctcgagatcacccagaatctggccggcggcaccgacaacaccctggcctcggtactcgactgtacggtgacgccgatgggtagccggatgctcaagcgctggctgcatatgccggtccgcgataccgccgtgctggtggagcgccagcagaccatcggcgcgctgcaggagcgctataccgagctgcagccggtgctgcgccaggtcggcgatctggagcgtattctggcgcgtctggcgctgcgtaccgcccggccgcgcgatcttgcccgcatgcgtcatgccctgcagcaactgcctctgctgcgtgagctgctggccgacgttgacagtcagccggtgcaaaaattgcgcgagaaaatgggcgagttcaccgaactgcgcgaactgctggagcgcgcggtgatcgacgcgccgccggtgctggtccgcgacggcggggtcatcgctccaggctatagcgaagagctggacgagtggcgggcgctggccgatggcgccaccgattatctcgataaactggagatccgcgagcgcgagcggctgggcctcgataccctgaaagtcggctacaacgccgtccacggctactacatccagatcagccgcggccagagccacctcgcgccgatccactacgtgcgccgccagacgctgaagaacgccgaacgctacattattcctgagctgaaggaatacgaagataaggtgctgacctccaagggcaaagcgctggcgctggaaaaacagctttatgacgaactgttcgacctgctgctgccgcatctcgccgatctgcaaaccagcgccagcgcgctggccgagctggacgtgctggtcaacctggcggaacgtgcggaaaccctgaactactgctgcccgacctttagcgataagccaggcattcgcattagcgaaggccgccatccggtggtcgagcaggtgctgaaagagccgtttatcgctaacccgctgcagctggcgccgcagcggcggatgctgattatcaccgggccgaacatgggcggtaaaagtacctatatgcgccagaccgcgctgattgcgctactggcctatatcggcagctacgtcccggcgcagaaagtagaaattggcccgatcgatcgcatcttcacccgcgtcggcgcggcggatgacctggccagcggccgctcgacctttatggtggagatgactgaaaccgccaatatcctgcacaatgccaccgagcatagcctggtgctgatggatgagattggccgcggcacgtccacctacgacgggctatcgctggcgtgggcctgtgcggaaaatctggccaacaaaatcaaggcgctgaccctgttcgccacccactacttcgagctcacccagctgccggagaaaatggaaggcgtcgccaacgtccacctcgacgcgctggagcacggcgataccatcgcctttatgcacagcgtgcaggacggcgcggccagcaagagctatggcctggcggtcgccgcgctggcgggggtgccgaaagaggtgatcaagcgcgcgcggcagaaactgcgcgagctggagagtatctcgcccaacgcggcggcgacccaggtcgacggcacgcagatgtcgctactcgccgccccggaagagacctcgcctgcggttgaggcgctggagaatcttgatccggactctctgaccccgcgtcaggcgctggagtggatttaccgtctgaaaagcctggtctag

SEQ ID NO: 2981 - DNA, 678 bp, Klebsiella pneumoniae
tggatgatgagtcaccaaaagaggaacgcaatggaaagaaacagactggcccggcagattatcgatacctgcctggaaatgacccgcctggggttaaatcaggggaccgccggcaatgtcagcgtgcgctatcagggaggaatgctgatcacccctaccggtatcccatatgaaaagctgacggaagacaagatcgtctttattgatgccgacggccagcatgagcagggaaaactgccctccagcgaatggcgttttcatcaggcggcctaccagacgcgacccgatgcccaggcggtggtccacaatcacgctgtccattgtacggcggtgtcgatcctcaatcggcccatcccggccatccactatatgatcgccgcggccggcgggaattcgatcccctgcgcgccctatgccaccttcggcacccgcgaactgtctgagcatgtcgcggtggcgctgaagcaccgcaaagccacgctgctgcagcatcacggcctgatcgcctgcgaggccagcctggagaaagcgctctggctggcgcatgaagtggaggtcctggcccagctctacctcagtacgctggcgattaccgacccggtcccggtgctggatgacgaggcgatcgccatcgtgctggagaagttcaaaacctacggattacgcattgaagagtga

SEQ ID NO: 2982 - DNA, 1554 bp, Klebsiella pneumoniae
ttcggggtgagtgtaatgcaacagcaaaaaccgctggaaggcgcgcagctggtcattatgaccattgcgctgtcgctcgcgacgttcatgcaggtgctggattccactatcgccaacgtggcgatcccgaccattgccggcaaccttggctcgtcgctgagccaggggacctgggtcatcacctcgttcggggtcgctaacgccatctccatcccgatcaccggctggctggccaagcgcgtcggcgaggtgaagctgttcctgtggtcaaccaccgccttcgccattgcctcctgggcctgcggcgtctccaacagcctgacgatgctgattttcttccgcgtcattcaggggatcgtcgccgggccgctgatcccgctgtcgcaaagtctgctgctcagcaactatcccccggcgaagcgctctatcgctctggcgctgtggtcgatgacggtgattgtcgcgcccatctgcggtccgatcctcggcggctatatcagcgataactatcactggggctggatcttctttatcaacgtgcccattggcgtggcggtggtgctgatgaccctgcagaccctgcgcaaccgggaaaccaaaaccgaacagcggcggatcgacggtgtcggtctggcgctgctgatcatcggtatcggtagcctgcaggtgatgctggaccggggtaaagagctggactggttctcctccaatgagattatcattctgaccatcgtggcggtggtggcgataagcttcctgatcgtctgggagctaaccgacgataacccgattgtcgatctgtcgctatttaagtcgcgcaacttcaccatcggctgcctctgtatcagtctggcctatatgctctacttcggcgccatcgtactgctgccgcagctgttgcaggaggtctacggctacaccgcgacctgggccggcctggcgtcggcgccggtgggggtgatcccggtcattctgtcgccgattatcggccgcttcgcgcataagctcgacatgcggcggctggtcaccttcagctttattatgtacgcggtctgcttctactggcgcgcctggaccttcgaaccggggatggactttggcgcctcggcgtggccacagtttatccagggcttcgcggtggcctgcttcttcatgccgttgaccaccatcaccctctccggcctgccgccggagcggctggcggcggcgtcgagcctgtcgaacttcacccgtacccttgccggctccatcgggacctcgatcaccaccaccctgtggaccaaccgcgaggcgctgcatcatgcgcagctcaccgaatcggtgaccccctttaaccccaacgcgcagcagatatacgatcagctgcagggcatgggaatgacgcagcagcaggcgtccggctggatagcgcagcagataaccaaccaggggctgattatctccgccaacgaaatcttctggatttctgcggctattttcatcctgctgttggggctggtgtggttcgccagaccaccgttcagcgccggcggcggcggcggcggcgcgcactaa

SEQ ID NO: 2983 - DNA, 1428 bp, Klebsiella pneumoniae
tgcatggcgagtttcccacagggatttttatggggcggcgcactggccgccaaccagtctgaaggcgcttatcttgaaggcggtaaggggctgaccaccgtggatacccttccccacggcgcccatcgcctgccggtaaaattaggcctggagaagcgctttacgctgcgtgaagacgaattttaccccagccaccaggcgatcgatttttaccatcgctataaagaagatatcgccctgatggccgagatggggttcagcgtctttcgcacctccatcgcctggagccgcctgttcccacgcggcgacgaacagcagccgaatccgcagggcatcgccttctatcgctcactgttcgaggagtgcaaaaagcacggtatcgagccgctggtcaccctgtgccatttcgacgtgccgatgcatctggtgatggagtacggctcctggcgcaaccgcaaaatggtggattttttcagccactacgcccgcacctgctttgaagcttttgacggcctggtgaaatactggctcaccttcaatgaaatcaacatcatgctgcacagcccctactccggcgccggtctggtgtttgaagagggtgaaaaccaggagcaggtgaagtatcaggccgcgcatcacgagctggtggccagcgcgctggcgacgaaaatcgcccatgagattaacccacaaaatcaggtcggctgtatgctggccggcggtaatttctacccttactcctgcaagccggaagatgtatggatggcgctggagaaggaccgcgaaaacctgttctttatcgatgtccaggcccgcggcgcctatccggtgtgggccgcgcgggtgttccgggaaaaaggggtcacgattgcgaaacagccgggcgatgacgagatcctcaaaaacaccgtcgatttcgtctcctttagctactacgcgtcgcgctgcgcctcggcggagatgaacgccagcaacaccaatgccgccaacatcgtcaagtcgctgaagaacccgcacattccggccagcgaatggggctggggcatcgacccgctgggcctgcgcatcaccatgaacatgatgtacgaccgctatcagaaaccgctgttcctggtggaaaacgggcttggcgcccgcgatgagatcgatgccaatggggacatcaatgacgactatcgcatcagctacctgcgcgagcacatcagggcaatgcgcgacgctatcggcgacggtattccggtgctgggctacaccagctggggctgcatcgatctggtctcggcgtcaaccggcgagatgagcaagcgctacggctttgtctatgtcgatcgcgacgatgccggcaacggcaccctggcgcgtaagcgtaaaaagtcattcttctggtaccagaaggtgatagccagcaacggcgccgatctcgactaa

SEQ ID NO: 2984 - DNA, 291 bp, Klebsiella pneumoniae
tcgccgcggagggacattaatatgaaaaagcccctgatcctgttggcgatggtggccgccctgatgatcctgccattttttattaaccacggcggcgagtttggcggctcggacggcgaagcggagagccagatccaggtggtggcgccggattatcaaccctggttccagccgctatatgaaccggcgagcggcgagattgagagtctgctgtttacccctgcagggctcgctgggcgcggcggtgattttttacattctcggatatgcgaggggcagacagcgccgtga

SEQ ID NO: 2985 - DNA, 468 bp, Klebsiella pneumoniae
tgctattttggctgccgtcttagagaggagaacaccatgaaccaattacgtcagccattcagtgaactgagcccggaagtctataaagggctggtacaggccagcatcgcgctggagaaaagcgagctgggcaacgccctggtagagctggtttatttacgcgtctcgcagatcaacggctgcgccttctgtcttgagaaacatagccaggcgctgcgcaaaggcggcatggcgcaaagcaaactggatgcccttgcgggctggcgggtaagcgcccactttactccggccgaacgcgcggcgctggcatgggccgagtcggtcaccgacattgccaccagccatgcggaagatgaggtttacctgccgctgcgcgaacattttaccccgcgtcagataagcgatctgaccttcgccgtcagtctgatgaacgcctttaaccgcctcgccgtggccatgcgcctgtag

SEQ ID NO: 2986 - DNA, 657 bp, Klebsiella pneumoniae
ccaggtactgggcagcagccgtccgctggcggcaattgcccgggagctgacatgttgacggtcgtgggaatgggcccggcggggctgcagtggctgaccccggccgcgcgcgaggcaatcgccgccgctgaggcgctggtgggcggcagccgccatctccagcagtttcccgacttcgccggcgagcgcttcgcgctgggggccgatatgccggcgctgctggcgtggattgaggcccgtaccgggcgccgcgtcgtggtgctggcctctggcgacccgctgttctatggcattggcacccggctgattgcccattttggccgggaacgagtgcaggtgatccccggcatcagcgcggtgcagtacctctgcgcccgggcgggcatcgacatgaacgatatgtggctgaccagcagccatggccgggcggtgagcttcgatgctctggccgcccaccggaaagtcgccatggtgaccgacggccgctgcggaccgcgggagatagccgcccagctgatggcccgcggcaaaggccatcgctggatggtgataggcgagaacctggcgatggaaaacgagcggatccactggctgccggtcagcgccgtggaggacgaatatgagatgaatgcggtggtgatcctcgatgaaagatga

SEQ ID NO: 2987 - DNA, 984 bp, Klebsiella pneumoniae
tgttttgctggcgccataccgctgctgagaaagggggacggcgagggtagggttaccaccaatcaggtcaggaaagacaccatgaagtatatcattctgttgatcattgttattgctgtactgtatgtccattaccgcggacgggtgcgctatcgtttctggcggcagctctccgaccattccacatttaccgcgccgctgaatggatttatgtatttattttcccgcgtgccgaatacgccttatctgcggccggagatgtttcccgagctggcgatattgcagcaaaactggcaggttattcgcgacgaaggtctccaccttcagcagctggagcagattaaagcggccgataaatataacgatgccgggtttaactcatttttcaaaaccggctggaaacgcttttatctgaaatggtatgaggatgcccatccttccgccagccagctctgtccgcaaactaccgcgctgctgcgcgatatcccgtcggtgaaagcggccatgtttgccactctgccggacggtagccgtctgccgcgccatcgtgacccctacgccggctcgctacgctttcatctgggcctggcaacgccgaacgatgaccgctgctttatcgaggtggatggccagcgttacagctggcgcgatggagaaggcgtgctgtttgatgagacctatatccactatgcggaaaataccagtggtgagaatcgcctgattctgttctgcgatattgaacggccgatgcgctaccgctgggcgcagaaagttaaccactggctgggacgccatctgatgagcgccgcttcggcgcccaacgatatcggcgatcgcaccggcgggattaaccgggcgtttcgctatatttaccagatccgtattgttggtaagcggttgaaaaaatggaataagacggtctattacatcgtcaaatggctgctcttcggcggcattgcctggcttatctggagcgcgttttaa

SEQ ID NO: 2988 - DNA, 1158 bp, Klebsiella pneumoniae
ccgcctgctggcggcgcgattgaccttttatctggcggattttactctgctgtttgcacagcagttgccggccggcgacggcgcaatcgcctatggtcaggcggtgatcgccgccgcccgcgggcaggctcaaggaatacaaccatgataatgacagttttacgccagcagccgcgcgccgcgggtctggtgctggggttgatcgcggcgaatttactggcctggtgctgggcgctgcaggcctttggcgacagcggcgcgctgatggccgccagcctgctggcctggggctacggcctgcgccacgcggtggacgccgaccatattgcggcgattgataacgtgacccgcaagatgatgcagcaggggcggcggcctttcgccgtcggggcgtggttttcgctgggccactcatcgattgtggtgctggcctcggcggcgattgccgcgaccgccaccgccttcagcacgcagatgagctggctgcatgataccggtagcgttatcggcaccgccgtgtcggccctgtttttactggcgatggcctttatcaacctggtgattttacgcagcgtgtggcgcagctttcgggcatggaagcgcggagagccggtgagcgacgaaatcgtcagcggcggcggggtgatgagctggctgtttggcaagaccttccgtctgataagccgcagctggcagatgtacctggtcggtttcctgtttggcctcggttttgataccgccaccgaaatcggcgtactgggtatctccgccgccggtgcgtcgagcgggatttccgtctggtcgattatggtcttcccggcgctgttcgccagtggtatggcgctggtggataccctcgataacgtgctgatggtcggcgcctacggctgggcgttcagcaaaccgcagcgcaagctctattacaacatgaccatcaccggcacctcggtggtggtggcgctgtttatcggcggcctggaagcgctgggcctgctgatggataagtttgcgctcagcggcggaatatggcgctgggtaggggcgttaaacgacaacctcggcgacgccggatttgtggtggtcgggttgtttgtcgcctgttgggcgctatcggtgcttaactatcgctggcgcggctacgacaatctggcgcgctag

SEQ ID NO: 2989 - DNA, 225 bp, Klebsiella pneumoniae
acagtggctggagtcggctctgcaggcgcagggctttcaggtcacgccgcagctggggggaattcaactggttatgtcggtcagcggcgacgatcggctgctcgcgcggcgggcggttgtggccgggctggcggtgcaggcgctgagcgactggcggattcgccacgcgggcgaggggggattattgatgagttttaccaatatacgttcgccggcgatggctga

SEQ ID NO: 2990 - DNA, 840 bp, Klebsiella pneumoniae
tggtcggctggccggtcgcctgcaggccggagtgcgctttcagggcgaacgcctgtcgcccgcgcgactgcagggcctgctggcgcagctcggcataacggcggagatcctcgacagcgcgccgttgctcagggaggcggtatgaaaccgacagtcatcagtcaggataccccctggggcgaaatcccttcgctgctgctccccgcctatggcgaaacctggctgatggtggccattgtgatgctgtttgtcgtcacgctgggagggctggtgggggtggtgttgtttaatgcctcgccgcggggcttatttccgcacgcactgctgtaccggctgctgaactgggtggtcaatatgggacgttcgctgccgtttctggtgctgatggccgccattatcccgttcacttactggctgaccggcaccacgattggcatccccgccgcggtagtgccgatgatcgccgccggcgtcccgttctttggccgtctggtggagaacgcgctgcgcgagttgccggcggaggtcaccgcggtgggggtcgtctgcggcgggtcgcgctggcaaatcattgccagcgcgcagctcagtgaagccatgcccgcgctggtggcggcggtgacgctaaacctggtctcgatgatcgagtattcggctatcgccgggaccatcggcgccggcggcatcggctacctggccgtggtgtacggctatcagcgcttcgacaaccacatcatgatcgcgacgatcgttgccctgatcgccacgatccagttgattcaatttttgggtgaccgtctggtcaaccgtttacgccacacgcaggggaaccttgtatga

SEQ ID NO: 2991 - DNA, 972 bp, Klebsiella pneumoniae
catagcaatggctataaacgctgggaaattaaccacaccattgcgagggatcctatgctacacctgacaccgctgaaatcattgctgctggccagcgcgctggctctgctggccgcgacgccggcctcggcgcaggagaaattcagggttatcaccaccttcacggttatcgccgatatggcgcagaacgtagccggcgacgccgccgtcgtcagctccatcaccaaaccgggcgcggagatccatgattaccagcccacgcccggcgatatcaaacgcgcgcagggggcgcagctgatcctcagcaatgggcttaatctcgaacggtggtttgcccgtttttatcagcacttacagggcgttccggaggtggtggtcagcgagaggatccagccgatgggcatcagcgcgggcccctatagcgggaagcccaatccccatgcctggatgtcggcagataacgccctgatctatgtcgataacattcgcgatgcgctggtgaagtacgatccgcctcacgctgacacctatcgccgtaacgccgaggcctacaaagagaagatccgtcagacgatggcgccgctgcaggccagactggcgcagctgccggcggataagcgctggctggtcaccagcgagggagccttctcctatctggcccgcgactatggcctgcgcgaactgtatctgtggccgatcaatgccgaccagcagggcaccccgcaacaggtgcgcaaggttatcgacaccatgaagaaagaacgcatcccgaccatcttcagcgaaagcaccatctccgataaaccggcgcgtcaggtggcgcgggaagccggggcccactacggcggcgtgctgtatgtcgattcgctgagcgccgccgacggcccggtgccgacctggctcgacctgctgcgcgtcaccaccgaaaccatcgtcaacggtatccaggacgggatgaggaagcagccatga

SEQ ID NO: 2992 - DNA, 189 bp, Klebsiella pneumoniae
ggcatcgatggtaatggccgcctgggtctgaaaagccaaagcgcctatgatcactgccagcagcgttttcatatcttaccccttatccgcgtcgtgccgtccctggccaggcgttattgctgtataatggtaaacctggcggtcgcattgccgtcgccagcttcggcgttgtctttatcccaggtatag

SEQ ID NO: 2993 - DNA, 972 bp, Klebsiella pneumoniae
ccagcgggtggccgactttttccccgagacgctgctgctgactccccagcgcgcctgctggggcgctacccgggcggtgctcccggccttcagtcatgtgaggtcggcatgatctggcacaccttctttcagcctttcattgaattcggctttatgcgtcgggccctcgtggtgtgtctggcgctgtcgctgagcaccaccatgctgggcgtcttcctgctgctgcggcgcatgagcctgatgggcgatgcgctgtcgcacgccattctccccggcgtggcggtggggtatctgctgagcggcatgtcgctgctggccatgaccctcggcggcttcatcgccggcatcgtggttgccctggtggccgggtgggtgagccggcggacaccgttaaaagaggacgccagttttgccggattttatctgggctcgctggccctgggcgtcaccctggtgtcgctgcgcggttccagcgtggacctcctgcatctgctatttggctccattctggcggtcgatcgcgatgcggcgctgtttgtcagcggcgtcgccagcctgacgctattgtgcattgcgctgtgctaccgcggtctggtcagcgaggcgttcgacagcgcctggctgcaggtgaatcaccggcggctgcctgcgctgctgcatgggctttttctggcgctgctggtgcttaatctggtggccgggtttcaggtgctcggcacgctgatggcggtaggggtaatgatgcttccggcggtcgccgcgcgctgctgggcgcgcacgctgccgggcattctgctgctggcggcgggaatgggcgcgctctgcgcctggctgggattaagcctctcctgggcgattagtcttcccgccgggcccgctattgtgctgaccgccagcgcactgttttttgtttcgctattttttggcacgcgcagccggctgctggtcggttggcgcacattgatggggtaa

SEQ ID NO: 2994 - DNA, 768 bp, Klebsiella pneumoniae
ctgcgcctcggggacatccttcacgctgcgcccgcgctggccggggatcacgctggctggcgttacgcctggtctggggttttatggtctgcgcagcaccgcctgggcggggaatctgcggctgcagagcgcggccggcagctggagcattgtgatctcacactgggggcggattcgtttatgccgcagcgacagcgcaggagggtgtcagtgagccgccgcggattttccctggcggaggcgcttatcgccatggccatcggctcgctgctgctgatgggggcctgccgctttctgcctgccctgcagcgtcatattctgcgccagggcgaacagctggccctggagaacgagctgtggcagcgtgtgcatgccgtgggaaaacatctgcagcgcgccgggtactgccggggagcgtgcggcggagccgggctggagctagccgctggcggcgagtgtctgattgtgcgctgggatgcgaacagcaacgggagatgggaaacctcccccgcggcagcggcggagagcaccggctttcgcctgcgcgacggcgcgctggagaccctgcgcggggccagcgactgccgcggcggcggatgggagaaaatcaccaacccggccgccatcgtggtgacgcgcttctcggtacaacgtcaggtcaccccgggcttcgcgccggagctgagcgtgacgctggcggcgcgctccgcgcaacagacgggcctgacgagcgaggttgagcagcgggtgacggggtataacctgtga

SEQ ID NO: 2995 - DNA, 504 bp, Klebsiella pneumoniae
ctctggcccggggtcagcggctgttcggccatccacaccacgtcgatgctggcgctttgtaccgccggcagcgaggcttgcgcgtcaaccagcaggtcgccgcgactgatgtcgatttcatctttcagcacaagggtaatggcttcgccggcggcggcttcctgcaggtcgccgtcgaaggtgacgatacgcgccacgctcgattcgacgcccgacggcagcaccttcagacgctggccaacctgcacggtaccggaggcgaccgtgccggagaagccgcggaaatcgaggttcggacggttaacatactgcaccgggaagcgcagcggctggctctcgaccacccgctggatctctacggtttcgaggacttccagcagcgtcgggccactgtaccacggcatattcgcgctctggctggcgacattatcgccttccagcgccgacaacggcacaaagcggatatcaaggttgcccggcagctgctcggcaaaggtcagataa

SEQ ID NO: 2996 - DNA, 1458 bp, Klebsiella pneumoniae
agcgctgccgggcggcgcgcgcaacgacgcgggcccgatgcagtacctgatccccggctggacattcgaccgcaaacgtcccgttttcggccgccactaattaaaaaggatgatgctatgacgactttctcttcaacgcccgttgtcaccaccatgcaggtgatcccggttgccggccatgacagcatgctgatgaacctgagcggcgcgcacgccccgtacttcacccgcaatatcgtaattatcaaagataacgccggccataccggcgtcggtgaaatcccgggcggtgaaaaaattcgccagaccctggaggatgccattccgctggtggtgggcaaaacgctgggcgagtataaaaacgtgctgggcgcggtgcgcaatcagtttgccgaccgcgacgccgggggccgcggcctgcagacctttgacctgcgcaccaccattcacgtggtgaccggcatcgaagcggcactgctggatctgctgggccagcaccttggggtcaacgtcgcctcgctgctaggcgatggccagcagcgcagcgaagtcgaaatgctgggctatctgttctttgtcggtaatcgccatgcgacgccgctggcctatcagagccagccggatgagcagtgcgagtggtatcgcctgcgccatgaagaggcgatgacgccggatgcggtggtccgcctggcggaagcggcgtatgaaaaatatggtttcaacgactttaagctgaagggcggcgtgctggccggttttgaagaagccgaagcgatcagcgccctggcgaagcgcttcccgaatgctcgcgtcactctcgacccgaatggcgcctggctgcttgaggaggccattcagattggtaaacagctgaagggcgtgctggcctatgcggaagatccgtgcggcgccgaacagggcttctccggccgcgaagtgatggccgagttccgccgcgcgacgggcctgccgaccgccaccaatatgatcgccaccgactggcggcagatgggccatacgctgtcgctacaatcggtggatatcccgctggcggacccgcacttctggaccatgcaggggtcggtgcgcgtagcgcagatgtgccatgagttcggtctgacctggggttcgcactctaataatcacttcgacgtgtcgctggcgatgttcacccacgtcgcggcagcggcgccgggcaagatcaccgctatcgatacccactggatctggcaggagggcaaccagcgtctgaccaaacaaccttttgaaatcaaaggcggcatggtgcaggtaccgagtaccccgggcctgggggttgagctggatatggaccgcgtgatgcaggcaaatgagctatataagaaacatggtcttggcgcccgcgatgatgcgatggcgatgcagtatctgatcccgggctggacctttgacaacaagcgtccatgcatggtgcgctaa

SEQ ID NO: 2997 - DNA, 1167 bp, Klebsiella pneumoniae
cgtggagccggacgtcggcgcgctgctgtacggcgaggagcgataatgcgttacgtagatgaataccgcgcccccgaacaggtgatgcagctggtggcccatcttcagcagcgtgctcgtctgctgccgcacaccgccgcgcgaccgctgcgcatcatggaggtctgcggcggccatacccatgccatttttaaattcgggctcgaccagctgttgccggagaacatcgaatttattcatgggcccggctgcccggtgtgcgtcctgccgatggggcgcatcgacgcctgcattgagattgccagccgcccgggagtgatcttctgcaccttcggcgacgccatgcgcgtgccgggtaaaaacggctcgcttctgcaggcgaaagcccgcggcgccgatgtccgcatcgtttactcgccgatggacgctctgcggctggcgcagcaaaatccgcagcgcgaggtggtcttttttggtctcggtttcgaaaccaccatgcccgctaccgccctgaccctgcgtcaggcgcgagagcgcaacgtcgataacttctactttttctgccagcacatcaccctgctgccgaccctgcgcagcctgctggaccagccggacaacagtatcgacgcctttctcgccccgggccacgtcagtatggtgatcggcaccgaggcctacggctttatcgccagcgactatcaccgtcctttagtggtcgccggtttcgaaccgcttgatctactgcaaggcgcggtgatgctggttgagcagacaatagcgcagcgcagcgatgtggaaaatcagtaccgtcgcgtggtgccggatgagggcaacccgctggcgcaggcggcgatggccgacgtcttccgcctggatggcgacagcgaatggcgcggcctgggggtcatcagcgactccggcgtgcagcttacgccagcctatcagcgcttcgatgccgaggcgcattttcgcccggcgccgcagcgcgtgtgcgacgacccgcgcgcccgctgcggcgaggtgctgaccggccgctgtaaaccgcaccagtgcccgctcttcgccagcacctgcaatccgcaaagcgcctttggcgcgctaatggtctcctctgaaggggcctgcgccgcctggtatcaatatcgcagtcaggaaaatgaagtatga

SEQ ID NO: 2998 - DNA, 1161 bp, Klebsiella pneumoniae
agcgctggcggtgatgccgggccgcacctggcagctgggcgtcaacgtcgacttctgattgcccgaataataacgcacctgcccccggcccgccggtcggggatattcatcgtcgagaaggatatgattatgccaaatgcacaccctgacctgtggcagcgctaccaggccaccaaagcggccagtaccgcgaaatatgcccgcgatatcgccgcggaaatggggatcagcgaagccgagctgaccgccgcccgcctcggccatgatgccgtgcgcctgagcgatgacgcccgggcgctgattgccgccctggagcgcgtcggcgaaaccaaatgcatctgccgcaacgagtatgccgtgcatgagcaggtgggccagttcacgcaccagcacctcagcggccacgccgggctggtgctgaacccgcgcgcgctcgacctgcgtctgttcctcagccagtgggccagcgccttccatctgaacgataatggccgtcagagcatccagtttttcgaccaccacggcgacgccctgctgaaagtctatgcgaccacgcagaccgacatggcggcctgggagaccctgatcgcggaatatcgggtggcggcgccggcaccgctgaccctgcgcccgctggagccggtgaaatatgccgataccgccgatggcgccgccctggagaacgactggcgcgcgatgaccgacgttcaccagttcttcggtctgctgcgtaaatatcagctttcccgccagcaggccttccgtctggtgagcgacgacctcgcctgccgcgtggatcgccatgcgctgccgtcgctgctggagacggtgcgccaggagggcaatgaaatcatgattttcgtcggcaatcgcggctgcgtgcagatctttaccggcgccctggaaaagctggcccccatgcgcggctggctgaatatcttcaatactacttttaccctgcatctgcgcgaagagagcgtcgatgaagtgtgggtgacccgcaagccgacttcggacggacacgtcaccagcgtcgaactgttcgctaaagacggcacccagattgcccagctctacggccagcgcagcgaggggcaccccgagcagacgcaatggcgccagcaggtagaccgcctgacccgtgaagggcagcccgcatga

SEQ ID NO: 2999 - DNA, 1587 bp, Klebsiella pneumoniae
aaccgaggcggagttttttcagcggatgcacaacaacgcgataggcgcgataaaggaggcgtcatgacgctggcagtgatgttgcagggcacggcttccgacgtggggaaaagcgtgctggtggcgggactgtgccgcatttttcatcaggatgggctgcgtaccgcgccgtttaaatcacagaatatggcgctgaactccggcattacgccggatggcaaagagatgggccgggcgcagattttccaggccgaagcggccgggattgcgccggatgtccgcatgaatccgattttgctcaagcccaccagcgaccgtcaggcgcaggtggtgctgatggggcaggtggcgaccagcatggatgcggtgagctatcaccagtacaagccgcgcctgcgcgagcagatcctcgcggtctaccagagcctggccggagagtatgaggcgctggtgctggaaggcgccggcagtccggcggagattaacctgcgcgaccgcgatatcgtcaatatgggcatggccgagatggcgcaatgcccggtgatcctggtggccgatatcgaccgcggcggggtgtttgccgcgatttacggcacgctggcgctgctgcagcctcaggagcgggcgcgggtgaaaggggtgatcatcaataaattccgcggcgatgtggcgctcctgcgctccgggatagagcaaatcgaggcgttgaccggggtgccggtgctgggcgttatgccatggcttgacgtggatctcgaggatgaggacggcgtcgcgctgcaggccgggaaataccatcgcaccgaccggcgcgatatcgacatcgccgtggttcacctgccgcatattgccaattttaccgactttaacgccctggcggcacagccagacgtccgggtgcgctatgtccgcgatccgcaggcgctggccgacgccgacctggtcattcttccgggcagtaaaaataccctcggcgatctgtgctggctgcgcgagagtggcatggcgcacgcggttgagcaggcccggcagcgcaaggtgccgctgctggggatctgcggcggctatcagatgctgggcgaaaccattatcgatgaggtggagtctggccttggcacccagcccgggctgggggtgctgaagaccgtgacccacttcgcccagcacaaaaccaccacccaggtgcaggcgaccctggggtctgcgctcccggattggttagccgacgcggcggggctgcgcgtcagtggctatgaaattcatatgggcgagacgcgccgcgaggcaggctgcccgccgctgctgctgctgcataaagcggggcaggcagtggacgacggggcgataagcgacgacggcctggcgttcggcacctatctccatggcctgttcgacagcgatgcctttacccgggcgctgctcaacggcctgcgccagcgcaaagggctggcgccgctggacagcgccctggagtatgcccgctataaaacccggcagtttgatcggctggccgaggccatgcgcgaacatatcgccatcgataaaatttacgccatcatgcgccaacatcaggagcccctatgctga

SEQ ID NO: 3000 - DNA, 1533 bp, Klebsiella pneumoniae
gcgttaacaggttggtttcgcccggaggcgcaggcttacctggcctacagacgcgcgcggtctgtaggccggataagcgctgcgccatccggcaatgttgtttcgggagtcactatgaagcaagacgttatcctggtcctcgactgcggcgccacgaacgtgcgggcgatggccgtggatcgacaagggaacattatcgcccgcgccgcaacggcgaacgccagcgacatcgcggcggaaaaaagcgactggcaccagtggtcgctggaggccattatgcagcgctttgccgactgctgtcggcagatccatgaccagctggcctcctgcacggtgcgcggcatcaccgtcacgacctttggcgtcgatggcgcgctggtagatgagaagggtgccctgctgtatccgatcatcagctggaaatgcccgcgcaccgcggcggtgatggagaaaatcagccagtatatgcccgcgcgccagctgcagcagatagccggcgtcggcgcgtttgcgttcaacaccctgtataagctggtgtggctgaaagagaaccacccgcagctgctggcgcaggcccatgcctggctttttatttcatcgctgatcaaccatcggctgaccggggagttcaccaccgacctcaccatggcgggcaccagccagatgctcgatctccggcagcgcgatttcagcgcgccgatcctgcaggcgaccggcctgccacgccgcctgttcccgcggctggttgaagcaggccagccgatcggcgccctgctgccggaggccgctgcgctgctgggccttcccgtcgggatcccggttatctcggccgggcatgacacccagttcgctctgtttggcgccggcgccgggcaggatgagccggtgctctcctccgggacctgggagatcctgatggtgcgcagcgcgcaggtcgacacctcgctgctctgtgactacagcggctccacctgcgagctggacagccagccgggccgctataacccgggtatgcagtggctggcctccggcgtgctcgagtgggtgcgcaaactgctgtggagcgctgacaccccatggcagacgctgattgacgaagcgcaggcgatcccgcccggcgcccagggcgtcaggatgcagtgcgacctgctcgccagccagcacgccggctggcagggcgtcacgctcaacaccacccgcggccatttttaccgcgccgcgctggaggggttaagcgatcagctggcgcagcatctgcaaaccctggaaaaaatcggcggcttcagggcgaaagagctgctgctggtgggcggcggcagccgcaacgcgctatggaaccagatcaaggccaaccgactcgggataccgatcaaagtcctcgacgatgccgaaaccaccgtggccggcgcggcgatgtttggctggtatggcgtgggcgagttctcttcgccagaacaggccagagcgcaggtcgcgtaccgctaccgctatttctggccgcaaactgaacctgaactgatagaggaagcctga

SEQ ID NO: 3001 - DNA, 1017 bp, Klebsiella pneumoniae
acaataagaggaaccaccatgcgacatagtacgatgttggccaccgccgcctttgccaccctgctcgccaccagcgccttcgccgccgacctgccgggtaaagggattacggtgaagcccgctcagagcactatctccgaagagagcttccagaccctgctggtcagtcgcgcgctggagaagctgggctacaccgtcgagaaacccagcgaagtggactataacgttgcctatacgtcgattgccgccggagataccacctttatcgccaccaactggcaaccgctgcacgatgacatgtacgccgcggcgggcggtgataacaaattctatcgcaaaggagtgtacgtctcaggcgccgcccagggctatttgatcgacaaaaaaaccgctgagcagtaccacatcacctccatcgatcagctcaaagatccgcagatcgccaaactgtttgataccaacaacgacggtaaagcggatctcaccggctgtaccccaggatggggctgcgaagcagtgattaaccatcagattgacgcctatggcctgagcaaaaccgtcacccataaccagggcaactacgcggcgatgatggccgacaccattgcccggtataaagagggtaaaccggtgctctactacacctggacgccgtactgggttagcgacgtgctgaagcctggcaaggacgtcgtctggctgcaggtgccgttctcctccctgccgggcgagcagaaaaacatcgacaccaaactggccaacggcgccaactatggcttcccggtgaacaccatgcacatcgtcgctaacaaagcctgggcggagaaaaatccggccgccgccactctgtttagcgtcatgaagctgccgatcgccgacatcaacgccgagaatgcgatgatgcatgaaggccatgcttccgaagccgacattaacggccacgttgatggctggatcaaagcccaccagccgctgttcgacagctgggtgaaaaccgccctcgccgcgcagcagtaa

SEQ ID NO: 3002 - DNA, 759 bp, Klebsiella pneumoniae
caaacagtgggaggaggcgtaatgaatcaggtgaaatcgctgaagcagctttcgtatggggggctggcggccgctgttctgctgatcatcgtcccgcaggaggcgttcgccatgcatatcatggagggctttttgccgccgatgtgggcgctggcgtggtggctgctgtttttaccctgcctgtggtacggcctggtgcgcctgcggcgtatcgttcaggaagagagcaatcagaaggtgctgctggccctctgcggggcgtttatttttgttctttcggcgctgaagatcccgtcggtgaccggcagctgctcgcatccgaccggcgtcggtctggcggtgatcctcttcgggccgggcgtggtggcggtgctgggggcgatcgttctgctgttccaggcgctgctgctggcgcatggcggcctgaccacccttggcgccaacgggatgtcgatggcggtgatcggcccgatggtcggctatctggtgtggaagctggcctgtcgggcggggatccgtcgcgatgtcggggtctttctctgcgccatgctggcggatctgatgacctactttgtcacctccgtccagctcggggtggcctttcccgatccggcaaccggggcaggcggatcgatcgccaagtttatgggcatcttctgcctgacgcagatcccgatcgccatcgcggaaggcttgctcaccgtgatgatctacgatcagctaaccaaacggcggctgatcgccgcggagggacattaa

SEQ ID NO: 3003 - DNA, 408 bp, Klebsiella pneumoniae
gtctggtcgggtatggatattaaggtgtatgataaatgcatcttaaaaaagacgaaaggcagggagatggggaagcgtatcgaacgggaaaaaatgacgattcagcggatgattgccctctaccagcggcgctgtcccgaggcgcaggccgataatgcgcactatcaggcgctgaacgcctacgctgacaagcgccttgataagtgcgtgtttggcgagaacaaaccggcctgcaagcagtgtccggtgcattgctaccagccggcgaagcgcgaggagatgaagcagattatgcgctgggccgggccgcggatgctctggcgccacccgatcctcactgttcgccatctgctggacgacaggcgcccggtgccgccgctgccggaaaaatatcgaccgaaaaagtag

SEQ ID NO: 3004 - DNA, 1137 bp, Klebsiella pneumoniae
atgagcgcgggaagcaccaaatttaccgtcagccgtattgcggctctttcactggtttcactctggctggccgggtgtaccaacaccaataatccgcctgcgccggttagctctgccggcggtgccgcctcttccagcaccaactccggcatgctgattacgccgccaccctccggcgtcaagtccgctcctcaggcgcagccgattcagccgatgcagacccagaccattcagccgcagccggcgccggtggcgcaggagccggtacagacggtaaatggccggatcgtttacaaccgcaaatatggcgatattccgaaaggtagctataccggcggcagtacctatacggtaaaacgcggcgacacgctattctatatcgcctgggtcaccggcaacgatttccgcgacctggcgcaacgcaacaatatcccggccccgtacgcgctgaacgtggggcaggtactgcaggtcggtaacgcctcaggccagccgatcaccggcgaaaacgccgtttctcaggccagcgcaagagcgagcggcggtgcgacgaccagcacaacttctgcacaaaaatcgaccgcggtggttgcttcacaaccgactattacgtattctgaatcttcaggtgaacagagtgctaccaagatgttgcctaataataaaccagcgactacaaccacaacggttgtcgcgccggtgacggcaccaacaacggtgagcacaacccagccgactgcaagcagtacgtcaaccagttcgccgatctcagcatggcgctggccgactgatggcaaggttatcgagaactttagcggcgcggaaggcggcaataaaggtatcgatattgcaggcagtaagggacaggctattgtcgcgaccgccgatgggcgcgtcgtctatgccggtaacgcactgcgcggctacggtaatcttattatcatcaaacacaacgatgattacctgagtgcctacgctcataacgataccatgctggttcgggagcaacaggaagtcaaagcggggcagaaaatcgctaccatgggtagcaccggaaccagctcaacaagattacattttgaaattcgttacaaggggaaatccgtcaacccgctgcagtacttaccgcagcgataa

SEQ ID NO: 3005 - DNA, 288 bp, Klebsiella pneumoniae
ataaaaaaggggcccgttcagggctttattaagaccagtttaaggttattattaccgggggatagaattggactcgcagatcggccagataattcactctttcatgtatcagtttgtacattactgtattttaaggttttttattttggctcttggaccttttattttatcctgaatgacaggaataacattttctgttacatatttccccccgcgcgtcagaatgctatttattttaattcttaccatgctaataaactaagccaaaagaaaagattgcttttttaa

SEQ ID NO: 3006 - DNA, 795 bp, Klebsiella pneumoniae
cgggttaggggagaatccggcggtgcgggcgatgtttgtcgcccatctgcagcaggcgctgaacgacacgatggagaaagcagcatgagcggcaaactatacgccctgagcagcgggccgggggcggccgatctgatcaccgtgcgtgcggcgcggatcctcggccagctggatgtgctgtatgcgccagccggccgcaaaggcggcgacagcctggcgctctccatcgtacgcgagtacctgggcgcacacacggaggtccgctgctgccattttccgatgagcgccgacagcgcggaaaaagaggcggtgtggaacgacgttgccgcggcgctggcccaggaggtggcggcgggcaggcaggtcgggtttatcaccctcggcgacgccatgttgttcagcacctgggtctttctgctgcagcggattggctgcccggagtggctggagattgtccctggcgttacctccttcgccgccattgccgcgcgggcgaaaacccctctggccatggagcagcagtcgctggcggtgatctcctgcaccgcgccggaagcggacattgccgcggcgctgcgccagcatgacagtctggtgctgatgaaagtctacggccgcttcgcccgcattaaggcgctgctggcgcaggcggggctgctggatgcggcgctgatgatgtcagaggccaccctgccgggcgagcagtgctggcgccgtctgcgcgaggtcagcgatgaccagccgctgccctatttctcgaccattctggttaacaaacagtgggaggaggcgtaa

SEQ ID NO: 3007 - DNA, 321 bp, Klebsiella pneumoniae
cggcgcaggggcaacctggcctggcgactatcagcagggcagcctgcgccagcgcctgcgccagatccgcctcgacgtcgcgtatgcggcgcagcagggcctgagctggcaggtggtgctggatgcggttcgtcagcaggggcaacggatctggcaggcgctcagcgtcgccgatcgccagcgttttctgcgccatctgcgccattactgggatgtccaccgctaccgcgtggcgccgcaggtcgccgaggtgctggaggcgcgccagcgcacgggcagtctgcaggtgcaggcggccaggctactgtcgataagcggtga

SEQ ID NO: 3008 - DNA, 2592 bp, Klebsiella pneumoniae
ttcccctttttgatgagcttaccggacggcgccagcatgaaaagaataacaacagccagggtgcgggagtatgccttgttgcccgttaccgccgggcgggcggtggcgctggcgacggtgccgacgatgatgttttgtctcagtccgttgagccgggcgctggccgacgactattttgacccggcggcgctggagtttgctgacccgcagcagcaaacctccgatctgcactacttcgccaaacccggcggccagcagccggggacttatcatgtcaccgtggtggttaatgaccaggagctgggtcaggctgatatcacgtttgttgacgatggcgggcagctgcgcccggtgctgacgcccggtcagctggcggagtatggcgtcaacgtcagcgcgtttcccgcctttcaagcgctgcatgaaggcgaaaccttcacccggatcgagaagtttattcccgacgccagcagtcggttcagcttcgctaaccagcgcctgacgctgagtattccccaggtggcgatgaacgtgcaaagccgcggctatgtcgatccgtcgcgctgggacgatggcgtgccggccgcgtttgtcgattactatttttccggcgcgcaaataaagaacgccgacgaaggggagagcagccgctcaaactatctcaatttacgcagcggcctcaacctgggcgcctggcgactgcgcaacatctcctcaatgcagtatgaccagcagcgccggcactgggatacccagagcacctggctgcagcgcgatgtccgctcgctgaagagcttgctgcggatcggcgatacctataccaccggcgatgtgtttgacagcatacagtttcgcggcgtccagctaatgtctgacgatgaaatgctcccggacagccagcgcggctttgcccccaccattcgtggcgtggcgcaccgcaatgccaaagtgaccgtctctcagcacgggtatgtgatctacgagacctttgtgtcgccgggggcgttcgccatcagcgatctctaccccacctcgcagagcggcgatctggaggtgaaggtgaccgagagcaatggcgcggtgcgtacctttacccagccctattccgcggtgccatatatgctgcgcgaagggcgcggcaaattcagtctcagcgccggccgctaccactccgggggggagtcggtgcgctcgccggaatttctgcagggcactttgttctacggtttgacggcgggattcaccctctacggtggtacgcagctggcccgggactatcaggcgtgggcgctgggcctgggccgcggttttggcgagttcggatcgctgggaggggatgtcacccaggccgtcacccgtacgccgtcgggcaagcgctatacgggccattcgctgcgcgctcagtatcagaaaaattttgtcagctcgggcactgcgttcagcctcgccagctatcgctactcgtcaagcggctattacgattttgccgaagccagcgccctcgaaagcgcccaggggcaagtagacaaccggcgtcgccgggaagagctgtcggtgtcgcaaagccttggtggcctgggcagtctggcggtttccgcctggtcgcaggagtactggcatcggcagagtcgggatgagacggtgcaccttgggttctacagcgcctggaaagggatctcctggggcgtgggctattactacacccgcgccagcggccagcaaaaaaatgaccgctcctggtcattcaatatcaatattccgctgggtggtccgctgtccgacagcgcggtgagctacaacaccacctcggacagcaatggctatacctcgcagcagatgtcgctgtatggcgcggtgccgacgcggccaaatctgttctactcggttcagcaaggttatggcaaccagggacgaggcagcaacagcagcgcctccctggactaccacggcggcttcggcaacgcccagatcggctatcgccatgacgccgccagcaaccagttgacctggggaggcgccggctcggtggtcgcgcatccgcacggcgtcaccttcggccagacggtgggtgagagcttcgccatcgtccgggcgccgggggccgccggcgtggcggtgcaaaacggcaacaatgtgcacaccgactggcgcggctatgccgtggtgccctctctgaccgcctaccggaaaaatgtcattaccctcgatacggagtcgatggccgacgacaccgacgtcgaccagcaggggcagaccgtgatccccggcggcggcgcggtggtgatggccaactaccagacccacattggtaaccgggtgctgtttaccctgcgcaatgcccaggggccgctaccgtttggcgccagtgcgcggctggtcgaggaggaggagagcggcaatccgccgggcggcatggtggccgacggcggccaggtgtatctcagcggtgtgccgcaggagggaaccctggcggtgagttggatcgtcaacaaccagtcgcagagctgcacgctgcattttcatcttccggataacccacagcagagtctgaatacggtgaaaaccgtctccggactgtgccagacacgctga

SEQ ID NO: 3009 - DNA, 1614 bp, Klebsiella pneumoniae
ttcgcctttatcgcccacctggccgccggactccgcatagaacggggtctggtcaaggatcaccaccgcttcctggccagcgctaacgctatccaccgctttgccgtcgataaacagggcggtaaccttgccgttcagctccagatgatcgtagcctttaaattcagaggcgccgtcaacgcggatcatcgcattatagtcggcgccgaaaccgctggactcgcgcgcgcggcggcgctgctcttccattgcggcttcaaaaccagcttcatcaaccttgatgttgcgctcgcggcacacatcggcggtcaggtcgaccgggaagccgtaggtgtcgtacagacggaaggcggtttcgccgtccagggtgtcgcctttcagcttcgacagctcctcatccagcagcgccaggccgcgctcgagggtgcgggcaaactgctcttcttcggttttcagcacctgctcaacctgagcctgctgctgcttcagctcgtcgccggcggagcccatcacatcgatcagcggggcaaccagtttccagaagaaggtgtccttcgcgcccagcatgttgccgtgacggatcgcgcggcgaatgatacgacgcagcacgtagccgcggttttcattcgacgggatcacgccgtcggcaaccaggaaggcgcaggagcgaatgtggtcggcgataacgcgcagcgacttgttcgtcagatcggtcgcgccggtgactttcgccacgctggcgatcagatcgcggaacaggtcgatgtcatagttggagttaacgtgctgcagcaccgcggcaatacgctccagacccataccggtgtcgacggacggcttcggcagcggctccatggtaccgtcagcctgacggttgaactgcatgaagacgatgttccaaatctcaatgtaacggtcgccatcttcttccgggcttcccggagggccgccccagatgtgatcgccgtggtcaaagaagatttcggtgcacgggccgcacggaccggtgtcgcccatctgccagaagttgtcagaagcaaacggcgcgcctttgttgtcgcctatgcggataatacgctcgcgcggaacgcctacttcattggcccagatgtcgaaagcttcgtcatcggtctcgtaaacggtaacccacagtttttctttcggcagcgcgaaccagttctcaccggtcagcagttcccacgcgtatttgatggcatcctgcttgaagtaatcgccaaagctgaagttgcccagcatttcaaagaaggtgtggtgacgcgcggtgtaaccgacgttttccagatcgttgtgtttaccacccgcacgcacgcaacgctgtgcggtggtcgcacgcgaataattacgtttgtcgagaccaaggaagacatccttgaactggttcatccctgcattggtaaacagcagggtcggatcgttgtgcggcaccagggagctgctggcaactacctgatgtcccttgctatggaaaaagtcgagaaacgcctgacggatctcagcggtgctcttgctcataattatcctgaaatcaagctacacgtcatccttcaagtcgcctctgtcctggctgcgcttgctcttccggcaccgaactga

SEQ ID NO: 3010 - DNA, 1101 bp, Klebsiella pneumoniae
ggaccccttatgttttccgcgttgtgccgccgtctgcttccgctggcgctcggcaccggttttgtttttgccgccgcccccgcattcagcgcgctgggcgacaccgccagtagccaggcccgccatatcgccaccgtcttcccgggacgaatgaccggaacgccgccggaaatgctctcagctgactatctgcgccagcagttcgccctgatggggtatcagagcgacgtgcgaagcttcaatacccgctatatctataccgacagcaatcagcgcaagaactggcataacgccaccggcagtacggtgatcgccgcccatgaaggtaaagtgcgccagcagattattatcatggcacacctcgacacctatgcgccgcagagcgataaagacgtggagaacaacctcggcggcctgacgctgcagggcatcgacgacaacgcgatgggacttggcgtattgctggagctggcggagcatttaaagaacgtccctacccgctatggcatccgctttatcgccaccagcggtgaagaggaaggccgtctcggcgcgcaaaacctgctgcagcggatgagcgaagcggaaaagaaaaataccctgctggtgatcaatctcgataatctggtggtgggcgataagctttacttcaacagcggccgcagcacgccggcctcggtgcgcaagctgacccgcgaccgcgcgctggctatcgctcgcagcaagggcatcgccgcctacaccaacccgggactcaacccggcttatccgaaaggcaccagctgctgcaatgacgccagcgtcttcgacaacgccgggatcccggtgctgtcggtcgaggcgactaactggtcactcggcaaaaaagatggctatcagcagcggagcaaatcggccagtttcccgcagggaaccagttggcatgacgtccagctggataatcagcagtatatcgaccacgcgctgccgggggcgcatcgaacaccgcggacgcgaggtagtgaaagtcatgctgccgctggtgaaagagctggcgaaagtggagaagaaaagctaatacgcacaaaagaacgcgcggtatcgcccgcgtgttctttttga

SEQ ID NO: 3011 - DNA, 198 bp, Klebsiella pneumoniae
agaaaacttatcttattcccactttattccgtcgggccgctggttgtgactgtgcaggcagcggcctgggcgattattcctttacacaaaatcattcaagctgcatcagggcggcaagagagactctctttcgcaacgcacgtcagttcggtgccggaagagcaagcgcagccaggacagaggcgacttgaaggatga

SEQ ID NO: 3012 - DNA, 492 bp, Klebsiella pneumoniae
ttcctcgttatcttttaccgcacattgaccttaccttattcattaaggacagtgctttcggaaaattccagaaaccacaacagtaagcataattcaaaatcttgtcctacacttactcactcgatggaattaagggagataacgatggctaaccatgtgaaccgcaacaattttgacgagaacgccgaagatattcataacgatgtcagccaattagcggatacgctggaagaggtgctgaaatcatggggcagtgacgccaaagaggaagcggaagcggcgcgtgtcaaagcgcagtcgctgttaaaagagactcgtgcccgccttaatggccacaaccgggtgcagcaggcggcgctggatgcgcgccaggcagcgtgcgatgcgctgggctgtgccgatacctacgtgcgcaataaaccgtggcacagtgtgggcgccgccgccgccgtcggggtatttattggcgtattgctcaatttacgtcgataa

SEQ ID NO: 3013 - DNA, 918 bp, Klebsiella pneumoniae
ggaacggttatggaccaaaaacgactcactcacctgcggcaactggaggcggaaagcatccatattattcgtgaggtggccgccgaattttctaacccggtaatgatgtactccatcgggaaagattccagcgtaatgctgcatctggcgcgcaaagcgttttatccgggaaccctgccgttcccgctgctgcacgtcgataccggctggaaattccgtgagatgtatgagttccgcgaccggaccgctaaagcctacggctgtgaactgctggtgcataaaaacccggaaggggtggcgatgggcatcaacccgtttgtccacggcagcgccaagcataccgatatcatgaaaaccgaaggcctgaagcaggcgctgaacaaatacggctttgacgccgcgttcggcggcgcgcgtcgcgacgaagagaaatcccgcgcgaaagagcgcatctactccttccgcgaccgtttccaccgctgggacccgaaaaatcagcgtccggagctgtggcacaactacaacggccagattaacaaaggcgaaagcatccgcgtcttcccgctctccaactggaccgagctggatatctggcagtacatctatctggaaaatattgaaatcgtgccgctgtatctggccgctgagcgtccggtgcttgagcgcgacggtatgctgatgatgatcgatgacgaccgtatcgatctgcagccgggcgaggtgattgaaaaacggatggtgcgtttccgtaccctcggctgctggccgctgaccggcgcggtggagtctgaagcgcagacgctacccgaaattattgaagagatgctggtatcgaccaccagcgaacgtcaggggcgcgtcattgaccgcgaccaggccggctcgatggagctgaagaaacgtcaggggtatttctaa

SEQ ID NO: 3014 - DNA, 573 bp, Klebsiella pneumoniae
aaacgctctattgcccgtgaggatcctatgaccatcgccaccttaactcccgccgaggcccaggcgcagattgcccagggcgccagactgattgatatccgcgatgcggatgaatatgcgcgcgaacatatccccgatgccgagctggtgccgctcgccactctgaccagcggtgcgcccctcaatgcccgggccggagagacggtcatctttcactgccaggcgggttcccggacgcagaataatgcgattcgtctggccgcggccgccgcgccggcgcaggcctgcctgctggcaggaggaattcaggcgtggaaagccgcggggttgccggtagtggaagattcatcgcagccgctgccgctgatgcgccaggtgcaaattgccgctggcgtcctgattttactgggggtgctgctgggctataccgttaacggcggctttttcctgctcagcggcgcggtcggcgccgggctcaccttcgccggcgtaaccggcttttgcggcatggcgcgtctgctggcgaccatgccgtggaaccggcgccagggggttaaaacgcgctccagataa

SEQ ID NO: 3015 - DNA, 855 bp, Klebsiella pneumoniae
tccccggctatatcgccgctgctacgcttaataggagatccacaaccagaaggcaggaacatgaaaattgatttagcgggaaaagtcgcgctggtcaccgcctccacggcgggtattggcttcgccatcgccaaaggcctggcggagagcggcgcagaggtcatccttaacgggcgcagcgagcagagcgtgaacgccgcgatcgcccggctgcaaaatgaggtgccgggcgcgaaggcgcgccccgccatcgccgacctcagcgacgccgacggcgcagcgcagctgctgcgggccgtgaccggcgtcgatattctggtcaataacgccgggatctatggcccgcaggatttctacgccaccgacgacgcgacctgggacaactactggcagaccaacgtcatgtccggcgtacgcctgtcgcgggggctgctcccggcgatggtcagtaaaggctgggggcgggtggtgtttatctcctcagaatcggcgcgcaatatcccggcggacatgatccactatggcgtgaccaagaccgcgcagctctcgctggcccgcggcctggcgaaatatgtcgccggcagcggagtgaccgttaacagcgttctgccagggccaacgatttccgacggctttgccgaaatgctgaaagacgaagtggcgaaaaccggtcagtcgctggaggaactggcgaaagcgtttgtcatgacccatcgtccgagctcggtgatccagcgggcggcctcggtggaagaggtcgccaatatggtggtctacgtctgctcgccgcaggcgtcggccacctccggcgccgcgctgcgcgtcgatggcggcgtggtggatgatattctctga

SEQ ID NO: 3016 - DNA, 756 bp, Klebsiella pneumoniae
gttattcatatggaaaaccccgcgcccttaacctgtgccttacctgaacgcgtcgccaccgtcggcgaaggcgtcaaagacagtctccccatcgtcatcagctaccttccggtggcattcgccttcggactcaatgctacccggctgggcttcaccccgctggaaagcctgttcttctcctgcattatttacgccggcgccagccagtttgtgatcaccgccatgttggccgccggcagttcgctgtgggtcgccgccctgacggtgatggcgatggatgtccgccacgtgctgtatggcccttcactgcgcagccgcattcgctcagcgctggataaaaagaaaaccgccctctgggccttcggcctgaccgatgaggttttcgccgccgctaccgccaggctggttcgcgataaccgccgctggagcgaaaactggatgctcggtctcgcttttacctcgtgggcatcgtgggtgtgcggcacgctggccggcgcctggtccggcaacggcctgctggtggattatccggcggtggaagccgccctcggctttatgctgccggcgctgtttatgagcttcctgctggcctctttccagcgtcagcagtcactctgcgtcacggcggcgctggcgggcgcgctgggcggcattctgttattttccattccggcggcgatcctcgccggaattgtctgcgggtgtctgacggcgctgcttcaggccatgctcaaggggatgccggatgaacagtga

SEQ ID NO: 3017 - DNA, 897 bp, Klebsiella pneumoniae
gtaaatatcatgccaatgaaatttaagcagattcaggcatttattaccgtcgcccgcgaaggcaatatgaccctggccgcagagaaaatggggatcacccagtcgggactgagccgactgctattgagcctggaagcggacctgagcgcatccttattcgaacgacataagcacggcatggcgttgagcgaatatggcagcgcctttttaccctacgcgctgacgatgctgaataccgaacaaaaggcgcgcgaggaaattgagctcatccgcggcgccgggaaaggcattctgcggattggctgcgtttccagtctgctgaccagccatttcatcgataagctggcggctttccatcagcgccatccccagatccatctgcggatcgtcgaccgcattgactccgagctgtataagctgttgctgatgcacgacatcgatatcgccctctgcggtcccttaccgcatgatgagaaaatcgtggtgcggggcaaaattaactggcaggaccggatctgcatcgtcgccaggcagcaccacccgctgcatcaggcggcggacgtcaccctggaggcgatgctggactatccgtggatcatgccgccgccgtctagtacgccaatgaacatcctggcggatatctttcgcgcccggcagttgccctgtccgcaaccggttattgagtgcgcctcatcctcggccattaaggcctttctgtgcgagagcgatctgttaacgtcgatgccggccccggtttaccgacacgaagaagcgcttggcctgctgcgcccgtttgagctcgagggcagcgtttttatccgggatttctatgcctacagccatttcggggttctgtccggggcagccctgcagttgattcagcatctgaagcagtga

SEQ ID NO: 3018 - DNA, 1332 bp, Klebsiella pneumoniae
ggaaagatcatgagctctctgtacgctaaactgatcgacgtgatcgaacggcagatcacgccgctggccggcgcgatcggccagcaaaaatatgtcacctcgatccgcgatggctttatcactgccctgccctttatgatcgtcggctcgttcctgctggtgtttatcttcccgccgttttctccggatacgacgtgggggtttgcccgcgcctggctgcaattttcgctcgatcatcgcgatgcgctgatgctgccgttcaacttcagcatgggggtgatgaccctgtttatcgccgtcgggatcgccgccagcctcgccaaacaccatcatctggactcgctgaccgccgggatgttgtcgctgatgtcgtttctgctggtagccgcgccgctgaaagatggccagatctctactgcctacttctccggtcaggggatctttaccgccattctggtggccatctattccaccgagctgtacgccttcctcaaacggcataacatcaccattcgcctgccgccggaagtgcctgccggggtggcgcgctcgtttgaaatcctgatcccggtgctggcgatcattctgacgctgcatccgctgaacctgtttatcgaagcccagctggggatgatcattccggaagcgatcatgtcgctggtgaagccgctggtcgcggcttccgatacgctgccggcgatcctgctgtcggtgctggtctgtcaggtgctgtggttcgccgggatccacggcgcgctgatcgtcaccgggatcatgaacccgttctggatggccaacctgtcggtcaatcaggcggccatggccgctggcaccgctatcccgcacatctatgtccagggcttctgggatcactatctgctgatcggcggcgtcggctccaccctgccgctggcgctgatgctgctgcgcagcaaggccgtgcatctgcggacgatcggccggatgggggtcgtgccgggcgtatttaacatcaacgaaccgattctgttcggcgcgccgatcatcatgaacccgctgtttttcctgccgttcgtgctggtgccgatggtcaacgcgaccctggcgtacttcgcgctgaagctggacctggtcagtcgcgtagtgtcgatgacgccgtggacaacgccggcgcctatcggcgcctcgtgggcggcgaactggggctttagcccggtgatcctgtgcctcatttgtatggccaccgccatggtgatgtacctgccatttctcaaagcttacgaaaaacagctgggggcccaggaacgtgaaaacgccgtcggccaggctgacaacgcggcgcaaaccgcttaa

SEQ ID NO: 3019 - DNA, 1341 bp, Klebsiella pneumoniae
gggtttgtcatggtgaaggaacgtcgcactgaactggtagaaggattccgccattctgttccctatattaatgcccatcggggaaaaacgtttgtcatcatgctgggcggcgaagccattgagcatgaaaatttctcaaatattgtcaatgacataggattattgcatagcctgggcattcgcctggtggtggtctatggcgcccgcccgcagattgacgctaacctcgccgagcaccatcacgagccggtctatcacaagcagacgcgagtgactgacgccaaaacgctggagctggttaagcaggcggcggggatgctgcagctggagatcaccgcccgtctgtcgatgagcctcaacaacaccccgctgcagggggcccatatcaacgttgtcagcggcaactttatcattgcccagccgctgggcgtcgatgacggcgtcgattattgccacagcggacgcattcgccgcattgacgaagaggcgattcatcgtcagctcgacagcggcgccattgtcctgatggggccggtcgcggtgtcggtcaccggcgagagctttaacctgacttcggaagagatcgctacccagctggccatcaagctgaaggcggagaaaatgatcggcttctgttcgtcgcaaggggtttacaaccaggccggggaaattgtctccgaactgttccctaatgaggcgcaggcccgcgtcgaagagctggaagcagacgaagactataactccggcaccgtgcgcttcctgcgcggggcggtgaaggcctgccgcagcggcgtacggcgctgccacctgatcagctatcaggaaaatggcgcgctgctgcaggagctgttttcacgcgacggcatcggcacccagatcgtcatggagagcgcggagcagatccgtcgggcgaccatcaatgatatcggcggtattcttgagctgataagcccgctcgagcagcagggcattctggtacgccgttcccgcgaacagctggagatggagatcgacaaattcaccattattcagcgcgataacaccaccatcgcctgcgccgccctctatcctttcccggaagagaagatcggcgaaatggcctgcgtggcggtgcatccggattaccggagctcgtcgcggggagaggtgctgctggagcgtattgccgctcaggccaggcagatgggactgagcaagctgttcgtgttaaccacccgcagcatccactggttccaggagcgcggcttcacgccggtggatatcgacctgctgccggagagtaaaaagcagatgtataactatcagcgccggtcgaaggtgctgatggccgacctcgcttaa

SEQ ID NO: 3020 - DNA, 1065 bp, Klebsiella pneumoniae
aggctgaccattaaggagaacactatgctgagccatcctgctgaaaagtaccgtccctatccgccgttcgccctgcctgaccgccgctggccagaccggcaaatcagccacgccccgcgctggctgtcgactgacctgcgcgacggcaaccaggcgctggcggagcccatggacagcgcccgcaaactgcagttctgggatctgctgctggagtgcggctttaaagagattgaagtcgccttcccttccgcctcacaaaccgatttcaactttgtccgccagctgattgacgaacagcgcatcccggaggatgtcaccatccaggtgctgacccaggcgcgagacccgctgatcctgcgcacctttgaggcgctgcgcggcgcccgccgggctaccgtccacctctacaatgccaccgcgccgctgttccgcgagctggttttcggcatggacaaggccgaggtgatcgccctcgcgacccgcgccacccggcttatccgtcagcagtgcgaacagcagccggagacccgctggcaatatgaatattcgcctgaaaccttctgcttcaccgagcccgagtttgcgcttgagatttgcgaagcggtggcggatgtctggcagccctgcgccgagcgaccgatgatcgtcaatctgccggcgacggtggaagtcaacacccccaacgtctatgccgatcagatcgagtatttttgccggcacttctcccgccgcggcgaggtctgcatcagcgtgcacccgcataacgatcgcggcaccggcgtcgccagcgccgagctggcggtgatggccggcgccgatcgggtagaaggctgcctgtttggcaacggcgaacgcaccggcaacgtctgtctggtgactttggcgatgaacctctacagccagggcatcgaccctgagcttcgcttcgagcagatgaaccgggtggtggaggtggtggaaaactgcaaccagatccccgttcacccgcgccacccgtgggcgggaagtctggcttacaccgccttcctccggctcccatcaggatgcgatcaaaaaagggtttga

SEQ ID NO: 3021 - DNA, 684 bp, Klebsiella pneumoniae
  unsure (11): Identity of nucleotide at the above locations are unknown.
acagagatgantatgcagtacccgattaacgagatgttccagaccctgcaaggcgagggttacttcaccggcgtgcctgccatttttattcgtctgcagggatgcccggtaggatgcgcgtggtgtgacaccaagcatacctgggacaagctggccgatcgggaagtgtcgttgttcagcatcctggcgaaaaccaaagagagcgacaagtggggcccggcaagcagcgaggatctgctggcgattattgggcggcaggggtggacagcccgccacgtggtcattaccggcggtgagccctgcattcatgatttaacgccgttaacctcgcttctggaacaaaacggctttagctgtcagattgaaaccagcggcacccatgaagtacgctgcagccccaatacctgggtgacggtttccccgaaggtcaacatgcgcggtggctatgacgtgctgtctcaggccctgcagcgggcggatgagatcaagcatccggtagggcgcgtccgcgacatagaagcgctggacgaactgctggaaacgctgagcgatgacaaaccgcggatcatcgccctgcagccgatcagtcagaaagaagatgcgacgcgcctgtgtatcgacacctgcatcgcccgcaactggcgcctgtctatgcagacgcacaagtatctgaatattgcctga

SEQ ID NO: 3022 - DNA, 552 bp, Klebsiella pneumoniae
ggaatcgccatgtttacctttattaaaaaagttattaagaccggcaccacgacgcacgcctacccgctggagccgatgccggtagacaaaaactttcgcggcaagccggagcatacgccacagcagtgtatcggctgcgcggcctgcgtgaacgcctgcccgtcgaacgccctgacggtcgagatcgatctggccactaaccagctggcgtggcagtttaacctcgggcgctgcatcttctgcggtcgctgtgaagaggtgtgcccgacggcggcgattaagctgtcgccggagtatgagctggcggtgtggaagaaagaggatttcctccagcagtcgcgcttcgctatctgccactgccgggagtgccagcgtccgttcgcggtgcagaaggagatcgactacgccatcgcgctgctcaagcataacggcgatacccgcgccgagctgcaccgcgaaagcttcgaaacctgcccggaatgcaagcgccagaaatgcctggtgccgtccgatcgtattgaactgacccgccacatgagggaggccagctga

SEQ ID NO: 3023 - DNA, 1437 bp, Klebsiella pneumoniae
ggagccgccatgaacacgaccattgcccaacaaattgccaacgaaggcggcgtagaagcttacctgcacgcgcaacagcacaagagcctgctgcgttttttgacctgcggcagcgtcgatgacggcaaaagcaccttaattggccgcctgctgcacgatacgcgccagatctatgaagaccagctctcttcgctgcacaacgacagcaagcgtcacggcacccagggcgaaaaactggacctggcgctgctggtggacggcctgcaggctgagcgtgagcagggcatcaccatcgatgtcgcttaccgctacttctcgaccgaaaaacgcaaatttatcatcgccgacaccccggggcacgagcagtacacgcgcaatatggccactggggcgtccacctgcgacctggcgatcctgctgatcgatgcgcgcaagggggtgctcgaccagacccgccgtcacagcttcatctcgacgctgctgggcattaaacacctggtagtggcggtcaacaaaatggatctcgtcgagtttagcgaagcgcgcttcaacgagatccgggaagattatctgacctttgccgagcagctgccgggcaaccttgatatccgctttgtgccgttgtcggcgctggaaggcgataatgtcgccagccagagcgcgaatatgccgtggtacagtggcccgacgctgctggaagtcctcgaaaccgtagagatccagcgggtggtcgagagccagccgctgcgcttcccggtgcagtatgttaaccgtccgaacctcgatttccgcggcttctccggcacggtcgcctccggtaccgtgcaggttggccagcgtctgaaggtgctgccgtcgggcgtcgaatcgagcgtggcgcgtatcgtcaccttcgacggcgacctgcaggaagccgccgccggcgaagccattacccttgtgctgaaagatgaaatcgacatcagtcgcggcgacctgctggttgacgcgcaagcctcgctgccggcggtacaaagcgccagcatcgacgtggtgtggatggccgaacagccgctgaccccgggccagagctacgacatcaaaatcgccggcaagaagacccgcgctcgcgtcgacgctatccgctaccaggtcgatattaacaacctgacccagcgtgaagtcgagtctctgccgctgaacggcatcggcctggtggagctgacctttgacgaacctttagtgctggatccgtatcagcaaaacccggtgaccggcgggtttatttttatcgatcgcctgaccaacgtcaccgtcggcgccgggatggtcaacgagccgcacctgcaggcatcgacttcggcatcacagtacagcgccttcgagctggagctgaaccagctgatccgtaaacatttcccgcactgggacgcccgcgacctgctgggaggcaaataa

SEQ ID NO: 3024 - DNA, 2259 bp, Klebsiella pneumoniae
gccacgcacattatgctcactcggttgcgagaaatagtcgagaaggtcgcgagcgcgccgcgtttaaacgaggcgctggatattctggtgacggatgtctgccaggcgatggagacggaagtctgctcggtttacctggctgacaatgaccgacgctgctattacctgatggccacccgcgggttaaaaaaacctcgcgggcgcaccgttgcgctggcgttcgatgaaggcctggtggggctggttggccgtctggcggaacccatcaacctcgccgatgcgcaaaaacaccccagcttcaaatatatccccgccgtcaaagaggaccgcttccgcgccttccttggcgtgccgatcattcagcgccgccagctgctgggcgtgctggtggtccagcagcgcgagctgcgtcagtttgatgaaagcgaagagtctttcctcgtcaccctcgccacccagatggcggcgatcctctcccagtcccagctgaacgccctgttcggccagtatcgtcaaacgcgcattcgcgctctgccggcctcttccggggtggcgatcgccgagggctggatggacgtcagcctgccgctgatggagcaggtgtatgaagcctcgacgctggacaccgcctcggaacgcgaacgcctgaccggtgcgctggaagaggcggccaacgagtttcgtcgctacagcaaacgctacgctgccggggcgcaaaaagagacggcggcgatcttcgatctctactcgcacctgctctctgacgcccgcctgcgtcgcgagctgtttgccgaagttgacaaaggcgccgtcgccgagtgggccgtcaaaaagatcattgagaagttcgccgaacagtttgccgcgctgagcgacggctatttgaaagagcgggccggcgatctgcgtaccctgggccagcgtctgctgttccatctcgacgacagtattcaggggcccaacacctggccggcgcgcattatcctcgtggcggacgagctgtcggccaccacactcgccgaagtgccgcaggatcgcctggccggcgtggtggtgcgcgatggcgccgccaactcccatgccgctattatggtgcgggccctcggcatcccaacggtgatgggcgccgatattcagccctcgctgctgcatggccatacgctgattgtcgatggctatcgcggtgaactgctggtggatcctgaacctgtcctgttgcaggagtatcagcgccttatcagcgaagagaacgaactcagccgcctggcggaggacgatctccagcgcgcgtcggagttgaaaagcggcgagcgggtgaaagtcatgctcaacgccggcttaagcccggagcacgaagagaagctcggcagctttgttgacggcattggcctctaccgcaccgaaattccctttatgctgcagagcggcttcccctcagaagaggagcaggtcgcccagtatcagggcatgctgcagatgtttaacagcaaaccggtgaccctgcgtaccctggacatcggcgcggataaacagctgccgtatatgccgatcagcgaagagaacccgtgcctcggctggcgcgggatccgcatcaccctcgatcagccggagatctttttgatccaggtgcgggcgatgctgcgcgccaacgccgccaccggcaacctcagcattttgctgccgatggtgaccagtctggaggaggtggatgaggcccgtcggctgatcgatcgcgccagccgggaagtggaagagatgatcggctacgccatcccacgtccgcgcctgggggtgatgctggaggtcccgtcgatggtctttatgctgccgcagctggccagccggatcgattttatctcggtagggacgaacgacctgacccagtacctgctggccgtcgaccgcaacaatacccgggtcgccagcatgtatgacagcctgcatcctgcggtattgcgggcgctggcgatgatcgcccatgacgcggaacgctttggcatcgatctgcgcctgtgcggcgagatggcgggcgacccgatgtgcgtgacgatccttatcggcctcggttaccgccatctgtcgatgaacggccgctcggtggcgagggtgaagtatctgctgcgccgcattgatatcgaagaggcgcaggagctgtcgcgtcgcagcctcgatgcgcagatgaccgccgaggtgcgccatcaggtggcggcctttatggagcgtcgtggtctcggcggcctgatccgcggcgggcggtag

SEQ ID NO: 3025 - DNA, 405 bp, Klebsiella pneumoniae
ggtaacaacatgaccagccgttttatgctgatattcgccgcgattagcggctttatctttgtggctctgggcgcctttggcgcgcatgtcttaagtcaatcgctcggcgcggcggagatggcctggatccataccggcctggagtatcaggccttccataccctggcgatttttggtctggcggtggcgatgcagcgtcggatcagtatctggttctactggagcagcgtatttctggcgttagggaccgtgctgttcagcggcagcctctattgtctggcgctctctcatttacgtctgtgggcgttcgtgaccccggtgggcggcgtaagcttcctcgccggttgggttttaatgttaattggtgcaattcgtctgaaacgtaagggcgttgttcatgaataa

SEQ ID NO: 3026 - DNA, 207 bp, Klebsiella pneumoniae
cgaatgaacatagacaattcagatgttagtctcttctttgcagggaggcaagatatgctgacaaaatatgcccttgtggcaatcatcgtactctgtattacggtactgggatttacgctgttggtgcacagctcactatgcgagctgagtattaaagagcgtaatattgagtttaaagctgttctcgcttacgaatcgaagaagtag

SEQ ID NO: 3027 - DNA, 201 bp, Klebsiella pneumoniae
agattatgcattcagaacgggtgcggcgataatttcgcagcctatgcaacaacatcgtcgttgttactgaggagaatatggtgcatccgggaggatgagtcggctacgcctcgcccttcgggccgttgcatacgcaacgttatccccctggtgctggcgatgatttcgcagaccataaaacaacgtcgtcgctgttattaa

SEQ ID NO: 3028 - DNA, 2760 bp, Klebsiella pneumoniae
tggaaccgcatgaccaactacagcctgcgtgctcgcatgatgattctgattctggcgccaaccgtcctgataggactgttgctcagtattttctttgtcgctcatcgttataacgacctgcaacgccagctggaggacgctggcgccagtattatcgaaccgctggcggtctccagcgaatatggcatgaacttgcaaaaccgtgaatccatcggccagctgatcagcgttctgcatcgtcgccactcggagatcgtgcgggccatctcggtgtacgattcgcataaccgcttatttgtcacctccaattaccagctcaatcccagcgaactgcagatcccgaaaggcgaggcattcccccgtcacctcagcgtcatccgcgatggcgacatgatgatcctgcgcacgcctattgtctcggaaagctattctccggatgaatcacccgaatctgacgctaaaatgccgggcaatatgctgggctacgtcgccctggagctggatctaaaatcggtccgcctccagcagtacaaagagatttttatctccagcgtaatgatgctgttctgtatcggcatcgcgttaatcttcggctggaggctgatgcgcgacgtcaccgggccaatccgcaatatggttaacactgtcgaccgcatccgccgcggacagctggacagccgggtcgaaggctttatgctcggcgaactggatatgctgaaaaatggcattaactcgatggccatgtcgctggcggcataccacgaagagatgcaacacaacgtcgaccaggcgacctccgatctacgggaaacgcttgagcagatggagatccagaacgtcgagctggacctggcgaaaaagcgcgcccaggaggcggcgcgcattaagtctgagttcctggccaatatgtctcacgagctgcgcaccccgctcaatggggtgatcggctttacccgcctgacgctgaaaaccgatctcaacgctacgcagcgcgaccacctgaccaccatcgaacgttcggccaacaatctgctggcgatcatcaatgacgtgctcgacttttccaagctggaagccgggaagctgatcctggagagtattccgttcctgctgcgcacttcgcttgatgaagtggtcaccctgctggcgcattccgcgcacgataaagggctggagctgacgctgaatattaagaacaatgtaccggacaacgttatcggcgacccgctgcgtctgcagcagattgtgaccaacctcgtgggcaacgccatcaaatttaccgagcacggcaatatcgacgtactggtggagcagcgggccatcagtaattcccgggtacagatcgaaattcagatccacgataccggcatcggcatccccgagcgcgaccagtcccggctattccaggccttccgtcaggccgatgccagtatttcacgccgccacggcggcaccgggctcgggctggtgattactcagcgtctggtcaaagagatgggcggggatatttcgttccacagccagccgaaccgcggctccaccttctggttccatatcagcctcgatctcaacccgaacgccattccggatacgctgaacaccgacgggcttgtcggcaaacgtctggcctatgtggaagccaacgcgacggcggcgcagtgtaccctggagatgctggccgctacgccgctggaggttatctatagccctaccttctcctcgctggcggaagcgcagtatgacattctgctggtcggtatcccggtttcaatgcgcgatttgtcgccgcatcgggaaaaattagccaaagcctgcgcgatgtccgataacgtactgctggccctgccgtgccatgcccaggtcagcgccgaagccctgaagcgcgacggcgttgccgcctgcctgttaaagccgctcaccaccacccgtctgctaccggcgctggtggctaccagccacgcgcttgcctccgcgccgctgatgcagatcgacagtcataagttgccaatgacggtaatggccgtcgacgacaacccggctaacctgaagctgattggcgccctgctggatgatcttgtgcagcaggtgatcctctgcgacagcggccagcaggcggtggacaaggccaagcagctgcagatggatctgatcctgatggatattcagatgccggatatggacggcatccgcgcctgtgagcttatccatcacctgtcccatcatcagcaaaccccggttattgcggtcaccgcgcacgccctggagggccagcgtgagaaattactgagcgccggcatgaacgactatctggcgaagccaatcgaagaagagaaactgcacgcactgctgctgcgctatcagcccggcctgcacagcgtcgttccggcgtcgttaccgcccgcagagccgatcgtcgatcataatcaaacgctcgactggcagctggcgctgcgccaggcggccatgaagccggacctggcgcgggagatgctgcaaatgctgatcgcctttatgccggaggtgcgtaacaaagttgaggagcagctggtgggcgagcagccggaagggctggtggatctgatccataaactgcacggcagctgcagctatagcggcgtgccgcggctgaaaaagctgtgccataccctggaaagtcagctgcgggcaggcaccgccgccgaggatctggagccggagctgcttgagctgttagatgagatggataatgtggcccgcgaagcgtgccggatgggggtgtaa

SEQ ID NO: 3029 - DNA, 3390 bp, Klebsiella pneumoniae
tcaggagcaattatgttaagggtataccactcaaaccggctggatgttctcgaggcgttgatggagtttatcgtcgagcgccagcggctggatgacccttttcaggccgaaatggtgctggtgcagagtaccggcatggcgcagtggctgcagatgaccctggccgcgcgctttgggattgccgccaatatcgagttcccgctgccggcgagctttatctgggatatgttcgtgcgcgtcctgaaagatattccgggcgaaagcgccttcagcaagcagagcatgagctggaagctgatgaccctcctgccgcagcacctggaggaagacgattttatcctgctgcgccagtatctgagtgatgacggcgacaagcgcaagctgtttcagctggccgcccgggtggcggacctctatgaccagtacctcgtctatcgcccggagtggctgatgcgctgggaggccggccagcgggtggaaggtctcggcgatgcccagcagtggcaggcgccgctgtggcaggcgctggtgagctacaccgccgagctggggcagccgcagtggcaccgcgccaatctctaccagcgctttatcagtaccctggaaaaagcggacgaaccgcccgccgggctgccgtcgcgcgtcttcatctgcgggatttccgcgctgccgccggtctatcttcaggccctgcaggcgctgggtaagcatgtcgatgtctacgtattgtttaccaacccctgccgctactactggggagacattaaggatccggcgttcctggcgaagctgctgtcgcgccagcggcgccatcaccgcgaggcgcgcgcgctccccctgtttcgcgacaccgagcaggcgccggggttgtttaatgacgccggggaacaggatgtcggcaacccgttgctcgcctcctgggggaaactggggcgcgactatatctacctgttggcggggctggagcgctatgaggagctggacgcttttgtcgacatcgcccccgataacctgttgcataacctgcagtcggatatccttgaactacgcaacgcggcggtggccgggcagagcgcagaggcattcgcccacagtcgcgacaaacgtccgctgacgctggatgaccgcagtctgagcattcacgtctgccacagtccgcagcgcgaagtggaggttctgcacgataggctactggcgatgctggaggcggatccgacgctcacgccgcgggatatcatcgtcatggtggcggatatcgacagctacagcccctatatacatgccgtgtttggcgccgccagcggcgatcgctggctgccgtgggcgatctccgaccgtcgcgcccgggagtcgcacccggtgctgcaggcgtttatcacgctgctctcgctgccggacagccgcttcgccagtgaagatgtgctggcgctgctggacgtcccggtgctggcggcgcgctttaatatcacggaagaagggctgcgctatctgcgccagtgggtgaacgagtccggcgtccgctggggaatggatgacgacaacgtccgcgagctggacctgccggcgaccgggcagcatacctggcggttcggcctcacccgcatgctgttgggctacgcgatggacagccgcgagggagaatggcagtcggtgctgccgtatgacgaatccagcggtttgatcgccgagctggtgggcaacctcgcgtcgctgctgatgcagcttaatctgtggcgacgcggcctggcccagcagcggccgctggcggagtggctgccggtctgtcgcgatctgctgaatgactttttcctgccggacagcgagaccgaagcggcgctggcgctgattgagcagcagtggctggcggttattgatagcggtctggaggcgcagtatggcgagcaggtgccgctgacgctgctgcgcgatgagctggcccagcgcctcgatcagcagcggatcagccagcgctttcttgccggcccggtcaatatctgtaccctgatgccgatgcgttcgatcccctttaaggtggtgtgcctgctggggatgaatgacggggtttatccgcgcacgctaccgccgctgggctttgatttaatgagccagaagccgcagcgcggcgaccgcagccggcgcgatgatgaccgctatctgttcctcgaagcgctgatgtccgccgagcagacgctgtatatcagctatatcggccgttcgatacaggacaacagcgagcgttttccttcggtgctggtgcaggagctggtggattatatcggccagagccactgtctcgccggtgacgaagagcttgactgcgacgccagcgaagcgcgggttaaagcccacatcacccatctgcatacgcgcatgccgttcgacgtagccaatttccaggaagacgagaacaagagctacgctcgtgaatggctggcggccgccggccagcagggagaggcgcatagcgattttatacagccgctcaccgcgccgccgattgacagcctgccgttcgatcagctcctgcgcttctggcagcacccggtacgcgcgttctttcagcagcgtttgcgggtcaatttccgcgcggaagaggacgatattccagacgacgagccgttcactcttgaagggctgagccgttatcaactgaatcagcaactgctcaatacgcttattgaggagcaggacgtctcggctatgttccgccgctttcgcgccgccggcgagctgccgtatggcgcctttggcgagctggtctgggagacgcagcgcctggagatgcaggcgctggccgagcgggtgatggccgagcgccagcaggcgcagagcatggagatcgatctgcagtgcggcggcgtgaacctgaccggctggctgcagcaggtgcagccggacggtctgctgcgctggcggccttcgctgctgagcgtctcccaggggatgcaactttggctggaacaccttgtctactgcgccagcggcggcaccggcgagagccggctgtttgtgcggaaagagggagagtggcgctttccggcgctggcgcccgccgaggcgcaggcgtaccttaacgagctggtggatggctatttgctggggatgtcgcagccgctgctgctgctgccggaaagcggtggcgcctggctgaaagcctgttacgacgccgaaaaggatgtcatcttaatggacgaagagacgcagcagaaagcgcggagcaaattcctgcagacctacgaagggaacatggtggtcagcggggagggcgccgatatctggtatcaacgcctgtggcgttcgctggagccggcgcattacgaagaaatcattgcccagacgcagcgttatctgttaccgctatatcgttaccatcggtccacacaaatttaa

SEQ ID NO: 3030 - DNA, 597 bp, Klebsiella pneumoniae
agagaccaaatacgtggtgacgggcaaaaacccgcaggaactgcgcgtggcgctttaacaaaggatatcccgatgaataccgacgcaattgaatccatggtacgcgacgtgctgagccggatgaacagcctacaggacgggataacgcccgcgccagccgcgccgacaaacgacaccgttcgccagccaaaagttagcgactacccgttagcgacccgccatccggagtgggtcaaaaccgctaccaataaaacgctcgatgacctgacgctggagaacgtattaagcgatcgcgttacggcgcaggacatgcgcatcactccggaaacgctgcgtatgcaggcggcgatcgcccaggatgccggacgcgatcggctggcgatgaactttgagcgggccgcagagctcaccgcggttcccgacgaccgaatccttgagatctacaacgccctgcgcccataccgttccacccaggcggagctactggcgatcgctgatgacctcgagcatcgctaccaggcacgactctgtgccgcctttgttcgggaagcggccgggctgtacatcgagcgtaagaaactgaaaggcgacgattaa

SEQ ID NO: 3031 - DNA, 1059 bp, Klebsiella pneumoniae
ggccgacaaatgatcgcctttgaccaactgacctggctgcacggcaagccgcagagcagtgggctgctgaaagccaatccggaagattttctggtggtggaagatctgggctttgccccggacggcgaaggcgaacacgtgctggtgcggatcctgaaaaacggctgcaatacgcgctttgtcgccgacgcgctggcaaaattccttaagatccacgcccgtgaagtgagcttcgccgggcaaaaagataagcacgcggtcaccgagcagtggctgtgcgcccgggtgcccggcaaagagatgccggacctgagcaaatttcagctcgagggctgccaggtactggaatatgctcgccataagcgtaagctgcgtttaggcgcgctgaaaggcaaccagtttaccgtgatcctgcgcgagattagcgatcgccaggacgtggagacgcgtctgcaggccatcgctgaacggggagtgccgaactatttcggcgcgcagcgcttcggcattggcggcagtaacctgcagggtgccctgcgctgggcggagagcggcgcgccagtgcgcgagcgcaataagcgcagtttttggttgtcggcagcccgcagcgcgttgtttaatcagcaagtgagtattagattaaaaaaaacggaatttaatcaggtcgttgatggcgatgcgctacaattagcggggcgcgggagctggtttgtcgtcacaccggaagaactcgaggtttcgcaggcacgggtgcataaccgcgaactgatgattacggccacgctgccgggcagcggcgactggggaagccagcgcgacgccctggctttcgagcaggccgcgatcgccgaggaaaccgcgttgcaggcgctgctggtgcgggagaaagtcgaggcggcgcgccgggcgatgcttctctatccacagcggctcagctggaactggtgggatgacgtaaccgttgaactgcgtttctggctgccggcgggcagcttcgccaccagcgtggtcagggagcttatcaatacaacgggtgactatgcgaatattgctgagtaa

SEQ ID NO: 3032 - DNA, 1431 bp, Klebsiella pneumoniae
ggtgaaaaaatgagtacattaccagtggataatcccggtatcgcttcggtaccggtcagtagcgtcggggatgtggcgcggctaattaattccggcaaggaacaagcgaaatatgcgcggatgattgtcttcctcgcgctggggggcgtttttctcgacgcatatgacttaaccacgctctcctacggtattgatgacgttgtacgtgaatttcagctctcaccgctgctgaccggcctggtgacttcgtccattatggtcgggactatcgtcggcaatattatcggcggctggctgaccgataaatatggtcgctattcggtttttatggccgatatgttctttttcgtgatttcggctatcgccgccgggctggcgccgaacgtctgggtgttgattggcgcccgcttcctgatgggcatcggcgttggcatcgacctgccggtagcgatgtcctatctggccgagttttcccgctttgccggcaaaggcaacaaagcggctcgcctcgcggcgtggtgcccgatgtggtacgccgcctcaaccgtctgctttctcattatcttcggcctgtatttcctgctgccgcaggagcatcttgactggctgtggcgcgcctccctgctgttcggcgccgtgccggcactgctgattattgccgtccgcagtcgatttatgaatgaatccccgctgtgggcggcgaaccagggcgatctgacctctgcagtgcgtattttacgcgactcctgggggatccatgcccatgaggtcccggcggcgaagcccgcgccagcgccgaaagtgagcttccgcgtgctgttcgaaaaaccctaccgcgagcggactatcgtcgccggggtgatgaatatctgtatctccttcgagtacacggcgattgcctttttcctgccgtcaattcttgcccagttcctcggggctggcgtcttcgaaactatttcggcatcgctggggctgaacgccctgtttgcttttaccggtgggctgctcggtatgcatctggcgtggaaatatccttcgcgtcatgtggcgatagccggcttcgccctgcagtttgtggcgctgattgtgctggcgctggtggggcaaccgcacgcgacggcaggtatcgtgctggctatcgcgatgctggggctgtggctgttcgccgaagggtttggcccgggggcgcagctgatgatctacccggcgctctcctatcctactgccattcgcgccaccggggtcggtttcagccgggcactctccgggatcggcagcgcgctggcgttgtttattctgccgctgctgcaggcctccctcggcacgcagatgttctgggtggtctcgcttgccgccattattcccattttcttcctgctggcggtccgtcatgaaccgacgcgagaagatatcgacgcacttcatgaataa

SEQ ID NO: 3033 - DNA, 693 bp, Klebsiella pneumoniae
aaaatggaaattaacgaaacgctgctgcgccagattatcgaagaggtgctgtcggagatgaaatcaggcgcagataagccggtctcctttagcgcgtctgcggcttctgtcgcctctgccgcgccggtcgccgttgcgcctgtgtccggcgacagcttcctgacggaaatcggcgaagccaaacccggcacgcagcaggatgaagtcattattgccgtcgggccagcgtttggtctggcgcaaaccgccaatatcgtcggcattccgcataaaaatattctgcgcgaagtgatcgccggcattgaggaagaaggcatcaaagcccgggtgatccgctgctttaagtcttctgacgtcgccttcgtggcagtggaaggcaaccgcctgagcggctccggcatctcgatcggtattcagtcgaaaggcaccaccgtcatccaccagcgcggcctgccgccgctttccaacctggaactcttcccgcaggcgccgctgctgacgctggaaacctaccgtcagattggcaaaaacgccgcgcgctacgccaaacgcgagtcgccgcagccggtgccgacgcttaacgatcagatggctcgtcccaaataccaggcgaagtcggccattttgcacattaaagagaccaaatacgtggtgacgggcaaaaacccgcaggaactgcgcgtggcgctttaa

SEQ ID NO: 3034 - DNA, 312 bp, Klebsiella pneumoniae
cctcggggaatcaggcccggccagcgcgtctggccgggcaaggcgctaggcgtgaagcggctgcgcgcggtaaatcgcaatcagttcggcaatcagctctttcgccagaatggatgtcatcaggtgatcctgagcatggaccattaccagcgtcattttggtttttccctcgccttcgtcagcttcgataagctgggtctgtacaaggtgagcttcgcgggaatagtgcgccgcttcctgcattttggcgtcggcggtggcgaaatcacccgctttagcggcgtgcagcgcttcgtagcacaggctacgtga

SEQ ID NO: 3035 - DNA, 804 bp, Klebsiella pneumoniae
gcaggcctgatgctggagattatctaccaggacgactggctggtggcggtcaacaaaccctcgggctggctggtgcatcgcagctggctcgatcgcgacgagaaagtggtggtgatgcagaccgtgcgcgaccagattggtcagcacgtttttaccgctcatcgtctcgaccggcccacctccggcgtgctgctgatgggattgtcgagcgaggcgggccggctgctggcgcaacagttcgagcagcaccagatccggaagcgctaccatgcgatcgtccgcggctggctgatggaagaggcgctgctggattacccgctggtggaggagctggatagaatcgccgataagttcgcccgcgaagataaagggccgcagccagcggtaacccactaccgcggtctggcgacagtggagatgccagtggcgactgggcgctatcccacctcgcgctatgggctggtggaactggagccgaaaaccggccgcaagcaccagctgcgccgtcatctggcccacctccgtcatccgatcctcggcgacagcaagcacggcgatctgcggcaaaaccgcagcgccgcggaacatttcggctgtcaacgcctgatgctgcacgccagcgagctgtcattaacccatccttttaccggcgagccgctgaccctgcgcgccggttttgacgacgtctggatgcgcgcgctgtcgcagtttggctggcgcgggcttctcccgctaaatgaaagggttgagtttgccgacgacagcggtcaggatgaagagaataaggtcaatccagggagataa

SEQ ID NO: 3036 - DNA, 813 bp, Klebsiella pneumoniae
ggaaccatgatgactagcaccctgaaaaaaatctcgcgccgtgtcgcgcttaccctcgccgtcagcgcctgtttttcccctgtcacccaggcggcggaactgctgaccgagggcgtctttaaggtgggaatggaggtcacctacccgccgtttgagtcctatgacagcaataacaatatcgtcggtctcgacccggagtttgccgcgctgatcgcccaacatctgcaggccaaaccgcagctgatcgacaccaagttcaccagcctgatcctcggcatcggcaagaaatatgacgcggtgatctccgggatgtacgtgacgccggagcgccagaaacaggccgacgccatcccttacgccctctccggcgcgtcgatcatcgccctgaagggcggcgcggtgcagccgaaaaccgaagatgagctgtgcggcgtaaaggtcggtctgcaggcgggcaccacctgggtgaccagcctgaaaaaacactccgatgagtggtgcctgaaaaacggcaaaccggccatcaccattcaggagttcccgacggcgccggaagcctcgcaggcgctgctgtcgaagaacatcggcgcccagcttgagattgccccggcagcgcagatcatcgtcgacaagagccgcggccgcctggcgataagctctacgcgcctggtctacccgctgccgctggggatctacgtcgccaaaggcaacaccgagctggcggaggcgatcaaggccaccctggccacgctgaaggccaacggccaatatgccgcgttgatcaaaaaatacaacttagaaagcatcgattaa

SEQ ID NO: 3037 - DNA, 372 bp, Klebsiella pneumoniae
gagtcaatgatgtccaccacgctgtttaaagatttcaccttcgaagccgcccaccacctgccgcacgtcccggaaggacacaaatgcggtcgcctgcatggccactcctttatggtgcgtctggagatcaccggtgaagtcgatccccataccgggtggatcatggattttgccgagctgaaggccgcctttaagccgacatacgatcgcctcgaccactattatctgaacgatattcctggtttggaaaaccccaccagcgaagtgctggccaaatggatctgggatgagatgaaaccgcgggtgccgctgctcagcgccgtgatggtcaaagagacctgcaccgccggctgcgtctatcgcggcgagtaa

SEQ ID NO: 3038 - DNA, 1860 bp, Klebsiella pneumoniae
aaggcgacgattaacaggggggtaagcatgcgctatatcgctggcattgatattggcaactcctcgacagaagtcgccctggcgacggtcgatgacgcaggtgtgctgaacattcgccacagcgcgttggctgaaaccacgggtataaaaggcacattacgaaatgtgttcggtatccaggaggcgctaacgcaggcggcaaaagcggccggcattcagctcagcgatatttcgcttattcgcattaacgaagccacgccggtcattggcgatgtggcgatggaaaccatcacggaaaccatcatcaccgagtccaccatgatcggccataacccgaagacacccggcggcgtcggactgggggtcggcatcaccatcacaccagaggcgctgctgtcctgctccgcggacactccctatattctggtggtctcctcggcctttgactttgccgatgtcgccgcgatggtcaatgcggcaacggcagcgggctatcagataaccggcattattttgcagcaggatgacggcgtgctggtcaataaccggctacagcaaccgctaccggtgatcgacgaagttcagcatatcgaccggattccacttggcatgctggcggccgtcgaggtcgctttacccggtaagatcatcgaaacgctctccaacccttacggtattgcgaccgttttcgatctcaacgccgaggagaccaaaaatatcgtgccaatggcacgggcgctgattggcaaccgctcggccgtggtggtgaaaaccccctccggcgacgtcaaggcccgcgctattccggcaggtaatctgctgctcatcgctcaggggcgcagcgtacaggttgatgtggccgccggggcggaagccatcatgaaagcggttgacggctgcggcaaactggacaacgtcgcgggagaagcgggcaccaatatcggcggcatgcttgagcacgtgcgccagaccatggcggagcttaccaataagccagctcaggagatccgcattcaggatctgctggccgttgatacggcggtgccagtcagcgtgaccggcggtcttgcgggagagttctcgctggagcaggcggtgggtatcgcctcgatggtcaagtcggatcgcctgcagatggccctgatcgcccgtgaaattgagcacaaactgcagattgcggttcaggtgggcggcgccgaagcggaggcggccattcttggggcgctcaccactcccggcaccacgcgcccgctggcgaccctcgatctgggcgccgggtcgaccgacgcctccattatcaatgcgcagggagagatcagcgccactcacctggccggcgccggcgatatggtcacgatgatcatcgcccgcgagctggggcttgaggaccgctacctggcggaagagatcaaaaaatatccgctggcaaaagtcgaaagcctgtttcatctgcgtcatgaagacggcagcgtccagttttttccgtcggccttaccaccggcggtatttgcccgcgtctgcgtggtgaaaccggatgaactggttcctctgcccggcgatctgccgctggagaaagtgcgcgccattcgccgtagcgccaaatcacgcgtctttgtcaccaacgccctgcgagcgttacgccaggtgagccctaccggcaacattcgcgacatcccgttcgtggtgctggtgggcggctcgtccctcgatttcgagatcccccagctggtcaccgacgcgctggcgcactaccggctggttgccgggcgcggcaacatccgcggctgtgaaggcccacgcaatgcggtcgccagcggattactcctttcctggcaaaaaggaggcacacatggagagtag

SEQ ID NO: 3039 - DNA, 1326 bp, Klebsiella pneumoniae
accgctgcgatcgttcgcttccactctgaccaccagcgagtagcccgccgagtagctttcgccccataccgcatcgacgatgcgctccggggcatgcgactgcagttctgccagctgatcgcagtccgcgcgatgcacggagatcccgcgcccctgggtgataaagccgacgatctcgtcgcccgggattggctggcagcagcgggcaatatggtgcatcaggttgcctaccccttccaccactacccggccattgtccttggtgcgattttgcggcgtgtaggttttctgctgcagttgcttcagcgcggccgcatcctgctcggcggcgctaggtttattgaactgcgcctgcaggaagttgaccatctggttgagacggatatcgccaccgccgatggcggccagcagttcatcgagctcgttgaagttatagcgcggcagcaggtgcttttccgcatccttcaggctgatgcccaaatgctccagctcgtcgtcgaggatctgccgaccggcgagaatgttcttgtcgcgatcctgcttacggaaccaggcgtggatcttcgagcgtccgcggctggtggtcacatagccgaggttagggttcagccagtcacggctcgggttcggctgcttctgggtaataatttcgatctgatcgcccatctgcagctggtaggtgaacggcacgatgcggccgccaattttggcgccgatgcagcgatggccgacatcgctgtgaatatgataggcaaagtccagcggcgtcgaccccgcaggcaggtccaccacgtcgcctttcggcgtaaagacatacacccggtcgtcgaagacctggctgcgcacttcgtcgagcatctcgccggagtcggccatctcttcctgccaggcaatcagcttacgcagccaggcgatacggtcttcatagccgcggccgccgctggtgccggctcccgcgccctctttgtacttccagtgcgcggccacgcccagctcggcgtcttcatgcatctgccgggtgcggatctgaatctccaccgtcttgccgctcggccccagcaccacggtatggatagactggtaaccgttgggtttcgggttggccacgtagtcgtcgaattcatccggcagatggcggtagtgagtatggacgatccccagcgcggcatagcaatcctgcaaacgctcagccacaatacgcaccgcgcgaacgtcaaacagctcgtcgaaagcgaggtgttttttctgcattttgcgccagatactgtagatatgcttcggccggccatagacttccgccttgacgccttcggctttcatctctga

SEQ ID NO: 3040 - DNA, 1245 bp, Klebsiella pneumoniae
atttgcgccttgttgatatcgcgggtggtggcggtatcgggggaagaacagggtcagcgacagcccctggtcgacgtggcgcgtcgcctcggcgtaagtgtcaatgatcttctccggccctatctcatacgcatcctggtagagggccagattgtcgttattcataaatggcgcggggtagtacacccgcccggttttcccctctttgcggatctcaatcttcgagacgatcgggtgaatgctggaggtggcatggttgatgtacgagatcgagccggtgggcggcaccgcctgcagatagcgattgtagatgccatagcgcatgacatcgtcgcgcagctggcgccagctttcccggtcgggcagagagatgccggcgcgggcgaacagcgtgcgcacccgttcggttttcggctgccactcctcctgcagatatttgtcgaagtacgccccgctggcgtagcgcgactgctcgaagccggcgaagcgctggccgcgctcgcgggccagctgcatcgaggtgtgcagcgcgtgccaggtcacggtgtagaagtagatattggtgaagtccagcccctccgggctgccgtaggcaatgccctcccgcgccaggtaaccgtgcagattcatctgccccaggccgatggcgtgggaggccgcgttgccggccgccaccgagggaaccgactgaatgtggctcatgtcggacacggcggtcagggcgcgcaccgcggtggcgattgtgcggccgaaatccggcgagtccatggtatgggcgatgttcagcgagccgaggttgcaggagatatcttccccgatatgcgcatagctgaggtcttcattataggcggacggcgtactgacctgcaggatctccgaacacagattgctcatggtgacccgcccggccaccggactggcgcggttcacggtgtcttcaaacatgatgtacgggtagccggattcaaactggatctccgccaggcgctggaacaggtcgcgggcgcggatccagcgcttgcggacccgctcgtcggccaccagctgcggatagaggtcgccgatggcgcaatcggcgaaaggtttgccgtacagccgttcgacgtcataaggcgagaacagggccatctgcgcatcttctttcgccagctggaaggtgatatcagggatcaccacccccagcgacaaggttttgatgcggattttctcatcggcattttcacgccgggtatcaagaaagcgtaa

SEQ ID NO: 3041 - DNA, 1149 bp, Klebsiella pneumoniae
ggacagcagatgaaaatagtgatcgcaccggattcctggaaggagagcctgagcgcgctggaagtggccagtgcgatagagcaaggctttcgcgagatttatcctgacgccgagtacgtcaagctgccggttgccgatggtggggaagggacggtggaagccatggtggcggcgaccggcgggcttctggttccgctgacggtcaccgggccgctgggcgagccggttgaggcattttacgggctgtccggcgatagccagtgcgcctttatcgaaatggcggcggccagcggcctggagagcgtcccgccggcgcagcgtaacccgctgctgaccacttcctggggtaccggggagcttatccgccatgcgctggacgccggggtaagacagatcattattggtattggcggcagtgcgaccaatgacggcggcgccgggatggcgcaggcgctgggggcgaaactgctgaccgccgagggccagcaaattgcctccgggggcggcgcgctggagacgctggcgcgaatcgatctcagcgaactcgattcgcggctggcagattgccggattgacgttgcctgcgacgtcaccaacccgttgaccggcccgcagggcgccagcgcggtgttcggcccgcaaaaaggggcgacggcgcagatgatcgaccggctcgatagcggcctacggcactatgcccggattatcgcccgcgatttagatatcgacgtgctgagccttgagggcggcggcgcggcgggcggcatgggtgcggcgctgtatgcgttctgtggtgctcagttgcgtccgggcattgagattgtcaccgatgcgctacagctggctgagcgggtggcggatgccgatttagtgatcaccggcgaagggcgtatcgatagccagacgatccacggcaaagtgccggtgggggtggcgagggtggcgaagcgttttaacgtcccggtgatcgggattgccggcagtcttaccgccgatgttggcgtcgtgcatcagcacgggctggatgcggtattcagcgtgttgtataccatctgtacccttgatgaagcgttggccaatgccgccgccaacctgcgaatgacggcgcgtaacgtagccgcggttttgcagatgggcgacaggcggtaa

SEQ ID NO: 3042 - DNA, 1197 bp, Klebsiella pneumoniae
aataataagatcgtggagaataacatgagtgcaaatgcggagagccaaaccccgcagcaaccaggcagcaaaaaaggaaagcgtaaaggcgcccttctgttgttgacattgctcttcattattattgccgtggcatatgggatttactggtttctggtactgcgtcactacgaagagaccgacgatgcctacgtggcagggaatcaggtacaaattatggctcaggtcgcgggcagcgtgaccaaagtctgggctgacaacacggactacgtgcagaaaggcgatccgctggtcacgctcgatcggaccgatgcccaacaggcgtttgaaaaggctaagacccaactggccgccagcgtccgtcagacccgccagcagatgatcaacagcaagcagctgcaggcaaatatcgacgtcaaaaaaaccgccctcgcccaggcgcaggctgacctgaaccgccgcatcccgctgggcgccgcgaacctcattggccgcgaagagctgcagcacgcccgcgataccgtcgccagcgcacaggccgaactcgacgtggcaatccagcagtacaacgccaaccaggcgatcgtgctgggcaccaggctggaacagcagccggcggtgctccaggcggccactgaagtgcgtaacgcctggctggccctgcagcgtacgcagatcgtcagcccgattagcggctacgtttcccgtcgctcggtacagcctggcgcgcagatcggcaccaccacgccgctgatggcggtggtcccggcgaccaacctgtggatcgatgctaactttaaagagactcagctggcgcatatgcgtatcggccagccggccactgtgatcagcgatatctatggcgatgacgtgaaatacaccggtaaagtggtcggtctggatatgggcaccggcagcgccttctctctgctgccggcgcagaatgccaccggcaactggatcaaagtggtacagcgtctgccggttcgtatcgagctggatgaaaaacaactagcggaacacccgctgcgcatcggcctctcgacgctggtggaagtcaacaccaccgatcgcgatggtgaaatgctggccagccaggtgcggagctccccggtttacgagagcaatgcccgcgaaatcgctctcgatccggttaataagctgatagacgagatcattcaggccaacgccggataa

SEQ ID NO: 3043 - DNA, 1410 bp, Klebsiella pneumoniae
tcaaaatggatgcattacggaaagcgctttcccgttgtggatttattagttgtgaccatgatcacctatggcaggctttcactttccggtgttgtgggcgatcatcccggcgagacaaccattcgcaaaggtaggagtatgaacattcagttaatgaatgtggccgtggacatcatcgagcagcggctggcgccgctggcgaacgttctgacgcgcaacaaccacattacggcgatgcgcgatagctttgcgctggctatgccctttgtgattgttggcagcctgttagttcccattttgtttccgcccgtttccatcgacggcgcctcgcgtttcggccaggtctatttgctgctgcggcctatcctgctgccgacctttcagctaactattggcctggtggcgctgattgtcgccttcggcgccagcgccagtctcgccaagcagtaccgtctgccggaacggctctgcggtttaaccgggtgtctggcttttctgctgtttatcggctttcgcgagactgcggtgagcaatgtttatctcggcggtatggggatatttaccgccctgatatccagcacctattccattgagattattcgctttttctacaaaaaaggctggtgtattcgcttgcctgatgaagtgccgctgatgacccgcaatggctttcaactgctgatcccgctgctggtggtgatgctgtcgataagcgtgatgaatgccatactgctgcagaccaccggacgcatcgtaccggagttgatcagcgaagcggtgcggccgctggtgctggcgtccgacacgctgatggcggtacttatctctttatttatctgtaacttactctggtttatcggtatccacggcgcgctaatcatcaccgggatcatgaaccccttctggatgacctatctgtttgaaaatcagcaggcgctggcggcgggttcgccaacgctgccgcatatttatctgcaggggttctgggatttttacctgctgatcggcggtattggctccactttgcctctggtgctgatggcgatgcgcagccgctcgcggcagctgaaaagcgtggccaagattggcctgctgccgtcgctgtttaatatcaacgagccgatactgtttggttttccggtgatcatgaacccggtttttttactgccgtttctctttgttcccctgataaacgcctgtatcgcatggtatttaactcagctgggtatcctcgaccgcgcggtggcgatgctgccatggtcgatgccttccccgctgggggcagcatggtcggcgaacggcagctggaaaaatttgtgcatgagcctgttcgcgatgtttaacgcctggatgctctatcgccccttcttcaaagtgtacgaacgtcagctcgcggaaaccgaacgctga

SEQ ID NO: 3044 - DNA, 1377 bp, Klebsiella pneumoniae
ggagttcacttgattacacatgttagcccgcttggttcaatggatatgctgtcgcagctggaagtggatatgcttaagcgcaccgccagcagcgacctgtaccaactctttcgcaactgctcgcttgctgtgctcaattcggggagcctgaccgataacagcaaggagctcctgtcccgtttcgaaaatttcgagattaacgtgctgcggcgcgaacgcggcgtgaagctggaactgatcaacccgccggaagacgccttcgttgacgggcggattatccgctccctgcaggccaacctgttcgccgtgctgcgcgatatcctgttcgtttacggccagatccacaataccgttcgcttcccgaacctcgatctcgaaagttcggttcatatcactaacctggtgttctcgatcctgcgcaacgcccgcgcgctgcacgtcggcgaggcgccgaacatgatcgtctgctggggcggccactccatcaacgaaaacgaatatctctacgcccgccgcgtcggtacgcagctgggcctgcgggaactgaatatctgcaccggctgcgggcttggcgcaatggaggcgccgatgaaaggcgccgccgtcggccatgcgcagcagcgctacaaagacagccgctttatcggcatgaccgaaccatccattatcgctgcggaaccaccgaacccgctggtcaatgaactgatcatcatgccggatatcgaaaagcgtctggaggccttcgtacgtatcgcccacgggatcattattttcccgggcggcgtcggcactgccgaagagctgctctacctgctgggtattctgatgcaccccgacaacaaagcgcaggtgctgccgctgatcctcaccgggccgaaggagagcgccgactacttccgcgtactggacgagtttatcacccataccctgggcgaatcggcccgtcgccactaccggatcatcattgacgacccggcggaagtggcgcggcagatgaaaaaagcgatgccgctggtgaaagagagccgtcgcgagaccgatgacgcctatagctttaactggtcgattcgcatctcgccggacctgcagatgccgtttgatccgacccacgagaacatggccaacctcaaactctccccggatcagccggtggaagtgctggccgccgacctgcgtcgtgccttctccgggattgtcgcggggaacgtcaaagaggtgggcatccaggtcattgagcagtacggtccttacaaactgcacggcgatccggagatgatgcgccgtatggacgatctgctgcagggcttcgtcgcccagcaccgcatgaagcttccgggcggcaccgcctatattccttgctacgaaatcatcgcctga

SEQ ID NO: 3045 - DNA, 213 bp, Klebsiella pneumoniae
attgtctatgttcattcgctagcctcagttgatagaaatatctcctggggctttcgtctgtctggggtcctggtaatgctcaaggccagacagcctcaagcacccgccgcaattctacactcgtcagggcgtgaaatttatctgcaaggaattaatcagaaagattttataataatctggatgcaggctcgcaaagtcatcccggtatattaa

SEQ ID NO: 3046 - DNA, 195 bp, Klebsiella pneumoniae
cggattttcgtgatcaagcgcgatttgtgtgattttataaataacaagcgcttgatttacgtcaaaaacatttcgccaaaagcgtctattttctctttccgttatgtcgttgaaacaccatgtagcctgcctcttcgagttgttcgagtcgcaacacaggtgcaacttgaagaacgaaggggaggggaagaatga

SEQ ID NO: 3047 - DNA, 372 bp, Klebsiella pneumoniae
cggcgctgcttcaggccatgctcaaggggatgccggatgaacagtgaagtccttctgctcggggtgatagtcggcggcgtcaactatctctttcgctatcttcctctgcgtttgcgcgccggccacgctcgtcctgcccgccgcggcccggtcagcgtgctgctggatactattggcatcgcctcgatttgcgcgctgctggtggtctccagcgtgccggagatcctcgccgatgcccatcgcctggcgccgacgctgaccggcttcctggtgctgggggccgccttctggaaaacccgcagcatcattgtcccgaccctgctgtcggcgtttgcctatggtctggcatggaaaatcaccaacgggctctaa

SEQ ID NO: 3048 - DNA, 891 bp, Klebsiella pneumoniae
cgagcggccgtttatcagccggcgcgcggcgggaggcccacgatgagctggctgctggagccgtttggctatcactatatgctcaatgcgatgtgggtgtcggcgctggtgggcggcgtctgcgcctttctctcctgctacctgatgctcaaaggctggtcgctgattggcgacgccctctcccactcgattgtgcccggcgtcgccggggcctatatgctcggcctgcctttcgcgctcggcgcatttctctccggcggtctggcggcaggcagcatgctgtttttgcaacagcgctcgcggctaaaagagtatgctattatcgggctgatcttctcctccttcttcgggatcgggctgtttatggtgtcgctgaatccgacgtcggtgaatatccagaccatcatcctcggcaatattctggccatcgccccggaggatattatccagctggcggcgatcggctttatctcaatggcgattctgctgctgaagtggaaagacctgatggtgaccttctttgatgaacaccatgcccgctcgattggcctgaacacccgcggcctgaaactgctgttctttaccctgctggccgcctgcaccgtggcggcgctgcagaccgtcggcgcctttctggtcatctgcctggttgtgactcccggggccaccgcgtggctgttaaccgaccgctttccgcgcctgctggccatcgccgtgtctatcggcagcctgacaagtttcttcggcgcctggctcagctactatctcgacggcgccaccggcggcattatcgtggtcgcgcaaacgctgctgttcctcatcacctttatcttcgcgccgaagcacggcctgctggccagccgccgccgcgccagggaggccgcatgctga

SEQ ID NO: 3049 - DNA, 480 bp, Klebsiella pneumoniae
ggagattacgtgactgacgttttactctgtgtcggcaacagcatgatgggcgacgacggcgccggcccgctgctggcggagatgtgcgcggctaacccggccggccagtgggtggtcatcgacggcggcagcgcgccggaaaacgacatcgtggcgatccgcgaattacgccccgaacgcctgctgattgtcgatgccaccgatatgggcctaaaccccggcgacattcgcatcatcgatcccgacgacatcgccgagatgtttatgatgaccacccataacatgccgctcaactacctggtcgatcagctgaaagaagacgtcggcgaggtgattttcctcggcattcagccggatatcgtcggtttttattatccgatgacccagccggtgaaagaggccgttgcccgggtgtatcagcagctggcaggctggcagggcaagggcggctttactcagctggaggccgcggacgactag

SEQ ID NO: 3050 - DNA, 1974 bp, Klebsiella pneumoniae
gttcagagcgtcaacgatcggaggcccgctatgctgaacccagaatccccttccaccgctcccgcgctgatcgacccggcgtcgaaggccttccagagcctgctggacaaactcgcgccaacggaggcgaccgtgctgatcgtgggcgaaaccggcaccggcaaagaggtggtggcccgctatctccatcatcacagcgcccgtcgccagcagccgtttctggccgttaactgcggcgcgctgaccgagagcctcgccgaagccgaactgttcggccatgagaaaggcgccttcaccggcgcgcagcagggacagcccggctggtttgaagccgcggaaggggggacgctgctgctggacgagatcggcgaattaagcctgccgctgcaggtcaagctgctgcgagtgctgcaggagcgtgaaattacccgcgtcggctcacgcaaagcgattaaagtgaatgtccgggtgattgccgccacccacgttgacctggcccaggcgatccgcgagcgccgctttcgcgaggatctctactatcgactgaatatcgcggtggtgccgctgccgccgctgcgccagcgtcggcaggatatcccgctgctggcgcaccactttttatcactctacgcccggcgcctcgggcggccaaccctgcgtctggcgccggaatcactggcccggctgatggactattcgtggccgggcaatattcgcgagctggaaaacaccctgcacaacgcggtgctgctcagtaaagaagaggagatcagtcctgcccagctgcgcctggcgacgctcaacgacgccccggggccggcgagcgatcatgaactggacgactttattcgccaccagctggcgcttcccggcgagccgctgtggcagcgagtgaccagcgccctgattcgccacgccatggcacattgcgacgataaccagagccaggcggccgcgctgttggggatcagccggcataccttgcgcacccagctcgctaacctcgggctgatcaaaagccgccgccgcccgcctgcgccgccgcgggcgttcgccaacgcagccggggccgatcgcgaactgcgcattggctaccagcgcttcggcagcctcgggatcctgaaagcccgtcagagtctggaaaccgccttcgccagcctcggcgtcaacgtgctgtggagtgagtttcctgccggaccgcagctcctccacgccctcgcctgcaacgagatcgacttcggcaccaccggagaagcgccgccggtgtttgcccaggccagcaatagcgaactgatgtacgtggcgtgggagccgccggcgccgcgcagcgtggcgatggtcgtcccgcaggagagcgacattcgccagctcagcgatctgcgcggtaaacgcatcgccctcaataaagggtcgaatgtccactggctgctgctgcagatcctcgaggacgccggcctgggtctgaacgatgtgcgggtggtctataccccgccgaaatatccgctgaccgccagcgactatctggcggttgacgcctggatgatgtgggatccgctgctcagcgacgccgaacacaccggcgagctgcgggtggtcgccagcggcgaaggccgggtcaacaaccatcagttttatctttcgcgacgggactacctcgctcagcatggcgatatcatgcgccgcctgctgacggagctgacccacaccgggcagtttatcgactcgcatcgcggcgaagcggcccgcttactctcggcagagctggggatcgacgcccggtcgctgagcatggccctcgcccgccgcagccatcgcccgcggccgatggatctgtcggtgatccgcgcccagcagaccatcgccgatcgcttttacgccctcgggcttatcgccaaaccggtcccggtgcgcgaagcggtgtggtacggtgaacccgcgccggacgtcatcagaccgctgatggcggtcagttag

SEQ ID NO: 3051 - DNA, 2265 bp, Klebsiella pneumoniae
tcttcttcagtagcgaggccttcatgctggcgatggattcatccaccgtcatcggcacgggaataccgttttcatcgcgcgggccaagtaaagtgctcatcagctggcctccctcatgtggcgggtcagttcaatacgatcggacggcaccaggcatttctggcgcttgcattccgggcaggtttcgaagctttcgcggtgcagctcggcgcgggtatcgccgttatgcttgagcagcgcgatggcgtagtcgatctccttctgcaccgcgaacggacgctggcactcccggcagtggcagatagcgaagcgcgactgctggaggaaatcctctttcttccacaccgccagctcatactccggcgacagcttaatcgccgccgtcgggcacacctcttcacagcgaccgcagaagatgcagcgcccgaggttaaactgccacgccagctggttagtggccagatcgatctcgaccgtcagggcgttcgacgggcaggcgttcacgcaggccgcgcagccgatacactgctgtggcgtatgctccggcttgccgcgaaagtttttgtctaccggcatcggctccagcgggtaggcgtgcgtcgtggtgccggtcttaataacttttttaataaaggtaaacatggcgattccttatttcagcggcgagtttttacgctcgatgctgtagcgctccagctctttgtatggcaccactttgctcttcttcttgcgtacatcgaccacggtcatgcggtcagtacaggagtagcacgggtcgaggctgccgatgatcagcggcgcatcggaaacggtgttgccgcgcagcatatagcgcagggtcggccagttggcgtaagtcgccgcccggcagcgccagcgatacagtttctggttgtcgccggtcatgctccagtggatatcgtcgccgcgcggcgcctcggagaagcccagcgcgaagcggtgcggaatataggtgaacccctccaccatcagcgggccgcccggcaggttatcgagaccgaaatcaatcatattcagcgcggtgtaaacctcgttgatccgcaccttgaggcgagatatcacgtcgcagccctgttcgctgtgaacttccatcggcagcaggccgtaaccgacaaacgggtggtcggcgcgggtgtcgcgggcgtggccgctggcgcgcaccatcgggcctacgttgctgaagtcgcgggcgatttccgggtccagacggccaataccgacggtacgctgttccatattcggcgtgctgagcagcatatccaccagctcctgcacgtcgcgacgcatctgctgcgccagctgacgggtctggatcatgtcctctttcagcaggtcgcggcggatcccgccgatcaggttcaggccgtaggttttacgcgcgccggtaaggatctctgccatcttcatcgaggtttcgcgcacgcggaagaactgcataaagccggagtcaaagccggtaaagtggcaggccagaccgaggttcagcaggtgcgagtgcaggcgttccacctccagcagaatggcgcggatcatctgcgcccgctccggcaccacgatgcccatcgcgttctccaccgaggtggtgtaagcggtgctgtgggcgaagccgcagatgccgcacacccggtccgacaggaaggtcacttcgttataacccatgcgggtttccgccagcttttccattccgcgatggacgtagaacaggcggtagtcggcgtcgataatgttctcgccgtcaacgaacaggcggaagtggccaggttcatcagaggtgacgtgcagcgggccaatcggcaccacgttgtttttcttgctgccgagctcgttaataaactcgtaggtttcggcgtcggtggtcggcgccggacgctggcgataatccatgctgtctttgcgcagcggatagagttcgtccggccagtcgtccggcagcaccagccggcgttcgtccggcaggccgaccggcaccaggccgtacatatcacgcacttcgcgctcgccccataccgccgccgggacgcgcggcgtcaccgacgggtattccggtttgttggcgtccacttccacgcgcacggtgatccagcatttggtgccctgctccatcgacagcacgtaatagaccgcgtagtggccgttgagcttacgttcatcgttgccgaacagcaccgacagccagccgccctgctggtagtagagaaactccaccacttccggcaggtaattgaccttcacggtgatggttaa

SEQ ID NO: 3052 - DNA, 285 bp, Klebsiella pneumoniae; identical to SEQ ID NO: 2106

SEQ ID NO: 3053 - DNA, 186 bp, Klebsiella pneumoniae
tttggcaaagtacggataagcgaagcatcagctaacaggcgccagggcggtgtctacgttcctctcgcagagagggcaggggaaatcgtccaggcgtcgtttgttgatgtgccgtggaaggtgctttgctcagggatcacgggtaggagccacctttatgagtcagaatacgctgaaagttcatga

SEQ ID NO: 3054 - DNA, 2550 bp, Klebsiella pneumoniae
ggagatagagtgatggacgatagtaaattacgctattttgccagcgcatggttaatctccatcacgttaccggcagacagtgcggaacgctataatgcccagtttgtgaacggtatcgacccgctggcttttaatcagtttgtcgccagcgatggcgacgtcatgccgggcacctatgacgttaatatttacattaacgatctgctggtggacagtcgccccgttcgcttctcagaggatagcgcacacggcgggttggccccctgcctgagcgcggcggaatatatccgctatggcgtcaagattgacgatgaccaccagccctgtttcgcgctgtcgcagacgatccgccaggcagagcaacagctggatatcgctaatcatcggctgatcattcatatccctcagcaatatattgagcactatccccgtgactatgtttcccccatgcgctttgatgaaggtattaacgctgctttcgtcaactacagctattctaccgatgccaataatggcgacgggggcagccaccagtatcaatatctttcgctaaacagcgggatcaatattgcatcgtggcgatttcgcaataatgcctactggaataagttcagcgggcaggcggataagtggcaaagcatcgccagttgggcggaaacgaacatcattccctggcgcagccggcttgtcgtcggccagaccagtaccgacaacagcgtcttcgatagcgtccagtttcgcggcgtacagcttggcaccgatgtcgaaatgcgccccagcagccagaccggcttcgcgccggtcattcgcggtgtggccaacagcaacgcccgggtggaagttcggcagaacaactatctgatttacagcgagaacgtcccagccgggccctttgagctaaatgatatcagcgccgttaaccgcagcggtgatttctacgtgaccgtcattgaagccgacggtagccagacgacctttactgtcgcctacaccaccctgccacagctggtgcgggcaggccaatggaattatcagctgtcggcgggtaagtatcatgacggtgctgacggctatgcccccgctctgatgcaaagctcgctctcttatggcctgaataataccttcacactgtacggtggcgcccttgcagcggagaactatcgcgccggcgcctttggcgtcggtagcaatttgggggagattggcgccctctcagccgactatacgctggcgggaacgacgctggcgaatggccagcgcaagcagggagggagcgtgcgttttctgtatgctaaatcctttttatcaagcaagaccgactttcaaatcgcgggctaccgttactcaacggcaggttattatagcctcagcgatgcggttaacgagcgtcgacgctggcacaatggcctgtacgaaaatgattactggccctctgacgaagacgaaagctggcaggcaagcgctccccaacactattacacgtcctggttttataataaaaagcatcgctttgatatttctgcccggcaaactctcggtaagaacagcgctttcttccttaacttcagccagcaaaattactggaatagctcaggaagtgatatctctctgcaggcgggttttaacagcactatccataacgtgaactatggtctgtactatcagaatacgcgtagccacttcacgcatgacgacaatagcatcacactgcgcgtttccatcccttttactctgcaagaaaaccgccggatcaataccgcatttaccctcgcccacagtaaatcgtctggcacgtccgggcaggctggggtaaacggcactctgctcgatgatggtcgcctgagctgggccgtcaccagcgcctatgatgacaccagccatagcaccaacagcgccagcctgggttatctcggccagtacggtaacctgtataccggctacgcctacagcaaaagccatcgtcaggcgagtctgaatctgagcggcggcgtggtggcacaccgcggcggcgttaccctctcgcaaccgctgggctcaacctttgcgctggtggaagccaaagacgctcagggggtagggatagagaatcagaccggcgtgcgcatcgatcccttcggctacgcggtcgtaccacaaagcgttccctatcgggtcaattctgtcgcgctcaaccctcaggacttcgatacctttcttgatgtccctaacgcagtggcggataccgtgcctacccgcggggcaattacccgggtgcgctttgatacgttccggggatatagcgtgctgatccacaccaccctcgccgacggcagctatccaccattgggcgccgagctctatcgcgccagtgggatcagcaatggtctggtcggcccgggaggagatgtctatgtcagcggagtcgattcaggcgaaaaactgcagataaaatggggcgaaacgcaccagcaaagctgcgaaatcaccctgcccgaactgcgccaggagcctcagcaggcgacggcctggcgtgaattatccttaatctgcacagtaaccccctcgaggtaa

SEQ ID NO: 3055 - DNA, 696 bp, Klebsiella pneumoniae
ataaggctggttatccggcctaatgtttgggggcgcctgagggcgcctttgtcgtctgcgccgctggccgcgacaacggcgggcttttgcgttacagtaatcattcccaaaccggttggtgagaagacaatgtacgaaggttacgcaggactgatctttgatatggatggcaccattctcgataccgagccgacccatcggcaggcatggaacgaggtgttgggccgctacggtatgcgtttcgacgaacaggcgatggtcgcgctcaatggctcaccaacctggcgaatcgcccaggcgattatcgaactcaaccaggccgatctcgatccacatcgcctggcgcaggaaaaaacccaggccgtcaaagcgatgctgctggacagcgtacgcccgttgccgctgattgaggtggttaaggcatggcacggccgtcgcccgatgtcggtgggaaccggcagcgagagcgccgtcgccgaagcgctgctggcgcacctggggctgcgtcattacttctccgcggtggtggcggccgatcatgtggtcaaccataaacccgcgcccgataccttcctgctgtgcgccgagcgcatgggcgtcgcgccggaaaaatgcgtcgtcttcgaagatgccgactttggtctgcaggcggcgaagcgcgcgggaatggacgcagttgacgtgcgtttgctgtga

SEQ ID NO: 3056 - DNA, 633 bp, Klebsiella pneumoniae
caggcaatggtaagtaaacgtgttgaaagtttgttgaatcaactgcgcacgcagggcatcgtcgatgaacgtgtcctcgaggcgatcgcgctggtcccgcgcgaaaagtttgttgatgaagcctttgaacataaagcgtgggaaaacaccgcgctgccgattggccaggggcagaccatctcccagccgtatatggtggcgcggatgaccgagctgctgacgctgacgccggagtcgcgggtgctggagatcggcaccggttccggctaccagacggccatcctggcgcatctggtgcatcacgtatgctcggtagagcgaattaagagtttacagtggcaggcgcgtcgtcgcctgaaacaacttgatttacataatgtttcaacccgtcatggcgatgggtggcaaggttggcaggcgcgggcgccgtttgatgccattattgtgacggcggcgccgccggaaataccgaccgcgctgctggcgcagctggatgatgacggcgtgctggtgctgccggtcggcgaagagcatcagtttctcaaacggatccgtcgtcggggcaacgaatttatcattgataccgtcgaggccgttcgctttgttcccctggtgaagggggagctggcctga

SEQ ID NO: 3057 - DNA, 540 bp, Klebsiella pneumoniae
ggtagtccggtgattgatgacgatggctaccgcccaaatgtcggtattgtaatctgtaatcgtcagggccaggtgatgtgggcccggcgctatggtcagcactcgtggcagttcccgcaagggggcattaatccaggagaatccgcagagcaggcgatgtatcgggaattgtttgaagaggtcgggttaagccgtaaagatgtgcggatcctggcctcaacccgtaactggctgcgttacaagttgcctaaacgtttggtgcgttgggacacaaagccggtttgtatcggccagaaacaaaagtggtttcttttgcagttgatcggcaacgatgcggacatcaatatgcaaaccagcagtacacctgaatttgatggttggcgctgggtgagttactggtacccggttcgccaggtggtgtcgtttaagcgcgacgtctaccgccgggtgatgaaagagttcgccagcgtgaccatgtcgctggcggagagcgcacctaagccgcaaaacgcgcctgcttatcgacgtaaaagaggttaa

SEQ ID NO: 3058 - DNA, 930 bp, Klebsiella pneumoniae
ttccccgaggtcactatgttacatcttggaatagatattggcggcaccaaaatggaagccgtactgctggacccggcgggcgaatgcgtccagcgcctgcgccggccgacccacaaagagagctatgacgcctttatgcgtcagctgctgaccctgattgccgatattcgcgcggtcagcccgcagccgttcaccctggggatcggcctgcccggggctatcgatccgcgaagcggacgcattaaaaactgcaactgcctggtgctcaacggtcacgatctgcgccgggatatcatgcagcagcttggccagccggtgtggatggcaaacgatgccgactgcttcaccctttcggaggcggtggatggcgccggcgccggagctaccaccgtcttcggggtgattatcggtaccggctgcggcggcgggatcgccgttcatcaacagctgctcagcggccccaacgctatcgccggggagtgggggcataatccgctgccgggctatactcctgagcgcgatggcccgccgcagccctgctactgcggcaaaacgaactgcatcgaaagctttctctccggtaccggcttcgcccgccgctatggggaacaagcccgtgcggaagccattgtcgccgcggcgcaaaacggcgatccgcgcgcgctggcccactggcgacactttatcgatgcctttgcccgcagcctggcgtcggtgatcaatattctcgacccgcaggtgattgtgctgggcggcggtctgtccaacgtcagccagatctatcgcgatctgcctgccgccatcgtgccgtggatcttctccgacacctgccgcacgcagatcaaaccggcccgtttcggcgacgccagcggcgtgcgcggcgcggcctggctgccccggcttcccggcgccgcgcaagggcagcggtag

SEQ ID NO: 3059 - DNA, 453 bp, Klebsiella pneumoniae
acaatgttatttgcatggataaccgatcctaacgcctggctggcgctgggcacattgacgctgctggagatcgtgctcgggatcgacaatattattttcctctctctggtcgtggctaagctccccaccgcccagcgcgcccatgcgcgccggatcggtttgatgggcgcgatggtcatgcgtctggcgctgctggcctcaatcgcctgggtcgttaagctgaccaacccgctctttaccgttttcggtcaggagatctcgtttcgcgatctgatcttgctgctcggcgggctgttccttatctggaaagccagtaaagagatccatgaatctatcgaaggtgaaaaggatgggctgaaaaccaacgtccactccttcctcggcgccatcgtgcaaatcatgctgctggatatcatctttagcctcgattcagtgatcaccgccgtcggcctg

SEQ ID NO: 3060 - DNA, 1398 bp, Klebsiella pneumoniae
tcatatgtattcccgtgctgtcggaaagcgcgccgccgtaaagcggcgcggggggaggcgttgaatgaattagctgaacagagagtagaagatcgcggagatggcaatcaggcccataatcaccacgaagacgttgctgatatggccgctgtatttacgcatcgccgggactttctgaatcgcgtacatcggcatcaggaacaggatcatcgcgataatcgggccgccaagggtctcgatcataccgaggatgctcgggttcagggttgccacaatccaggtggtgatcagcatgaacagcgcggtcagcttgttcagtttgttgatttcaatcgatttgcctttactgcgcagggatttaatcaccatgccgttaaagccttcgcgagcgcccagatagtggccaaggaaggatttggtgatggcgatcatcgcgatgatcggcgccatccaggcaatgattggcgcgttaaagtggttcgccaggtaagacagaatcgagatgttctgctctttcgccgccgccaggtctgccggagagaggctcagaacgcagctgaagacgaagaacatcacggtcagcaccatcatgatgtgggcgcgagcgaggatactggagcatttcttctcagcgccttcgccgtactcttcacgtttggctaccgcgaaggaagagatgatcggcgagtggttgaaggagaagaccatcaccgggatcgccagccacagggtcatcagcaggccgttgccggtaacggaagcgccgctcagggagagcgtctccagcgccgcgccgttccactgcgggatcagatacagggcgagcaccatcagcgcgataacgaatgggaaaaccagcacgctcatcgctttcacaatcatctgctcgccgaaacgcacaatggtcatcatgccgacaatcaggatcagcgacagaatggcgcgcggcggcggcgtcatgtgcagctggtgcgccatgaaggtttcgacggtgttagtgatcgccacgctataaaccagcaggatcgggtagatagcgaagaaataaagcagggtaatcagcttacctgcgcctacgccgaagtgttcttccactacttcggtgatgtcttcgcccgggtttttcccggagagcacgaagcgggtcatgccgcggtgggcgaagaaagtcatcgggaaggccagaatcgccatgatgatcagggggatcatgccgccaacgccggcgttgatcggcaggaacaagacgcccgcgccaatcgctgtaccgtacaggcccagcatccacatggtgtcggttttacgccatccgctgcgggtttcgcccgaaacgatggtgctggtttgagtggtttccatctgtatctcctggaggaatcaacaaaatctaatgaataa

SEQ ID NO: 3061 - DNA, 1071 bp, Klebsiella pneumoniae
tgcatcgtatttagttcaccaataaatgaactgagtatttacgccagacgatgtaaagtccagcgcgggttgcgcactatctctcctgttacgtttcatccgtcagattcaggagcagacatggataacctctttcaccaaccgcagggtggcaatgagatgccacgcttcgccggacgcgccacaatgatgcgcctgccgtttatcgaagatttacagggacttgacgcggcatttgtcggcattccgctggatatcggcacctcgcagcgctcgggcacgcgctacggaccacgctatattcgcgccgaatcggtgatgatccgtccgtacaatatggcgaccggcgccgcgccgttcgactcgctgtcggtggctgatatcggcgatgtgccgatcaatacctacagcctgctcaaatcggtgcaaattatcgaagattactacaccggtttgaatagttatccgctgatcccgctgaccctcggcggggaccacaccattaccctgccgatcctgcgggcgctgaccaaaaaacatggtccggtgggcctcatccacgtcgacgcccataccgacaccaatgatgagatgttcggagagaaaatcgcccacggcaccaccttccgccgcgccgtagaggaggggctgctcgacctcaaacgggtggtgcagattggccagcgcgcccagggctatgccgccggcgacttccagtggggcgttgaccagggctttcgcctggtgcaggcggagcagtgctggcatacctcgctggcgccgctgatggccgaagtccgtcagcagatgggcgacgggccggtgtatctcagctttgatatcgacagcctcgatcccatctgggcgccgggaaccgggacgccggaagttggcggtctgacctccattcaggcgctggagatcgtccgcggctgccgcggcctgaatctgattggcgccgatctggtcgaggtctcgcccccctacgacgtgagcggtaatacctcccagctggcggccaacctgctgtacgagatgctctgcgtcctgcccggcgtgaagtacgcctga

SEQ ID NO: 3062 - DNA, 720 bp, Klebsiella pneumoniae
ttttttacattctcggatatgcgaggggcagacagcgccgtgatgaccgggtttgaccgactcagctaccagagccgctggttgcaggtggcgccagagcgtaagtttctgctctggctactgctgatggcgctggcctttacgctgccggcgtggggccaggcgctgacgctggcgctgaccgccgcgctgacctgctggctgctgcgggtctcattctggcgctggtgccgctggatggcgctaccctttggctttttgctggtcggcgtgctgaccattgtgttcagcgtcagccgcgatccgcagatgctgttagcgagctttcggttgggcgctttctcgatagggatttccgccccggggctggccgtggccggggagaccttctggcgcagcctggcggcgatggcggcgacgctctggctggtgcttaatctgcctttcccgcagttgattattttactcaagcgcggtcgcgtaccgcggctgttgacggagcagatcctgctgacctggcgcttcatttttattctgttggacgaggcgatggcgattcaccgcgcgcaaaccctgcgttttggctatggtagtgtgccgcagggctatcgctcgctggcgatgctggtgggactgctgttcacccgcgtcctcctgcgctatcaacagatgagcacggcgctggatatcaaattgtaccagggtgattttcacctctaa

SEQ ID NO: 3063 - DNA, 225 bp, Klebsiella pneumoniae
aaaatggcattaactcgatggccatgtcgctggcggcataccacgaagagatgcaacacaacgtcgaccaggcgacctccgatctacgggaaacgcttgagcagatggagatccagaacgtcgagctggacctggcgaaaaagcgcgcccaggaggcggcgcgcattaagtctgagttcctggccaatatgtctcacgagctgcgcaccccgctcaatggggtga

SEQ ID NO: 3064 - DNA, 948 bp, Klebsiella pneumoniae
cattatttttccctattgtatcccgtaaggaaccaatctgtgcgcgacgatctgaatgcgatcccggtatttgtcaccgtggtcgagagcggcaactttgccagcgcggcggcgatcctccatgtgacgcgttcggcggtgggaaaaaccattgcccggctggaagcgcgtctcggcgtggcgttattccagcgtaccacccgacggcaactgctgacggaagagggggagcaattctatctccagtgccgggaagcgctggagcgcatccgcgaggccgaagagacgctgcagcgcggcaaagatgaggtgcaggggcggctgcgggtgtcgctgccggtgctgtttggccagcgctgcgtggcaccgctgctgttccgcctcagccagcgctatccgttactgaagctcgagctccactacagcgaccggcaggtcaatctgctggaggaggggtttgatcttgcggtgcgtatcgggagcctggccgataccgggtcgctgcgggcccgggcgctgggagagcatggcatggtgctgtgcgcggcggcggagtacctgcgccagcagccagcgccgcagactattgccgggttgaacgagcaccgtaccctcggctatctgcacaacggccagctgcaaaaatggcaactgtatgacccgcagcagggcgaagtgcgcttcagtccgcagacgtggctgatacaggatgattttgccgccatcgcggcggcagtgcagcaggggatgggcatcgcctggctgccggactggctggtggcgcaggcgcttgccgatgggacattgcagcaggtgttggcgcccagcgctcaggtgcgtttcgccatccacgcggtatggccggaggggccgtggctgccgcaaaaaacgcgggcggcgatcgatgccctgcgggaagggctgcctcttaccgcaacacctggttag

SEQ ID NO: 3065 - DNA, 339 bp, Klebsiella pneumoniae
tgccgtttttcagggggcaggatgggtaaactaacgctgctattattagctttgctggtctggctacagtattcgctgtggttcggtaaaaacggcctgcatgactacacgcgggttaacgacgacgtcaccgcccagcaggcgactaacgccaaattaaaagcacgcaacgatcagctgtttgccgaaattgacgacctcaacggcgggcaggaagcgattgaggagcgtgcgcgcaatgaactcagcatgacccgcccgggcgaaaccttctatcgtctggtaccggatgcgtctaaacgcaatcaggcatcggggcaacagcagaacaatcgataa

SEQ ID NO: 3066 - DNA, 468 bp, Klebsiella pneumoniae
ataaacgtttctattacacttgccgcgttgtatcttttaatttgctatttggaattttttaattttatgtcttcaatgttacacaaactgaataatatccgttcactgcgtgccctgtcccgtgaattctccattgacgtgcttgaagagatgctggaaaagctcaggatcgtcactgaagaaaaacgtacgcaacagcagcaggcagctcagcagcaggctgaatatcaggagaaagtaaatacctggcttgaactgatgcgcgccgacggtatttctcctgacgagctggtggccgatattcagccgccaaaggcgggaggcaaaaagcgtcaaccgcgcccggcgaaatatcgttataccgatcatactggcgcagagaaaacctggaccggacagggaagaatgccgaagccgattgccgaggctgtcgcccagggtaaatcgctggatagctttttaatttaa

SEQ ID NO: 3067 - DNA, 1092 bp, Klebsiella pneumoniae
tcgggcgtttcatgctgggcggggagcaccccgccgccgctgaaaagaatggcgatatactccagccccgacgcctgcaggcggtcggcgagctgccgccgctcagccaccgttaacggcacgcgggcttcgataccgcagcagccgacgcgctgcagttcatccagcgtttgcggccagggggtcgtcactccccagagggtgcgaaagcatttcagctccatggcggcttcctcaggcgtacttcacgccgggcaggacgcagagcatctcgtacagcaggttggccgccagctgggaggtattaccgctcacgtcgtaggggggcgagacctcgaccagatcggcgccaatcagattcaggccgcggcagccgcggacgatctccagcgcctgaatggaggtcagaccgccaacttccggcgtcccggttcccggcgcccagatgggatcgaggctgtcgatatcaaagctgagatacaccggcccgtcgcccatctgctgacggacttcggccatcagcggcgccagcgaggtatgccagcactgctccgcctgcaccaggcgaaagccctggtcaacgccccactggaagtcgccggcggcatagccctgggcgcgctggccaatctgcaccacccgtttgaggtcgagcagcccctcctctacggcgcggcggaaggtggtgccgtgggcgattttctctccgaacatctcatcattggtgtcggtatgggcgtcgacgtggatgaggcccaccggaccatgttttttggtcagcgcccgcaggatcggcagggtaatggtgtggtccccgccgagggtcagcgggatcagcggataactattcaaaccggtgtagtaatcttcgataatttgcaccgatttgagcaggctgtaggtattgatcggcacatcgccgatatcagccaccgacagcgagtcgaacggcgcggcgccggtcgccatattgtacggacggatcatcaccgattcggcgcgaatatagcgtggtccgtagcgcgtgcccgagcgctgcgaggtgccgatatccagcggaatgccgacaaatgccgcgtcaagtccctgtaa

SEQ ID NO: 3068 - DNA, 849 bp, Klebsiella pneumoniae
aacatgtcttcttacgataatcatcaggcgctggccggcctgacgctcggtaaatcaaccgattaccgcgatacctatgacgcctcgctgctgcagagcgtgccgcgcagtttaaaccgcgacccgctgggcctgcatgccgataatctgccgtttcacggcgccgatatctggacgctgtacgaactctcctggctgaacggcaaaggtctgccgcaggtggctgtcggccacgtcgagctgcccgataccagcctcaatctggtggagtcgaaaagctttaagctctatctcaacagctttaaccagacccgtttcgccagctggcaggacgttgcagagacgctgactcgcgatctcagcgcctgcgcgcaggggaaggtgaaggtatcgctctaccgcctggatgaactggaaggccagccgattgcccgcctgcacggcacctgcatcgacgatcaggatatcgagatcgataactatcacttcagcgccgattacctgcagggcgccgccagcggcaaaatcgtggaggagacgctggtcagccacctgctgaagtccaattgccttatcactcatcagccggactggggctcggtgcagatccagtatcggggtgcgaaaatcgaccgcgagcagctcctgcgctatctggtttcgttccgccaccataacgaattccatgagcagtgcgtcgaacgtatctttaacgatattctccgtttctgccagccggaatcgctttccgtttacgcccgctatacgcggcgcggcggtctggatatcaacccctggcgcagcaatggcgacttttcccccgccaccggccgcctcgcccgtcaataa

SEQ ID NO: 3069 - DNA, 1485 bp, Klebsiella pneumoniae
tccgccacctcaaacgtcagcagtaccttgacgcccgctccgccctctaatctctcgctgaaagacatcatgatgacaacacaccacgaccgtcactataaagccggtggcgacccgcgcacgctggctgattttatggccctgcgtgcggaaatgaacaagctcagccacccggcgcggccggatattaactggccgtatgccgagcagcttgcccgcgggctgttggagcatcacggcgcggacctgcagactgtcgcctggtataccctggcccgcgcccggctgggcggggtggcagggatcaatgaggggctgacgctgatggagtcgctgctggttcgtcaggggaaaaacctgtggccacaggcgctcccggcccggacagagatcttccgcaccctgagcaagcggctgcggcaggtgatccgtaccctgaatcttaccccagaggatgttgagtcgcttgagcaggctgaacgttcgctgcaaagcttcgacgcagtgctccagcgccttgagatcgctcctgaaaaccagctgagcgacctgcgggcgctactgcacagcacggcaactcgcttcgagagcctcgatcctgcgccagcgcttcccaccgcgccgccggtggcggtgtctgacgcggaacttcccggcactctggtcagcgaagaggatgcggcgaaggttgagccagtgccagacctaaaacgtagaccaaaggctgagccgctggctccgccttcacctgcaaagcggcccgcgccggtggcggcgtctactccggcagccgcgccgcgctggaagccgtttatcgccgggatggttaccatgctggcggtaacgggtatcgccgtcggcggatggctggcgctgcgtcagtccgacttgccgcccatttcggtcacccaaaatgccggaccgataccgggcctgccggcgacaacgcccccggggccggttgatctgccacagacgcagcgccagcttggcgagcttgcccgcctggcgccggactgggcggtcagctacggcgaccagctggtccggcaggccctgatccgctggccggatcaggcgcaaccgctggagcagcagtggcggcagcagctgagtgctggcgcattgcccgcggaaaaccttaccggctggtcggagggcatgcagcagctgcagcggctcgccgaccagctcaatgccctcgacgagcagaaggggaagtacctgacggtgagcgaactgaaaaccgcagtatttgccatcacgcagtcgtttaaccgcgctgttccgctggaggagcagctgcgccagctggccgcgcttcccgttgatcaaccctggccagccgctcggggaagcctcgcggagctgcatctgcaacagctgatagtggagtatgccctgctgaagcgaaaacagccggcgtcgccgaccgctgcgctccccgcaaccggtgagccctcggtgagtgaggcggtgaaataa

SEQ ID NO: 3070 - DNA, 1506 bp, Klebsiella pneumoniae
tgcgtaaactcatcacatatcgtcattcaaaaggattttacatctatgacaaccttttacacggtggtgaactggctggtcattctggggtactggctgttgatcgccggtgtaacattacgaattctaatgaaacgccgcgctgtcccgtccgccatggcatggttgctgatcatttatatcctgccgctggtggggatcatcgcctatctctcctttggcgagctgcatctcggcaagcgtcgggccgagcgcgccagggcgatgtggccctcgacggccaagtggttaaacgacctcaaagcctgcaaacatatcttcgcggaagataacagcccggtggccgaatccctgttcaagctgtgcgaacggcgtcagggcattggcggcgtaaaaggcaaccagctacagctgctgacggaatctgacgacgtgatgcaggccctgatccgcgatattcagctggcccgtcacaacatagagatggtcttttatatctggcagcccggcggcatggccgacagcgtcgctgaatcgctgatggccgccgctcgccgcggggttcactgtcggctaatgctcgactccgcgggcagcgtggcctttttccgcagcccatgggcggcgatgatgcgtaacgccggtattgaagtcgtcgaagctcttaaggttaacctgatgcgcgtattcctgcgccgtatggacctgcgtcagcatcgtaaaatggtgatgatcgataactatatcgcctacaccggcagcatgaatatggtcgatccgcgctactttaaacaggactcaggagtcggacagtggattgatctaatggcgcgaatggaaggcccggtggcgacctcgatgggcatcgtctactcctgcgactgggaaatagagaccggcaagcgcattctgccgccgccgccggacgtcaatatcatgccgttcgaagacgccagcggacatactattcacacgatcgcctccggaccgggctttccggaagatctgattcatcaggctctcctcaccgccgcctatgcggcgaaagagcatctgatcatgaccaccccctacttcgtacccagcgacgacctgctgcatgcgatctgtaccgccgcccagcgcggcgttgacgtgagcattattttaccgcgcaagaacgattcgctgctggtaggctgggccagccgggccttcttcaccgagctgctggcggccggggtcaaaatctatcagtttgagggcggactgttgcataccaagagcgtgctggtcgatggcgagctaagtctcgtggggaccgtcaacctggatatgcgcagcctgtggctcaacttcgagattaccctggtcatcgatgacgccggtttcggcagcgatctggcggcggttcaggatgattatatctcgcgctcgcgcctgctggatgcccgtctctggttaaaacgtccgctgtggcagcggatcgccgagcgactgttttacttcttcagcccgttgctgtaa

SEQ ID NO: 3071 - DNA, 1191 bp, Klebsiella pneumoniae
aatatatgctctataacggctgggcaatcgtggtggcgaacatcattctctttgcgctgctgtttcagattctggtgtgacgaacgaccgcagacgcggaggagattttcctccgcgtcgacgtttggtcgtgaggttttccttttctcaccgcgacagcccaccgtaaaatcagcctcttgttccccctgcgtaatggaatctatgctgactctcgcccatcttcaacagcgccgtagccggcgttggctcttcggattaacgctgttgctgctggtcaccctgctgatcagcctgtgcgcgggggagcaatggatcccgcccggcgagtggctcagcgccaaaggtcagctgtttatctggcagatccgcctgccgcgaaccctggcggtgctgctggtgggggcggcgctggcgctctccggggcgataatgcaggcgctgtttgaaaatcctctggcggagccggggctgctgggggtctccaacggcgcgggcgtcgggctgattgccgccgtcctgctgggcaaaggagtcttgcccggctgggcgctcggcctgtgtgccatctttggcgcgctgctgatcacttttattctgctgcgtttcgcccgccgccatctgtctaccagccgtctgctgctggcgggggtggcgctggggatcatctgcagcgccctgatgacctgggcagtctacttctccacctcttttgacctgcgtcagctaatgtactggatgatgggcgggtttggcggcgtcgactggcaacagctgtggctgatgatagccctcctgccggtgctctgctgggtctgtctgcagtcgcaacccctgaatttactggcgctgggcgaagtctccgctcgtcagcttgggctgccgctgtggctgtggcgcaaattactggtggtggcgaccggctggatggtcggcgttagcgtggcgctggcgggggcgattggctttatcggtctggtgatcccgcatattctgcggctatgcggcttgagcgatcaccgggtgttgctcccggcctgtatgctggccggggcaagcgccttgctgggggcggatatcattgcccggctggcgctttccgccgcagagctgccgattggcgtggtgacggcgaccctgggcgcgccggtctttatctggttgctgctgcgttcgcgggggcggggatag

SEQ ID NO: 3072 - DNA, 345 bp, Klebsiella pneumoniae
ataatattatcgttttcaaaacagcgaaccacatggccgatggcttcggtttcacggatgttggtcagaaactggttgccaagaccttcacctttggacgcgcctttcaccaggcccgcgatatccacgaactccatggtggtcggcaggatgcgctgcggtttgacgatttcagccagcttgtccagacgcggatcgggcatcggtacgacaccggtgttcggctcaatggtacagaaggggaagttggccgcttcaatacccgctttggtgagcgcattgaacagggtggatttgccgacgttgggcaaaccgacgataccgcatttgaatcccatgatttaa

SEQ ID NO: 3073 - DNA, 1401 bp, Klebsiella pneumoniae
tcagaggtatctatgagtcaatcttccctcccggagaaggctaaccgctcggtcataaccgactggcggcctgaagatcctgaattctggcaacagcgcggccatcgtgtggcaagccgcaatttatggatctccgttccctgtctgttactggcgttctgcgtttggatgttgttcagcgcggttgccgttaacctcaacaaagtaggctttcagtttacaaccgatcagctgtttatgctgaccgcgctgccggcgctgtcaggcgccttattacgcgtgccttacgcctttatggtgccgctgttcggcggccgtcgctggacggcgttcagcaccgggatcatgattgtgccgtgcgtctggctgggcttcgcggtccaggatacctctacgccgtttagcatcttcgtgattatctctctgctgtgcggcttcgccggagccaactttgcctccagtatggccaacatcagcttcttcttcccgaaagcgaagcagggcggggcgctcggcgttaacggcggcctcggcaatatgggcgtcagcgtgatgcagctggtcgcgccgctggtggtctcgatctctatctttgccgtttttggcggtaacggtagcgagcaaccggacggctcgatgctgtatctggaaaacgccgcgtggatctgggtacctttcctgattattttcactctggcggcgtggttctttatgaacgacctgtcggcttcgaaagcgtcgctgagcgagcagttgccggtacttaagcgcctgcatctgtggattatggcgctgctctatctcgcgaccttcggctcctttatcggcttttccgccgggttcgcgatgctgtcaaaaactcagttcccggatgtgcagatcctgcattacgctttcttcggcccgttcattggcgcgctggcgcgttcgatgggcggggcgatctccgaccgcctcggtgggacccgcgtaacgctggtcaactttgtggtgatggctgtcttctgcgcgctgctgttcctgaccctgccgaccaacggccagggcggtaactttatcgccttcttcgcggtgtttatggtgctgttcctgaccgccgggctggggagcgcctccaccttccagatgatctccgtgatcttccgtaagctgactatggaccgcgtgaaggcccagggcggcagcgaagcgcaggcgatgcgcgaggcggcgaccgataccgcggcggcgctgggctttatctccgccattggcgctatcggcggcttctttattccgaaagcgttcggtatctcgctggatctgaccggctcgccggccggggcgatgaaagtgttcctcgtgttctatattgcctgcgtggtgatcacctgggcggtatacggtcgtaagcgtcagtaa

SEQ ID NO: 3074 - DNA, 1095 bp, Klebsiella pneumoniae
atcatgggattcaaatgcggtatcgtcggtttgcccaacgtcggcaaatccaccctgttcaatgcgctcaccaaagcgggtattgaagcggccaacttccccttctgtaccattgagccgaacaccggtgtcgtaccgatgcccgatccgcgtctggacaagctggctgaaatcgtcaaaccgcagcgcatcctgccgaccaccatggagttcgtggatatcgcgggcctggtgaaaggcgcgtccaaaggtgaaggtcttggcaaccagtttctgaccaacatccgtgaaaccgaagccatcggccatgtggttcgctgttttgaaaacgataatattattcacgtcgcggggaaagtgaacccggcggaagatatcgacgttatcaacaccgaactggcgctgtctgaccttgatacctgcgaacgcgcgattcaccgcgtctccaaaaaagccaaaggcggcgataaagacgcgaaggttgagctggccgcgctggaaaaatgcctgccgcagctggaaaacgccggtatgctgcgcgcgctggatctgaccaaagaagagaaagaggccatccgctatctgagcttcctgaccctgaagccgaccatgtacatcgcgaacgtcaatgaagacggtttcgagaacaacccgtacctcgatcaggttcgcgccatcgccgagcaggaagggtctgtggtggtgccggtgtgcgccgccgttgaagcggacatcgccgagctggacgatgaagagcgtgacgagttcatggctgagctgggcctcgaagagccgggcctgaaccgcgtgatccgggccggttacgctctgctgaacttgcagacctacttcaccgcgggcgtgatagaagttcgcgcatggaccatcccggtcggagcgaccgcgccgcaggcagccggtaagatccataccgacttcgaaaaaggctttatccgcgcgcagaccatcgcttatgaagacttcattgcctacaaaggcgaacagggcgcgaaagaagccggtaaaatgcgtgctgaaggtaaagactacatcgtgaaagatggcgatgtgatgaacttcctgttcaacgtctga

SEQ ID NO: 3075 - DNA, 1332 bp, Klebsiella pneumoniae
cggggcttgtcgcgatgctatcgctgttggttaagcggattttttcgcttttttctcagcctttaccggagcaacttcggctttcgcaccggcttcgccttcgacgaattcgcggccgtagtaggtatccagcaggatctgtttcagttcggagatcagcgggtagcgcgggttagcgccggtgcactggtcatcgaatgcatcttcagacaatttatcaacgtgggccaggaagtcagcttcctgaacgccagcttcgcggatagatttcggaatacccagctcagctttaatgctttccagccatgccagcagtttctcgattttcgctgcggtgcggtcgcctggtgcggagaggcccaggtgatcggcgatttcagcgtaacgacgacgagcctgcggacggtcgtactggctgaacgcggtctgcttggtcgggttgtcattcgcgttatagcggataacgttgcagatcagcagggcgttggccagaccgtgtggaatatggaactgggagcccagtttgtgcgccatcgagtgacacacgccgaggaaggcgttagcgaacgcgataccggcgatagtcgcggcactgtgtacgcgctcacgggcaaccgggttcttggaaccttcgtgataggaagccggcaggtactctttcagcagtttcagcgcctgcagcgcctggccgtcagagaactcagaagccagtacggaaacgtaagcttccagggcgtgagtcaccgcatccagaccaccgaacgcacacagcgatttcggcatatccatcaccaggttggcatcgacaatggccatatccggggtcagcgcgtagtctgccagcgggtatttctgaccggtcgcgtcatcggtcaccacggcgaacggcgtcacttcagaaccggtaccggaagtggtagtgatcgccaccatcttggctttgacgcccattttcgggaacttgtagatacgtttacggatatccataaagcgcagcgccagttcttcgaagtgggtttccggatgttcgtacatgacccacatgattttcgccgcatccatcggggaaccgccgcccagggcgatgatcacgtctggtttaaaggagttcgccaggtcggcacctttacgtacgatggtcagcgtcgggtcagcttcaacttcgaagaagacttccgtctcaacacccgcagctttcagtacggaagtgatctgatcggcatagccgttgttgaacaggaagcggtcagtcacgatcagcgcgcgtttgtgaccatcggtaatcacttcatccagtgcgattggcagggagcccacgacggaagtagatag

SEQ ID NO: 3076 - DNA, 258 bp, Klebsiella pneumoniae
cgcttgccgtcaaaaacaacattattgataatgattatcattgttgccttgatttttattctgagagctatgacgcgtatggataacactgccacagctgaaaaaccaaaagacaatgccccttatcccgtggcgacggacagagagatcagcagtcgggttctgttaggcagcgaaggacgagtagtgattgagcatggcggccagcgctatctgctgcgccagacccacgccgggaagttaattctgaccaagtaa

SEQ ID NO: 3077 - DNA, 816 bp, Klebsiella pneumoniae
gtcatggggtcattagcggatttcgaatttaacaaagcgccattgtgtgatggcatggtcctcatttctgaacaggtccgcgacgattttccgtcgcgttttgtcgaggaagagctgcagcgattgctgcgcctcgcgcaggaggagattgcgccgtcgtgggaccaggagcgccagatagaacgattgctggagctgttttacgacgagtggggctttggcgcctcgcagggcgtgtatcgtctttccgacgcgctatggctggataaagtgctggttaaccgccaggggagcgcggtgtcgttaggcgcgatcctgctgtggatcgcccagcgcctggcgctgccggtggtgccggtgatcttcccgacccaaatgctgctgcgtgcggacccggaaaccagcgaagagatgtggctgattaatccgtttaacggcgagaccctcgacgagcataccctggaggtatggctgaagggcaacatcgggccggtggcggaactgtttaatgaagatctcgacgaagcggataacgccgaggtgatccgcaagctgctggacaccctgaagtcggcgctgatggaagagcggcagatggagctggccctgcgcgccagcgaagcgctgctgcagtttaatccggaagatccgtatgagatccgcgaccgcgggctgatatacgcccagctggactgcgatcacgtggcgctgttggatctgagctatttcgttgagcagtgcccggaggatccgatcagcgagatgatccgcgcgcagatcaacacgatttcgcataaacaaattacattgcattag

SEQ ID NO: 3078 - DNA, 363 bp, Klebsiella pneumoniae
tccgctgttccaggcactacactggagagaagaggaaccatgaccctttcttttaccacccactggcgggatgaaatgccggacttttacacttccctgtcaccaacgccgttggataacgcccgactcatctgggacaacgccccgttggggcaacaacttggggtgcccaacgccctgtttgccctaaaaccgggcccgtgtttgggccggccaagcgctgtttccgggcatgttgccgcgggcccaggtatccaacggccatcagtttggcgcctgggcggccaaattgggcgacggacgcgggatcctgttcggcgagcagcagctgccggatggcccgccgttacgactggcatctga

SEQ ID NO: 3079 - DNA, 711 bp, Klebsiella pneumoniae
ccgaggtctccaacgtgctggggacggaaaacccgctgggcggcgctgattgctcttgcgcatcagcatggcgcgaaagtgctggtggatggcgcccaggcggtgatgcaccacccggtggacgtccaggcgctgggctgcgatttttatgttttctccgcccacaagctgtatgggccgaccgggatcggcgtgctctacgcccggtccgagctgctgcagacgatggcgccttgggaagggggcgggtcgatgatcgccaccgtcagcctgacggagggcaccacctggaatcaggcgccgtggcgctttgaggccggcacgccgaataccggggggatcattggcctcggcgcggcgctgacctacgtcagccagctgggactgacgcagattgccgagtatgagcagacgctgatgcgctacgcgctcgatgccctgcgcgcggtaccggatctgatcctttacggcccggcgcagcgtaaaggggtaattgctttcaacctcggtcagcatcacgcctatgacgtcggcagcttcctcgataactacgggatcgccgtgcgcaccggacaccactgcgcgatgccgttgatggcccggtatcaggtaccggctatgtgtcgggcatcgctggcgatgtacaataccacggaagaggtggaccgcctggtggccggcctccagcggatccgcaaactgttagggtaa

SEQ ID NO: 3080 - DNA, 906 bp, Klebsiella pneumoniae
gccgattgtccaggaacatcaggccgatcagctggcggcgctgtccgagcaggaatgatgacctttcaggcctggctgcagcaggcgatcgcccgcctggcggagagcgacagcccgcgacgcgacgccgagatcttgctgggacacgttaccggccgggcgcgaacctggattttggccttcggtgaaacgacgctctctgctgacgaggcggcgaggctggaggcgctcctggtgcgacgccagcgcggggaacctattgctcatctggtcgggcagcgcgagttttggtcgctgccgctgttcgtctccccggcgacgctgatcccccgcccggataccgaatgtctggtagagcaggcgctggcgcgtctgccaaccgcgccgtgccgtattctcgacctcggcaccgggaccggcgccattgccctggcgctggccagcgaacgtccggactgtgaggtcaccgcggtggacgtgatgccggacgccgtggcgctggcgttgcgcaatgccgaacatctgggcatcgctaacgtgacgataagtcaaagcgactggtttagcgcgctggacgggcagcgcttcgccatgatcgtcagcaatcccccctatatcgacgccgccgacccgcatctcgccgaaggcgatgtgcgctttgagccgttgacggcgctggtcgcaggcgatcaggggctggccgatctggcgcatatcatccgcgagggacggcagtatctgcagcccggcggttggatgctgctggagcatggctggactcagggcgaggcggttcgcgcgctgttccgcgaagcgggctatctggacgtcgcgacctgtcgcgactatggcgacaatgagcgtctgaccctcggacgtttacccgacatggagaatgttggctga

SEQ ID NO: 3081 - DNA, 486 bp, Klebsiella pneumoniae
agcaggcgtcctctcctgcgagagtggccgcggcgatgcgcgccatctgatagcccggcgccaccagaccgtaaattttattgtcccacagggcgcattcgcctatcgccagcacgtccgggtcagaggtacggcactggccgtcgatgtgaattcccccgcgttcgcccacctgcagcgcgcagccgcgggccagcgcgtcctgcgggcggatccccgccgagaagaccaccatgtcggtccgcaacgcgccgccgtcggcaaagttcagccgcaggccgtcggcctcgcgcacgatggcggtggtcgctttgctggtatgcacccccacgccgagggcgacgatcttctcccggagcatcgccgccccgccgttatccagctggacggccatcaggttcggggcaaactccaccacctgcgtctccagccccagctgtttcagggcgttggccgcctcaagcccgagcagcccgccgccgataa

SEQ ID NO: 3082 - DNA, 438 bp, Klebsiella pneumoniae
gcgtctgaccctcggacgtttacccgacatggagaatgttggctgatgaacttattcacggctgtcctctacctgcacattgccacagtggcggtgtcggtaggattgttcgttttacgttactggtggatgtatcaccagagcccgctgctgaaccagcggtgggtgcgaattgcaccgcactgcagcgatacgctgctgtttctcagcggcgcggggttaatggcgataacgcactacctgccgttcacagaagacggcgcatggctgactgaaaagctgtttggcgttatcatttacatcgcattaggttttatcgcgttgggccgtcgtcgtccgcgcagccagcagagccgctttatcgcgttcctgctggcgctggtggtgttgtttatcatcattcaactcgccatcacaagaataccgatactggggtag

SEQ ID NO: 3083 - DNA, 534 bp, Klebsiella pneumoniae
ctcagcagccctgggaaaagcgctttaatcccggtcacaataaactcaatgccgagggccatcagcaacaggcccataatacgggtgatgacgttgattcccgtctgccccagcaaacggaccagccacggcgccatacggaaaatcccccagcagcagagggcaaataccgctatcgccagtgagaacccgaccagatgcacccaggagtggtaccgggtcccccagacgatagttgaactgattgcccctggcccggccattaatggtagcgcgagaggaacgacgccgatgctctcccggaccgccgtctccgacttttcctgcttgttctgcttatcttcgccgagcttaccgctgatcatcgacatcgcgatggtcaccaccaggatgccgccggcgatacggaaggagtcaatggagataccgaaaatctgcagaatgccatcgccgaggaacagcgacgtcaggaggatgatcgccaccgacaggttggcggtgaggttggtcttattacgcaccgcagccggctga

SEQ ID NO: 3084 - DNA, 402 bp, Klebsiella pneumoniae
tggcgccaacctggaggtctatcgatggaagtacaagcaggaacttttaatcccgccgatttcagctggcagggactgaccatgacgccggccgctgccgcgcatatccgcgatctgatgcgcaagcagccggataagaaagggctgcggctgggcattaaaaccagcggctgcgccggttttggctatgtgctcgaaatgattgccgagccggcgcccgacgatctgctctttgaatctgacggggcgaagctgtttgcgccgctgcaggcgatgccgttcatcgacggcaccgagctggattatgtccgggaaggtttaaatgaaatctttaaatttcataacccgaaagcgcagcatgagtgcggctgcggcgaaagttttggggtgcaggcggagtaa

SEQ ID NO: 3085 - DNA, 312 bp, Klebsiella pneumoniae
gggattgaacctatggcgcttacaaaagctgaaatgtcagaatatctgtttgataagcttgggcttagcaagcgggatgccaaagaactggtcgagttgtttttcgaagagatccgtcgtgctctggaaaacggagaacaggtcaaactctccgggttcggcaacttcgatttgcgggataaaaaccaacgcccgggacgtaacccgaagacgggggaggatattcccattacagcccggcgcgtggtgaccttcagacccggtcagaagctgaaaagccgtgtcgaaaacgcgtcgccgaaagacaaataa

SEQ ID NO: 3086 - DNA, 1050 bp, Klebsiella pneumoniae
tgccctcgacccgaaagaccgctaaggagcgctgccatgaccatgattgaaacggcaaaagcgccgcaagcgcagagccacagcgggctactgctggacgtgaaagatcttcgcgtcacctttaaaacgccggatggcgacgtcaccgccgtcaatgatctgaacttcaccctgcaggcgggcgagacgctcggcattgtgggcgaatccggctccggtaaatcgcaaaccgccttcgccctgatgggactgctggcggccaacggtcgcatcgggggttccgccacctttaacggtcggcaaatcctcaatttgcccgagcgtgagctgaacaaactgcgcgctgaacaaatctcaatgattttccaggatccgatgacctctcttaacccctatatgcgggtgggcgagcagttaatggaagtcctgatgctgcataaagggctgagtaaagccgaagcgtttgaagagtcggtgaagatgctcgacgcggtaaaaatgccggaagcgcgtaagcgcatgaaaatgttcccgcacgagttctccgggggcatgcgtcagcgcgtgatgattgccatggcgctgctgtgccggccccggctgctgattgcggatgaaccgaccactgccctggacgttaccgtgcaggcgcagatcatgacgctgttgaatgagcttaaacgcgaattcaacacggccattatcatgatcacccacgaccttggggtggtggcagggatctgcgataaagtgctggtgatgtacgccgggcgcaccatggagtacggtcaggcgcgcgatgtcttctatcaaccgtcgcacccatactctattgggctgttgaatgcagttccacgtctggatgcggaaggcgatgcgttgttgaccattcccggcaacccaccgaacctgctgcgattgccaaaaggctgtccattccagccgcgttgcccgcatgccatggagcagtgcagcagcgcgccgccgctggaatcgttcgcgccaggccgcctgcgcgcctgctttaaaccggtgggggatctgctatga

SEQ ID NO: 3087 - DNA, 279 bp, Klebsiella pneumoniae
agcgcctcgccttcgggccattgcctgcggcaacgttctctcgcttcgctcgagtcgaaccttggtcgaagcttctcatccttccccgtggggcagaatatagaatatcgtagagtaattggattgaggtgttttttaagaagatggtggtgggggaaggataactcgtcgctatcgctcctcgcccttcgggccgttgcctgcggcaacgttctctcgcttcgctcgagtcgaaccttggtcgaagcttctcatccttccccgtggggcagaatatag

SEQ ID NO: 3088 - DNA, 1071 bp, Klebsiella pneumoniae
tttcgcgctttgctaaacccatataaaaggctaatgactatgaaaacatggcttccgacatcgaccgccggcagtttaccgaaaccttcctggctggcgcagccagagtccctgtggtcgccctggaaactgtccagcgaagaattactggccggcaagcgcgacgccttgcggttatccctcgacgaccagctgcgggccgggatcgatattgttagcgacggcgagcaaacgcggcagcactttgtcaccaccttcatcgagcacctcagcggggtggattttgccaaacgcgagatcgtgaaaattcgtaaccgctatgaggccagtgttccgacggtggtgggcgccgtggagcgccagaaaccggtcttcgtggaggacgctcgctatctgcggcagctcaccagtcagccgatcaaatgggcgcttccgggcccgatgaccatgatcgacacgctgtatgacaaccactataaaagccgggaaaagctggcctgggaatttgctaaaatcctcaatcaggaagcgaaagagttagaggctgcgggggttgatattattcagttcgatgagccggcctttaacgtcttcttcgatgaggtcaacgactgggggatcgccgccttagaacgagccaccgaagggctgaagtgtgagacagcggtgcatatctgctacggctatggcatcaaggccaataccgactggaaaaagacgctgggctccgagtggcgacagtatgaagaggctttcccgcagctgcagaaatcgtcccttgatattatctctctcgagtgccacaactcgcgcgtgccgatggatctgctggagttgatccgcggtaaaaaggtgatggtcggggcgatcgatgtcgccagccatgctatcgaaaccccggaagaggtggctggaaccctgcgcaaggcgctggcgttcgtcgatgccgacaaactctacccgtccaccaactgcggtatggcgccgctgccgcgccatgtcgcgaccggcaaactgcacgccctgagcgccggcgccgagattattcgtcgcgagctggcggcaaagtaa

SEQ ID NO: 3089 - DNA, 1074 bp, Klebsiella pneumoniae
cggacctggccacagagaggagcagtcatgttaattcaggtgggagagctggcgaagcgtgccggactgacggtacgtacgctgcatcattatgaacagacggggctgttaacgccttcggccagaagcgaggcgggctatcggctctataacctgtccgcggttcagcgcctgcatatgataaaggcgctggcgcaggccgggctaacgctcgccacaatcaaggactgtctcgatcggcaaacgctgtcgctgcccgagctgctgacgcagcagatagatatgctcaacgcccagctacgcgatgttggcaggctgcgcgaccgactattggtgctgcgcgaggcgctggcgagcggcaatgaacccgatctggagtcctggctacagacgctggagttaatgaaaatgtacgatcgttggtttagtcaacaggagttagccgcgctgccgtttgcggcacaggatgaacagcgggcgcaggcgtggcgcgagctaacggaggaggtgcagacgctgatggcgagcggctgcccgacggacagtccgcaggcgatgcgtctggcgacgcgctggatggagcgcctggagcaggatacggccgggcgtccggagtttctgacccgcctgaacgagatgcatgccgccgagccgcagatggttgaacagaccggcgtcacgccggcaatcatcgcctatatcaccgaggcctttgccgaaagcaaactggccatctgggcgcggtaccttgacgaagaagagatggcgttcacccgccagcactattttgaccggctacaggagtggcctgcgctggtggcgaagctgcatcaggcgtgccgggagggcgtagcgccggactcggcgtcgggtcaggcgctggcccgggcgtggcttgaactgtttcagtcctacgccggtacccggccgcagacgttgcagaagtttcgtcgggcaatggagcaggagccgcatttgatgaagggcacctggatgacgccggcggtgctgagctggctgcagcaggcgaccggatccttgatgcggcaggcgcagggacctgccgccgggtga

SEQ ID NO: 3090 - DNA, 378 bp, Klebsiella pneumoniae
catagtcggccagttgctggaccttctgcggctcacggcgatagtaaaaatgttcgaaatggccgaagcggacatggctctcggccacccgcatcagcatcgcgccgggctccacgcgctcgcggtagaccggggtatcgctggtcaccatcgccagggcgcgcgtcgtcgggatccccagagcatgcatcgcctccgacgccagactttcccggatcggcgagcgcagcacggcgcggccgttccccatccgcgaataaggagtcaggccggcgcctttcagatgccagtcgtaacggcgggccatccggcagctgctgctcgccgaacaggatcccgcgtccgtcgcccaatttggccgcccaggcgccaaactga

SEQ ID NO: 3091 - DNA, 2691 bp, Klebsiella pneumoniae
acaggcggtacgcgcctggccggtgaaagtagaaaacggcaaagtgtgggtgggcaaccagcagctgctggcccgcgcggaggcctcctgatgaagaccatccgaacgacctgcccctactgcggcgtaggctgcggggtgctggcgagcgtggacgacgcgggacaggtgagcgtgcgcggcgacgatcagcacccggcgaacctcggccgtctgtgcgtcaaaggggccgccttaggggagaccacgggcctggcggggcggctgctgacgccggaggtcgacggccagcaggtagcctggcctcaggcgctggcggaaaccgctgcgcgcctgagacagatcatcgaccagcacggaccgcaagcggtggccttttacgcctccggccagctgttaaccgaggattactatgccgccaataagctgatgaaagggtttatcggcgcggcgaacatcgataccaattcacggctgtgcatgtcgtcagcggtcactggctacaagcgggcctttggcgccgacgtggtgccctgcagctacgatgatgtggaaaacagcgatctggtggtgctggtcggctcgaacgccgcctgggcgcatccggtgctgttccagcggctggcgcaggcgaagcgggataatccccgattgcggatcgtggcgatcgacccccgacgcaccgctacctgcgagatcgccgaccgccatctggcgctggccccgggaagcgacggcgggttgtttgcggggctgcttaacgccctggctgaggcaggagcctgcgtcgatggctttcgcgacggcccgcaggcgctggccgccgcccgcggctgggacgtggcgatggtggcggccttttgcggtctgcctgccgatgaggtggcgggattctatcgcgagttcatcgccgccccgcgggcgatcaccctctacaccatgggaatcaatcaatccgccagcggcagcgacaaatgtaacgccatcatcaacgtccatctggccagcgggaagtatggccgccgcggctgcggccccttttcgctgaccggtcaacccaacgccatgggcggccgcgaagtcggcgggctggcgacgatgctggcggcgcacatggattttgtgccagacgatctgcagcggctggcccgcttctgggggacggaacggctggcgcagacccccgggctgaccgccgtggagctgtttgccgccattggccgcggcgaggtcaaagcggtctggatcatgggtaccaacccggtggtgtcgctccctgacagccacgcggtgagccaggcgctggccgcctgtccgctggtgatcgtctcggatgtcgccgcccagaccgataccggacgtttcgcccacatccgctttccggcgctggcctggggcgagaagaatggcacggtcaccaactcggagcggcggatctcccgtcagcgcagctttctgccgccgccgggggaggcgaaagcggactggtggatcatcgccagagtgggccaggcgctggggtatcgcgaggcgtttgcctggcagcatccgcatgacgtcttccgcgagcatgcggcgctgtccggtttcgaaaacgacggccagcgggcgtttgatatcggcgcgctggcggatctcagccgtgaggcgtgggacgccatgccgccggtgcgctggccggtcagccgcagcgaggccgcctgggatatcacgcgcggctggcatggcgatggcaggctgcggatggtgccggtgacgcctcaaccgacccgggcgacaaccgatgccttttatccgctgatcctcaacagcgggcggatccgcgatcagtggcacaccatgacccgtaccggcgcagtgccgcggctgatgcagcatatcgcggagccaatggtggaggtggcgccgcaggatgccgttcgctatcagcttcccgctgacgggctggcgcggatctggtcgcggcatggggtgatggtggcgaaagtggcgatcagcgaagggcagcgccccggctcgctgtttgttccgatgcactggaacaaccagtttgcccgtcaggggcgggtgaataacctgctggccgccgtcacggacccgtattccggccagccggaaagtaaacaggcggcggtggcgatcgccgcctggcaaccggcctggcacagcgagcttttttgtcgcgaaccgctaccatttcctgcggcctggcactggcggcggcgggcgacgccaggcgtgctgcactactcgctggccggggaggcatctgcccgacagtggctcagcgcgtggtgcgcccggcgcggctggcagttacaggtggctgacggcggcgcggtgtggaacctgctggcctggcatcagggaaggctgatgctcggctggtggagcgatgcgcgcgagccggcggtggattgcgcatggataagcgctgcctttgccgcgccgccgtccgatgctgcccaacgacatgccttgcttagcggccgaccgggcgccgccgtcgcgccgcgggggcggatcgtctgcagctgctttggggtgggggaatggtcaattaacgaggccatcgccagcggctgcgccagcgtcggggcgctgggtgggaagctgaaatgcgggaccaactgcggctcttgcgtgccggagctcaacgcgctgctggcggcgcaacgaacccgggcgtaa

SEQ ID NO: 3092 - DNA, 312 bp, Klebsiella pneumoniae
cctgtgatcacccggcggcaggtccctgcgcctgccgcatcaaggatccggtcgcctgctgcagccagctcagcaccgccggcgtcatccaggtgcccttcatcaaatgcggctcctgctccattgcccgacgaaacttctgcaacgtctgcggccgggtaccggcgtaggactgaaacagttcaagccacgcccgggccagcgcctgacccgacgccgagtccggcgctacgccctcccggcacgcctgatgcagcttcgccaccagcgcaggccactcctgtagccggtcaaaatagtgctggcgggtga

SEQ ID NO: 3093 - DNA, 1332 bp, Klebsiella pneumoniae
aaaaaatccacgccgctgcgtggattttttatgacgtggtggcggcgaaaacgccagttagcgggatcagacgttgaacaggaagttcatcacatcgccatctttcacgatgtagtctttaccttcagcacgcattttaccggcttctttcgcgccctgttcgcctttgtaggcaatgaagtcttcataagcgatggtctgcgcgcggataaagcctttttcgaagtcggtatggatcttaccggctgcctgcggcgcggtcgctccgaccgggatggtccatgcgcgaacttctatcacgcccgcggtgaagtaggtctgcaagttcagcagagcgtaaccggcccggatcacgcggttcaggcccggctcttcgaggcccagctcagccatgaactcgtcacgctcttcatcgtccagctcggcgatgtccgcttcaacggcggcgcacaccggcaccaccacagacccttcctgctcggcgatggcgcgaacctgatcgaggtacgggttgttctcgaaaccgtcttcattgacgttcgcgatgtacatggtcggcttcagggtcaggaagctcagatagcggatggcctctttctcttctttggtcagatccagcgcgcgcagcataccggcgttttccagctgcggcaggcatttttccagcgcggccagctcaaccttcgcgtctttatcgccgcctttggcttttttggagacgcggtgaatcgcgcgttcgcaggtatcaaggtcagacagcgccagttcggtgttgataacgtcgatatcttccgccgggttcactttccccgcgacgtgaataatattatcgttttcaaaacagcgaaccacatggccgatggcttcggtttcacggatgttggtcagaaactggttgccaagaccttcacctttggacgcgcctttcaccaggcccgcgatatccacgaactccatggtggtcggcaggatgcgctgcggtttgacgatttcagccagcttgtccagacgcggatcgggcatcggtacgacaccggtgttcggctcaatggtacagaaggggaagttggccgcttcaatacccgctttggtgagcgcattgaacagggtggatttgccgacgttgggcaaaccgacgataccgcatttgaatcccatgatttaaatcaccttaatctttggataatcaatctgttacaaggaacagattgcagaaaattgaatagctttgcctattatacacggtgcgcggcaaaaatgccgcacgacaacggcttattgcgccttaaaggcgtgcaaacggttggtcgctttggtcagcccgtcctttaa

SEQ ID NO: 3094 - DNA, 684 bp, Klebsiella pneumoniae
acagtgttaactcgtgatttcttaatgaatgcggattgtaagacagcgtttggcgctattgaggaatcgctactctggtcggcagaacaacgtgcagcctcgctggcggcgacgctggcctgccgcccggatgatggctcagtatggatctttggctacggttcgcttatctggaacccggcgctcaattatcgcgagtcctgcaccggcacgctgccgggctggcaccgcgcgttttgcctgcggttgaccgccgggcgcggtagtgcctgccagccgggacgcatgctggctctcaaagagggcggccgaaccaccggcgtcgcctatcgtctgcctgacgacacgctggaggaggagctgaccctgctgtggaagcgggagatgatcaccggctgctatctgcccacctggtgcaagctggagctggacgacggacggacggtgaatgccctggtgtttattatggatccgcgccatccactgtttgaaccggataccagtgcccaggttatcgccccgctgatcgcccgggccagcgggccgctcggcaccaacgcccagtatctgttttcgcttgagcaggcgctgcgcaagctgggcatgcacgatgccagtctcgatgacctggtggccagcgtccgcgcgctgttgggcgagagtccgacgccgggcctggcctga

SEQ ID NO: 3095 - DNA, 3111 bp, Klebsiella pneumoniae
ttagcaccaacacaatattttcaaacacaacatagtcaggcagggtcaagcgtgatgatcccacaaatttctcaggcgccaggggtagttcaactggtgctgaattttttgcaggtactggagcaacagggttttaccggcgataccgccaccagctatgccgacaggctaacgatggccaccgacaacagcgtctatcagctgctgccggatgcggtcatttttccacgatccacggcggacgtggcgctgctggcgcgcgttgccgccgaaccgcgttttaaatcgctgattttcaccccgcgtggcggcggcaccggcactaacggccaggcgctgaacggcgggattatcgttgatatgtcccgctatatgaatcgcatcatcgagattaaccccgaagagggctgggtgcgcgttgaagccggggtcatcaaagatcagctgaaccagtttcttaaaccctatggttacttttttgcgcctgagctatccaccagcaaccgcgccacgctgggggggatgattaacaccgacgcgtccggccagggatcgctggtgtacggcaaaacgtcggatcacgtgctcggcctgcgggcggtgctgatgggcggggatatcctcgatacccaggcggtgccggtggcgctggcggagacgctgggcaataccccctcgacggttggacggatctacaacacggtctaccagcgctgcaaggcgcagcgtgacctgatcattgataagtttcccaaactcaaccgcttcctcaccggatacgatctgcgtcacgtctttaacgatgagatgagcgagttcgacctgacccgtattttaaccggttcggaagggacgctggcgtttattaccgaagcgcggctggatatcacccgcctgccgaaggtgcgccgtctggtcaacgtcaaatatgactccttcgactctgcgctgcgcaatgcgccctttatggtcgaagcgaaagccctgtcggtggagaccgtcgattctaaagttctcaatctggcgcgcgaggatatcgtctggcactcggtaagcgaactgatcaccgacgtaccggataaagagatgctcgggctcaatatcgtcgaattcgccggcgatgacgcggcgctgattgaccagcaggttactaccctgtgccagcggctggacgagctgatggccgccagcgaggcgggcgtcattggctggcaggtctgtcacgatcttgaaggcgtggagcgcatctatgccatgcgcaagaaggccgtcggcctgttgggcaatgccaaaggcgccgccaagcctattcctttcgccgaggacacctgcgtaccgcccgaacatctggcggattacatcgttgagttccgcgcgctgctcgacagccacggcctgagctacggcatgtttggccacgttgatgccggggtgctgcacgtgcgcccggcgctggacatgtgcgatccgcagcaggagatactgatgaagcagatctccgacgaggtggtagcgctgacggcgaagtatggcggcctgctgtggggcgaacatggcaaaggtttccgcgcggagtacagcccggccttctttggcgagacgctgtatgccgagctgcgcaagatcaaagcggtcttcgatcccgataaccgcctgaatccggggaaaatctgtccaccggaaggtatcgacgcgccgatgatgaaagtcgatgcggcgaagcgcggcacctgggatcggcagatccccatcgcggtgcgcagcagctggcgtggggcgatggagtgtaatggcaacgggctgtgcttcaactttgacgtcaagagcccgatgtgtccgtcgatgaaagtcagcaaccagcgcatccactcgccgaaagggcgggcgacgctggtgcgggaatggctgcgcatgctggccgaccgcggcgtcgatcccaaccagctggagaaggcgctgccggagcagggcgtcagcctgcgctcgctggtggcgcgcacgcgcaacagctggcatgcgcgtaaaggcgagtatgacttctcgcatgaggtcaaagaggcgatgtccggctgtctggcctgtaaagcctgttcgacccagtgcccgatcaaaatcgatgttcccgagttccgctcgcgtttcctgcagctgtaccacagccgctatctgcgtccggtgcgggatcatctggtggcgtcggtggagtcctatgcgccgctgatggcccaggcgccgaagacctttaacttcttcattaaccagccgtggctgaaaaagctgtcggagaagcatatcgggatggtcgatctgccgctgctttcggcgccgtcgctgaagcagcagatggccggccaccgttccgccaatatgacccttgagcagctcgaagcgttgagcgccgagcagaaagcgaagatggtgctggtggtgcaggatcccttcaccagctactacgacgcccaggtggtggccgactttatccgtctggtcgaggccttaggctatcagccggtgctcctgccgttctcgccgaacggcaaggcgcagcatatcaaaggcttcctcacccgcttcgcgcgcaccgcgcagaagacggcggacttcctcaaccgcgtggcgcagctgggcatgccgctggtgggcgtcgatccggcgctggtgctctgctaccgcgatgagtacaagcagacgctcggcgacaagcgcggcgatttccaggtgctgttagtccatgagtggttgccgaaggccctaaccagcgacgcccgtcccgatctgggcggtgagccctggtacctgttcggtcactgtaccgaagtgaccgcgctaccggcggcgacaaagcagtgggcagatatttttgcccacttcggcgcgaagctggaaaacgtcagcgttgggtgttgcgggatggctggcacctatggtcatgaagtgaaaaaccacgccaactcgttggccatttacgcgctctcctggcagcaggcgatgcagcggctgccgcgaaaccgctgtctggtgacgggctactcctgccgcagtcaggtgaagcgtattgaaggcagcggcgttcgccacccgctgcaggcgttactggagataatcggatga

SEQ ID NO: 3096 - DNA, 483 bp, Klebsiella pneumoniae
ataccagggttttcatgccagcggcccaggcgcgctccagcgcgttacgcatatagccgcgatctttcagtacgtacagctgggaccagagcgcgccgctggcgtggctcgccacctcttcaatcgagcagaccgacacggtggataaggtgtacgggatcccggcgcgggaggcggcgcgggccgcctggacttcgccgcggcgggcgtacatcccggtggcgccgacgggccccagcgccacgggcatcgcccatggggcatcaaggatcgtggtcgccagcgtcggttcgccggccccgcacagtacgcgctggcgaagagctaccgaggcaagctcggcggcgttggcgttcatggtgttttccgccaccgcgccaccgtcaatataatcgaaaaggaagcggggcagacgacgacgagcggcttcgcgataatcgctgggggctgaaacaatcattattatgtccttatgttttttaa

SEQ ID NO: 3097 - DNA, 1704 bp, Klebsiella pneumoniae
cggttcgcgacaaaaaagctcgctgtgccaggccggttgccaggcggcgatcgccaccgccgcctgtttactttccggctggccggaatacgggtccgtgacggcggccagcaggttattcacccgcccctgacgggcaaactggttgttccagtgcatcggaacaaacagcgagccggggcgctgcccttcgctgatcgccactttcgccaccatcaccccatgccgcgaccagatccgcgccagcccgtcagcgggaagctgatagcgaacggcatcctgcggcgccacctccaccattggctccgcgatatgctgcatcagccgcggcactgcgccggtacgggtcatggtgtgccactgatcgcggatccgcccgctgttgaggatcagcggataaaaggcatcggttgtcgcccgggtcggttgaggcgtcaccggcaccatccgcagcctgccatcgccatgccagccgcgcgtgatatcccaggcggcctcgctgcggctgaccggccagcgcaccggcggcatggcgtcccacgcctcacggctgagatccgccagcgcgccgatatcaaacgcccgctggccgtcgttttcgaaaccggacagcgccgcatgctcgcggaagacgtcatgcggatgctgccaggcaaacgcctcgcgataccccagcgcctggcccactctggcgatgatccaccagtccgctttcgcctcccccggcggcggcagaaagctgcgctgacgggagatccgccgctccgagttggtgaccgtgccattcttctcgccccaggccagcgccggaaagcggatgtgggcgaaacgtccggtatcggtctgggcggcgacatccgagacgatcaccagcggacaggcggccagcgcctggctcaccgcgtggctgtcagggagcgacaccaccgggttggtacccatgatccagaccgctttgacctcgccgcggccaatggcggcaaacagctccacggcggtcagcccgggggtctgcgccagccgttccgtcccccagaagcgggccagccgctgcagatcgtctggcacaaaatccatgtgcgccgccagcatcgtcgccagcccgccgacttcgcggccgcccatggcgttgggttgaccggtcagcgaaaaggggccgcagccgcggcggccatacttcccgctggccagatggacgttgatgatggcgttacatttgtcgctgccgctggcggattgattgattcccatggtgtagagggtgatcgcccgcggggcggcgatgaactcgcgatagaatcccgccacctcatcggcaggcagaccgcaaaaggccgccaccatcgccacgtcccagccgcgggcggcggccagcgcctgcgggccgtcgcgaaagccatcgacgcaggctcctgcctcagccagggcgttaagcagccccgcaaacaacccgccgtcgcttcccggggccagcgccagatggcggtcggcgatctcgcaggtagcggtgcgtcgggggtcgatcgccacgatccgcaatcggggattatcccgcttcgcctgcgccagccgctggaacagcaccggatgcgcccaggcggcgttcgagccgaccagcaccaccagatcgctgttttccacatcatcgtagctgcagggcaccacgtcggcgccaaaggcccgcttgtagccagtgaccgctga

SEQ ID NO: 3098 - DNA, 228 bp, Klebsiella pneumoniae
aaccctgttgctccagtacctgcaaaaaattcagcaccagttgaactacccctggcgcctgagaaatttgtgggatcatcacgcttgaccctgcctgactatgttgtgtttgaaaatattgtgttggtgctaactaaacgtttgcgtagcgcattcaactttttatcacatttttttcatatgcgcccacgtgttttctgtgcaaaatcagcccggcaaaattattga

SEQ ID NO: 3099 - DNA, 324 bp, Klebsiella pneumoniae
ccagcccctgcgaaaaccagttatttccggcgcgcgggccaaaaaaatcgcccgcccggacaatcaacgcccggccgccgcgctgcacgtaatcctccagcgccagctccatcgccacccggatggcgcctttgcgggtcaccggctgttgtgcggcctcttcagcaatcagcggaaaggcattcggtccatagttgtagaccgtgccgggcaggactacaagcgcccgctgccgttcggcagcctgcagggtgttgtgcagcatgggcagtacctgttgccgccagtgccggtagcccggcggattcaccgcatggacgatga

SEQ ID NO: 3100 - DNA, 687 bp, Klebsiella pneumoniae
cagtcaaccgccaattttgatgatgctgcggagcccaatgtgactcaatcactgttcgatttttctgcatatttcaagtttttcatcggcttatttgccctggttaacccggttggcattattccggtattcatcagtatgaccagctatcagccggctgcggtgcgtaataagaccaacctcaccgccaacctgtcggtggcgatcatcctcctgacgtcgctgttcctcggcgatggcattctgcagattttcggtatctccattgactccttccgtatcgccggcggcatcctggtggtgaccatcgcgatgtcgatgatcagcggtaagctcggcgaagataagcagaacaagcaggaaaagtcggagacggcggtccgggagagcatcggcgtcgttcctctcgcgctaccattaatggccgggccaggggcaatcagttcaactatcgtctgggggacccggtaccactcctgggtgcatctggtcgggttctcactggcgatagcggtatttgccctctgctgctgggggattttccgtatggcgccgtggctggtccgtttgctggggcagacgggaatcaacgtcatcacccgtattatgggcctgttgctgatggccctcggcattgagtttattgtgaccgggattaaagcgcttttcccagggctgctgagttag

SEQ ID NO: 3101 - DNA, 198 bp, Klebsiella pneumoniae
cgatacggcgcgccgcgccagctacgcagctgctcgttcagattcgccaccaccgtaatggagtctgccagccgaggattcggcggcggtgcccgatggctgctgcagccggctaaaattaacgccgccgccaacatgaaccagaagcgcatttcagatgatccctctgtccctagtctctttatcgcaataatttag

SEQ ID NO: 3102 - DNA, 360 bp, Klebsiella pneumoniae
tcaaaatcagcatcccgacccgcgccgtttggtgtgatgcacagagcaaagtgtgaacaatatcacgcgaggactgggtgggcaggatgctgtagcgggacagaaacggggtataaaatggcgatggttaaagcaagtttgacgttatttggtggtgacacgctggtggtgcggtgctcagagcgctgccatattcatctgatgagcgcgaaggtcccgggcgacagtcatgcggatattctgagcgtgcaggatcgggacagcgcctatctgacggtgccctacagcggcacctggaacgtgcttatcgacagtcacagccagtcgctggagcactccatcagctacgtgccggcctga

SEQ ID NO: 3103 - DNA, 870 bp, Klebsiella pneumoniae
cgcaggtcagccctttttttttgcgaggttaacgaagtgggtatgctttctgccgctcgtctgcggctttatcatttacttttcgatcagaaccgacgttccggccgccgctttgaagggctgtgcggacttttcgccctgctcagcgtactggtgatatttatcgagtcgggactgggcacgcaatatcacctgacattagatgaatggcatattttcgtctggctggagctgctggtgaccgcggtctttaccctggaatacctgctgcgtatcgctacctggcccaatccgctccactatattttcagcttttgggggctgattgacctggcgacgattttaccgctgtatgtgatgtggctatggccggaaattagcctcaattatgtattcgcctggcgggcaatgcgggcgatccgcgcgctgcgtattctcaaactactgcgctttatgccttcgctcaacgtgttctggcgagcgattgtcagcgcgcgccatcagctgatcctgttttattcgtttatcgccattgtgatggtgattttcggctcgttaatgtatctgattgaggggccggaatacggctttaccacgcttaacgcctcggtctattgggccatcgtgaccatcaccaccgtcggctacggagacatcacgccgcacacgccgttgggtcgcatcctggcctccattcttatcctgatcggctactccattattgccataccgaccggacttatcaccacgcatatgaccagcgccctgaatcgtcgacgacagcagcgcctgtgtccgcagtgtcagcagggcgaccatgacgataacgcccgtttctgccatgcctgcggtcatgccttgccgaagtaa

SEQ ID NO: 3104 - DNA, 693 bp, Klebsiella pneumoniae
cggaggacagcaataatgcacttcctgaatatgttcttctttgacatttatccgtacattgcgggttcggtgttcctgattggcagctggttgcgctatgactatggccagtacacctggcgcgccgcctccagccagatgctggaccgtaaggggatgaacctggcgtcgaacctgttccatatcggcatcctgggtattttcgccggccacttcctcggcatgctgaccccgcactggatgtatgagtccttcctgccgatcgacgtcaagcagaagatggcgatgatcgccggcggcgcctgcggcgtgatgaccctggtgggcgggttactgctgctcaagcgtcgtctgctcagcccgcgcgttcgcgccaccaccaccggagcggatattctgatcctctcgttgctgatggtgcagtgtgcgctcggcctgctgacgatcccgttctccgctcagcatatggacggcagtgaaatgatgaaactggtcggctgggcgcagtcggtggtgacgttccacggcggcgcgtcacagcatctggatggcgtggcgtttattttccgcgttcacctggtgctgggtatgaccctgttcctgctgttcccgttctcccgtctggttcatatctggagcgcgccggtcgaatacctgacgcgcaaataccagattgtccgcgcccgtcgctaa

SEQ ID NO: 3105 - DNA, 990 bp, Klebsiella pneumoniae
cgaagagcagctgttctatctgcgctcgcgcggtatcgaacagcaggcggcgcagcagatgatcctctacgccttcgccgccgagctcaccgaggctatccgcagcgacgcgctcagagagcaggtgctggcgcgtattggacagcgtttgccgggaggcacagtatgacattttcagtagaacaggttcgcgccgattttccggtactgaaccgggaggtcaacggtcagccgctggtctatctcgacagcgccgccagcgcccagaagccggaggcagtgatcggcgccgaagcggaattctatcgccatggctacgcggcggtgcatcgtggcatccataccctcagcgcggaagccaccgcgcggatggaagccgtgcgtcagcaggcggccaccttccttaacgccgggtcggcggaggaagtggtgttcgtccgcggcaccaccgagggtatcaacctggtggccaacagctggggaaacgccaacgtcggcgccggggataacatcatcatcagcgaaatggagcaccacgccaatattgtgccgtggcagatgctctgcgcccgcgtcggggctgagctgcgggtgatccccctgaacccggacggtacgctgcaactggatgttgtcccgggactgtttgacccgcgcacccgcctgctggcgataaccgaggtctccaacgtgctggggacggaaaacccgctgggcggcgctgattgctcttgcgcatcagcatggcgcgaaagtgctggtggatggcgcccaggcggtgatgcaccacccggtggacgtccaggcgctgggctgcgatttttatgttttctccgcccacaagctgtatgggccgaccgggatcggcgtgctctacgcccggtccgagctgctgcagacgatggcgccttgggaagggggcgggtcgatgatcgccaccgtcagcctgacggagggcaccacctggaatcaggcgccgtggcgctttga

SEQ ID NO: 3106 - DNA, 486 bp, Klebsiella pneumoniae
ataatcacggcaaagaaaggcaccccaaccagggcggttactaccccaacgggcagactttgcggggcaatcagcaggcgcgacgcaatgtccgccagtaccatcaatatcgcccctgccagcgcgctggcgatcagcaacgttcggtgcagcgggccaaagaagaaacgcatcacgtgcggcaccaccaggccaacaaagccgattgagccggccatgctgacgatggtggcggtgatcagcgccgcagtggtgaagaggatcaggcgcacgcgcggcacagcaatccccagcgaggcggcggcatcgtcgccgaaggtgaacgcgtccagcgcccgggcataccacaggcagaccgccagacccgcgagcaccaccacaatgaccagctggaattcgggccagcgaacgccgctgaagctgcccagcagccagaacatcacatcgcgcgcctgctgcgcgctggcggaggtgctgatggtgtaa

SEQ ID NO: 3107 - DNA, 1440 bp, Klebsiella pneumoniae
cgccggcaggcttttttactgatgcagtcaggcttacttgctggtatccagctcgtcgaagcttttcaccagatcgtcaatcgctttcatctgtttgaggaacggctccagtttatccagcggcagcgcggacgggccgtcgcatttcgcgtggtccggatccggatgcgcttctataaacagaccggcgatacctaccgccataccggcgcgggccagctcgctcacctgcgcacgacgaccgccggaggctgcgccaaacgggtcgcggcactgcagcgcgtgggtgacgtcgaaaatgaccggcgagttgttggaggctttcttcatcacgccgaagccgagcatatccacgaccaggttgtcgtaaccgaagttcgcgccgcggtcgcagaggattactttgtcgttacccccttcgataaacttatcgacgatgttgcccatctgacccgggctgacaaactgcggcttcttgacgttgatcaccgccccggtcttcgccatcgcttccaccaggtcagtctggcgcgcgaggaaagccggaagctggatcacgtccaccacgtcagctaccggctgcgcctggctggcttcatgaacgtcggtgatgattttcacgccaaaggtctgcttcagctcctggaaaatcttcatcccttcttccagacccggcccacgataggagtggatggaggaacggttggctttatcaaaggaggctttgaagacgtagggaataccaagcttctgcgtaacggtgacataatgttcgcagatacgcatcgccaggtcgcgcgactccagcacgttcatcccgccgaacagcacgaacggcaggtcgttcgctacgttgatatcaccaatgctaaccactttttgtttcataagttcgccttatcagggtgtaaccggaatggttccagactaatgcaatgtaatttgtttatgcgaaatcgtgttgatctgcgcgcggatcatctcgctgatcggatcctccgggcactgctcaacgaaatagctcagatccaacagcgccacgtgatcgcagtccagctgggcgtatatcagcccgcggtcgcggatctcatacggatcttccggattaaactgcagcagcgcttcgctggcgcgcagggccagctccatctgccgctcttccatcagcgccgacttcagggtgtccagcagcttgcggatcacctcggcgttatccgcttcgtcgagatcttcattaaacagttccgccaccggcccgatgttgcccttcagccatacctccagggtatgctcgtcgagggtctcgccgttaaacggattaatcagccacatctcttcgctggtttccgggtccgcacgcagcagcatttgggtcgggaagatcaccggcaccaccggcagcgccaggcgctgggcgatccacagcaggatcgcgcctaa

SEQ ID NO: 3108 - DNA, 1758 bp, Klebsiella pneumoniae
cggccgtgggctttatgcccaatggatttgcgcagtccaccgccggggcagtacgccagcaatgtgttctggatcgtcggtatcgcgctgattgcctcctggattgtggcggtgatttttaccccctggctgggggtgcacctgttgccggacagaaagcccgcggcggccggccacgccgcgctgtatgacaccccgcgctatcagcgcttccgtcggctgctgacccgggttattgctcataaatggcgcgtggccgccggagtgatggcgctgtttatcgtggcgatcctgggcatgagcgtggtgaacaagcagtttttccccacctccgatcgtccggaagtgctggttgaagtgcagctgccttacgggtcgtcgattagccagaccagcgccgcggcggcgaaaattgagcactggctgcatctgcagccggaggcgaagattgtcaccagctatatcggccagggcgcgccgcgcttttacctggcgatggctccggaattgcccgatccctccttcgccaaactggtggtgttgacagacgggcagggtgcccgcgaggcgctcaagcggcggctgcgggaggcggtggccaatggcctggcgccggaggcgcgggtgcgcgtcactcagctggtgtttggcccttattcgccttatccggtcgcctggcgggtgatggggcccgatccgcacgctctgctcgacatcgccgagcgggttaaatcggtgctgcaggccagtccgctgatgcgcaccgtcaataccgactggggttcgcgggtaccggtgatgcatttcagcctcaatcaggaccggctgcaggcgagcggactcagctcccagtccgttgcccagcagctgcagttcctgctgtcagggatcccgatcaccaccgtccgggaagatattcgcgccgtgcaggtgatcggccgcgcggcgggcgatatccgtctggatccggcgaaaatcgccgacttcaccctggtgggcagcggcggacagcgggttcccttgtcacagattggcgacgtgtcgatcaggatggaggacccgctgcttcgccgtcgcgaccgcacgccgaccatcaccgtccgcggagatgttgcggagaacctgcagccgccggatgtctccaccgcgctgatgaagccgctgcagcccattatcgactcgctgccgcctggctatcgcatcgagacggcggggtcgattgaggaatccggcaaggccacccgggcgatggtgccgttatttccgataatgatcgccctcacgctgctgatcattatcctgcaggtgcgttcgctgtcggcgatggtcatggttttcctgaccgcgccgctggggctgattggcgtggtcccgacgctgctgctgttcaatcagccgtttggcatcaatgccctggtgggtctgatcgccctgtcggggatcctgatgcgcaatacgctgatcctgattggccaaatccatcataaccaacaggcggggctcgatccgttccacgcggtggtggaggcgacggtgcagcgcgcccgcccggttctgctgaccgcgctggcggcgatcctggcgttcattccgctcactcattcggtcttctggggaacgctcgcctatacgctgattggcgggacgctggggggaaccatcatgacccttatcttcctgccggccatgtacgcgatctggttccgcatccgcccggagaacacggtacagcagacagagttgcaccttcagaggtaa

SEQ ID NO: 3109 - DNA, 462 bp, Klebsiella pneumoniae
cgcacctttctcttattttcaggacagggtgaattcacgcctatgaagtcttctattgttgccaaactggaagcgttgtacgagcgccatgaagaagtgcaggcgctgctcggcgatgccgcgacgattgccgatcaggataaattccgcgcgctgtcgcgggagtatgctcaactgagcgatgtggcgcgctgctataccgactggcgtcaggtgcaggaggatattgaaaccgcgcagatgatgctcgacgatccggaaatgcgcgaaatggcgcaggaagagctgcgtgacgccaaagaaaaaggcgaccagctggagcaacagctgcaggttctcctcctgccgaaagatcctgatgacgagcgtaacgccttcgtggaagtgcgcgccgggaccggcggcgacgaagcagcgctgtttgccggcgatctattccgcatgtacacccgttacccataa

SEQ ID NO: 3110 - DNA, 1182 bp, Klebsiella pneumoniae
aaatttgtttatgctatcacccgtggcctatacaggatcatgccctgctcttgcaataagcagggattggtttatcgtgatgcgcatcacttcccggcattttcgccgcggaagaaacagatttttgagaccccaatgaataaaacagacgaattgcgtaccgcgcgcattgagagcctggtaacgcccgcggagctggcccagcgccatcccgtgacggccgacgtggctgcccacgtctcggcctcccgccgccgaattgaaaaaatcctcaacggcgaagaccgccgactgctggtgattatcggcccctgctccattcacgacaccgacgcggcgctggagtatgcccgccgcctgctgggcatgcgcgagcgctaccagccgcagctggagatcgtgatgcgcacctactttgaaaaaccgcgtaccgtggtgggctggaaaggcttaatctccgatcccgacctcaacggcagctaccgggtcaaccacggaattgagctggcgcggcgcctgctgctgcaggttaatgagctgggggtaccgacggccaccgagtttctcgatatggtgaccggtcagtttatcgccgatctcatcagctggggggccatcggggcgcgcaccactgaaagccagatccaccgtgaaatggcctcagcgctctcctgcccggttggatttaaaaacggcaccgacggcaatacgcgcatcgcggtggacgccatccgcgcctcccgcgccagccatatgttcctctctccggacaagcaggggcagatgacgatttaccagaccagcggcaatccgtatgggcatattattatgcgcggcggcaaacggccaaactatcacgccgaggatatcgccgccgccggcgaggcgctgcgtgaattcgatctgccggaacagctggtcgttgatttcagccatggcaactgccagaagcagcaccgccgtcagctggaggtgtgcgccgatatctgtcagcaaattcgcgcgggctccaccgccatcgccgggattatggccgaaagcttcctgcaggaaggcactcagaaagtggtccccggccagccgttgacctggggccagtcgatcaccgacccctgcctgagctgggaagacagcgaaagattattgagcgagctggctgcggccaccgccacccgcctgtaa

SEQ ID NO: 3111 - DNA, 336 bp, Klebsiella pneumoniae
tatttatattattaccgatccactctcgttatttatgctactcttttcaatactaaatgcttaaaggtaacaagaggacggttaaccatgggtattctttcctggatcatttttggacttattgccggtattttagccaagtggattatgccgggaaaagatggcggcggatttatcgtgaccgttattttggggatcatcggcgccgtggtcggcggctggatcagtaccctgtttggttttggtaaggtcgatgggtttaatttcggcagcttcgtggtagcggttatcggtgcgctggtggtactgtttatttaccggaaagtgcgtagctaa

SEQ ID NO: 3112 - DNA, 1233 bp, Klebsiella pneumoniae
aggcacggttattgctttaggcagtataaagcgttaacccggaggaggggtatgaataatacgactggtcatgcgcatgatgcgacggcctggctgcagctggcgcgtcgcctgcaaaaacaacagcttcagcagcttagccaactgggggaactggccagccagctcagcgcgctggtgcatatgctgcagtgtgagcgcggggcgtcgaatatctatctttgctcaggcggcttgctgtatacagcggagtgtcgggcgggaggggcgctggttgacgagcggctagccctgttttatgccagcctcgaacgggcgcgcgcggtagccggcagcgcgctgtgctggcgtatcgccagagcggttgacgagctggcgcagctcccggcgctacgcgcgcagatcggccgccggcaaattgccgctgaagccgcgacggagcagttcagccgcgtcatccgccatctgctgaacatcgccccgcagctcaatgacagcattgacgatccgccggtggctggtcggatggtcgccctgtacagctttatgcagggaaaagagctggtgggccaggagcgcgcgctgggagcattgggctttacccgcggcgagttcagcgacagcctgcgccagcagctggtggaccgtattgacggtcagcagccctgcttcgacagctttcaggcgctgggcagcccggcgaccgtccagttgttcagaacccagtgccacgccggtctggatattgaacagctgcggcggatcgcctgtacccgccagccggctgccgacggcggggaaacggcgctgcgctggtttggcctgcaaacccaacggcttgagcaactgcgtgaagtggaagagcaactgatcgacgatctgctggatgccaccgacgcgctgttagcagacgacgcgcctggctggcaggccggagaggaagacgatagcgtgacgccacggctcgataaacagctactgccgctggtgcgccagcaggcctatgagctgcagcagctctccagccagctggcctcgctgaaagacgcgctcgaagagcgcaagctgatcgaaaaagcgaaaagtctgctgatgacgcaccagggaatgcaggaggagcaggcctggcagacgctgcgcaagatggccatggacaaaaatcagcgcatggttgagatagcccgcgcgctgctgatggtgaaggcgatttggccgctaacaccaaaggagtag

SEQ ID NO: 3113 - DNA, 1365 bp, Klebsiella pneumoniae
ccaggtttgtaccacggtatccgggttcagggacaagctatcaatcccctcttccatcagccaggcggcgaaatcctcatggtcagacggcccctggccgcagatgccgacgtatttaccctgtttcttcgccgcgcggatggccatcgacagcagggctttcaccgcgtcgttgcgttcatcaaacagctcagaaaccacaccggaatcgcgatccagaccgagcgccagctgggtcatgtcgttcgaaccgatggagaagccgtcgaagtactcgaggaactgctccgccagcaaggcgttcgacgggatctcgcacatcataatgatcttcagcccgttctcgccgcgcttcagcccctgacgctccagctcttcgaccaccgctttcgcctgggcgacggtacggacgaacgggaccatcacttcaacgttggtcagtcccatatcgttacgtacgcgcttcatcgcttcgcactcaagggcgaagcagtcgcggaagctttcggaaacgtagcgtccggcgccgcggaagccgagcatcgggttctcttcttccggctcatagcgctcgccgcccaccaggttggcgtattcgttcgatttgaagtccgacagacgcacgatcacccgtttcggatagaaagcggcgccgagggtggcgatcccttcggtcaggcggccaacgtagaactctctcggcgaatcgtagcctttcatcagctcgcggatttcgttctgcaggcccggctcctggtcgtcaaactccagcagcgcgcgcggatgaacgccaatcatgcggttgatgataaattccagccgcgccagaccgacgccttcgttcggcaggcaggcgaagtcgaacgcgcgatccgggttgccgacgttcatcatcaccttcagcggcagatccggcatgtcgccgacgctggagctcttgacgctgaagtcgagcagctcggcgtagacatagccggtgtcgccttcggcgcaggagacggtgacattctgattttcctgaatgcgatcggtagcatcaccgcagccgaccaccgccgggatccccagctcacgggcgataatcgccgcgtgacaggtacgcccgccgcggttggtgacaatcgccgaggcttttttcatgatcggttcccagtccgggtcggtcatgtcggtaaccagtacgtcgcctggctcaatgcgattcatctcgctgatatcgtggatcaccttgaccggaccggcgccaatacggtggccgatggcgcgcccctcggcgatgatctgcccctgagcgtggagggtataacgctccatcacctggccgcgggaacgcacggtttcaggacgcgcctggacgataaatag

SEQ ID NO: 3114 - DNA, 1098 bp, Klebsiella pneumoniae
agggaaatgtatccggtggaaagagaatcacagtctgcgcctgcccggctgatggcgcagctccggcctcagttgccgtacatgaatttttaccgcttctgccagttgctggagaagaaccatccgaaggcgccgatcatcggcagcggctggctattaggtgatgaacccatacgttttcgcccgcatccggggatgggctttccggctggcgaaatccgtggaatggacgatcctgaaccgccccgtccgccggcggttcgcgtgacttttatgggactctacggcgtggaatccccgctgccgacccactatagcgatgacattgcgcaacggcgggaaggcgtcgaggccaccgaggatttcctcgatatctttaaccatcggctgatcgcccagtattaccgtatctggcgcaaatattcctacccggcaacctttcgggcgggcggcacggacaacatctcgcagtatctgctgggcctggcggggctgggcataccgggatgtgccgccgttgccgcagcgccgctgtcgcgatttctggcgctgctgccggtgatgatgctgccggggagatccggggaaggcatggaggcgctggtggcgctcctggccccggggacccgggcgacggtgtaccaccacgatccctgccggatccccttgtcgcagccgttaacgatgagcgtccgtcagccggttagcctgcaacataggccagtgatgggaacccacgccacggatgtgaacggtcaggtattgctgcagctggccacggaaaagcctgatgaggttcgcggctggctgcccggcggcgaactgttcagcgacctgatggcgcttctgcacgtctggctcggatctcatcttgacgtgcggctgcagctttgcgtcgcccgccatttactgccggatgcgcaactttgctgccagcaggagcatgccgtccagctcggccgtaccgctgtgctgcgtccgctggatgcgcagaagcaggctgacgacagagtcacgatttatctggggcgctatcagcgcgtccgggaaaatatccaccgcagggagagcgatgaagatggcgattaccgcagttaa

SEQ ID NO: 3115 - DNA, 1281 bp, Klebsiella pneumoniae
caacgctggtactactccctcacaatgacccttttagctcttggcatcaatcataaaacagctccggtcgccctgcgagaacgcgtcacgttttcgccggaaacgctcgataaggcgctggagagcttgctggctcagccgatggtgcagggtggggtggtgctgtcgacctgcaaccgcacggaactctatctcagcgtcgaagagcaggataacctgcaggaagcgctgatccgctggctgtgcaactaccacggcctcaacgaagaagacctgcgaaaaagcctttactggcatcaggataatgacgccgtcagccatctgatgcgcgtcgccagcggcctcgattcgctggtgctgggcgagccgcagatcctcggccaggtgaaaaaagccttcgccgactccagccgcggccatcttaacgtcagcgagctggagcggatgttccagaaatccttttcagtggctaagcgcgtgcgtaccgaaaccgatatcggcgccagcgcggtctctgtggctttcgccgcctgtaccctggcgcggcaaatctttgaatcgctctccagcgtcaccgtgttactggtcggcgccggtgaaaccattgagctggtagcgcgccatcttcgcgaacatcacgtgcgcaaaatggtgatcgccaaccgcacccgtgaacgcgcccaggcgctggcggaggaagtgggcgccgaggtgatagccctcagcgatatcgacgaacggctgaaagaggccgacatcattatcagctccaccgccagcccgctgccgatcatcggcaaaggcatggtggagcgtgcgcttaaggcgcggcgtaaccagccgatgctgctggtggatatcgccgtcccgcgcgacgttgaaccagaggtcggcaaactggctaacgcctacctctacagcgtcgacgatttgcaaaacatcattcagcataacctggcgcagcgtaaggctgccgcggtgcaggcggaatcgatcgtcgagcaggaaaccagcgaatttatggcctggctgcgcgcgcagagcgccagcgagaccattcgcgaataccgttctcagtctgagcaggtccgtgaggagctgacggcgaaagcgctggccgcgctggagcagggcggtgatgcccaggaaattatgcaggatctggcgcgcaagctcactaaccgcctgatccacgcgccaaccaaatctcttcagcaggccgcccgtgacggggacgacgaacgtctgcatattctgcgcaacagcctcgggctggaatag

SEQ ID NO: 3116 - DNA, 441 bp, Klebsiella pneumoniae
cagtcagttcaacctgttcaacagccgtcgcatcgacgccatcgacgtgaccagcaaaacggagccgcacgcatgattgaactcgtgattgtatcgcgtctgctcgaatatcctgacgctgccttatggcagcatcagcaggagatgttcgaggcgctcgcgtcatcagagaaactcagcaaagaggatgcccacgcgctgggcgttttcctgcgcgatttagtggctcaggatccgctggacgcccaggcggcctatagcgaactgtttgaccgcggccgggccacctcgctgctgctgtttgaacatgtccacggcgaatcccgcgatcgcgggcaggcgatggtcgacctgatggcgcagtacgagcgccacggtctgctgctggatagccatgagctgccggatcatctgccgctatatctggaatatctggcgtag

SEQ ID NO: 3117 - DNA, 1362 bp, Klebsiella pneumoniae
cgcccgactcatctgggacaacgccccgttggggcaacaacttggggtgcccaacgccctgtttgccctaaaaccgggcccgtgtttgggccggccaagcgctgtttccgggcatgttgccgcgggcccaggtatccaacggccatcagtttggcgcctgggcggccaaattgggcgacggacgcgggatcctgttcggcgagcagcagctgccggatggcccgccgttacgactggcatctgaaaggcgccggcctgactccttattcgcggatggggaacggccgcgccgtgctgcgctcgccgatccgggaaagtctggcgtcggaggcgatgcatgctctggggatcccgacgacgcgcgccctggcgatggtgaccagcgataccccggtctaccgcgagcgcgtggagcccggcgcgatgctgatgcgggtggccgagagccatgtccgcttcggccatttcgaacatttttactatcgccgtgagccgcagaaggtccagcaactggccgactatgttattcgccaccactggccgcagctgcaggatgaggcggataagtacctgttatggttccgtgacattgtcatgcgtaccgcgcagactatcgccagctggcaaaccgtgggctttgcccatggggtgatgaataccgacaacatgtcgattctcggtctgaccatcgactacggcccgtatggcttccttgacgatttccaaccggacttcatctgcaaccactccgattatcaggggcgctacagttttgaaaaccagccggcggtggggctgtggaatctgcagcgtctcgcccaatcgctgtcgccgtttatcagcgctgaagcgttaaacgcggcgctggatgagtatcagcacgccttgctgacagcttatggccagcggatgcgcgataaactcggcctgttcagccagcagaaaggggataacgacctgctggacgggctgtttgccctgatgatccgcgagaagagcgactatacccggacgttccgcctgctgagccacagcgaacagctcagcgccgcatcgccgctgcgcgatgagtttatcgaccgcgcggcctttgacagctggtttgccgggtatcgtgcgcggctgcgtgatgaacaggtggacgacgcgcagcgccagcagaggatgcagggcgtgaatccggcgctggtgttacgtaactggctggcgcagcgggcgatcgagcaggctgaggcgggcgatatgggcgagctggagcgcctgcatgccgcgctggcagacccctttaccgatcgcgaggacgactacgtccgccgcccgccggactgggggaaacgtctggaagtcagctgctcgagctaa

SEQ ID NO: 3118 - DNA, 1896 bp, Klebsiella pneumoniae
aaaatcaaccagtttatcgttgcgcaggcgtaccggcagacgccagagatagtgcatctcgaccatttcgcgcagggtggcgttgaagggcgccgccagcttcaccagccaccagggaaaggacttcactaccgccctgccgccatagcgggcgaccacccgctggatcgcctgactcatttcgctgccgtccgggtcccagtggccctgcatatgaaagcgggcgaacggctcaagctcatgcctgcgggccagcagcgcggcaatggtggcggcgacgtcgggcagccaggcccactgatgcccgacgccgatcgtccccgggtagctaatgatgcggggaagctgaccaggcttgaccagcccctgcgaaaaccagttatttccggcgcgcgggccaaaaaaatcgcccgcccggacaatcaacgcccggccgccgcgctgcacgtaatcctccagcgccagctccatcgccacccggatggcgcctttgcgggtcaccggctgttgtgcggcctcttcagcaatcagcggaaaggcattcggtccatagttgtagaccgtgccgggcaggactacaagcgcccgctgccgttcggcagcctgcagggtgttgtgcagcatgggcagtacctgttgccgccagtgccggtagcccggcggattcaccgcatggacgatgacgtcgcaaccggcagccgccgccgcgacctggccgccatccagcgcgtcgccggttatccactgtatgccatcttcgggatcacgcatccgggcgccgcgcttcagcgcccgaacctgccagttgtctgccaccagccggcgcgccacttccccgccgatgcccccgcttgctcccagaataagtaccttgccgctgctgttcatcctctttccccgttcgctaatggatgcttgacagcctacctgcggctcatatcaaatgaaattgcatatcatcgtcgagcggctatacatatttgtatgaatacctctattccctgggagtggtaccgaacctttctcgccgtcctgcaggaaggctctttatcgggcgcatcgcgtaccctgaacatcactcagccgacggcggggcgccatattgccgggctggaaaacgccctcggccaggccttatttacccgctcgcaaaccggcctgctggcgaccgacgcggcgctggcgctgcgggtgcacgccgaggcgatggacaacaccgcccgggcgctggaacgcacggcggccaacttcagtcgcgacagagccgagctgcgtggcgtggtgcgggtggccgccagcgaggtggtcggcgccgaggtgctgccgccgctggttgcccggctcaggcaggcgtgcccgaatatcgtcatcgaactgatgctctccaatcggtttcaggatctgcttcaccgggaggcggatattgcggtgcggatggtcgccccgcagcaggagcagcttatcgcccgccgtctcggcaggatcgagcttgggttacatgccaccgccgcctacctgacgcggcagggcctgcccgcgaccctcgacgatctggccagccacgcgctaattggttttgatagcgccacccctctcgtgcgccgggcgctgcaggcttacccccgttttcagcgcgaggcgttcgcgatgcggaccgatagcgacctcgcccagttgagcctgatccgcgccggagcggggatcggcatctgccaggcgcctcttgcggatggcattattcccctgcagcgagtgctggcggccgacttttctctgtatcttgatacctggctggtaatgcatgaggatctgcgccacagccctgcctgtaagcgggtatttgattttttcgcccaggggttgcaggcgtatattcgtggcccactggcgagctga

SEQ ID NO: 3119 - DNA, 1662 bp, Klebsiella pneumoniae
ggcctcgaccagacggataaagtcggccaccacctgggcgtcgtagtagctggtgaagggatcctgcaccaccagcaccatcttcgctttctgctcggcgctcaacgcttcgagctgctcaagggtcatattggcggaacggtggccggccatctgctgcttcagcgacggcgccgaaagcagcggcagatcgaccatcccgatatgcttctccgacagctttttcagccacggctggttaatgaagaagttaaaggtcttcggcgcctgggccatcagcggcgcataggactccaccgacgccaccagatgatcccgcaccggacgcagatagcggctgtggtacagctgcaggaaacgcgagcggaactcgggaacatcgattttgatcgggcactgggtcgaacaggctttacaggccagacagccggacatcgcctctttgacctcatgcgagaagtcatactcgcctttacgcgcatgccagctgttgcgcgtgcgcgccaccagcgagcgcaggctgacgccctgctccggcagcgccttctccagctggttgggatcgacgccgcggtcggccagcatgcgcagccattcccgcaccagcgtcgcccgccctttcggcgagtggatgcgctggttgctgactttcatcgacggacacatcgggctcttgacgtcaaagttgaagcacagcccgttgccattacactccatcgccccacgccagctgctgcgcaccgcgatggggatctgccgatcccaggtgccgcgcttcgccgcatcgactttcatcatcggcgcgtcgataccttccggtggacagattttccccggattcaggcggttatcgggatcgaagaccgctttgatcttgcgcagctcggcatacagcgtctcgccaaagaaggccgggctgtactccgcgcggaaacctttgccatgttcgccccacagcaggccgccatacttcgccgtcagcgctaccacctcgtcggagatctgcttcatcagtatctcctgctgcggatcgcacatgtccagcgccgggcgcacgtgcagcaccccggcatcaacgtggccaaacatgccgtagctcaggccgtggctgtcgagcagcgcgcggaactcaacgatgtaatccgccagatgttcgggcggtacgcaggtgtcctcggcgaaaggaataggcttggcggcgcctttggcattgcccaacaggccgacggccttcttgcgcatggcatagatgcgctccacgccttcaagatcgtgacagacctgccagccaatgacgcccgcctcgctggcggccatcagctcgtccagccgctggcacagggtagtaacctgctggtcaatcagcgccgcgtcatcgccggcgaattcgacgatattgagcccgagcatctctttatccggtacgtcggtgatcagttcgcttaccgagtgccagacgatatcctcgcgcgccagattgagaactttagaatcgacggtctccaccgacagggctttcgcttcgaccataaagggcgcattgcgcagcgcagagtcgaaggagtcatatttgacgttgaccagacggcgcaccttcggcaggcgggtgatatccagccgcgcttcggtaataaacgccagcgtcccttccgaaccggttaa

SEQ ID NO: 3120 - DNA, 687 bp, Klebsiella pneumoniae
cctgctacacaaatcggcccgctgttccctgccgccgtttttccctgtagacatcaaggatttgtcatcattatgaatcgactgttccgcctgctgccgctggccagcctcgtcctcaccgcctgttctcttcatacgccgcaagggcctggcaaaagcccggattcgccgcagtggcgtcagcaccagcaggctgtccgcagcctcaatcagttccagacccgcggggcggttgcctatctttccgatgagcaaaaagtctatgcccgcttcttctggcagcaaaccggccaggaccggctatcgcctgctgctgaccaacccgctgggcagcaccgagctgtcgctgaccgcgcaacccgggcaggcgtgcagctgatcgataacaaaggccagacctataccgccactgatgccgaagagatgaatggccgtctgaccgggatgccgatcccgttgaacagcctgcgccagtggatcatcggtctgccgggcgacgccaccgactattcgctggacgatcggtaccgtctgcgtgaactgaactatacgcaaaaccgcaaaacctggcacgtgacctacggcggctacaccagcgatacccagccagccctaccgtccaatgtcgagctgaacaatggcgctcagcgcatcaagctgaagatggataactggatcgtgaaatga

SEQ ID NO: 3121 - DNA, 399 bp, Klebsiella pneumoniae
cgacatgcacatcagcatcaccacgatgtcgtccttcggcgcgtggcgcagcagattgatgactttatgcgcctcgctcatattccatgccaccatcagcagcagggcggccatcgccgacagtggcagccaggagagcagtggggcgaggatcagcagcgccaggatcaccagcagggcgtggatcacggcggcaaccggcgatgtggcgccggcgcggacgttcgccgccgagcgggcaatcgccgcggtggcagtgatcccgccgaagaacggcgcgacaatgttgcccagcccctggccaatcagctcgctattggctttgtgcttggtgccggtcatgccatcaagcaccaccgcgcacagcagagattcaatggcgccgagcatcgccattga

SEQ ID NO: 3122 - DNA, 963 bp, Klebsiella pneumoniae
tatactcgacacgttatttgtaacgagaagtttaaaaaacaaacagtccaggagatttcaatggctgcccttaattctaaagtcagaaaagcggttatcccggttgcgggattaggcaccaggatgctgccggccaccaaagcgattccaaaagaaatgctgccgctggtagataagccgttaattcagtacgttgttaatgaatgtatcgctgcaggaattactgaaattgttctggtaacgcactcgtcgaaaaactctatcgaaaaccatttcgataccagttttgagctggaagcgatgctggaaaaacgtgtaaaacgccagctgctggaagaagtgcagtctatttgcccgccgcacgtgactattatgcaagttcgtcagggcctggcgaaaggtctgggtcacgcggtgttgtgcgcccatccggtagtgggagatgagccggtcgcggttattctgccagacgttattctggatgaatatgaatccgatctgagccgcgataacctcgctgagatgatctctcgcttcgatgagactggcgccagccagattatggttgaacctgtcgaagacgtaaccgcttatggcgtggttgactgcaaaggcgaatctctgaagccgggcgaaagcgtaccgatggtgggcgtggttgagaagccaaaagctgacgttgcgccgtccaacctggcggtggtggggcgttatgtcctcagcgccgatatctggccgctgctggcgaaaacccctccgggcgctggtgatgaaattcagctgactgacgccattgatatgctgatcgagaaagaaacggttgaagcttatcatatgaaaggcaagagccatgactgcggtaataagcttggctacatgcaggcgtttgtcgaatatggtattcgtcacaaaacgctgggcgacgattttaaagcctggctggaaacggcggtagcgaagtaa

SEQ ID NO: 3123 - DNA, 1047 bp, Klebsiella pneumoniae
tatgagccgcaggtaggctgtcaagcatccattagcgaacggggaaagaggatgaacagcagcggcaaggtacttattctgggagcaagcgggggcatcggcggggaagtggcgcgccggctggtggcagacaactggcaggttcgggcgctgaagcgcggcgcccggatgcgtgatcccgaagatggcatacagtggataaccggcgacgcgctggatggcggccaggtcgcggcggcggctgccggttgcgacgtcatcgtccatgcggtgaatccgccgggctaccggcactggcggcaacaggtactgcccatgctgcacaacaccctgcaggctgccgaacggcagcgggcgcttgtagtcctgcccggcacggtctacaactatggaccgaatgcctttccgctgattgctgaagaggccgcacaacagccggtgacccgcaaaggcgccatccgggtggcgatggagctggcgctggaggattacgtgcagcgcggcggccgggcgttgattgtccgggcgggcgatttttttggcccgcgcgccggaaataactggttttcgcaggggctggtcaagcctggtcagcttccccgcatcattagctacccggggacgatcggcgtcgggcatcagtgggcctggctgcccgacgtcgccgccaccattgccgcgctgctggcccgcaggcatgagcttgagccgttcgcccgctttcatatgcagggccactgggacccggacggcagcgaaatgagtcaggcgatccagcgggtggtcgcccgctatggcggcagggcggtagtgaagtcctttccctggtggctggtgaagctggcggcgcccttcaacgccaccctgcgcgaaatggtcgagatgcactatctctggcgtctgccggtacgcctgcgcaacgataaactggttgattttttaggcgcggaaccgcataccccgctcgacagcgcggtgtatcagacgctgcaaggcctgggttgtctgcccgccggcgcgataaaccaagaggcgggtgaggcgtaa

SEQ ID NO: 3124 - DNA, 432 bp, Klebsiella pneumoniae
gattttacgcaattgataattaacagaccaaagagtctaaaaaataatttcaagactcacaagtctgttaattgttcattagtgttatgccattgcaatcagccgcttagtttgtttttctcctgccaggtgccctgccgcaggctttgcgtcagacgtaaagaaggtgaatttgaaattgagcagatggtatcttttgctagcctttctgaggaggacagacggagcgacaccatgaaagataaagatgaacaaacggcattgattggcatggccatcggcgcggcggtcattagcttagtggctacacaaaagcagattaatcaggggagtatcgtggatgaactggtgaggctgggcagacagaagggggacggggtagaggatgaggtctttgtccaggccgcccggctggtgagtaaaggcacctag

SEQ ID NO: 3125 - DNA, 288 bp, Klebsiella pneumoniae
gctattcagcaaaatgaatggtggtgggggaaggataactcgtcgctatctctcctcgcccttcgggccgttgcctgcggcaacgttctctcgctggcgctcgagtcgaaccttagtcgaaggttcttacccttcccgctaagtgcaaacatcgtttacgcttgtcggggaaaccatatcactgtagtgaataatggtggtgggggaaggattcgaaccttcgaagtcgatgacggcagatttacagtctgctccctttggccgctcgggaaccccaccacggggtaa

SEQ ID NO: 3126 - DNA, 519 bp, Klebsiella pneumoniae
agacaagagcagcaacgcgatccggagatgcatcagaccaagaaaggcaatcagtggcactttggcatgaaggcccacattggtgtcgatgccaagagtggcctgacccacagcctagtcaccaccgcggccaacgagcatgacctcaatcagctgggtaatctgcttcatggagaggagcaatttgtctcagccgatgccggctaccaaggagcgccacagcgcgaggagctggccgaggtggatgtggactggctgatcgccgagcgtcccggcaaggtaaaaaccttgaagcagcatccgcgcaagaacaaaacggccatcaacatcgaatacatgaaagccagcatccgtgccagggtggagcacccgtttcgcatcatcaagcggcagttcggcttcgtgaaagccagatacaaagggctgctgaaaaacgataaccaactggcgatgttattcaccctggccaacctgtttcgggtggaccaaatgatacgtcagtgggagagatctcagtaa

SEQ ID NO: 3127 - DNA, 3516 bp, Klebsiella pneumoniae
ccgcgctggcagccgatctggtcagcctccgtaaacagcccctgctggcgttattttccagcgaacaggaacattttatcagtaccatcaccccagggagtgaagatgaatataccgggtaatggcctgggccggtttggcctggccgggcttacgttggccgggatggctgcaatatggtgggggatcacccgctatggcggcatgctgaatatcaatacgcggggcgagcaggtactggcgtttgtcctggtctgtctggcgttggtatttgttttttaccttcctgcaatgtcccgccgtgtgaaggagagtttatatcgccggcagtcgcagcaggccagcgtcttacccggcgaagaagggcgcgtggcgctgacacctccccatcatattacggtgggggaaattcgccagactctacgctatcagtatggacgcgcctggtcccgcaaagtccgtattctgctgataattggctcagtcagagacgtagaacaactgaccccaaagctcacgcaggaactctggcaggaagatcagggtacattattgctgtggggtggagaccctggggcagcggtagataacgcctggttcacagcgctgcgtaaactgcgttatcgcccggctgatggtatggtgtgggtaacatcgggctttgacggcgttttgacaacgatgaacagaacgaagcccaggctcacgccagatgaaatggacagtgtgtctcactctctaaagctacgcttagaagctcttggctggaaactacccctatacgtctggtcgctgtatgaggggggcaacgaaaaaaatggacgtatcactcagcctgtaggctgcctgttacctgcaggttgtacgccgcaaatagttgccgaacagttcactgccctggcgtcgttactgatagagcagggcatccaccagatatgcgggcaaccacagcacaattttttactcgcgctggccgaccagttgactcgggaagcggaagcggtggtggaaccgttatcgatactgcttaatccataccgaccattgccgctggccggggtggtatttagtgaggcgtcagtagaggctggtcgcagtgtccgtcatcactggggacgggataaccgctgggaaacgataccagactcagtgctgaggttgccagccggtctacgtccgcgcaaacagggagtcaactggatgcgtgggatgagcgtggccgccgccgccctgatgttactctgggccgcctcaatgacagtctcttttatcgccaaccgccacctggtggcgatcgcacaggagcaggtgcggctggcctcagcggagaaacagccgctggccgtacgcctgcatgcgctctccgcgttacagaaaacgctttctcaactggaataccgctcgcagcacggcgcgccgtggtacctccgcgctggcctcagtcagaacgatgacctgctggcggcgctgttcccgcactacggagagagggcgcagccgctgctgcgcgatgcggcggcgcatcatctggaagagcagctcaccgccttcgtgcagctgccgccggacagcccactgcgtgagaagatgacgaagaccgcttacggacaactgaaacaatatctgatgttgacccgcccggaaaaaatggacgccgcgtggttcgccactacgctaatgcaggactggccgcagcgctcaggcatcgccgacgccgtctggcagggcagcggcccttcgctgctggcattttatgccgccagcctggcatcgcatccgcagtggcgtctgcctgtcgatgacggtctggtcagccaggtgcgcacacggttaattcgccaactgggccagcgcaacagtgagtccacgctttaccagaagatgctcgcgcaggtggcgaatcagtatgccgatatgcgcctggcggatatgactgccgacaccgatgcttcgcgtctgttcagcactgatgaggtggtgccgggaatgtttacccgtcaggcctgggagcaggccgtgcagccggccattgagaaagtggtcgcggaacgccgcgatgaaatggactgggtgctgagcgatacgaagcagactgccgcgcagtcgacgtcgccggaagctctgcgagccaggctggcggagcgttatttcgctgatttcagcggcgcctggctggatttcctcaacagtctgcgctggcagcgcgcggcgaccctctccgatgctatcgaccagctgaccctgatggccgatgtgcgccagtcgccgctggtggcgctgatgaacaccctgagcgtgcaggggcgaaccggccagaccggggaagccatcgccgattcgctggtcaaatcggccaggcagctgttcaaccgtgataactcgcccgtcatcgatcaacggtccggcgcgcgcggtcctctggatgccaccttcgggcccgtactggcgctgctggacaatcgcgacggcgggacacccaccagccgtcttagcctgcagaccttcctgacccgcgtcacccaggtgcgtctgcgcctgcagcaggtcaccaacgccaccgatccgcaggcgatgacccggttgcttgcgcagacggtattccagggcaaggccgtggatttaaccgaaacgcgcgactacggcagcctggtggcggcggggctgggccaggagtggagtggatttgggcagacgctgtttgttcgcccgatggaacaggcctggcagcaggtgctgaccccggcggcggaaagcctcaacgcccagtggcgcagcgcagtggtggaggactggaatagcgcttttggcggtcgctacccctttaaaaataccagcagtgaagtctctctgccgctgctggcaaaatacctcaacagcgagaccgggcgcatcgcccgctttctgcagacccggctgaacggcgtgctgcataaagaggggagccgctggatggcggacagtatcaatgctcaggggctgacgtttaacccggcctttctgcaggcgatgaataccctgagccatctctccgacgtcgcgttcgccaacggcgaagcgggattgcattttgcgcttcgccccggcacggcggacggcgtgatgcagacggagctggtcatcgacagtcagaaacttgtctatatgaaccagatgccggtctggcggcggttcagctggcccgctgacaccgaagcgccgggcgccagtctgagctgggtcagtacccgggcgggcacccgccagtatggcgatttcccgggcgcctgggggtggatccgtctgctggataaggcggtggtcagcgcttatcccggaacgagcagcagctggagcctgagctggaaagcgccggatggtctgttgctgaactacacgctgcgtaccgaggcgggggaaggaccgctggcgctgctggcgctgcgaaactttacgctaccggagacgatattcagcgtgcgcgcgtctgctgaacgtgttccgctgaccgacgatatacccggcgaagagggatactga

SEQ ID NO: 3128 - DNA, 1242 bp, Klebsiella pneumoniae
acgctgcggcagagagaagtccagctgtacggtaccgcactgccatgcacgatcgaggcagtcatacagggtaaattcaattttcgggccgtagaacgccccttcacccagttgatattcaaatgggatgttattttcttccagcgccaccgccagatccgcttccgcgcgatcccaggtctcgtcgctaccgatacgtttttccgggcgagtcgacagtttgacgacgatcttctcgaagccaaaggtgctatacatatcgtagaccatacgaatacaggcgttcacttcatcgcgaacctgatcttcagtacagaagatatgcgcatcatcctgggtaaagccgcgcacgcgcatcagaccatgcagcgcgccagacggttcgttacggtggcagctaccgaattccgccatacgcagcggcaggtcgcggtaggatttcagcccctggttgaagatctgcacgtgacccgggcagttcatcggcttgatacagtattcacggttctcagaagaggtggtgaacatcgcatctttgtagttgtcccagtggccggttttttcccacagcacacggtccatcatgaacggaccttttacttcctgatactggtactctttcagtttagaacgaacaaacgtttccagttcacggaagatggtccagccgtcattgtgccagaacaccatccccggcgcctcttcctgcatgtgatacaggtcgagctgcttaccgattttacggtggtcacgcttggcggcttcttccagacgctgcaggtaggcattcagcgcttttttatctgcccacgcggtgccgtagatacgctgcaacattttattgttgctgtcgccgcgccagtaggctccggcggttttcatcagcttaaagtgatggcagaagcgcatgttcggtacgtgcggaccgcggcacatatcgatatattcttcatgatgatacaggccaggcttgtcatcatgggcaatgttttcatcaagaatagaaactttatagctttcgccgcgtttcacgaaggtttcacgcgcttcatgccagctcactttcttcttgataacgtcgtagtttttctcggcgagctcatgcatacgtttttcgagcgcgtcgatatcttcctgggtcagggtgtggtcgaggtctacgtcatagtagaaaccattatcgacaaccggaccgatagccattttggtgttgggccacagctgtttgatggcatggcctaa

SEQ ID NO: 3129 - DNA, 1125 bp, Klebsiella pneumoniae
cacctgcataaatggagatggttcatgacccatgcacatgaggcggtaaaaacccgccataaggagtcttccctcgtctttccggtgctggcgctggcggtgctgtttttctggggcagcagccagtcactgccagtggttatcgcgatcaatatcctcgcactggtcggcattttgagcagcgccttcagcgtggtccgccacgccgacgtcctcgcccaccgcctgggcgaaccctatggctccctgattttaagcctgtcggtggttatccttgaggtcagtttgatctctgccttaatggccaccggcgacgccgcgccgaccttgatgcgggataccctctactccattattatgatcgtcaccggcggtctggtcggtttctctctgctgctgggcgggcgtaaattcgccacccaatatatgaatctgttcggcattaagcagtatcttatcgccctgtttccgctagcgattatcgtgctggtctttccgatggcgctgccgggcgcgaacttcagcaccgggcaatcgctgctggtggcggtaatttcggcggccatgtacggcgttttcctgcttattcagaccaaaacccatcagagcctgtttgtttatgagcatgaagacgacagcgacgatgacgacccgcaccacggtaaaccgtccgcccacagcagcgggtggcataccgcctggctgctggtgcacctggtggcagtgatcgcggttaccaaaatgaacgctaacccgctggaaacgctgttgaccagcatgaatgccccggtggcatttaccggcttcctggtggctctgctgatcctgtcgccggaaggccttggcgccctgaaagcggtgctcaacaatcaggttcagcgggcgatgaatctgtttttcggctccgtgctggccaccatctcgctgacggtcccggtggtcaccctcatcgccttcctgaccggcaatgagctgcgctttggccttggcgccccggagatggtggtgatggtcgcctcgctggtgctgtgccatatctccttctccaccggacgcaccaatgtgctgaacggcgcggcccacatggcgctgttcgccgcctatctgatgaccattttcgcctga

SEQ ID NO: 3130 - DNA, 1671 bp, Klebsiella pneumoniae
aaaaccagtaattataatgactggagttacaacacaatgaccatcatcactaaaaagcgtttaatcgccgcgggagtgctatccgcactgatcgccggcaatatggcaatggcagcggatgtcccggctggtgtgcagctggcagagaagcaaaccctggtacgtaatagcggcgccgagccgcaatcgctggacccaaataaaatcgaaggggtgccagaggccaatattagccgcgacctgttcgaaggtttgctgaatacttcgccgaaagatggccacccgatccctggcgtggcggagagctgggataataaagattttaaagtctggaccttccatctgcgtaaagatgcaaaatggtctaacggcgagccggttaccgcccaggacttcgtatacagctggcagcgtctggtggatccgaaaaccgcgtctccttatgccagctatccgcaatatggtcatatcgttaacgtcgacgaaatcattgacggcaagaaagcgccgagcgagctgggcgtaaaagccattgacgaccacacgctggaagtcaccctcagcgaaccggtaccctatttttataaactgctggttaacccggcgatgtctcccgtctacaaaccggccatcgaaaaatttggcgaaaagtggacgcagcctggcaatatcgttaccaacggcgcgtatactctgaaagactgggtggtcaacgagcggatcgtgatggagcgtaacccgcactattgggataatgctaaaaccgtcattaacaccgttacctggctgccgacctcttccgaagtgacctatgttaaccgctaccgcagcggtgaactggacatgacttataaccagctgccgatcgaactcttccagaagctgaaaaaagagatccccaacgagctgcacgttgacccctatctgtgtacctattattacgaaatcaacaaccagaaggccccgttcaccgacgtgcgcgtgcgtaccgcgctgaagctgggtctggatcgtgatattattgctaataaggtgaaaggacagggcgatctgccggcctacggctacaccccaccgtataccgatggcgcgaagctgagcgagccggaatggtttacctggtcgcaagaaaaacgcaacgaagaagcgaaaaaactgctggccgaagccggctatagcgccgataaaccgttgaccttcaacctgctgtataacacctctgatttgcacaagaagctggcgattgccgccgcctcgctgtggcgtaaaaacctgggcattgacgtgaagctggtcaaccaggagtggaaaacgttcctcgatacccgtcatcagggcacctatgacgtggcgcgtgcgggctggtgcgccgattataacgagccaacctctttcctgaacaccatgctctctgacagttcaatgaacaccgcgcactataagagcccggcgttcgacaagattatggctgaatccgtaaaagcatccgatgaagcgcagcgcacggcggcctatgcgaaagcagagcagcagctggacaaagacagcgcgatcgtaccggtctattactacgttaacgcccgcctggtgaaaccgtgggtcggtggctataccggtaaagacccgatggataacgtctataccaaagacctctacgttatcaaacattaa

SEQ ID NO: 3131 - DNA, 957 bp, Klebsiella pneumoniae
gagcagtgcaaaggcacacgccagaaggtacgggcaatgttaaaatttatcttacgtcgctgtctggaagcgattccgacgctatttattcttatcaccatctcattcttcatgatgcgtctggcgccgggaagtccttttaccggggaacgcacgctaccgccggaagtcatggcgaatattgaagcaaaataccatttaaacgaccctatcatgacgcagtacttcaattatctgaagcagctggcgcatggcgattttggtccctcttttaaatacaaagattattccgtcaacgatctggtggccgccagcttcccggtttcagcgaaactgggcttcgccgcctttttactggcggtggtgatcggcgttgccgccggggtgatagccgccctgaagcaaaatacccgctgggactacgcggtgatgggggtagccatgaccggcgtggttattccgagctttgtggtcgcgccgctgctggtgatgatctttgccattaccctgcactggctgccgggcggcggctggaacggcggggcgctgaaatttatgatcctgccgatggtggcgctttccctggcctatatcgccagcatcgcgcgtattactcgcggttcgatgattgaagtgctgcactctaactttatccgcaccgcgcgggcgaaggggctgccgatgcgtcgcattattctgcgccatgcgctgaagccggcgctgctgccggtgctctcctatatggggccagctttcgtgggcatcatcaccggctcaatggtcattgaaaccatttacggcctgccggggatcggccagctgttcgttaacggggcgcttaaccgcgactactcgctggtgctcagcctgacgatcctcgttggcgccctgactatcctgttcaacgccatcgttgacgtgctgtacgccgttatcgatccgaagattcgctactga

SEQ ID NO: 3132 - DNA, 915 bp, Klebsiella pneumoniae
caagagacaaatcaaacagggatatgcttaaatttaatatccgctttcaggcaattaaactcattataccggatggtcaaaatggaaagtgctgtagatcgccacgtattttatatttctgacggtaccgccatcacggcggaggtgctggggcatgccgtgatgtcgcaattcccggtcgccatcagcagcgtaaccctgccgtttgtggaaaacatcagccgcgcgcgggcggtgaaggagcagatcgacgccatctatcagcaaacgggtattcgcccgctggtgttctactccatcgtcatcccggaaatacgcgacattattctgcaaagtgaaggcttttgtcaggatatcgtgcaggcgctggtggccccgctgcagcaggagctcaacctcgacccgacgccggtggcccaccgtacccacggcctcaaccccggcaacctgattaaatacgatgcgcgtatcgccgccatcgattataccctcgcccatgacgatggcatctcgctgcgcaaccttgaccaggcgcaggtgatcctcctcggcgtctcgcgctgcggcaaaacacccaccagtctgtatctcgccatgcagtacggtattcgcgccgccaactatccgtttatcgccgacgatatggacaatctggtgctgccggcctcgctgaaacccctgcagcataagatgttcggcctgaccatcaatccggagcgtctggcggcgatccgcgaggagcgccgggagaacagccgctacgcctcgctgcgccagtgtcggatggaagtgaccgaagtggaggccctgtatcgcaagaataaaatcccctgcctgaacagcaccaactattccgttgaggaaatagcgacaaaaatcatggacatcatggggctgaatcgcagaatgtactaa

SEQ ID NO: 3133 - DNA, 345 bp, Klebsiella pneumoniae
atcggaggaaaaggcatggcaacggcaagaagcggctatacgctgcaggtgataaaggcagggcagcaggggcatgttgaaatgagatgggggcatctcgcagacgttgatacgcgcgcggcggcggcggctatcatgcagcatatcgggcgttcttcgtcctcgcggggccagcaggagatcagcctgtcgctgaccaatgccgccagcggcatctcggtggagcttcatcacccggcctcaggggaaagcgctaccccggcttttattgaggctgagttaaagaaaattgtgcagatcgttgatggctacgaggcggcagaagatacccatattgtggagtag

SEQ ID NO: 3134 - DNA, 480 bp, Klebsiella pneumoniae
aaggggggaaatgccttttataattatgtgaaatatatgaatgacgtacttgatgaaattgaccgggcgatcctctcctgcctgactcaggatgccagagtttcgctcaaggtcctgagcgcgcgagtggggctgacctcgccgagcaccgccgagcgggtgaagcgcctggaggagcggggtgtcattcagggctatggggcgcgggtaaatctcgccgcgctgggctatagcctgcaggcgctggtgcgggtccggccgctgcctgggctgctgcagaaggtggataaatatatccaggcgatgccggaatgtattgaaagtgacaaggtgaccggggaagattgttttgtaatgcgtctcgtggtgcgcgatattgctcagctggataccctgctggacggtctggcggagtatgcgcagtgtaacacctcggtggtgaaaagctcgccggtaaaaaggcggttgccaccgctgtga

SEQ ID NO: 3135 - DNA, 921 bp, Klebsiella pneumoniae
ctgttcatgaaactgcgtcatctggaaatcttctatgccgtcatgacctgcggctctttatcgcgggcggcggaagcgctcaatatctcccagcccgcggccagcaaagcgttaaaaagcgccgaaatgaagctgggttttaccctgtttcagcgggtgcgcggcaagctgctgccgaccagcgaggcgatcacacttttcgaaaaagcgcagagcatttatcaggacctggacaacctgcgcctgctggccgacaacctggctcgcgatccgcgcgccaagatcactttaggctgtctgccaagcctggggttaagcctggtgccggagctggtgaccgacttttatcagcaaaacagcaacctggtgatgacgcttactaccgagcacaccgagacgctggtcaaaaaactggatttgcgcgagatagatttggcgctgacgctacagccggtgcagcagggggagatcctgaccaccctgattgccgaagtaccgctggtgtacatcgaccgtcattatcgtcagggggcggtggagatcgatcagatcgaccagcagcgctggatctcgccgggaccgcactcgctctctgccgccatcgccacccgtcgcgacttttccaccacccggctaaacgtccagacctactatatggccaccgagttcgtgaagcgcggcatgggctgcagcatcactgatatcttttccgcccagcacaacctggccccggagatgatccatcccattacgccgccgatggcgattaacctctgtctgttacgccgggccgacgtttccctgagcccgatggcgcaaaagttcgttgattttctctgccagcgtctgcgccaacagctcaaggagattaacctgcggttataccctgaccataaaaagtcaattgcgccgctggggtaa

SEQ ID NO: 3136 - DNA, 1005 bp, Klebsiella pneumoniae
cgtttaatgaagaaggtcctttgcgcgttaggcttgatgttcaccgccgtcagttccgcgctggcaacaacctaccccctgacgattgaaaactgcggctatcaggagaccttcacccggccgccggagcgcgtggtcgcgctggggcaaaatacggtcgaaattctgctgctgctcgggctgcaaaagcaggtggtcgccagcgccttctggccgaccagcgttttaccgcagctggctgagcaaaacgcgaagattaaaaccttgacggtggaaattccgagcctggaatcggtgctggcgcaaaatcctgatttcgttcccgcccagttgccgctgctgctggggccggaaagcaaagtcgccaggcgtgaagatctcgccaccgtcggcgtgaacagctacgtctcaccggggatgtgcgccactaaaaaggccaccggcgacatgtacggcagccggcaaaagctgtgggatatgacctggctgtatcaggaaattagcgatttcgcccgcattttcaacgtcgaagatcgtggtcaggcgctgattgccgatttcaaaaaacgtgaagccgacctgcgccaggagtttggtaaaagcaaaaaggatctctccttcgtcttctggttctccagcgcctcaccttcggccgatgcctatgttggcggcaaaaacagcgcctccggatttatcgccagcgtgctgggcggacataatgcgataacctccgagaccgagtggcccacggtgagctgggagagcatcattgccgccaacccggatgtgatcgtggtcgccagtctggaccgtaaccgctgggcgctggataaggccgaggagaagatcaaattcctcaaaagcgatcccgccgtcagccagctggaggcggtgaaaaaaggccatatcgtggtcatggacggtcaggcgatgaatccgaccattcgcacgctttacggcgcggaacaggtgggcgaacagctgagaaaaatggggctgaactga

SEQ ID NO: 3137 - DNA, 456 bp, Klebsiella pneumoniae
ggagaagtgaaaatgcctcgtccctccctgtatgacatcctgtacggcaatttcgccggcgggcttgacctgaatactgtcagcgaaacggatcaggtcatcctgtcggtgctcgataacatgcagcgcatcctcaactgtcgggccggaacgctggcgcatctgccggactacggcctgccggatatgaccgctatcctccaggggatgccagcgtcggcgcaccagctgatgagcacgttgtcggcggtgttgctgaaatacgaaccgcgtctgcagcggatcgcggtggtgatgctcgatcagcatgcgcccggcgaactgcgctatgccattgatgcggagttgaaggatattggcctggtgcgttacggcacggagtttatgcccgagggcagggtgttgatccgccacctcaaacgtcagcagtaccttgacgcccgctccgccctctaa

SEQ ID NO: 3138 - DNA, 513 bp, Klebsiella pneumoniae
cataatgccctttggcgtagaagcgccgttactctttcttccatggaggcagttttgtcgcaattatgcccctgtggcagcgcactggagtatagctcatgttgccagcgatatctgtccggcgctgagcttgcgccgggcccgtcacagcttatgcgctcccgttatagcgcgttcgtcatgaaagacgctgactatctaatcaaaacctggcacccgtcctgtcaggcgcagcaatttcgcgccgaactggagaaagggttttcccagaccgaatggctgggcttaaccctgttcgccagtgatgaggggcgagctccaaatgaaggttttgtcagctttgtcgcccgctttaatgacaataaccgccctggcgccattattgaacgttccagattcttaaaagaaaatggacagtggtactatatcgacgggacacgaccgctgattggccgtaacgacccctgcccctgcggctcaggtaaaaaatttaaaaaatgctgcggccagtaa

SEQ ID NO: 3139 - DNA, 327 bp, Klebsiella pneumoniae
ccatcggctgatcgcccagtattaccgtatctggcgcaaatattcctacccggcaacctttcgggcgggcggcacggacaacatctcgcagtatctgctgggcctggcggggctgggcataccgggatgtgccgccgttgccgcagcgccgctgtcgcgatttctggcgctgctgccggtgatgatgctgccggggagatccggggaaggcatggaggcgctggtggcgctcctggccccggggacccgggcgacggtgtaccaccacgatccctgccggatccccttgtcgcagccgttaacgatgagcgtccgtcagccggttag

SEQ ID NO: 3140 - DNA, 864 bp, Klebsiella pneumoniae
ctggatcgtgaaatgatgacccgctggccctctcctgcaaaactgaatctgtttttatatatcaccggccagcgggccgatggttaccataccctgcaaacgctgtttcagtttctcgattacggcgatacgttgaccatcgaaccgcgtactgacggccaactgcgcctgctgacgccggtggccggcgtgccggacgaggagaatctgatcgttcgcgccgcgcgtctgctgatgcatgccgccagcgaaagcgatcgcctgccggcgggcagcggcgccgatatcagtatcgataagcgcctgccgatgggcggcggcctgggcggtggctcctccaatgccgccaccgtgctggtggcgctcaaccatctgtggggctgcggtctctcggaagatgagctggcgactcttggccttcagctgggggccgatgtgccggttttcgtgcgcggccatgccgccttcgccgagggggtgggtgaaatactgacgccggtagaacccgaggaaaaatggtacctggtggcccacccgggggtcagtattccgacgccgatcatttttcgcgatccggagctaccacgaaataccccgcgccggtcaattaatacgttattaaattgtgaattcagcaacgattgcgagcttatcgcaagaaaacgttttcgcgaggttgatgccgcgctttcctggctgttagaatatgcgccgtcgcgcctgaccggcacaggggcctgtgtgtttgctgaatttaacaccgaatccgctgcccgtcaggtgctggacactgccccggcatggctaaatggctttgtggcgcgcggagttaacctttcgccgctcaagcaggccctgctctga

SEQ ID NO: 3141 - DNA, 183 bp, Klebsiella pneumoniae
tcaagcagtgatgtccctactatcactctgcgtgaagtttacgcaacgaaattaataggctttaaaaatgatgctcagcaacttaacgctggcagcgtagttaatatccctttatgtcaggcaggtaaacctttgtatgcaggggtgttatttccaagtgctttcaagcggctacggccctga

SEQ ID NO: 3142 - DNA, 702 bp, Klebsiella pneumoniae
tcgtcacgtttatcccggaaaaaacgttttccatccaataaggagaccctcatgagtcaacaggaacgggcaactatccttctcattgacgaccatccgatgctgcgcaccggcgtgaaacagttgatcagcatggcgccggacatccaggtgattggcgaggccagcaatggcgcgcaaggtattgagctggccgagtcgctggatcctgacctgatcctgctggacctcaatatgccgggcatgaacggtctggagacgctggataagctgcgtgagaaatccctttctggccgggtagtggtcttcagcgtctccaaccatgaagaggacgttgtcaccgccctgaagcgcggcgccgatggctatttgttgaaggacatggaaccggaagatctgctgaaagcgctgcagcaggcggccgccggagagatggtattaagcgaagcgttaacgccggtgctggccgccagcctgcgcgccaaccgcgccacctccgatcgggacatcagccagctgaccccgcgcgagcgcgacattctcaagctgatagcccagggactgccgaacaaaatgatcgcccgtcgcctggatatcaccgaaagcaccgtcaaagtacacgtgaagcacatgctgaagaaaatgaagctcaaatcccgcgtggaagcggcggtatgggtccaccaggagcgaatcttctaa

SEQ ID NO: 3143 - DNA, 804 bp, Klebsiella pneumoniae
caggacgccgagatagcggatgcgacccacgcaggtttcggagcacaccgtcggcatcccggattcaatacgcgggtagcagaagatgcatttctcggatttcccgctcttccagttgaaatagatcttcttgtacggacagccggtgatacacatccgccagccgcggcacttgtcctggtcgatcagtacgatgccgtcttcttcacgcttatagatggcgccgctcgggcaggtcgcgacgcaggccgggttcaggcagtgctcgcacaggcgcggcagatacatcatgaaggtgttttcgaactggccgtacatcgccttctgcatgttgtcgaagttctgatctttggcgcgtttttcaaactcgccgccgaggatctcttcccagttcggaccgctggtgatcttgtccatccgctggccggtgatcagcgagcgcggacgggcgatcggctgatgtttgctctccggcgcgttatgcagattctggtagtcataatcaaacggctcgtagtaatcatcgatgcccggcagatgcgggttggcgaagattttacccaacagcatcgcgcgattgcccatgcgcggctgcagtttaccgttgattttgcggatccagccgcccttccatttttcctggttttcccagtcgttcgggaaaccgacgcccggcttactttccacgttgttgaaccaggcgtattccatcccttcccggctggtccagacgtttttacaggtcaccgagcaggtgtggcagccgatgcacttatcgagattcagcaccatgccgacttgtga

SEQ ID NO: 3144 - DNA, 1419 bp, Klebsiella pneumoniae
ccatgccgcgatgttctgcgattcgctgatcgtgatgcagcaggggcagatcctcgccagcgggacgccggaggagattttgtccgaagcgctgctgtgggacgttttccgggtgaaaaccaaaatcgagatctccccttaccacggcaaaaagcacattcatttcatcgtttaggttgggcggatatgcctcttttctccctgcgccctgcggcaaccctctggcctccggtgttactgggaagccagttcgtttttaatattggcttttacgcggtcgttcctttcctcgccctcttcctgcgcgacgacatgctgctctcaggcggacttatcggcctgatcctcgggctgcgtaccttctcccaacaggggatgtttatcctcggcgggacgctggccgaccgctatggcgctaaggcaatcattctcgccggctgcgtcgttcgcgtcgccggttttctcctgctggcgtgcggggcgtcgctgtggcccattatcctcggcgcctgcctgaccggcgtcggcggcgccctgttctccccgtcgatagaggccctgctggcgcgggccggcaccctcagccaggccaacgggaaacgcagccgcgccgagtggtttgcgctgtttgcggtatgcggtgaactgggagcggtgatcggcccggtggccggaggcgtgctgagcgggatcggctttcggcatatcgccctcgccggcgcgggaatatttcttctggcgctggcggtgctctttttctgtctgcccgccgacgggcacacgacaacaacgcgcagacgagtcccatggtggacgcctttgcgccagccgcgctttgtcgcgtttattctcgcctacagctcatggctgttgagctacaaccaactgtacctcgccctgccggtggagatccaacgttccggcggccgcgagcaggatctggcgccgctctttatgctggcctcgctgttgattatcaccctccagctccctctcgcccgcttcgcccggcgaatgggcgccgtgcgcatcctgccggtgggctttctgctgctgtcggcttcctttgccagcgtggcgttattcgccgccgccccacccgccgaaggttggctgcggttaatgccggcggctggttttgtcacgctgctcaccctcggccagatgctgttagtgcccgcagccaaggatctgatcccgctgttcgccgaggagtcgacgctgggcgcccactacggagcgctcgccaccgcaggagggtgcgcggtgttagccgggaatttactgctcggtcatttacttgaccaggcgctcattccgtcgccgcaggcggtttatccctggcttctgctggcgctgtttccgctgtgcagcgccgtcgccctgcgggcgatctgtcgcccgctggcggcaacatga

SEQ ID NO: 3145 - DNA, 285 bp, Klebsiella pneumoniae
ccggaaggcgacattgcccggtctgatttccgtaataagagaattaacatcatgaaaaacaatcgttataccatcgcagccctggcgctgtgcgtgctttcttttggcgcatcagccgccacgcccgttccgccatcgggtcatcaggatcatacccaggtaggtatcgccaaagccactgacgttgaggctggttcgaatattgcgcccggcgctcctaccaccggaaaatccatgagcgacgcctttaatgtgcatacgctggtggccggcgagtggtcttaa

SEQ ID NO: 3146 - DNA, 192 bp, Klebsiella pneumoniae
ggccatcaagaaacatttccggtgggcttcggctcactggttttgttcgcctttgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcacattctga

SEQ ID NO: 3147 - DNA, 342 bp, Klebsiella pneumoniae
ctgccggaagaggaagcgcttggcggcctgcgggacgtcgcgccgatcctcggtctgctcagcgcgcgcctgcagcagcgcgaaagtcgctatgcggtgctgttcgagctgttgctgaagctggccaatactcaggtcgacagccagaaggtggcggagaagattgccgacgaagcgcgcgacgatacgccgcaggcgctggacgccgtctgggaagaagaacaggtcaaattctttgccgaccagggctgcggcgagtcggaaatttccgctcaccagcgtcgttttgccggagccgtggccccgcaatatctgaatatctctaacggaggacagcaataa

SEQ ID NO: 3148 - DNA, 1341 bp, Klebsiella pneumoniae
actgtcagagagcatggtgttcaggaaagaggttggctcgttataatcggcgcaccagcccgcacgcgccacgtcataggtgccctgatgacgggtatcgaggaacgttttccactcctggttgaccagcttcacgtcaatgcccaggtttttacgccacagcgaggcggcggcaatcgccagcttcttgtgcaaatcagaggtgttatacagcaggttgaaggtcaacggtttatcggcgctatagccggcttcggccagcagttttttcgcttcttcgttgcgtttttcttgcgaccaggtaaaccattccggctcgctcagcttcgcgccatcggtatacggtggggtgtagccgtaggccggcagatcgccctgtcctttcaccttattagcaataatatcacgatccagacccagcttcagcgcggtacgcacgcgcacgtcggtgaacggggccttctggttgttgatttcgtaataataggtacacagataggggtcaacgtgcagctcgttggggatctcttttttcagcttctggaagagttcgatcggcagctggttataagtcatgtccagttcaccgctgcggtagcggttaacataggtcacttcggaagaggtcggcagccaggtaacggtgttaatgacggttttagcattatcccaatagtgcgggttacgctccatcacgatccgctcgttgaccacccagtctttcagagtatacgcgccgttggtaacgatattgccaggctgcgtccacttttcgccaaatttttcgatggccggtttgtagacgggagacatcgccgggttaaccagcagtttataaaaatagggtaccggttcgctgagggtgacttccagcgtgtggtcgtcaatggcttttacgcccagctcgctcggcgctttcttgccgtcaatgatttcgtcgacgttaacgatatgaccatattgcggatagctggcataaggagacgcggttttcggatccaccagacgctgccagctgtatacgaagtcctgggcggtaaccggctcgccgttagaccattttgcatctttacgcagatggaaggtccagactttaaaatctttattatcccagctctccgccacgccagggatcgggtggccatctttcggcgaagtattcagcaaaccttcgaacaggtcgcggctaatattggcctctggcaccccttcgattttatttgggtccagcgattgcggctcggcgccgctattacgtaccagggtttgcttctctgccagctgcacaccagccgggacatccgctgccattgccatattgccggcgatcagtgcggatag

SEQ ID NO: 3149 - DNA, 414 bp, Klebsiella pneumoniae
gggttaagagaggtcatcggatcctggaaaatcattgagatttgttcagcgcgcagtttgttcagctcacgctcgggcaaattgaggatttgccgaccgttaaaggtggcggaacccccgatgcgaccgttggccgccagcagtcccatcagggcgaaggcggtttgcgatttaccggagccggattcgcccacaatgccgagcgtctcgcccgcctgcagggtgaagttcagatcattgacggcggtgacgtcgccatccggcgttttaaaggtgacgcgaagatctttcacgtccagcagtagcccgctgtggctctgcgcttgcggcgcttttgccgtttcaatcatggtcatggcagcgctccttagcggtctttcgggtcgagggcatcacgcagaccatcgccgataa

SEQ ID NO: 3150 - DNA, 1209 bp, Klebsiella pneumoniae
ggccgaggagaagatcaaattcctcaaaagcgatcccgccgtcagccagctggaggcggtgaaaaaaggccatatcgtggtcatggacggtcaggcgatgaatccgaccattcgcacgctttacggcgcggaacaggtgggcgaacagctgagaaaaatggggctgaactgatgagcgtcgccgcgattgagacgcgccgcagcatactgctcaccggctggtgtgtactggcagcgatcgtgctggcgctggtgatagcggtgggcgtcagcgtcggcgagctggccatcccgctgcagaatgtcttttacgctatcagcaacagaaccggcttaaccgctgagcctctcaaccgtatctatgagagcgtaatctgggatttccgcctcagccgcgcgctggtcgccgcctgctgcggcgcaggcctcgctatctgcggcgtcgtgctgcaaagcctgctgaaaaatgccctcgcggaaccctacgtcctcggcgtctccgccggggcctccaccggcgcggtgtcgatcgtggtgctgggccttggcgctggcgcgatttccctctcggcaggggcctttgccggggccttcgccgccttcgcctttgtcgccttgctgactaacggcgcgcgcggcggcaatgagcgtaccattctggcgggcgtcgccgcctcgcagttatttaacgccatcacggcttacaccatcagcacctccgccagcgcgcagcaggcgcgcgatgtgatgttctggctgctgggcagcttcagcggcgttcgctggcccgaattccagctggtcattgtggtggtgctcgcgggtctggcggtctgcctgtggtatgcccgggcgctggacgcgttcaccttcggcgacgatgccgccgcctcgctggggattgctgtgccgcgcgtgcgcctgatcctcttcaccactgcggcgctgatcaccgccaccatcgtcagcatggccggctcaatcggctttgttggcctggtggtgccgcacgtgatgcgtttcttctttggcccgctgcaccgaacgttgctgatcgccagcgcgctggcaggggcgatattgatggtactggcggacattgcgtcgcgcctgctgattgccccgcaaagtctgcccgttggggtagtaaccgccctggttggggtgcctttctttgccgtgattatctaccgctcaaggaataagtga

SEQ ID NO: 3151 - DNA, 2697 bp, Klebsiella pneumoniae
cattatcaggagagcattatggctgttactaatatcgctgaactgaacgcgcttgttgagcgtgtcaagaaagcccagcgtgaatatgccagtttcactcaagaacaagtcgacaaaatcttccgcgccgccgctctggccgctgcagatgctcgaatccctctcgccaaaatggccgtagccgaatccggcatgggcatcgttgaagacaaagtgatcaaaaaccactttgcttccgaatacatttacaacgcttataaagacgaaaaaacctgtggcgttctgtcagaagacgacacctttggcaccatcactattgctgagcctatcggcatcatctgcggtatcgtaccgaccactaacccgacttcaacagccattttcaaatcgctcatcagtctgaaaacgcgtaacgccatcattttctctccgcacccgcgtgcaaaagaagccaccaacaaagcggctgatatcgtgctgcaggctgccatcgcggccggcgcgccgaaggacctgattggctggatcgatcagccgtctgtagaactgtctaacgcgctgatgcatcacccggacatcaacctgatcctggcgaccggtggcccaggcatggtgaaagcagcgtacagctccggtaaacctgctatcggcgtcggcgccggtaacaccccggtagtcattgatgaaaccgccgacatcaaacgtgccgtagcgtccgtactgatgtctaaaaccttcgataacggcgtgatctgtgcttctgagcagtccgttgtggtggttgattcagtctatgacgcggttcgcgaacgtttcgccagccacggcggctatctgctgcagggtaaagagctgaaagccgttcaggacattatcctgaaaaatggcgcgctgaacgcggctatcgttggtcagccagcggccaaaatcgctgaactggcaggcttcaccgtgccggccaccaccaaaattctgattggtgaagtgaccaacgttgacgagagcgagccgtttgctcacgaaaaactgtctccgacgctggctatgtaccgtgcaaaagatttcgaagacgcggtagccaaagcagaaaaactggtcgccatgggcggtatcggccacacctcttgcctgtacaccgaccaggacaaccagccggctcgcgtggcttacttcggccaaatgatgaaaaccgcgcgtatcctgatcaacaccccggcttctcagggtggtatcggtgacctgtacaacttcaaactcgcgccttccctgactctgggttgtggttcctggggtggtaactccatctctgaaaacgttggtccgaaacacctgatcaacaagaaaaccgttgctaagcgagctgaaaacatgttgtggcacaaacttccgaaaatcctatctacttccgtcgtgggctccctgccaatcgcactggatgaagtgattaccgatggtcacaaacgcgcgctgatcgtgactgaccgcttcctgttcaacaacggctatgccgatcagatcacttccgtactgaaagctgcgggtgttgagacggaagtcttcttcgaagttgaagctgacccgacgctgaccatcgtacgtaaaggtgccgacctggcgaactcctttaaaccagacgtgatcatcgccctgggcggcggttccccgatggatgcggcgaaaatcatgtgggtcatgtacgaacatccggaaacccacttcgaagaactggcgctgcgctttatggatatccgtaaacgtatctacaagttcccgaaaatgggcgtcaaagccaagatggtggcgatcactaccacttccggtaccggttctgaagtgacgccgttcgccgtggtgaccgatgacgcgaccggtcagaaatacccgctggcagactacgcgctgaccccggatatggccattgtcgatgccaacctggtgatggatatgccgaaatcgctgtgtgcgttcggtggtctggatgcggtgactcacgccctggaagcttacgtttccgtactggcttctgagttctctgacggccaggcgctgcaggcgctgaaactgctgaaagagtacctgccggcttcctatcacgaaggttccaagaacccggttgcccgtgagcgcgtacacagtgccgcgactatcgccggtatcgcgttcgctaacgccttcctcggcgtgtgtcactcgatggcgcacaaactgggctcccagttccatattccacacggtctggccaacgccctgctgatctgcaacgttatccgctataacgcgaatgacaacccgaccaagcagaccgcgttcagccagtacgaccgtccgcaggctcgtcgtcgttacgctgaaatcgccgatcacctgggcctctccgcaccaggcgaccgcaccgcagcgaaaatcgagaaactgctggcatggctggaaagcattaaagctgagctgggtattccgaaatctatccgcgaagctggcgttcaggaagctgacttcctggcccacgttgataaattgtctgaagatgcattcgatgaccagtgcaccggcgctaacccgcgctacccgctgatctccgaactgaaacagatcctgctggatacctactacggccgcgaattcgtcgaaggcgaagccggtgcgaaagccgaagttgctccggtaaaggctgagaaaaaagcgaaaaaatccgcttaa

SEQ ID NO: 3152 - DNA, 1446 bp, Klebsiella pneumoniae
tgccgccgggagccagccatgagcgccgggcgttttaatctctccgcgctggccgtccgcgagcggtcggtgaccctgtttttgattatccttatctccgtcgccgggctggtggcgttcttcggactcgggcgagcggaagatccgccctttacggtcaagcaaatgacggtcattaccgtctggcccggcgccaccgcgcaggagatgcaggatcaggtcgccgagccgctggaaaaacgactccaggagctaaagtggtacgatcgcacggagacctatacccgccctggcatggcgttgatcaccctgtcgctgcaggatcagaccccgccttccgaggtgccggagcagttttatcaggcgcgcaaaaagctcggggatgaggcgaaaaacctgcctgccggcgtctccggcccgatgatgaatgacgaattcgccgatgtcacctttgccctctttgctctgaaagcgcggggagagccgccgcggcagctggtgcgtgacgctgaagccctgcgccagcagctgctgcatgtatccggggtgaaaaaagtgaatatcctcggcgaacaggcggagcgcatttatctctcgttttctcatgatcgtctcgccaccctgggcctttcgccagaggcgatttttgccgcgctgaacagccagaatgtgctgaccgccgccggggccattgagacccggggcgggcagatctttatccgcctcgatggggcgtttgaccgcctgcagcagatccgcgacacgccaattattgccgggggcagaacgctgaaactggccgatgtcgccacggttgagcggaggtacgaagatcccgccaccttcctgatccgccatcagggcgaaccggcgctgctgctgggggtggtgatgcgcgagggctggaatggtctggcgctggggaaagcgctggatgccgaaacggccagcatcaatcagaacctgccgctcggcatgtcgttgaccaaggtgaccgatcagtcggtgaatatcagcgccgcggtcgatgagttcatgatcaaattctttgtcgccctgctggtggtgatggcggtgtgctttgtcagcatggggtggcgcgtgggcgtggtggtcgcggcggcggtgcctttaaccctcgccgtggtgtttgtggtgatggaggcgaccggcaaaaacttcgaccgcatcactctcggctcgctgatcctcgccctggggctgctggtggatgatgccatcattgccatcgaaatgatggtggtcaaaatggaggaagggtatgaccgcctcaaagcctcggcctatgcctggagcccataccgccgcgcccatgctggccggtaccctggtgacggccgtgggctttatgcccaatggatttgcgcagtccaccgccggggcagtacgccagcaatgtgttctggatcgtcggtatcgcgctga

SEQ ID NO: 3153 - DNA, 915 bp, Klebsiella pneumoniae
ttattagtactaatgagaaagcttaaaattggtctggcgctaggtgcgggagccgctcgcggatggtcgcacattggcgtcatcaacgccctccagcgggccggtattgagattgatatcgtagccggttgttctatcggttcgctggtaggggcggcgtatgcctgtaaccgactcccggcactcgaatcatgggtctgctcattcagcaactgggatgtcctgaagctgatggatctctcctggcgccgggggggactgctgcggggggaaaaggtattcaatcattaccgccgcattatgcccgtcaccgagattgaacgctgcgagcgccggtttgccgctgttgccaccaatttaagcaccggtagggagctgtggtttaccgaaggcgatctacatttagccattcgcgcctcctgcagtatgccggggttaatgtcgccagtaaggcataatggttactggctggtcgatggcgcggtggtcaatccggttcctgtgtcgctcacccgggcaatgggagcggatattgtgattgccgtcgacctgcaacatgatgcccatcttatgcagcaggatttgttctcccttgaaacgccgcggcaggaagcggaagagaaggaggggccatggcatactcgtctgcgcgcgcgcttgacgcgaatgagttcccgccgtacggccgtgacgccgacggcgatggagatcatgaccacctctatccaggtactggaaaaccgtcttaaacgcaatcgtatggcgggtgacccgccggatatcctgttgcagccatactgtccgcaagtttcgacgcttgattttcatcgcgccggagaggcgatcgccgcggggcaactggcggtagaaaagaaaatggatgaattattaccattagtgcgtacagccgtttga

SEQ ID NO: 3154 - DNA, 900 bp, Klebsiella pneumoniae
aaaatgcaacttacccgcggtgtctggcagatgagcctggcaatgataatctccggctcgatcggcgcgttcgtgctgctctctggtttgccggtgactgatgtggtgttctggcgctgcctgattggcgcgctaaccctgctggtgtttatcgtgttaagccgccagcccttcagccggctaacgcgtttcactctcgctctggcggtgattggcggcgcggcgctggtcgtcaactggctgctgctgtttgccgcctattcgcggatctcaatcggtatggccaccgtggtctataacacccagccgtttatgctggtactgatggggatggtgctgggggaacgggtcagcgccgtgaaatggggatggttactgctggcctttggcggcgtagtgatcctgctgtcgagcgagctgacgcctgcacacgaagaggggcttaccaccggcgtgttgctggcgctgggcgcggcattcttctatgccctgaccgccatcatcgcgcgcaaactgcatccgctccccgcgcagcatatcgccttcattcaggttctcgtcggcgtcgtgatgctgctgccgctggtgcataccccagaattgacggccagcttcccctggcgctatctgctgatcctcggcatcgtccataccgggatcatgtatcagcttttatatagcgcgatacagaaactgccgacgcccgttaccggttcgctctcctttatttatccgctggtggcgatggtggtcgactatctggtcttccaccatgcgttatccgcggtgcaattgctcggtgggatgcttattctgtttgccgccgcagggaataatctcggctggggcgaaaaaaaaccccgccgcggcggggtcagtgagcagtcgcgggccagttag

SEQ ID NO: 3155 - DNA, 657 bp, Klebsiella pneumoniae
ccagaattttgtcaagcgcgcccgcagacagtacactacgcggcagagaatgccccatgcaggatagaaaacgtgaccattaaactgattgtcggcctggccaaccccggtgcggaatatgccgctacccggcacaacgctggcgcctggtatgtggatttactggcggatcgccatcgtgcgccgctgcgcgaagagagcaaattcttcggctacacctcgcgcatcaacctggcgggcgaggacgtccgcctgctggtccccactacctttatgaacctcagcggtaaagccgtggccgcgatggcgaccttttatcgcatcaaccctgatgaaattctggtcgcccatgacgagctggatttaccgccgggcgtggcgaaatttaagcttggcggtggccatggcggccacaatggcctgaaggatatcatcagtaagctcggcaataacccgaactttcaccgtttacgcgtcggaatcggccatccgggcgacaaaaacaaggttgtcggctttgtgcttggcaaaccaccggccagcgagcagaaactgatcgatgacgctgtcgacgaagcggcgcgctgtaccgaaatctggttaaaggacgggctgaccaaagcgaccaaccgtttgcacgcctttaaggcgcaataa

SEQ ID NO: 3156 - DNA, 366 bp, Klebsiella pneumoniae
gaaggagtttgtatgcaacgtattgtgatcatcgccaacggcgccgcctacggcagcgaatccctgttcaacagcctgcgcctggccattgccctgcgcgagcagcagtccgacctcgatctcaagctgtttctgatgtccgacgccgtcaccgccgggctgcgggggcagaagccggcagaagggtataatgtgcagcagatgctggagatcctcaccgcccagcaggttcccgtgaagctgtgtaaaacctgcgcggacggccgcggggtcagcgcactgccgctggtggacggcgtggaggttggcactctcgttgagctggcccagtggaccctggcggcagataaagtgctgaccttctga

SEQ ID NO: 3157 - DNA, 777 bp, Klebsiella pneumoniae
tggcgcttctgcacgtctggctcggatctcatcttgacgtgcggctgcagctttgcgtcgcccgccatttactgccggatgcgcaactttgctgccagcaggagcatgccgtccagctcggccgtaccgctgtgctgcgtccgctggatgcgcagaagcaggctgacgacagagtcacgatttatctggggcgctatcagcgcgtccgggaaaatatccaccgcagggagagcgatgaagatggcgattaccgcagttaaaccctccgccaggttgctggcattcctcatggttaccgtcttaaccggctgcggcctgacgcagaccgtgaaagacggcgccgtttccgtgacccagtccattttttacccccaggtgaaaaccctgcatctggatcttcgcgcccgggaaggcgtgaataacaacgccaaaggcgcctccctggcgacggtggtgcgtatttatcagctgaaggaccggcaagcgttcgacaatactgactacccgtcgctgtttgccggcgatggccaggcgctgcagacggaccgggtggcggaaaaagatgttcgcctgcgtccgggcgaatcggtgaccgtcgatatgcccatggaaaccagcgcgcagtttgtggcggtggcggccatgtttatcgatccagacctgacgcaaaacagctggcggctggtactcacccgggacgaacttgatccggcgaggccgcgcattatcgaagccagccaaaatcaactgacgctgcacccgtttaaggagaagtga

SEQ ID NO: 3158 - DNA, 192 bp, Klebsiella pneumoniae
ataattccctgccgacgcccggctgatcttgtgacaacctctctggctctggcaggccggctctcgcttattaccttaaaaaaagggaggctattcgcctcccgccatgcggcttatattaccgcggtggttagtcgtgatgaacaacataaccgcgactgttcgtcgaagatttcaatttgccagacctga

SEQ ID NO: 3159 - DNA, 1032 bp, Klebsiella pneumoniae
atacaccgactggatcgaatggcgccatcccgcacattattggcccattcatccaccactggacgcatgcctgaggttcttctcgtgcctgatatgaagctttttgctggtaacgccaccccggaactagcacaacgtattgccaaccgcctgtacacttctcttggcgacgccgctgtaggtcgttttagcgacggcgaagtcagcgtacaaatcaatgaaaacgtacgcggtggtgatattttcatcatccagtccacttgtgctcccaccaatgacaacctgatggaactggttgttatggttgatgctctgcgtcgtgcttcggcaggtcgtatcaccgccgttatcccttacttcggttatgctcgtcaggaccgtcgtgttcgttctgctcgtgtgccaatcaccgcgaaagtggtggcggattttctgtccagcgtcggcgttgaccgcgtgctgaccgttgacctgcacgcagaacagatccagggcttcttcgatgtgccagtcgataacgtgttcggcagcccaatcctgctggaagatatgctgcagctgaacctggacaacccgattgtggtttctccggacatcggcggcgtcgtgcgtgcccgcgctatcgctaaactgctgaatgataccgatatggctatcatcgacaagcgccgtccgcgcgccaacgtctcccaggtgatgcacatcatcggcgacgttgccggtcgtgactgcgtgatggtcgacgatatgatcgacaccggcggcaccctgtgtaaagcggcagaagcgctgaaagagcgtggcgcgaaacgcgtattcgcttacgcgacgcacccaatcttctccggcaacgctatccagaacatcaagaactctgtcattgatgaatttgtcgtctgcgataccattccgctggcaccagaaattaaagcgctggataaagtgcgtactctgacgctctccggtatgctggctgaagctattcgccgtatcagcaatgaagaatctatctctgctatgttcgaacattaa

SEQ ID NO: 3160 - DNA, 282 bp, Klebsiella pneumoniae
ccagccgactgcgtaccagacttaaacttaatgctcaaacaggaggtcagtatgccctatcgcagtaaacaagaactccccgacagcgttcagcatgtactgcctgcccatgcgcaggaaatttataaagaagcgtttaacagcgcctgggatcaatataaagataaagacgagcggcgcgatgacgccagccgcgaagagacggcgcacaaagtcgcctgggcggcggtgaagaacagctatgagaaaggcgatgatgataagtggcataagaaaaaataa

SEQ ID NO: 3161 - DNA, 297 bp, Klebsiella pneumoniae
aaaatggactgggtcacggaaacggcgccgtctttcacggtctgcgtcaggccgcagccggttaagacggtaaccatgaggaatgccagcaacctggcggagggtttaactgcggtaatcgccatcttcatcgctctccctgcggtggatattttcccggacgcgctgatagcgccccagataaatcgtgactctgtcgtcagcctgcttctgcgcatccagcggacgcagcacagcggtacggccgagctggacggcatgctcctgctggcagcaaagttgcgcatccggcagtaa

SEQ ID NO: 3162 - DNA, 663 bp, Klebsiella pneumoniae
tcgcgccgctggcaggtaaagatcctcagcgccaacgaaggtgagcacggcggctttaaagaggtgatcgccaagatcagcggcgacggcgtctatggtcggctcaaatttgaatccggcggccatcgcgtgcagcgtgtgccggccaccgaatcgcaggggcggatccacacctccgcctgtacggtggcggtgatgccggagctgccggaagccgaaatgccggacattaacccggcggatctgcgcatcgataccttccgttcctccggggcaggcggtcagcacgttaacaccaccgactcggctatccgcattacccacctgcccaccggcatcgtggtggagtgccaggacgagcgttctcagcataaaaacaaagccaaggcgctgtcggtgctgggggcgcgcatccgcgccgccgaagtggccaaacgtcagcaggcggaagcctccacgcgccgcaacctgctgggcagcggcgaccgcagcgaccgcaatcgcacctataacttcccgcagggccgcgtgaccgaccaccgcatcaacctgacgctctaccgtctggatgaggcgatggagggcaaactcgacatgctgattgagccgattgtccaggaacatcaggccgatcagctggcggcgctgtccgagcaggaatga

SEQ ID NO: 3163 - DNA, 1161 bp, Klebsiella pneumoniae
aaaatgggctgggtacgaacaaaagcattgaccatggagcagccatcggctccttcactgacccgatggctgtttgccggtgtactgatggcgattatcggtgtcctgctctttatcctccatgcctccggcaccgtaaaaattatctcagtgataaatatctggtgggtatccctgatgcctgcaggatgctggttgctgattttttgcctgcgttgctacctgtgggacagggatctgaaagcgcatcagttcttgctgaaagaggcggaatacggacagcagaggtgggaagactgggccgggcgctggctggccgttccgagcagtgcagtgctgttgccggatcatatttctgcggcgcattgggggagtgagcggcctcagcaatacggacttgcccgcaggattaattaccttccggcagaagagcccgtgcagttgagtgcgatgcatgcgctgctgaccagtatagaagagcgcgtgcagtgcctgccggaagagctaccgctgtatgtcaccctgatcacggataatccctcgcctgagctgaccagcagtttcagtaatctctggaaagaacacattcctggccgcgccgtgcctgatgatattaccgttaccggctcattctcactgtcggaagtggaggagcgcctgaagcagcctgtactgacggtcaatttactcctggtcatccagctcaacggtggtacagcatactccgacgggctggccgtgctgctgctgaccagcgatgatgtggcgcaaaaataccatctgccgcactcatcacggctgttacgtcctatgcccttagatatgacgaactttgaagacgatatcaccctgtttctggaaacccagactgtcgcctgccatacgccctccgttatcggggacgcaaaaaaatggacggaaagaagcgccgcgcttatcacgcagggcggcaaaatgcataccccatggaaagctgaagatatcgcgctgctggaaaaatggtgcggtattccgggacccgcagcgccctggctcctgaccgcgctggcagccgatctggtcagcctccgtaaacagcccctgctggcgttattttccagcgaacaggaacattttatcagtaccatcaccccagggagtgaagatgaatataccgggtaa

SEQ ID NO: 3164 - DNA, 195 bp, Klebsiella pneumoniae
tgtgcgggatggcgccattcgatccagtcggtgtatttaaagagcacgatgcaacgtctggaacagggtgacgttgtcaccgtaactcaatttccccggctgactcattatcaatgtgccatcacggcgcaggattcagagcagggcctgcttgagcggcgaaaggttaactccgcgcgccacaaagccatttag

SEQ ID NO: 3165 - DNA, 591 bp, Klebsiella pneumoniae
ctacgggatcgccgtgcgcaccggacaccactgcgcgatgccgttgatggcccggtatcaggtaccggctatgtgtcgggcatcgctggcgatgtacaataccacggaagaggtggaccgcctggtggccggcctccagcggatccgcaaactgttagggtaaaggacgggacaatggcggcactaccggacaaagacaaactgttgcgtaactttagccgttgcgccaactgggaagagaagtatctctatatcatcgagcttggccagcgtctggcgccgctaagcccggaagaacatagcgtgcagaacattattcagggttgtcaaagccaggtctggatcgtgatggaccaggatcccacaggcgtgatcaccctgcgcggcgatagcgatgcggcgatcgtcaagggtctgatagcggtggtgtttatcctctatgaccggatgaccgctcaggacatcaccgagttcgacgtgcgtccgtggtttgaaaaaatggcgctcacccagcatctcaccccctcccgctcgcaaggcctcgaagccatgatccgcgcgatacgcgcgaaagcggcaaatattagctag

SEQ ID NO: 3166 - DNA, 252 bp, Klebsiella pneumoniae
atcttcttttttcctcgcgaatgtggaggtcagatgagagcgagtgtcattgcgttcgggagcctcttaattcagcagtacgctcataatcagcagtacggccatgcacatcgacataatactgatatcaacaatcattctgtacgacaaaagctccagctaaacgggtacggcgggcaggtaaaagcccatcttatagtggttaaagagtgtaccctgcctacttccattgaacaaacgtttattgactaa

SEQ ID NO: 3167 - DNA, 4230 bp, Klebsiella pneumoniae
ccaacggtccggcggcaacggtcggcgagatcctcgcggtcgatctgccgcgtccgcgccaccgcgttcagctggcggacgacagccggtatcaccatctgcgccagcagatcctccatttcctgtatgaaaaacagccgaaagcggcgtaaggaggcggtcatgacgcggcgactggtggtgatcggtaacggcatggcggccacccggctggtgcagcggctggttgagcgcgaccccgcgcggtttgccattaccgtcgtcggcgacgagccgcacccggcctataaccgcattcagctctcgccgctgctggctggtgaaaaaacggcggcgcagatcccgttgctgccggcggagtggtatacccggcacggggtgtgcctgcggtctggcgaggcggtcgatgaagtcgatattcagcaacggcggctgcgcatcgcggaaacctggctgccgtgggatgagctggtgttcgccaccggttcgcggccctttatcccgccgctgccgggcattgatcgtccgcaggttatgcccttccgcaccctggcggacgtggaacgtattctggcgataccaggcccggcggtggtgattggcggcggcgtgctgggggtggaagcggcggcggcgctgcgtcgtcacggcggagaggtcactcttctgcatcgcggcagcggattaatggcgccgctgaccgacgcttttgccgccgatgagctcagacagcagcttgaagcgcgcggcattcgctgcgtgctggcgtgccgcatcgccgccatcgacgccgatggcgtgcggctggcggacgggcgcgtattccgcgccgccagagtggtgctggctaccggcgtgcagcccgacagccgtctggcggcgcagtccggcgtgctgtgccagcgggggatcgtggtcgaccgtcagatggccgcctcgctgccggggatcagcgccatcggcgaatgttgcgaaattgacggccagacctggggattggtggctccctgcctgcgtcaggccgaggtgctggcggatcgcctgtgcggcgcccccggcgagggctttgtctggcaggacgccgggacccgcctgaaggtcaccggcattgaactctttagcgctggcgagcagcaggccggcgaacaggatgacatttataccagctgggaccccatcgaccgccactatcgccgcctgctgctgcgcgatggccgcctgcgcggcgtgctgctgatgggcgactgcaccgccgccgccgcgctcaccgcgcgcctggaaagcgatgagcctgtcaccgtggactggctttttgacccctcttcaacgcagccgcaggctgcaggaatgatgacaatgacgaaacctgtattagtgctggtgggacatggcatggtcggccaccattttctcgaacaatgcgtgagccgcaatctgcatcagcaatatcgaatcgtggtgtttggcgaagagcgttaccccgcctacgaccgggtacatctctccgagtattttgccggacgcagcgccgagtcgctgtcgctggcggccggggatttctttattgaacacggtattgaactccgcctcggcgaggcggtggcgaccatcgaccgcgacgcacggctggtacgggacgccgaggggcatgaaatccactgggataaactggtgctggcgaccggctcgtatccctttgttccgccaatccccggtaacgatctcgcggggtgctttgtctaccgcactcttgacgatctcgaccgtatcgccgcccatgccgccgcggcgaagagcggggtggttatcggcggcgggctgctcgggcttgaggcggccaacgccctgaaacagctggggctggagacgcaggtggtggagtttgccccgaacctgatggccgtccagctggataacggcggggcggcgatgctccgggagaagatcgtcgccctcggcgtgggggtgcataccagcaaagcgaccaccgccatcgtgcgcgaggccgacggcctgcggctgaactttgccgacggcggcgcgttgcggaccgacatggtggtcttctcggcggggatccgcccgcaggacgcgctggcccgcggctgcgcgctgcaggtgggcgaacgcgggggaattcacatcgacggccagtgccgtacctctgacccggacgtgctggcgataggcgaatgcgccctgtgggacaataaaatttacggtctggtggcgccgggctatcagatggcgcgcatcgccgcggccactctcgcaggagaggacgcctgctttagcggcgccgacatgagcaccaaactgaagctgctgggggtcgacgtggcctcgtttggcgatgcgcaggggcgcacgccgggctgtcagagctatcaatggaccgacggtccgcagcagatttacaaaaaaatcgtcgtcagtcaggacggcaaagccttgcttggcggcgtgctggtgggggatgccagcgactatgccacgctgctgcagatgatgctgaacggcatggcgctgccgccgcgtccggagagtctgatcctgcccgcgctggagggagccgcgccgaaggcgctcggcgtcgcggcgctgccggacagcgcgccgatctgctcctgccataacgtcagcaaaggcgatatctgccaggcggtgaacaatggggcgggggatatgtcggcgataaaaagctgcaccagagcggctaccggctgcggcggctgcagcgcgctggtgaaacaggtgatggagtatcagctggcggagcagggcgtcgaagtgaaaaaagacgtctgcgaacatttcccgtggtcgcgccaggagatctaccacctggtacgggttaaccatatccataccttcgagcagttgattagccgctacggccaggggcacggctgcgatgtctgcaaaccgctggtggcctcggtgctggcctcctgctggaacgagtacctgctgaagccggcgcacctgccgctgcaggataccaacgaccgctatttcgccaatatccagaaggacgggagctattcggtggtgccgcggatggcggcaggggaagtgacgccggacggactgatcgccatcgggcagatcgccaaacgttaccagctctacagcaaagtgaccggcggccagcgcatcgacctgtttggcgcgcggctggaacagctgccggctatctggcgcgagctggccgacgccgggtttgaaaccggccacgcctacggcaagtcgctgcgcacggtgaaatcctgcgtcggctcaacctggtgtcgctacggcgtgcaagactccaccgggctcgcggtacggctcgagcatcgctataaagggctacgcgccccgcacaaaatcaagatggcggtctccggctgcacccgcgaatgcgctgaagcccaggggaaagatatcggggtgattgccaccgacaaaggctggaatctgtacgtctgcggcaacggcgggatgaaaccgcgtcacgccgacctgtttgccagcgatctcgacgaagcgacgctgatccgcagcatcgatcgtctgctgatgttctatatccgtaccgccgatcgcctgcagcgaaccagcacctggatggataacctggagggcggcgtcgcctatctgcggcaggtggtgctggaggatagtcttggcattggcgaggagctggagcaggagatggcccggatcgtcgacagctaccagtgcgagtggcagaccaccctcaacgatccgcagcgtctggcgctgttccgctccttcgttaatagcgaccagcccgacgaggctgtgcagcgccgcgatctgcgcggtcagccgcagccgctgctgactgagacgttgcccgaaggcgaactcccatcccgaccgtggcaggcggtatgcgatcttgacgccattccggcgcaggcggggatcggcgcccgcttaggggagcggcagattgccctgttccgcttcggcgagcgggtctacgccctcgacaaccgcgagccgggcagcacggccaacgtgctgtcgcgtgggctgttaggggacgtcggcggcgagccggtggtgatctccccgctgtacaaacagcggatacgcctgcgcgacggctggccgtgcgacggcagtgaacaggcggtacgcgcctggccggtgaaagtagaaaacggcaaagtgtgggtgggcaaccagcagctgctggcccgcgcggaggcctcctga

SEQ ID NO: 3168 - DNA, 420 bp, Klebsiella pneumoniae
aaccgggcccgtgtttgggccggccaagcgctgtttccgggcatgttgccgcgggcccaggtatccaacggccatcagtttggcgcctgggcggccaaattgggcgacggacgcgggatcctgttcggcgagcagcagctgccggatggcccgccgttacgactggcatctgaaaggcgccggcctgactccttattcgcggatggggaacggccgcgccgtgctgcgctcgccgatccgggaaagtctggcgtcggaggcgatgcatgctctggggatcccgacgacgcgcgccctggcgatggtgaccagcgataccccggtctaccgcgagcgcgtggagcccggcgcgatgctgatgcgggtggccgagagccatgtccgcttcggccatttcgaacatttttactatcgccgtga

SEQ ID NO: 3169 - DNA, 690 bp, Klebsiella pneumoniae
acacattaccgtggtcggaggattaattatgagcgcgctgtttgcaggctatcggcgatgagcgaaacccctcgtcagaaaggtcggccaaaagatccattgaaaacgcaggcgatacttcaggcagcccgtaagctgtttctggaacagggcctggaggtgacaacggccgaaatcgcccgcgtagccggggtggcgaaagccaccctgtatgccaatttcagcgataaagaacatctgatagaggcggtcttacgccaggaatcggatctcaccatcagcgaccatgatttcgcccagcgccatcatctgccgctgatcgaggtgctgacggcgtttggctatcgctttgtccgctttatcaaccagcgggaactgaccggctgggaccgactgatcgcctcggctgccgtgcgtcaccccgatctccccggccgcttttacgccgccgggccggggcgcgcgcagcagatgctggaagcgatcatcgccgaggcgatcgaagccggtactttacgagcctgcgatccgcaggaggctgccgacgaactggccggtttatggttgggaatgaccagcctggcgataaaacttggcgcaagacctccgctgtccgacgacgaaatcaaacagcgggttgagcgcgccctggacgtctttctgcgcgcgtattccctgacgccgggctga

SEQ ID NO: 3170 - DNA, 2481 bp, Klebsiella pneumoniae
acgattcaccgtttttttcagcttcataaatatgtcaggataatcctgcagtcgatcgtgaaatttttttcactggtattaaatcacaaaaggattgtctcgatgtccaacaatggctcgtcaccgctggtgctttggtataaccaactcggcatgaatgatgtagacagagttgggggcaaaaatgcctcccttggtgaaatgattacgaatctgtccggtatgggtgtttccgtacctaacgggtttgccaccaccgctgatgctttcaatcagttcctggaccaaagcggtgttaaccagcgcatctatgcgctgctggatgaaaccgacattgacgacgtttccgcattagcgaaagcgggcgcgcagatccgacagtggatcatcgatacccccttccagagcgaactggaaaacgcgattcgcgatgcttatgacctgctgtccgccgatgacgccgaggcctcattcgccgtgcgctcttccgccaccgcggaagatatgccggacgcctccttcgccgggcagcaagagacattcctcaacgtgcagggctttgacgccgtgctcgttgccgtgaagcacgtgtttgcttcgctgtttaacgatcgcgcaatctcctaccgcgtgcatcagggttacgatcaccgcggcgtggcgctctccgccggggtgcagaggatggtccgctccgatctggcctcctccggcgtcatgttctccatcgataccgaatccggctttgaccaggtggtgtttatcacctcggcgtggggtttgggcgagatggtggtgcagggcgcggtgaacccggacgaattctacgtccacaaaccgacgctggccgctggccgtccggcgatcgtgcgccgcaccatggggtcgaaaaagatccgtatggtttacgcgccgacccaggagcacggtaaacaggtgcgtatcgaagatgtgccgcaggcgcagcgcgatattttctcgttaagcaacgaggaggtgcaggagctggcgaagcaggcggtgcagatcgagaagcactacggccgtccgatggatatcgagtgggcgaaagatggccacaccggtaagctatttatcgtccaggcgcgtcctgaaaccgtgcgttcccgcggccaggtgatggagcgttataccctccacgctcaggggcagatcatcgccgaggggcgcgccatcggccaccgtattggcgccggtccggtcaaggtgatccacgatatcagcgagatgaatcgcattgagccaggcgacgtactggttaccgacatgaccgacccggactgggaaccgatcatgaaaaaagcctcggcgattgtcaccaaccgcggcgggcgtacctgtcacgcggcgattatcgcccgtgagctggggatcccggcggtggtcggctgcggtgatgctaccgatcgcattcaggaaaatcagaatgtcaccgtctcctgcgccgaaggcgacaccggctatgtctacgccgagctgctcgacttcagcgtcaagagctccagcgtcggcgacatgccggatctgccgctgaaggtgatgatgaacgtcggcaacccggatcgcgcgttcgacttcgcctgcctgccgaacgaaggcgtcggtctggcgcggctggaatttatcatcaaccgcatgattggcgttcatccgcgcgcgctgctggagtttgacgaccaggagccgggcctgcagaacgaaatccgcgagctgatgaaaggctacgattcgccgagagagttctacgttggccgcctgaccgaagggatcgccaccctcggcgccgctttctatccgaaacgggtgatcgtgcgtctgtcggacttcaaatcgaacgaatacgccaacctggtgggcggcgagcgctatgagccggaagaagagaacccgatgctcggcttccgcggcgccggacgctacgtttccgaaagcttccgcgactgcttcgcccttgagtgcgaagcgatgaagcgcgtacgtaacgatatgggactgaccaacgttgaagtgatggtcccgttcgtccgtaccgtcgcccaggcgaaagcggtggtcgaagagctggagcgtcaggggctgaagcgcggcgagaacgggctgaagatcattatgatgtgcgagatcccgtcgaacgccttgctggcggagcagttcctcgagtacttcgacggcttctccatcggttcgaacgacatgacccagctggcgctcggtctggatcgcgattccggtgtggtttctgagctgtttgatgaacgcaacgacgcggtgaaagccctgctgtcgatggccatccgcgcggcgaagaaacagggtaaatacgtcggcatctgcggccaggggccgtctgaccatgaggatttcgccgcctggctgatggaagaggggattgatagcttgtccctgaacccggataccgtggtacaaacctggttaggtctggcggaactgaaaaaataa

SEQ ID NO: 3171 - DNA, 1041 bp, Klebsiella pneumoniae
ccctgccgccgttcagtctcctggcgttttatcagcgaaagaaggaatctcagtatgaaacgcaaaacgatgatcaccttagcccttctcagcgcccttggcgcctcctcggccgcctgggccgttgattatccgcttcctcccgccaacagtcggctgattggtcagaatcagtactggacggtccaggagggagatcgcaacctgcaggcgattgcgcgccatttcgataccgcggcgatgctgatcctcgaagccaacgatacgattgcgccggtgcagccgaagcccggcactcaggtccttatcccttctcagatgctgctgcccgacgtgccgagggagggcattgtcgtcaacctcgccgaactgcggctgtattacttcccgccgggagagaatcaggtgcaggtctatccgctgggcattggccagttaggtctggaaacgccggagatgaccacccgcgtggggcagaagatccctaaccctacctggacgcctaccgccggcatccgcgcgcgctcgctggagaaaggggtgacgctgccagcggtggtcccggccggaccgaacaatcccctgggccgctatgcgctgcgtctggcctacggtaacggtgaatatctcatccacggaactaacgccccagacagcgttggtctgcgcgtcagctcgggctgtatgcggatgaacgctgatgacatcaaagcgctgttcagccaggtgaaaaccgggacgccggtacggattatcaatcagccggtgaagtttgccgtcgagccggatggtaaacgctatgtcgaagtccacaggccgctttcgcagaccgaaggggaaaacacccggaccatcgcttacacgctgccagcggcgtttcacgccttcgcagaggataaagcagtggatgacctgcagttgaaaaaagcgatgtcgagaagggcggggtatccggtggtggtgtcggcgggggcaggtagcacggcgacgtcgctgtcggcgcagaatagttcgtctgacaacggtctgcttacccaatag

SEQ ID NO: 3172 - DNA, 963 bp, Klebsiella pneumoniae
cgtgctgtacgccgttatcgatccgaagattcgctactgaagccggagttcgccatgatgttaagtaagaaaaatagcgaggcgctggaaaacttcagtgagaagctggaagtggaggggcgtagcctctggcaggatgcgcgtcgtcgctttatgcataaccgcgccgcggtgaccagcctgattatgctggtgcttattgcgctgttcgttaccttcgcgccgatggtgtcgtcgttctcctacttcgataccgactggggcatgatgtccaatgccccggatatggcctccggccactacttcggaaccgactcctccgggcgcgatctgctggtgcgcgtagcgatcggcgggcgcatttcgctgatggtcggggtggcggcggcgctggtggcggtgatcctcggcacgctgtacggttcgctctccggttatctcggcggcaaagtggattcggtgatgatgcgtctgctggagatcctcaactccttcccgtttatgttcttcgtcatcctgctggtgaccttttttggtcagaatatcctgctgatctttgtcgccatcggcatggtgtcctggctggatatggcgcgtatcgtgcgcgggcagacgctaagcctgaagcgcaaagagtttatcgaagccgcgcaggtcggcggggtctcgacggcgagcatcgttctgcgccatatcgtccccaacgtgctgggggtggtggtggtgtatgcctcgctgctggtccccagcatgatcctcttcgaatccttcctcagtttcctgggactggggacgcaggagccgctcagcagctggggggcattgctcagcgatggcgccaactcaatggaagtttcgccctggctactgttgttcccggcgggtttcctggtggtgaccctgttctgtttcaactttatcggcgatggtctgcgtgatgccctcgacccgaaagaccgctaa

SEQ ID NO: 3173 - DNA, 279 bp, Klebsiella pneumoniae
cacatgaaacgcaaaaacgcttcgttactcggtaacgtactcatggggttagggttggtggtgatggttgtgggggtaggttactccattctgaaccagcttccgcagcttaacctgccacaattctttgcgcatggcgcaatcctaagcatcttcgttggcgcagtgctctggctggccggtgcccgtattggcggccacgagcaggtcagcgaccgctactggtgggtgcgccactacgataaacgctgccgtcgtaaccagcatcgtcacagctaa

SEQ ID NO: 3174 - DNA, 192 bp, Klebsiella pneumoniae
tgcgccccgcttcccgagaaggaagcaggccagtaccaagcattaccccgtggtggggttcccgagcggccaaagggagcagactgtaaatctgccgtcatcgacttcgaaggttcgaatccttcccccaccaccattattcactacagtgatatggtttccccgacaagcgtaaacgatgtttgcacttag

SEQ ID NO: 3175 - DNA, 1101 bp, Klebsiella pneumoniae
aagaagaaacggaaaacagcgccagaaagcctcccctgtggaggcttttttcgtatatggattcggaatattaatttcactataaccggtgtctgcaccgacataatgaggaaaaccatgtcacatctcgcagagctggttgccagtgccaaggcagccattaacgaggcatcagatgttgctgcgctggacaacgtccgcgtggaatacctgggtaaaaaagggcatctgaccctgcaaatgaccaccctgcgtgagctgccgccggaagagcgtccggcagccggtgcggtcatcaacgaggcgaaagagcaggtgcagcaggcgctgaacgcgcgtaaagctgaactggaaggcgcagcgctgaatgcgcgtctggccgcagagaccattgacgtctcgctgccgggtcgccgcattgaaaacggcggcctgcatccggttactcgcaccatcgaccgtattgaaagtttcttcggtgagctcggctttaccgtggcgacgggcccggaaatcgaagacgattaccacaacttcgatgcgctgaatattccgggtcaccatccggcgcgcgctgaccacgacactttctggttcgatgccactcgcctgctgcgtacgcagacctccggcgtgcagatccgcaccatggaaaaccagcagccgcctatccgtattatcgcgccgggccgcgtctatcgtaacgactacgatcagacccacaccccgatgttccatcagatggaaggtctgatcgttgataaaaatatcagcttcaccaacctgaaagggacgctgcacgacttcctgaacaacttctttgaagaagatctgcaggtccgcttccgtccgtcctacttcccgttcaccgaaccgtctgcggaagttgacgtgatgggtaaaaacggcaaatggctggaagtgctgggctgcgggatggtgcacccgaacgtgctgcgtaacgtgggtatcgatccggaagtctactccggcttcgccttcggcatgggcatggagcgtctgaccatgctgcgctatggcgtcaccgatctgcgcgcgttcttcgaaaacgatctgcgtttcctcaaacagtttaaataa

SEQ ID NO: 3176 - DNA, 1581 bp, Klebsiella pneumoniae
ctggttagacggcgaaggcaacgaccaggtacaggagagcgtaaaatgaaaattcgttcacaagtcggcatggtgctgaatctcgataagtgcatcggctgccacacctgctcggtgacctgtaaaaacgtctggaccagccgggaagggatggaatacgcctggttcaacaacgtggaaagtaagccgggcgtcggtttcccgaacgactgggaaaaccaggaaaaatggaagggcggctggatccgcaaaatcaacggtaaactgcagccgcgcatgggcaatcgcgcgatgctgttgggtaaaatcttcgccaacccgcatctgccgggcatcgatgattactacgagccgtttgattatgactaccagaatctgcataacgcgccggagagcaaacatcagccgatcgcccgtccgcgctcgctgatcaccggccagcggatggacaagatcaccagcggtccgaactgggaagagatcctcggcggcgagtttgaaaaacgcgccaaagatcagaacttcgacaacatgcagaaggcgatgtacggccagttcgaaaacaccttcatgatgtatctgccgcgcctgtgcgagcactgcctgaacccggcctgcgtcgcgacctgcccgagcggcgccatctataagcgtgaagaagacggcatcgtactgatcgaccaggacaagtgccgcggctggcggatgtgtatcaccggctgtccgtacaagaagatctatttcaactggaagagcgggaaatccgagaaatgcatcttctgctacccgcgtattgaatccgggatgccgacggtgtgctccgaaacctgcgtgggtcgcatccgctatctcggcgtcctgctatacgacgcggacgcgattgaaaacgccgccagcaccgagaacgagaaagatctgtatcagcgtcagctggacgtgttcctcgatcccaacgatccaaaagtgatcgagcaggcgctgaaagatggcgtaccgcagggggtcattgaagctgcgcagcagtcgccggtttacaaaatggcgatggactggaagctggccctgccgctgcacccggaatatcgcaccttgccaatggtctggtacgtgccgccgctgtcgccgattcagtccgccgccgatgcgggtgaactgggtagcaacgggatcctgccggacgtggaaagcctgcgtattccggtgcaatatctggcgaacctgctgaccgcgggcgatacccagccggtactgctggcgctgaaacgaatgctggcgatgcgccactataagcgtgcggaaaccgttgacggcgtcgtcgatacccgcgcgctggaagaggtggggctgagcgaagcgcaggcccaggaaatgtatcgctatctggcgatcgccaactacgaagatcgtttcgtggtgccgagcagccatcgtgaacaggcgcgagaagcgtttccggagaaaaacggctgcggctttagctttggcgatggctgccacggctctgacagtcagttcaacctgttcaacagccgtcgcatcgacgccatcgacgtgaccagcaaaacggagccgcacgcatga

SEQ ID NO: 3177 - DNA, 204 bp, Klebsiella pneumoniae
atcactggacgatttcctgatctaatctccgttgatcgctataaaaaatcccgctgcggcgggattttttttgccctcagggccgatataaaaaaaccgggagtcgcagatgcgctcccggtttgtgctttcaaccgcgcggcggattacttcgctaccgccgtttccagccaggctttaaaatcgtcgcccagcgttttgtga

SEQ ID NO: 3178 - DNA, 963 bp, Klebsiella pneumoniae
tggacgggacggtctggaacgggtccgacccggaaggctacgcccgtcatttctctattcaacgtaagggggcatgagatgaagcaggcacaacgtaagcaaccggtcgtcagcgtggacaacgcgcctggcgaagtgattatcctgccgccggtgcaggtccggcgcaccacgccgaccgtcacgcgctggctgcgtgagctcacccagcgcctgctgcccccgctgttggggctgggtgtgctgctgctggcctggcagctggcggcgatgcatagcaaaggctttcccacgccgctgagcacgctggactcggcgctgaccctgtttgccgatccgttctatcaggacgggcccaatgacatgggcatcggctggaacgtgctggcctccctgcagcgcgtggcggtgggattcggcctggcggcgctggcgggcattccgctggggtttttgatcggccgttcgctgttcttcgcccgcatgtttaatccgctgattgctctgctgcgcccggtcagcccgctggcctggctgccgattggcctgctgctgttccagaaggcggagccggcttccagctggaccatttttatctgctccatctggccgatggtgatcaacaccgcggagggtgtgcggcggatcccgcaggactatctcaacgtcgcccgcgtcctccagctctcggagtggacggtgatgcgcaaaatcctctttccggcggtgctgccggcggtgcttaccggcgtgcgcctctccatcggcatcgcctggctggtgatcgtggcggcggaaatgcttaccggcgggctggggatcggcttctggatctggaacgagtggaacaacctcaatgtggaaaacatcatcatcgccatcgtcattatcggcgtcgtcggcctgctgctggagcagggcctgatgctgctcgctcgccgctttagctggcaggaaaaataa

SEQ ID NO: 3179 - DNA, 1530 bp, Klebsiella pneumoniae
gtgcggctgcggcgaaagttttggggtgcaggcggagtaactatgtcgcgtaatactgaagcaactgacgatgtcaaaacttggaccggcggcccgctcaactacaaagagggcttttttactcgcctgcaaaccgatgagctggccaaaggcattaatgaagaagtcgttcgggctatctcggctcgccgcaatgagccgcagtggatgttggagtttcgtctgaatgcctaccgggcgtggctggaaatggaggagccgcactggctgaaagcgcattacgataagctgaattatcaggattacagctactattccgcgccctcctgcggcaactgcgatgagacctgcgcctccgagcctggcgcggtgcagcagaccggggccaatacctttctgaccagcgaggtggaagaagcctttaaccagctgggcgtgccggtacgcgaagggcgcgaggtggcggtggacgcgatatttgactcggtgtcggtggcgaccacctaccgagaaaagctggccgagcaggggatcatcttctgttctttcggcgaggcgatccacgaccatccggaactggtgaaaaagtatctgggcaccgtagtgccggggaatgacaacttctttgccgcgctgaacgccgcagtggcttcggacggcacctttatctatgtgccgaagggcgtccgctgcccgatggagctgtcgacctatttccgcatcaacgccgaaaagaccgggcagtttgaacgcaccattctggtggccgatgaaggcagctacgtcagctatattgaaggctgctcggcgccggtgcgcgacagctatcagctgcatgccgcggtcgttgaagtcatcatccataaagacgcggaagtgaaatactccacggtgcagaactggttccccggcgataacaacaccggcgggatcctcaacttcgtcaccaagcgcgccctgtgcgaaggggagaacagcaaaatgtcatggacccagtcggaaaccggctcggccatcacctggaaataccccagctgcatcctgcgcggcgataactcgatcggcgaattcttttcggtggcgctgaccagcggccatcagcaggcggacaccggcaccaaaatgatccatatcggcaagaacacccgctcgaccatcatctcgaaagggatctccgccggacacagccagaacagctatcgcgggctggtcaaaatcatgccgaccgccaccaacgcccgcaactatacccagtgcgattcgatgctgatcggcccggactgcggggcgcataccttcccgtatgttgaatgccgcaacaacagcgcccagctggagcacgaggcgaccacctcgcggattggcgaagatcaattgttctactgcctgcagcgcgggatcagcgaagacgatgccatctcgatgatcgtcaacggtttctgtaaagacgtcttctccgagctgccgctggagttcgctgtagaggcgcaaaaattgctggccattagccttgaacatagcgtcggctga

SEQ ID NO: 3180 - DNA, 1281 bp, Klebsiella pneumoniae
atttatcagcggtggatatatcgggttatgaacaaacgcattgtcattatcggcggcggcgtggtcggtctggccacggcctgggaactgatcaagcgcggccatcaggtgcaattactggagcgcaatgccgaaccgggcagcgccaccagttttgccaacggcggacaattaagttaccgctacgtcgccccccttgccgacagcggcgttcccctgcagggaatgaaatggatgggcaaagccgattcgccgctgaatatgcgtatcaggatgtctctccagcagtggcgctggctgctgcagtttctgcgcgcctgtaataaccagaccaataaaatgaatggcgaccatattttacgcctgtcgctgctcagccgtcaggtcatgcaggcgtggcgggatgaggataatcttgccgatttccactggcggcgcagcggaaaattaattatccatcgtcgcgaatatgattttaataaagcagcaaaagggattgatcctcagtatcagcaggcgctgaatgctgaagcctgcctgcaactggagccggcgctcaaacatattagtccttctctgcagggcggaatctattcgccaggcgatgaaacggcagattgtcatcagttctgccttgccctgctcgacaagctcaatgccagcagcgactttagcctgctgacccagtgtgaggtgcggcgactcaataagcgcgggggacgcatcagcagccttgagaccagtcaggggcccctccccggcgatgagtatgtcgtcgccgccggtaacggcagtggttctctgcttgggcatctgggggttcgcgtgccgctgtgcgccctgaaggggtacagcctgaccctgccctatcctgaaaaagcaggtattgcccctgacatcagcgtcaccgactacgggcacaaaatcgtttatgcccgccttggccaacagctgcgcatcgcggcgatggtggacatcggctacgacggcgacgaactgcgcgaaagccgcattcaggcgctgaaaaacatcgtcgcccgcagctttcctgaactggaggggctggacgaggccgaagtctggaccggcatgcgcccgtcaacgccagctggcccgccgatgctggggcgcgccggctaccccaacctgtggatgaacctcggccagggtagcctcggctttactctcgccgccggcagcgcggtggtgctgggcgcgttaatcgataatcagatgccagacatttctttagaaggtctcacatggaaacaaaccgcatga

SEQ ID NO: 3181 - DNA, 318 bp, Klebsiella pneumoniae
acgcggtggcgcggacgcggcagatcgaccgcgaggatctcgccgaccgttgccgccggaccgttggtcatcatcagcacccgatccgagagcagcaccgcttcatcaacgtcgtgggtgatcatgacgatggtggtattgagctcctgctggatatgcatcaccgtgtcctggaggtgggcgcgggtcagcgcatccagggcgccgaagggctcatcaagcagcagcactttcggcttcatcgccagcgcccgggcgatacccacccgctgcttcatgccgccggagatctccccgggacgtttgtgcagcgcatga

SEQ ID NO: 3182 - DNA, 459 bp, Klebsiella pneumoniae
aggcagcggcgttcgccacccgctgcaggcgttactggagataatcggatgatttggaaacgtcaggccacgctggagcagctcaaccggctcggtgaggggaacatggtagggctgctcgatattcgctttgagaccgttaccgacgatacgctggaggccactatgccggtcgatagccgcacacagcagccgtttggcctgctgcacggcggagcgtcggtggtgctggcggagaccctggggtcggtggcaggctatctgtgcagcgaaggcgaacaaaaggtggtggggctggaggttaacgccaaccacatccgttcggcgcgcgggggccgggtgcgcggcgtctgcaaagcgctgcacgtcgggacgcgccatcaggtctggcaaattgaaatcttcgacgaacagtcgcggttatgttgttcatcacgactaaccaccgcggtaatataa

SEQ ID NO: 3183 - DNA, 1113 bp, Klebsiella pneumoniae
cccatgctcaggctcaacgccgtccatcttgccgtctgcctcctgccgctggccctcgcgggctgcggcgaacctgccgatcatgacgacccccgcatccggccgccgctggtccgggtggcgaccgtcgagcgcgcggaggccggctcgcgggcctttaccggcgtggtagtggcccgaacccaaagcgacctcggcttcagggtggcgggaaaagtgcttgaacggcgggtggaaaccgggcagagcgtcaagcgcgatcagctgctgctgcgcctggatccggctgatctagccttgcaggcgcagtcccaacagcgggccgtagatgccgcgcgggcgcgagccaaaaaggcggccaacgatctggcccgctatcgcggcctggtggcgagcggcgccatctctgccgcggaattcgaccagattaacgcggcagcagaggcggcgagagccgacctcagcgcggcccaggcgcaggccaatgtggcgcaaaacgccaccggctatgccggactgctggcggatgctgacggcgtggtggtggaaaccctcgctgagccggggcaggtggtcagcgccgggcaggtggtgatccgcctggcgcgggcggggcagcgcgaagcgcgggtgcaactgccggagacgctgcgcccggcggtcggcagcgaggcgctggcgacacgctatggcagcgaatctcagccggtcacggcgtccctgcgcctgctttcggacgcggctgacgccaccacccgcacctttgaagcgcgctatgtactgaacggcgcgctggcgaatgccccgctggggtctaccgtgaccctgcgcatcggcaacgaccaggcgccaggccaggtgctggcggtgcccctggcgtcggtctacgatccgggtaacggccctggcgtctggcgcattgcctctcgtccggccaccgtctcctggcaaccggtaactgtgctcggcctggatgatgaaaccgcgcgggtgaccggcccgctgaagcccggcgagccgatcgtcgccctgggcgcccatcttctgcaccagggcgaggcggtgcgtctggcggaacgacgcgagcataatgccgccgggagccagccatga

SEQ ID NO: 3184 - DNA, 201 bp, Klebsiella pneumoniae
gttgttgccagcgcggaactgacggcggtgaacatcaagcctaacgcgcaaaggaccttcttcattaaacgctatccttgtaaacaggcgagtggatggccagcaaatgggagtaatgcaaatgaaactcattattggggcggggttttatacaatgccatatttacagtgtcaatgagtgactatttccgcaggcaatga

SEQ ID NO: 3185 - DNA, 402 bp, Klebsiella pneumoniae
tcagatgccagacatttctttagaaggtctcacatggaaacaaaccgcatgacaattattcgcaataatccacaacctcgtcttgccgccagcgttgcgtatggcgatctgctgttcctctccgggcagacgccaaaaagcaatgaagacgatatcgttttacaaacccgtgaagtactggagaagatcgacgcgctgctggccgcagccgggagcgataagcagcacgttctctccgcgcagatctggttgaaaaatatcgagcgtgactttgccgcattcaatgaggtgtgggtgcaatggatgccggaaggctatagcccggcgcgagcggccgtgcaggcggagatggcgcgaccagaaatcctggtggagatcatgctcaccgccgtcaaagcgtaa

SEQ ID NO: 3186 - DNA, 378 bp, Klebsiella pneumoniae
aatagatacaggagagcacacatggctcgcgtaaaacgtggtgtaattgcacgtgcacgtcacaagaaaattttgaaacaagctaaaggctactacggtgcgcgttctcgcgtataccgcgttgccttccaggctgttatcaaagctggtcagtacgcttaccgtgaccgtcgtcaacgtaaacgtcagttccgtcaactgtggattgcacgtatcaacgcagcagcacgtcagaacggtatttcttacagcaaattcatcaatggcctgaaaaaagcctctgttgaaatcgaccgtaagatcctggctgacatcgctgtattcgacaaagtagcgttcaccgctctggtcgaaaaagcgaaagcagctctggcataa

SEQ ID NO: 3187 - DNA, 2403 bp, Klebsiella pneumoniae
gggcaggacagaacaatgaaattcagtgaactgtggttacgcgaatgggttaacccggcgatcgacagcgaagcgctttccgatcagatcaccatggcgggcctcgaagtagatggcgttgagccggttgccggcagcttcaacggcgtcgtagtcggggaagtggtggagtgcggtcagcacccgaacgccgacaaactgcgcgttactaaagtcaatgtcggcggcgaacgcctgctggatatcgtctgcggcgcgccaaactgccgtcaggggctaaaggtcgcggtagccaccatcggcgccgtgctgccgggcgatttcaaaatcaaggccgcgaagctgcgcggcgagccgtctgaggggatgctgtgctccttctccgagctgggtatttccgacgaccatagcggtatcatcgagctgccggcagatgcgcccatcggcaccgatattcgcgaatacctcaagcttgacgataacaccatcgaaatcagcgtcacgccaaaccgcgccgactgcctgggcatcattggcgtggcgcgcgatgtcgctgtcctgaacaaagcgccgctgaacgcgccggaaatcacgccggttgccgcgacgattgacgacgtgctgccgattcaggttgacgcgccgcaggcttgcccgcgctatctggggcgcgtggtgaaaggtatcaacgtcaaagcgccgacgccgctgtggatgaaagagaagctgcgccgctgcgggatccgctccatcgacgcggtggttgacgtgaccaactatgtgctgcttgagctgggccagccgatgcacgcctttgaccgcgaccgtattgaaggcgggatcgtggtgcgcatggcgaaagaaggggaaaccctggtcctgctcgatggctctgaagcaaagctcgacagcgacacgctggtcattgcagaccataacaaagcgctggcgatgggggggatcttcggcggggaacacaccggcgttaacgacgaaacccaaaacgtgctgctggaatgcgcgttcttcagcccgctgtccattaccggccgcgcgcgccgtcatggcctgcacaccgatgcctctcaccgctatgagcgcggcgtcgatccggccctgcagtataaagcgctggagcgtgccacccgtctgctgatcgacctctgcggcggtgaagccggcccggtcattgacgttaccagcaaagagaatctaccaacacgcgccaccattacgctgcgtcgcagcaagctggatcgcctgattggccaccatatcgacgacgcgcaggtcaccgacattctgcagcgcctcggctgcgaagtgacggttggtgagggcgaatggcaggcggttgcgccgagctggcgtttcgacatggagatcgaagaagatctggttgaagaagtggctcgcgtttacggctacaacaacattcctgacgagccggtgcaggcgggtctgatcatgggaacccaccgcgaagcggacctgtcgctgaagcgcgtgaaaacgctgctgaacgacaaaggctatcaggaagtgatcacctacagcttcgtcgacccgaaagtccagcagctgatccacgccggggaagaggcgctgatcctgccaagcccgatctccagcgaaatgtcggcgatgcgcctgtcgctgtggaccggcctgctgggcaccgtggtctacaaccagaaccgtcagcagagccgggtgcgcatctttgagagcggcctgcgctttgtgccggacaccaatgcgccgctgggcattcgtcaggatgtgatgctggccggggcgatctgcggcaaccgctacgaagagcactggacactggcgaaagagacggtcgatttctatgatctgaaaggcgatctggaagccgttctggatttaaccggaaaattagcggatatcgaattccgtgctgaagcgaccaccgcgctgcatccgggacaatccgcagcgatttatcttaaaggtgaacgcattggtttcattggggttgttcatcctgagctggaacgtaaactggatctgaacggtcgcactctggtgttcgaactggagtggaacaagctcgcagaccgcgtggtgcctcaggcgcgcgatatttcccgcttcccggcgaaccgtcgcgacatcgcggtgctggtcgcggaaaacgtggctgccgccgatgttttagccgaatgtaagaaagttggcgtaaatcaggtagttggcgtaaacttatttgacgtgtaccgtggtaagggtgtggcggaagggtataagagccttgcgattagcctgatcctgcaggataccagccgtacactcgaagaagaggagattgccgctaccgttgccagatgtgtagaggcattaaaagagcgattccaggcatcattgagggattga

SEQ ID NO: 3188 - DNA, 885 bp, Klebsiella pneumoniae
cgctggcgcagcgcttgcaaacattacaggattttcctcgcgatgcattcattacaacgtaaagtactacgcactatttgccctgatcagaaaggcctcatcgcgcgtatcaccaatatctgctacaagcatgaactcaacattgtgcagaacaatgagtttgttgaccaccgtaccggtcgtttctttatgcgcaccgaactggaaggcatttttaacgacgctactctgctggccgatctcgacagcgccctgcctgaaggctccatccgcgaactgaatccggcaggccgtcgccgggtggtgattctggtgacgaaagaggcgcactgtctgggcgatctgctgatgaaagccaactacggcgggctggatgtcgatattgccgcggttatcggcaaccatgacaccctgcgctcgttggtggagcgctttggtattccgtttgagctggtcagccatgaaggactgagccgcgaagaacacgatcagcgaatgggcgatgctatcgccgcccacgaaccggattacgtggtgctggccaagtatatgcgcgtcctgacgccagaatttgtcgcccgcttcccgaacaaaatcatcaatatccaccattcgtttttgccggcgtttatcggcgcccgtccctatcatcaggcctatgagcgcggcgtgaaaatcattggcgctaccgcccactacgtgaatgacaatctggatgaaggcccgatcatcatgcaggatgtgattcacgtcgatcatacttataccgcagaagatatgatgcgcgctgggcgcgatgtcgaaaaaaacgtcttgagccgggcgctgtatcaggtactggcgcagcgcgtcttcgtttacggtaaccggacgattattctttaa

SEQ ID NO: 3189 - DNA, 1452 bp, Klebsiella pneumoniae
ttggcattaaggagtgttatgagtgactcaacgctcacaggcaatgcgcctgtcagacaaaatatcacgcggaaaaacgttattattggtctgttattgctgctgttcgtgttgatcgcgctgtggtgccacggtcgaccaggcagcgagcttggtctgctgggatttacgccgctggtggcgctagcgatattatcgctgatcggcgttgatattgtgctggcggtcatctcctcgattattatcgccatgataatgacctcgaccggcctgccggaaatgggcacgatgctggcgaaatccaccgggtcatttattgccaccgttgggcttatcattatgctcggcgccggcgtgggggaagtggccacccgcaccggcgcagcggttgagctggtaaaatttgtcgtccatcgcatcgggttgtcgagtcagacgcgggtgaaattcggcattgtggcgtcatcgattttaatttgcggttcgctgggcactatggccggtggcaatgccattatcgtggcagtaatcattccggtggcggcagcggtacgcttgacgccgccaacggtcgccgcgctgatgatgaccgccggttccgttgggctgtttaccgcgcctttcacccccagtaccgtgacgatcctcagcctcggtgggttgagctacccggattatctgctgtacgttggtctgccgatgagcgcggtcacgctgctggccggctgggtaatggcgggacggatccagaagatgaccgaaggcaaactgcgctatgacgtcgatctcgcggaaaagccgcaagaggatctcagcgccgcgcagcagcgtcggcgtaaattaagcgcgctggccttcgcggcgaccatcatcgtgatggcgatcgttggcgtggtgattaaagccggcttcagcttcgcgataatcgtgatgctgctggtggccctgatgaccggcctggtaggcggcctgcgaccgacgcagatccttcaggccctgtatcacggctgcggccgcctggtgtggatgtttattctctactggctgtacaacccgatccttgagctgatggatggcctgcacgcctatcaggggctgctggagtatacccaaccgctgctggaggggatctccccggcctggctgtgctttagcatcttcgcgttcaatattatcggccatgtgcccggtgcggcggtggcccagatgacctttactcataaaatctttggcccgatgctgatggccgccggcgtgccgccccaggggaccaccgccgtgctgctggcctcatcccaggtggactggttcgggccgtttccctcatcagatatgttcggccagatggggctggcgcagtctactcatctgaaatatatgctctataacggctgggcaatcgtggtggcgaacatcattctctttgcgctgctgtttcagattctggtgtga

SEQ ID NO: 3190 - DNA, 825 bp, Klebsiella pneumoniae
ctcaggttaagacgccttattgaatatgattgctatttgcatttaaaatcggagcatcatttttcaacagaaacgactatgagcgcaatgacccttgatttacctcgccgctttccgtggccaacgctgctgtccgtggctatccacggtgccgttgtggcggggctgctttatacctcggtacatcaggttattgaacagccttctccgacgcagccgatagagatcacaatggtggcgccggccgatcttgagccgcctccggcggcgcagcctgtcgtggagcccgttgttgaacccgaacctgagccggagccagaggtagtgcctgaaccgccgaaagaggcgccggtggtgatccataaaccggaacctaagccgaagcccaaacctaaacccaagcctaagccggagaaaaaggttgaacagccgaagcgggaagtgaagccggcagcagagccgcgtccggcctcgccgtttgaaaacaacaatacggcgccggcgcgtacagcgccaagcacctcgaccgcagcggctaaacccaccgttactgctccaagcggcccgcgggcgatcagccgcgttcagccgtcctatccggcgcgcgctcaggcgctgcgcattgaagggacggtacgggtgaagtttgacgtttcgcctgatggccgcattgataatctgcagatcctctctgctcagccggcgaatatgttcgaacgcgaggtgaaaagcgcgatgcgcagatggcgttatcagcagggaagaccgggtaccggcgtaacgatgaccatcaaattccgcctgaacggcgtcgagattaactga

SEQ ID NO: 3191 - DNA, 318 bp, Klebsiella pneumoniae
ttattgataaggagctttgccgtgctttacgttatctacgctgaagatatcgccgattctctggaaaagcggctgtcggttcgccccgcgcatctcgcgcgtttacaactcttacacgatgaaggccgactgcttaccgccgggccaatgccggccgttgacagtaacgaaccgggcgcagcaggattcagcggatcaacggtgattgccgagtttgaatcgctggaagcggcccaggcctgggccaatgacgatccgtatatcgccgccggggtttaccgccaggtctcagttaagccgtataagaaggttttttga

SEQ ID NO: 3192 - DNA, 1371 bp, Klebsiella pneumoniae
gtgaataaaagtccgggcaacgaaccaatggcggttcgggggcccgtggataaaggcgtcctgcagtgcgtatgcactgtcgggcgctttttttttgcgcatggtggagcggatatgggcgacaaattttcaatttcccggcggcgcttgctgcaggcaggggccgcgctgggcggcgcgatgctgctgccgggcgtgatgcaggccgcctgggccggcggctcggacaaaccggagcaaacccgcgtgcgggtcggatttattccgctgaccgattgcgcgccgctggccatcgccgcggcgaaggggtttgaccaaaaatatggcatcaccctggtggcgagtaaggaagccagctgggcggcggtgcgcgacaagctggtggccggcgagctcgacgcggcgcatattctctatggcctgctgtacggcctcgaactggggatcgccagcaagccgcaggcgatggccaatttgatgaccctcaaccgcaatggccaggcgattaccctctccagcgagctgcaggagaaaggggtgaccgacctcggcgggctgaagcggctgatcgaccgcagcgcgccgggcagttacaccttcgcccatacctttcctaccggcacccatgccatgtggctttactactggctggcgagcgccggcatcgatcccttcaacgatgtgcgcaccgtcgtggtgccgccgccgcagatggtgatgaacatgcgcatcggcaatatgagcggcttttgcgtcggcgagccgtggaacgcccgcgctattaacgaccgtatcggcttcaccgcggccacttcccaggatatctggcccgagcatccggaaaaggtgctgggcacccgtcgcgactgggtggaacgcaacccgaacaccgcccgcgcgctggtggcggccctgatggaggcgcagcgctggatcgccgcctcgccggagaacacccgggagacggcccgcctgctcgccagacgcggctggctcaataccaaggagcaatacctcaccggccggatgcttggagagtatgacaacggccttggccgccgctggcaggatgcccatccgatacgcttctgggccgggggcgaggtgagtttcccgtggctgtcggacgggatgtggttcctcacccagttccgccgctgggggttgctgaagcaggctccggattacctcgcggtggcgtcgcgcattaaccgcatcgatgtctggcaggctgccgcccaggcggtaggagggatcagcgcgccggcagccaggatgcgcagcagcacactaatggacgggacggtctggaacgggtccgacccggaaggctacgcccgtcatttctctattcaacgtaagggggcatga

SEQ ID NO: 3193 - DNA, 258 bp, Klebsiella pneumoniae
ccaccagtgaggaaaaaccacgctttttccttactggtcagcaatcggacgcccggtcatgccgggcgttttcttttgcgcgcgctcaggccaggcccggcgtcggactctcgcccaacagcgcgcggacgctggccaccaggtcatcgagactggcatcgtgcatgcccagcttgcgcagcgcctgctcaagcgaaaacagatactgggcgttggtgccgagcggcccgctggcccgggcgatcagcggggcgataa

SEQ ID NO: 3194 - DNA, 183 bp, Klebsiella pneumoniae
cccggcgcgagcggccgtgcaggcggagatggcgcgaccagaaatcctggtggagatcatgctcaccgccgtcaaagcgtaaaaattgacagaaaagaaaaaggccgcaatgcggcctttttaattagttcagattatttgtctttcggcgacgcgttttcgacacggcttttcagcttctga

SEQ ID NO: 3195 - DNA, 270 bp, Klebsiella pneumoniae
agatgggcgagagtcagcatagattccattacgcagggggaacaagaggctgattttacggtgggctgtcgcggtgagaaaaggaaaacctcacgaccaaacgtcgacgcggaggaaaatctcctccgcgtctgcggtcgttcgtcacaccagaatctgaaacagcagcgcaaagagaatgatgttcgccaccacgattgcccagccgttatagagcatatatttcagatgagtagactgcgccagccccatctggccgaacatatctga

SEQ ID NO: 3196 - DNA, 384 bp, Klebsiella pneumoniae
gctcctgctggatatgcatcaccgtgtcctggaggtgggcgcgggtcagcgcatccagggcgccgaagggctcatcaagcagcagcactttcggcttcatcgccagcgcccgggcgatacccacccgctgcttcatgccgccggagatctccccgggacgtttgtgcagcgcatgacccatctgtacgcgcgccaggttgtgttcgatccactcccggcgctcactcttgctcatggtgcgacggaacacctgatccaccgccagcgccacattgtcgaaacagctcagccacggcagcagcgagtggttctggaaaaccaccgcccgctccggcccgggaccggcgatttcccggttatcacacagtagtccgccctcggtag

SEQ ID NO: 3197 - DNA, 768 bp, Klebsiella pneumoniae
aggagcgctggcgcaataatgtcgtttctgatgcagctacaggatgtagaagcggcggggcgcctggccccgttttctgcggcctttcgcgccggggagattgtccatctggtggggccgaacggcgcagggaagagcacgctgctgacccgcatggcggggctgtccgacggccccggcacggttcattttaacggccggctgcttgacgagtggccggcgagggagctggcgcgccgtcgcggatatctgagtcaacaccagaccccgccgttcgccatgccggtatggcactacctggcgctgcatatgcagcagcagggtgatagcgcccgtctgagcgatatcgcggccaggcttggtctggacaataagctgggccgtccggtcaatcagctgtcgggcggcgagtggcagcgcgtgcggctggcggcagtgatcctgcagatcgatcccttgagtaattccgcgggtcagctgctgctgctggatgagccgatgaacagtctggatgtggctcagcaggcggcgctggatcggctgttacacgagctgagcgcggcggggattgcggtggtgatgagcagccacgatctcaaccataccctgcgccacgccggtcagagctggctgctctgccagggggaagccatcgcctgcggggagaccgccgaggtgctgaatgaggaaaatttaaccgccgcctatgcgatcccgttccagcgcgttgaggtggccggtcatattatgctcatcgcgtcacagtag

SEQ ID NO: 3198 - DNA, 1785 bp, Klebsiella pneumoniae
acgaataatggaatattcataatggacgatttaaccctgcgatattttgatgctgaaatgcgctacctgcgcgaggcggcaaaagcgttcgcgcaggctcaccccgatcgggcggcgatgctggatctcgataaagccggtacgccggacccttacgttgagcgcctgtttgaaggctttgccttttccgtaggtcgcttgcgcgaaaaaattgatgatgatctgccggagctgaccgagggtctggtcagcatgctgtggccgcactatttgcgcactattccatcgctatcgatcgtggcgctgaccccaacgctgccggcgatgaagatggcggaaacggtgcccgccgggtttgagattagctcccgcccactggggccgaaaaataccgtgtgccggtaccgaaccacccgcgatctgacgcttaacccgctggcgatagaggaggcggtgatgacggcggagccggacggacgttcggccctgcgactacgattcgcctgtagcgagctggctgactggtcgcagaccgatctccgccgcctggcgctgtacctgggggaagacgccgttactggcagcgccctccatctgtggctgacccgacgccaggccgccctgtacctgcgtctgccgggtcagacagagcgggtaagcctcgacggctatttttccccggggggattcagcgaggaggatcgtttatggccgaagggggagagtgctttcagcggctatcagctgctgctcgagtatttcacctttcgcgaaaaatttatgttcgtgcagctaaatggcctggaaaacatcaccctgccggcggggatatcgcatttcacgcttgaggtggtgttcagcgaggtctggcaaagtgatttacccgtcagcgcaagcagcctgcgcctgcactgtgtgccggtgattaacctgtttacccttgaggccgatccgttgaccatcagcgggctggagagcgaatacctcctgcgtccgaagcgcctgcaggacgggcataccgaaatctattctgttgacagcgtgaccggctccgggcgcaccggggaggcacgctatgtgcctttcacccgctttcgtcaccaggggggaatgatgcgtcgccatgcgccggagcgctactaccacacccgcgtaaaacggggcgtaaccggcatgcacgatacctggcttatcctcggcggacagcaatgggaggctgaccgggagctggcgcgggaaacggtctccttgcgcatcaccggcactaacggccagctgccgcgccgggcgctacagagcacgctgctggatcgctgtgagtcgatatcagccacgccgcttaccgtccgcaatctctgtaagcccacgctgccggcctatcccccggcggaagaccgctaccactggcgggtcatgagccatctgggcacccgttttctcaacatgatgagcagcgccgaggtgctgcgcggcacgctgtcgctctacaactggcgggaggatgagctcaataatcgccgtctggacgccattctggcggtcagccatcaccgaattcagcgtttcgagcagggcttcctgctgcgcgggctggatatcgaagtgacgctcgacggtagcggatttaccggtgcgggcgatgtccacctgtttggcgacatgctcaaccgctttttcgcactgtatgccgatatgaatcagttcaaccagctgacgctcattgttcaacctgaagggaaatgtatccggtggaaagagaatcacagtctgcgcctgcccggctga

SEQ ID NO: 3199 - DNA, 1293 bp, Klebsiella pneumoniae
gggaatagtgggaatgctaatatttcatttcctcgccggtttttagaggcctatagtttttttacctgcagaacatccactaaggttaaaaaacataaggacataataatgattgtttcagcccccagcgattatcgcgaagccgctcgtcgtcgtctgccccgcttccttttcgattatattgacggtggcgcggtggcggaaaacaccatgaacgccaacgccgccgagcttgcctcggtagctcttcgccagcgcgtactgtgcggggccggcgaaccgacgctggcgaccacgatccttgatgccccatgggcgatgcccgtggcgctggggcccgtcggcgccaccgggatgtacgcccgccgcggcgaagtccaggcggcccgcgccgcctcccgcgccgggatcccgtacaccttatccaccgtgtcggtctgctcgattgaagaggtggcgagccacgccagcggcgcgctctggtcccagctgtacgtactgaaagatcgcggctatatgcgtaacgcgctggagcgcgcctgggccgctggcatgaaaaccctggtatttaccgtcgatatgccaatccccggctcgcggtatcgcgataaccgctcagggatgtccgggccgcacgccaccctgcgacaatatctccaggcttgcacccatccgcgctgggcgatgaacgtcgggctggcgggcagacccctgtcgtttggtaatatcgaagcctacaccggccacaaaatgaccatggacgactatatggggttcatcagcaacaacttcgacccgtccatcgcctggcacgatctggagtggatccgcgacagctggcaagggaaattaatcatcaaagggatcctcgatgccgacgatgcgcgcaatgccgtgcggctgggcgccgatggtattgtggtgtcaaatcatggcggcagacagctcgatggcgccatccccaccgcccgggcgctgcccagggtggtggatgcggtcggcgacgatctgacagtgcttgccgattccggggtgcgctccggcgtggacgttatacgtctgctggccctcggcgcgaaaggcgtgctgctcggtcgggcctatatttatgccctggccgcggcgggcgaagcgggcgtggcgcatctgctgcgcttatttgccgaggatatgaaggttaccatgaccctcaccggcgcgacctcgccatcggccatcagcctcgattgccttgatcgcctcgaacaggatcaacaccgcactcatgcggtgccggtatccttacccgcctga

SEQ ID NO: 3200 - DNA, 183 bp, Klebsiella pneumoniae
gacagctccggaaacaatctttatttcataatgaaaatagaggcatctttgcaaaactgtcaggaactggactttccctccccgagtcatcgtgccatgcttaaattaacgacagtcgccgtattaaggaggagaaggaatgaccaaaatttacacgctcacgctggccccctcgctggatag

SEQ ID NO: 3201 - DNA, 249 bp, Klebsiella pneumoniae
gtttttcccggaggcggtgctgcgcacctgtccgggctaccagacggcaccacttgtagcctcgctaagcgaagcgcgagcgatgagacagcagaacaggtggctgagagtgcaacagtggtgggggaaggattactcggcgctaaagcgcctcgccttcgggccattgcctgcggcaacgttctctcgcttcgctcgagtcgaaccttggtcgaagcttctcatccttccccgtggggcagaatatag

SEQ ID NO: 3202 - DNA, 1071 bp, Klebsiella pneumoniae
agcgcgcccggcctgactccgcgtcgccaggctggtggagagtattccgccgggttcgctttatgcccgccatcaggatggacaatcgccatgaataataaatttacctatacgattaagcgcacccggtttgatgaaaactataaccctgcggaaaatacgcgtattaccaccaacttcgctaatttagccagaggggtgaaccgtgaggaaaatctgcgcaatacgttaatcatgatgaataaccgttttaatagcctggcccactgggataatcctcataacgatcgctatgcggtggaactggatattatttctgtcgagatgaatattgctcaggatagcgccagcttcccggtgattgagatcctgcaaacgcatattgtcgataaaaagagcggggagcgtcatgccggtatcgtcggcaataacttctcctcctatgtgcgggattacgattttagcgtactgcttctggaacataataaggaccagagtcgcttcagcgtaccggaaaactttggcgagctgcacggcaatatctttaaggattttgtgcaatccagcgcctggcgcgccaacttcagcaaggcgccggtgatttgcctgagcgtctccagtaaagatgtttaccatcgcaccggtaacgaacatccggtcctcggcattgaatatgctcaggaaggcgtctcgctgaccgagcgctatttcagcaaaatggggctgcaggtacgctattttatgccaaaaaacagcgtcgcgccgttggccttttattttaccggcgatctgctcagcgattacaccagcctggaactgatcgccaccatcagcacgatggagacgtttcagaaaatatatcgcccggagatctacaatgccaactccccggcggggcaatactatcagcccaatctcagccacctggatcattcattaacaaaaatcgtctatgaccgggaagagcgcagcctgttggcgattgaacaggggaaatttacacaacaacattttatcaacccgcacaagacgttgcttgagcaatggtctgctaatttcgcgctttgctaa

SEQ ID NO: 3203 - DNA, 1908 bp, Klebsiella pneumoniae
gccgacgcaggatttcaccgtgcgcagcgacttgccgtaggcgtggccggtttcaaacccggcgtcggccagctcgcgccagatagccggcagctgttccagccgcgcgccaaacaggtcgatgcgctggccgccggtcactttgctgtagagctggtaacgtttggcgatctgcccgatggcgatcagtccgtccggcgtcacttcccctgccgccatccgcggcaccaccgaatagctcccgtccttctggatattggcgaaatagcggtcgttggtatcctgcagcggcaggtgcgccggcttcagcaggtactcgttccagcaggaggccagcaccgaggccaccagcggtttgcagacatcgcagccgtgcccctggccgtagcggctaatcaactgctcgaaggtatggatatggttaacccgtaccaggtggtagatctcctggcgcgaccacgggaaatgttcgcagacgtcttttttcacttcgacgccctgctccgccagctgatactccatcacctgtttcaccagcgcgctgcagccgccgcagccggtagccgctctggtgcagctttttatcgccgacatatcccccgccccattgttcaccgcctggcagatatcgcctttgctgacgttatggcaggagcagatcggcgcgctgtccggcagcgccgcgacgccgagcgccttcggcgcggctccctccagcgcgggcaggatcagactctccggacgcggcggcagcgccatgccgttcagcatcatctgcagcagcgtggcatagtcgctggcatcccccaccagcacgccgccaagcaaggctttgccgtcctgactgacgacgatttttttgtaaatctgctgcggaccgtcggtccattgatagctctgacagcccggcgtgcgcccctgcgcatcgccaaacgaggccacgtcgacccccagcagcttcagtttggtgctcatgtcggcgccgctaaagcaggcgtcctctcctgcgagagtggccgcggcgatgcgcgccatctgatagcccggcgccaccagaccgtaaattttattgtcccacagggcgcattcgcctatcgccagcacgtccgggtcagaggtacggcactggccgtcgatgtgaattcccccgcgttcgcccacctgcagcgcgcagccgcgggccagcgcgtcctgcgggcggatccccgccgagaagaccaccatgtcggtccgcaacgcgccgccgtcggcaaagttcagccgcaggccgtcggcctcgcgcacgatggcggtggtcgctttgctggtatgcacccccacgccgagggcgacgatcttctcccggagcatcgccgccccgccgttatccagctggacggccatcaggttcggggcaaactccaccacctgcgtctccagccccagctgtttcagggcgttggccgcctcaagcccgagcagcccgccgccgataaccaccccgctcttcgccgcggcggcatgggcggcgatacggtcgagatcgtcaagagtgcggtagacaaagcaccccgcgagatcgttaccggggattggcggaacaaagggatacgagccggtcgccagcaccagtttatcccagtggatttcatgcccctcggcgtcccgtaccagccgtgcgtcgcggtcgatggtcgccaccgcctcgccgaggcggagttcaataccgtgttcaataaagaaatccccggccgccagcgacagcgactcggcgctgcgtccggcaaaatactcggagagatgtacccggtcgtaggcggggtaacgctcttcgccaaacaccacgattcgatattgctgatgcagattgcggctcacgcattgttcgagaaaatggtggccgaccatgccatgtcccaccagcactaa

SEQ ID NO: 3204 - DNA, 546 bp, Klebsiella pneumoniae
ggtattaaaggcggaaaacgagttcaaacggcacgtccgaatcgtattaatggcgagattcgcgcccaggaagttcgcttaacaggtctggaaggtgagcagctgggaattgtgagtctgagagaagctatcgaaaaggctgaagaggctggagtagatttagttgaaatcagccctaacgccgagccgccagtttgtcgtatcatggactacggcaagttcctttatgaaaagagtaagtcttctaaggaacagaagaagaagcagaaagttatccaggttaaggaaattaaattccgccctggtactgatgaaggtgactatcaggtaaaactccgcagcctgattcgctttctcgaagatggcgataaggccaagatcacgctgcgtttccgcggtcgtgagatggcccaccagcagatcggtatggaagtgcttaaccgcgtgaaagacgatctggttgaactggcagtagtcgaatccttcccaacgaagatcgaaggccgccagatgatcatggtgctcgctcctaagaagaaacagtaa

SEQ ID NO: 3205 - DNA, 285 bp, Klebsiella pneumoniae
tatataaaaggaaattcaatgtccaaaggttttgtattactcggcgataaaaccacgcacggcggtgctgttatttccgcatcctccaccatgattgtaaatggaaagcccgtagcgctggtgggggataaagtcagctgcccgattccgggacatggcactaatgccattattgagggagcgccggaatggtcttccgatggtaaagccatcgtggtcgatggctgcaaatgtcagtgcggttgccaggtgatttccggcgcgccggaatgcgcgataggataa

SEQ ID NO: 3206 - DNA, 945 bp, Klebsiella pneumoniae
ggaggagaaggaatgaccaaaatttacacgctcacgctggccccctcgctggatagcgccacgcaaaccccacagatctacccggaaggcaaacttcgctgcagcgcgccggtatttgaacctggcggcggcgggatcaacgtggcccgcgccgtgacctttctcggcggcaaagccaccgccattttcccggtcggtggcgctaccggcgagcatcttgccgccctgctggccgatgagcaggtgccggtcgagaccgtcgaaacccgcgactggacgcggcaaaacctgcacgtccacgtggccgccagcggcgaacagtatcgcttcgttatgcccggcgcggcactgacggacgatgaattccgccgtctggaagagaaggttctgactatcgaacccggctctctgctggtgatcagcggcagcctgccgccaggtattagcgtcgataatctgatgcagctggtgaaaaatgcgcaacagcagggactgcgctgcatcattgacagttccggcgatgcgctggccgccgcgctggacgtcggtaatattgagctggtgaaaccgaaccagaaagagcttagcgccctcgtgcagcgcgatctcagccaacccgatgacgtgcgccttgccgctcagtcgttgatccagtccggtaaagtgcgccgggtggtggtctccctgggtccgcagggggcattaggcgtggacgccagcggcagcgttcaggtagtgcctccaccgatgaaaagccagagcaccgtcggggctggcgacagcatggtgggcgccatgaccttgcgtctggcggaaaacgccagccttgaagacatggtacgctttggcgtcgccgccggtagcgccgcgaccatcaaccagggcacccgcctctgctcgcgggccaatacgcaaaaaatctatgattatctctgcgggcgttga

SEQ ID NO: 3207 - DNA, 1866 bp, Klebsiella pneumoniae
ctctttaggggtatgggtatactccaggggatagtcgagaataagcgccactcccggagacatgaccggtcaggagccacgcattccatgttaaaacgtctttttaccccgctgacgctggtcaatcaactggcgttaatcgtgctgctcgccacgattattggcgtcgccggcatggcgatctccgcgcgcctggtgaacggcgtgcagggcagcgcgcacgccattaacaaggccggttcattgcgtatgcaaagctaccggctgctggcggcgatcccgctgaatgaaaacgatcaaaaactggtggcggacatgaccgccaccgtcttcagcccggagctgcaaaattccgcccgccgcgacggccaggaaatccagcttaaagccctgcagcagtactggcagctggcgctggcccccggcatgcagcgcgcagtcaatcaggcggaagtggcccaggatgtcgccgactttgtcgatcgtatcgaccagttggtcaccgcattcgaccacaccaccgagcagcgtatcgaacggggggtctggatccatcgcatcctcgccattggtatggcgctgctgctgatcttcactatcatctggctacgcgcccgcctgctgcggccgtggaaacagctgctgagcatggcgcgcgcggtgagtcagcgtgatttcacccagcgggcgcacatcagcggccgcaacgaaatggcgaccctgggcatggcgctgaataacatgtcggaagagctggcggaaagctacgccgtgctcgagcggcgggtgcaggagaagactgccggactggagcagaagaacgagatcctcgctttcttatggcaggccaaccgccggctgcactccagcgccccgctctgcgaacgtatttcgccggtactgaatggcctgcaggggctgacgctgctgcgcgatatcgaggtacgggtttacgacctggaagacgaagataatcaccaggagtttacctgccactcggatgatgactgtgatgataaaggctgctacctctgtccacgcaatctgccgccgctgccggatgggggaacaacgctgaagtggcggctgtcggatgcgcatagtcagtacggcatcctgctggcgacgctgccggttggccgccatctcagccacgatcagcagcagctggtggataccctggtggaacagctgaccagcaccctggcgctggaccgccatcaggagaagcagcagcagctgatcgtcatggaagaacgggccactatcgcccgcgagctgcacgactccatcgcccagtcgctatcctgtatgaagatgcaggttagctgtctgcagatgcaaggcgacgccttgccgacggaaagccgccagctgctggggcagatccgtaacgaactgaatacctcgtgggcccagctgcgggagctgttaaccaccttccgcctgcagttgaccgagccggggctgcgcccggcgctggaggccagctgtcaggagtacagcgcccacttcggctttacggtgcagcttgattaccagctcccgccgcgctttgtgccctcgcatcaggcgatccacctgctgcagatcgctcgcgaagcgttgagcaacgctctgaagcatgccagcgcgaccgaagtgaccgtgacggtgtcacaacgcgataatcaggttcgtctggtggtagcggataacggccgcggcgtaccggaccacgccgaacggagtaaccattacggtttaattattatgcgggatcgcgcccagagcttgcgcggtgactgtcaggtacgacgccgggaaaccggtggaaccgaagtgatcgtcacgtttatcccggaaaaaacgttttccatccaataa

SEQ ID NO: 3208 - DNA, 1023 bp, Klebsiella pneumoniae
accggtgggggatctgctatgaacgccgtaactgaacaacgaaaagtcctgctcgaaattgccgacctgaaggtgcacttcgatatcaaagatggcaagcagtggttctggcagccgtcgaaaacgctgaaagcggtggatggcgtgacgctgcgcctttacgagggggaaaccctcggtgtggtaggggagtcgggctgcggcaaatcgaccttcgcccgcgccattattggtctggtgaaagcgaccgatggcaaagtggcctggctgggtaaagatctgctgggcatgaagcaggaagagtggcgcgacgtgcgcagcgatatccagatgatcttccaggatccgctggcctcgctgaacccgcgcatgaccatcggagaaattatcgccgaaccgctgcgtacctatcatccgaagatgccccgtcaggaagtgcgcgatcgcgtcaaagcgatgatgatgaaagttgggttgctgcccaacctgatcaaccgctatccgcacgagttctccggcggtcagtgtcagcgtatcggcatcgcgcgggcgctgatccttgagccaaagctgattatctgcgatgagccggtctccgcgcttgacgtgtcgattcaggcgcaggtcgtcaacctgctgcagcaactgcagcgtgagatggggctatcgctgatatttatcgctcacgatctggcggtggttaagcatatctccgatcgggttctggtaatgtatctgggccatgcggtggagctggggacttacgacgaggtgtaccataatccgctgcatccctataccaaagcgctgatgtcggcggtgccgatccccgatcctgatctcgagaaaacgaaaactatccaactgctcgaaggcgaattaccctcgccgattaatccgccctcaggctgcgtattccgcacccgctgtccgcttgccggaccggagtgcgccaaaacccgcccggtgctggaaggcagtttccgccatgcggtttcctgccttaaggtagacccgttataa

SEQ ID NO: 3209 - DNA, 864 bp, Klebsiella pneumoniae
ggcgaacttatgaaacaaaaagtggttagcattggtgatatcaacgtagcgaacgacctgccgttcgtgctgttcggcgggatgaacgtgctggagtcgcgcgacctggcgatgcgtatctgcgaacattatgtcaccgttacgcagaagcttggtattccctacgtcttcaaagcctcctttgataaagccaaccgttcctccatccactcctatcgtgggccgggtctggaagaagggatgaagattttccaggagctgaagcagacctttggcgtgaaaatcatcaccgacgttcatgaagccagccaggcgcagccggtagctgacgtggtggacgtgatccagcttccggctttcctcgcgcgccagactgacctggtggaagcgatggcgaagaccggggcggtgatcaacgtcaagaagccgcagtttgtcagcccgggtcagatgggcaacatcgtcgataagtttatcgaagggggtaacgacaaagtaatcctctgcgaccgcggcgcgaacttcggttacgacaacctggtcgtggatatgctcggcttcggcgtgatgaagaaagcctccaacaactcgccggtcattttcgacgtcacccacgcgctgcagtgccgcgacccgtttggcgcagcctccggcggtcgtcgtgcgcaggtgagcgagctggcccgcgccggtatggcggtaggtatcgccggtctgtttatagaagcgcatccggatccggaccacgcgaaatgcgacggcccgtccgcgctgccgctggataaactggagccgttcctcaaacagatgaaagcgattgacgatctggtgaaaagcttcgacgagctggataccagcaagtaa

SEQ ID NO: 3210 - DNA, 234 bp, Klebsiella pneumoniae
cgacgagttatccttcccccaccaccattcattttgctgaatagcctacaatgtgattttacccctggtggggttcccgagcggccaaagggagcagactgtaaatctgccgtcatcgacttcgaaggttcgaatccttcccccaccaccatcttcttaaaaaacacctcaatccaattattctacgatattctatattctgccccatggggaaggatgagaagcttcgactaa

SEQ ID NO: 3211 - DNA, 1122 bp, Klebsiella pneumoniae
aatttctctatgattaatccccatcagcctcgggacattccgcaaatactgctgtcggtgctgttcctggccctgattatcatatcctgcctgtgggttgtgcagccgtttattctgtccttcgcctgggccggtacggtggtgatcgccacctggccggtgctgttgcgtctgcagcgtgtgctgttcggcaaacgactgctggcggtgctggcgatgaccctgttgctgtttctgctattcgttattcctatcgctctgctggtcaacagcctggtggataacagcgttccgctgatcaaactcatcagcagcggaaatgtgacgctgccggatttcgcctggctcaacagcgtaccgctggtcggcgataaactgtactccgcctggcacggtctgctggatatgggcggctcggcgattatggccaaggttcgtccctatattggcaccaccaccagctggtttgtcggtcaggcggcgcacatcggcaagctgctggtctactgcggtttgatgctgctgttcagcgcgctgctctactggcgcggcgagcaggtggcctatggtttccgctacttcgccacgcgcctcgcggccaaacgcggcgacgccgcggtgctgctggccggccaggccgtgcgcgccgtggcgctgggcgtggtggtcactgccctcactcaggcggtactgggcgggattggccttgccgtctccggcgtgccctacgccgctctgctgaccgtggtgatgatctttacctgtctggtccagctcggccctttactggttttggtgccgtcgattatctggctttactggagcggggacaccacctggggcaccgtgctgctggtgtggagctgcgtagtcggcaccatggacaacgttattcgtccggtgctcatccgcatgggcgccgacctgccaatgatccttatcctcaccggcgtcattggcggcctgatcgccttcggcatgatcggcctgtttatcggtccggtgctgctcgccgtctcctggcgactgtatgacgcctgggtgcatgaggtgccgccgccgccgaaagaccctgacgtcgtccttgaagagcttagtgagctggaggccggtcgcaagtaa

SEQ ID NO: 3212 - DNA, 924 bp, Klebsiella pneumoniae
gggcatactatgaagcactgtaaaatcatcctgttagtaggccttctggccagttccgcttcggcattagcagagaagatcggcgtctcaatggcctacttcgatcaaaactttctcactattatccgccagtccattgagaaagaagctcaagcccgccacgtcgacgtacagtttgaagacgcccgcggcgacaccggacgccaggccgatcaggtgcagagcttcattgcctccggcgtggacgcgatcatcgtcgacccggtggactccgccagcaccccgcagctgacgaagatggcgcagcaggccaaaatgccgctggtgtatgtgaaccggacgccgggggataaaacgttaccgcccggcgtggtgtttgtcggttcggacgagcgggagtctggcacattgcagatggaggcgctggcgaagctggcgaactacaaaggcaacgtcgccatcatgatcggcaatctcaccgacgccggcgcgctgcagcgcaccaaagatgtggagcaggtggtggccaagtatccggcaatgaaagtggtgcagaaacagccggccaactattcccgtagcgagggcatggatctgatgcagaactggacgggcaacggagaagcgattgatattgtggcggcgaacaacgatgagatggcgattggcgcggcgatggcgctggagaaaagccagaagaagctgctgatcggcgggatcgacgccaccccggacgggctgaaagccctggccagcgataagattcaggtgacggttttccaggacgccgtcggtcagggcaaaacggccttagcggtagcgctgaagctgattaaaggagaaaaggtcgagtctcatgtctggatcccgtttgagttagtgaccaaagaaaacatgcagacctatgtggaaaagagtcattaa

SEQ ID NO: 3213 - DNA, 1053 bp, Klebsiella pneumoniae
cgtgccactattgaattatcgtcagccaggggagatatcatgacgcagccattggcgggaaaacagattctgatagttgaagacgaacccgttttccgctcactcttgcatggatggctgacctcgctgggagcaacaaccttccaggcggaagatggcaaggatgccctgcataaaatgacggaggtgcatccggacctgatgatttgcgacatttctatgccgagaatgaacggtctggagctggtggaaacgctgcgtaaccgcggcgaacagttaccgatcctgatgatctccgccaccgaaaacatggcggatatagctaaagcgttgcgacttggcgtccaggacgtgctgttaaagccagtaaaagatttcgatcgcctgcgcgagaccgtttacgcctgtctctatcccgcgatgttcagttcgcgcgtggaagaggaagagcgtttatttgaggactgggatgcgctggtcagtaatcccatcgccgcttcaagactattgcaggaattacagccgccggtgcaacaggaaatgtcgcactgccgtattcattatcgacaactggtgtcggcagacaagcccggtctggtactcgatatcgcgccgctttcggaaaatgatttggctttctattgtctggatgtcacacgcgcaggcgataatggcgtgttggcagcattattgctgcgcgcgttgtttaatggtctgctgcaggagcaactggcgcaccagggacaacggctaccagaaatgggaagtttgttaaaacaggtgaatcaactgctgcgtcaggcaaatcttccgggccagttccctctgttagtagggtattaccacagcgggctgaaaaatttaattctggtgtcagcgggacttaatggcacgctgaatacgggggagcatcaaattcagattagtaatggcgttcctttggggacgctgggtgatgcttatcttaaccaaattagccaacgctgcacctcgtggcagtgccaaatttggggggctggcggtcgtttacgcttaatgttgtctgcggaatga

SEQ ID NO: 3214 - DNA, 291 bp, Klebsiella pneumoniae
ctcgtcgctatcgctcctcgcccttcgggccgttgcctgcggcaacgttctctcgcttcgctcgagtcgaaccttggtcgaagcttctcatccttccccgtggggcagaatatagaatatcgtagagtaattggattgaggtgttttttaagaagatggtggtgggggaaggataactcgtcgctatcgctcctcgcccttcgggccgttgcctgcggcaacgttctctcgcttcgctcgagtcgaaccttagtcgaagcttctcatccttccccgtggggcagaatatag

SEQ ID NO: 3215 - DNA, 561 bp, Klebsiella pneumoniae
ggacaggctatgcaacatgacattctgaataccgaagtgacgaccattgatggcgagaaaaccaccctggcatcctttgccggcaaggtgctactgatcgtcaatgtagcctcgaaatgcggcctgacgccgcagtatgagcaactcgaggatctgcaaaagcagtttgccgccgagggcttcagcgtgctggggttcccctgcaaccagttcctcggccaggagccgggcagtgaagaggagattaagaccttctgcagcactacctacggcgtcaccttcccgctgtttagcaaaattgacgtcaacggtgaacatcgcgcgccgctctatcaaaaactgattgccgccgcgccgaaagcggtggccccggaaggcagcggtttttatgagcggatggccagcaaaggccgggcgccgctgtatgtggacgacattctgtggaacttcgaaaaattcctcatcgatcgccagggcaacgtcattcagcgcttctctccggatatgacgccggacgatccgcagctggtggcggcgattaaaggagcgctggcgcaataa

SEQ ID NO: 3216 - DNA, 1077 bp, Klebsiella pneumoniae
ctcaatctcttcgccagttttaccgtcgcgctgttcgaggttccatttgcctttgtcgccccagcggaatccgagggaaccgttcggtacggtcatgtcgcccttctcgtcaaaggcgacggttttccattccggattattctcctgaccaagggaatccacgaggtcggatgcgcgcagcgtacggccggcggcataataaccgtcgcgctcctcgagcatcaccagcatcggcatgtcggtatagcggcgcacatagtcggtgaaatactggctcggcttatcgaggtggaattcacgcagcatcacatggcccatcgccagcgccatcgcggcatcagtaccctgcttcggcgccagccacagatcgcagagtttggcgatttcggcgtagtccggagtgatggctacggttttggtccctttatagcggacttcggtaaagaagtgcgcatccggggtgcgggtctgcggcacgttggagccccaggcgatgatatagctggagttataccagtcggcggattccggcacatcggtctgctcgccccaggtcatcggcgaagccggcggcaggtcgcagtaccagtcgtagaagctcaggcaggtgccgccgatcagcgacagataacgggcgccggacgcgtaggagaccatcgacatcgccgggatcggcgagaagccagccacgcggtccggaccgtaggttttgacggtataaacgttggaggcggcaatcagctcattcacttcctgccaggaggaacgtacaaaaccgccgcgaccgcgggcctgtttgaagcttttggctttgtcggcgtcttcgataatcgacgcccatgcctcaaccggatcgctatgctgaactttcgcttcccgccacatcttcatcaggcgtttacgcatcagcgggtatttcaggcggttagcgctgtacaggtaccaggagtagctggcgccgcgcgggcagccgcgtggttcgtggttcggcaggtccgggcgggtgcgcgggtagtcagtctgctgcgtttcccaggtcaccagaccgtttttgacataaatcttccagctgcatga

SEQ ID NO: 3217 - DNA, 909 bp, Klebsiella pneumoniae
ccttatgatatggtggaaaacatggggagagacagcatgtggcaagcaatcagtactcttttacgcgattggcataccgaagacgctgaaatcgaactgaaaaccgagctgcccggtggagagatccattccgcctggcatttacgcttcggcgggaaagattacttcgtgaaatgcgacgaacgggaacttctgcctatcttcaccgccgagtccgatcagctggagctgctgtcgcgaagcaaaaccgttcgcgtaccgcaggtctttgccgtcggcagcgatcgcgactatagcttcgtggtcatggagtacctccctccccgtccgctggatgcgcacaatgcgtttctgcttggccagcagctagcccacctccatcagtggagcgatcagccgcagttcggtctggattttgataacgatctttccaccacgccgcagcccaacgcctggcagcgtcgctggtcggtcttttttgccgagcagcgtatcggctggcagctggagctcgcggcggagaagggattgcactttggcgatatcgataccttagtcgatatggtacagcagcgactggccaaccatcagccgcagccttcgctgctgcacggggatctgtggtccggcaactgcgccttagggccggatggcccctatatattcgatcccgcctgctactggggcgaccgcgagtgcgatttagccatgctgccgatgcatccggaacagcccccgcaaatctatgacggctatcagtccgtttcgcctctgccgtcgggttttctcgatcgtcagccgatttatcagctttatactctgctgaacagagcgattttgtttggcggccagcacctggtaacggcccagcaggcgctggatgatgtattgatggagaaaatgcgttaa

SEQ ID NO: 3218 - DNA, 765 bp, Klebsiella pneumoniae
gtgatgagtatttgcgctgaaaatatcacctggaaggcaggcaaaaaggtcatcgtcaataatgtctcgctgcgggtgccgcgaggcgaaacggtcggactgctggggcccaacggctgcggcaaatcctcgctgctgcgcgttctggcgggcctgcgccgcccggatgcaggtcgcgtcaccctcgacggccaggatatcgcccggatggcgaaaaagcagctcgcccgccgcgtggctttcgtcgagcaacacggcatgaccgaggccaatatgcgggtgcgcgacgtcgtgcgcctgggacgcattccccaccactctccgttctcaaactggagcgctcaggatgacgaggcgattgccgccgcgctgcagcgggtagcgatgctggagaaaagcgaacagggatggttaagcctctccggcggcgagcggcagcgggtgcatatcgcccgcgcgctggcgcagagcccgagcgaaatcctgctggatgagccgaccaaccatctggatatacaccatcagatgcagttaatgcagttgatcagcgagctgccggtaaccagcattgtggccattcacgatcttaaccatgccgcgatgttctgcgattcgctgatcgtgatgcagcaggggcagatcctcgccagcgggacgccggaggagattttgtccgaagcgctgctgtgggacgttttccgggtgaaaaccaaaatcgagatctccccttaccacggcaaaaagcacattcatttcatcgtttag

SEQ ID NO: 3219 - DNA, 339 bp, Klebsiella pneumoniae
gtagcaatcatggatatggatttaaacaaccgcctgaccgaagacgaaacgctcgagcaggcttacgatatcttcctcgaactggcggccgacaatctcgacccggcggacatcattctgtttaacctgcagtttgaggagcgcggcggcgccgaactgttcgacccttcggcagactgggaagagcatgtagattacgatctcaacccggatttcttcgccgaagtggtgattggtctggcggataccgacggcggggaaatcaatgatatcttcgcccgcgttctgctgtgccgcgagaaagatcataagctgtgccatattctgtggcgtgaataa

SEQ ID NO: 3220 - DNA, 231 bp, Klebsiella pneumoniae
ccgtactccatggtgcgcccggcgtacatcaccagcactttatcgcagatccctgccaccaccccaaggtcgtgggtgatcatgataatggccgtgttgaattcgcgtttaagctcattcaacagcgtcatgatctgcgcctgcacggtaacgtccagggcagtggtcggttcatccgcaatcagcagccggggccggcacagcagcgccatggcaatcatcacgcgctga

SEQ ID NO: 3221 - DNA, 501 bp, Klebsiella pneumoniae
attccttacattcccccctattgcacaacgcattttatcgctctattattagttcaacaaaccaccccacaatataagtttgagattactacaatgagcgaagcacttaaaattttgaacaacatccgtactcttcgtgcgcaggcaagagaatgcaccctggaaacgctcgaagaaatgctggaaaaattagaagtcgtcgttaacgagcgccgtgaagaagaaaacgctgccgcggcagaaattgaagagcgtacgcgtaagctgcagcaataccgtgaaatgctgattgctgacggtattgatccgaatgaactgctgagcaccatggctgctgttaaagccggtaccaaaaccaagcgtgctgcacgtccggctaaatatagctatgttgacgaaaatggtgaaaccaaaacctggaccggtcagggccgtaccccggctgtgatcaaaaaagcaatggatgagcaaggtaaatcactggacgatttcctgatctaa

SEQ ID NO: 3222 - DNA, 798 bp, Klebsiella pneumoniae
ggagccaacatgaaaccattaattcaggtgcaggccgtcagccaacgcttcaacaccgccagcggcgagttcctggcgctgcagaatgtctccttcgatatcgtcgaaggggagaccattagcctgatcggccactcgggttgcggaaaatcgaccctgctgaacctgatcgccgggatcaccacccctaccgagggcggactactgtgtgataaccgggaaatcgccggtcccgggccggagcgggcggtggttttccagaaccactcgctgctgccgtggctgagctgtttcgacaatgtggcgctggcggtggatcaggtgttccgtcgcaccatgagcaagagtgagcgccgggagtggatcgaacacaacctggcgcgcgtacagatgggtcatgcgctgcacaaacgtcccggggagatctccggcggcatgaagcagcgggtgggtatcgcccgggcgctggcgatgaagccgaaagtgctgctgcttgatgagcccttcggcgccctggatgcgctgacccgcgcccacctccaggacacggtgatgcatatccagcaggagctcaataccaccatcgtcatgatcacccacgacgttgatgaagcggtgctgctctcggatcgggtgctgatgatgaccaacggtccggcggcaacggtcggcgagatcctcgcggtcgatctgccgcgtccgcgccaccgcgttcagctggcggacgacagccggtatcaccatctgcgccagcagatcctccatttcctgtatgaaaaacagccgaaagcggcgtaa

SEQ ID NO: 3223 - DNA, 249 bp, Klebsiella pneumoniae
agggtattaataatgaatcgtactaaactggtactgggcgcggtaatcctgggttctactctgctggctggttgctccagcaatgctaaaatcgatcagctgtcttctgacgttcagactctgaacgctaaagttgaccagctgagcaacgacgtgaacgcaatgcgttccgacgttcaggctgctaaagacgacgcagctcgcgctaaccagcgtctggacaaccaggctcactcttaccgtaagtaa

SEQ ID NO: 3224 - DNA, 768 bp, Klebsiella pneumoniae
agagttataatgaagcttttaaagacagtacccgcagcggttatgctggcgggggggctttttgcgtctgttggcgcaatggccgatgattctgtatttaccgtcatggatgacccttccgctgccaaaaaaccgttcgaaggggtggttaacgcaggctacctggcgcagtccggcaacaccaagagctcttcgatgacggcggattccaccctgacctggtatggtaataccaccgcctggtcgctgtggggcaacgccagcaacacgtcgtccaatgatgagcgatcctcagaaaaatatgctgtcggcggacgtagccgctacaacctgaccgatatgaactatgtttttggtcagggtagctggctaactgaccgctacaacggctatcaacagcgcgatgttgtgacggcgggctatggtcgtcagatcctcaacgggccggtgcacagtctgcggtttgaattcggtcctggcgttcgctatgacgaatataccgacggggatactgatacccagccgctgggttatgcttcgggtacatgggcctggcagatgaccgataacgccaaattttcgcaaggggtatcggtgttcggcgccgaggacaccacggtcaactcagagagcgcgttaaacgtggcgattaacgcccatttcgccctgaaggtcgcctacaacgtgacctggaactctgagccgcctgcgtccgcgccggagcataccgatcgccggacctcgctctccctcgggtataagatgtaa

SEQ ID NO: 3225 - DNA, 3846 bp, Klebsiella pneumoniae
tcgctatcaattctcgccctctttcatagcgttaccttcgctgcaaatccagcaatgtcgatttatcagagagccgtcaggctccatatcaggagaaacccgatgagtaaattcctggaccggtttcgctacttcaaacagaagggtgaaacctttgccgatgggcacggccagcttctaaacaccaaccgggactgggaggatggataccgtcaacgttggcagcatgacaaaattgtgcgttccactcacggtgtcaactgcaccggctcatgcagctggaagatttatgtcaaaaacggtctggtgacctgggaaacgcagcagactgactacccgcgcacccgcccggacctgccgaaccacgaaccacgcggctgcccgcgcggcgccagctactcctggtacctgtacagcgctaaccgcctgaaatacccgctgatgcgtaaacgcctgatgaagatgtggcgggaagcgaaagttcagcatagcgatccggttgaggcatgggcgtcgattatcgaagacgccgacaaagccaaaagcttcaaacaggcccgcggtcgcggcggttttgtacgttcctcctggcaggaagtgaatgagctgattgccgcctccaacgtttataccgtcaaaacctacggtccggaccgcgtggctggcttctcgccgatcccggcgatgtcgatggtctcctacgcgtccggcgcccgttatctgtcgctgatcggcggcacctgcctgagcttctacgactggtactgcgacctgccgccggcttcgccgatgacctggggcgagcagaccgatgtgccggaatccgccgactggtataactccagctatatcatcgcctggggctccaacgtgccgcagacccgcaccccggatgcgcacttctttaccgaagtccgctataaagggaccaaaaccgtagccatcactccggactacgccgaaatcgccaaactctgcgatctgtggctggcgccgaagcagggtactgatgccgcgatggcgctggcgatgggccatgtgatgctgcgtgaattccacctcgataagccgagccagtatttcaccgactatgtgcgccgctataccgacatgccgatgctggtgatgctcgaggagcgcgacggttattatgccgccggccgtacgctgcgcgcatccgacctcgtggattcccttggtcaggagaataatccggaatggaaaaccgtcgcctttgacgagaagggcgacatgaccgtaccgaacggttccctcggattccgctggggcgacaaaggcaaatggaacctcgaacagcgcgacggtaaaactggcgaagagattgagctacgtctgagcctgctgggcagccatgatgaagtggcgaacgtcggcttcccgtacttcggcggcgaagggtctgagcactttaacaaagtcgatctggaaaacattctgctgcacaaactgccggccaaacgcctgcagctggccgacggctctaccgccctggtcaccaccgtgtatgacctgaccatggctaactacggcctggagcgcggtctgaacgatgacaactgcgccgccggctacgatgaagtgaaagcctacaccccggcgtgggcggagaagatcaccggcgtctcccgcgcgcatatcatccgtaccgcccgtgaatttgccgataacgccgataaaactcacggtcgttcgatgattatcgtcggggcgggcctcaaccactggttccacctcgacatgaactaccgcggcctgatcaatatgctgatcttctgcggctgcgttggtcagagcggcggcggttgggcgcactatgtgggccaggaaaaactgcgtccgcagaccggctggcagccgctggcgttcgcccttgactggcagcgtccggcacgtcacatgaatagtacctcgtacttctataaccactccagccagtggcgctatgaaacggtgaccgcgcaggaactgctgtcgccgatggcggataaatcccgttacagcggccacctgatcgactttaacgtgcgcgcagagcggatgggctggctgccgtcggcgccgcagcttggcgtcaacccgctgcgtatcgcggacgaagcgaaaaaagccggcatgaccccggtggattacaccgtgaagtcgctgaaagagggctcgattcgctttgcggccgagcagccggaaaatggcaaaaaccacccgcgtaacctgtttatctggcgttccaacctgctgggctcctccggtaaaggccatgaatacatgctcaagtacctgctgggtaccgagaacggcattcagggcaaagacctgggcaagcagggcggcgtgaagccggaagaagtcgaatggcgggataacggcctcgacggcaaactggatctggtggtgaccctcgatttccgtctgtcgagcacctgtctctactccgacatcgtgctgccgaccgccacctggtacgaaaaagacgacatgaatacctcggatatgcatccgtttattcacccgctgtcggccgccgttgatccagcctgggaatcgaagagcgactgggagatctataaaggtatcgcgaagaaattctctgaagtgtgcgtgggccacctcggtaaagaaaccgacgtggtgaccctgccgatccagcacgactccgccgcggaaatggcgcagccgctggatgtcaaagactggaaaaaaggcgaatgcgatctcatccccgggaaaaccgcgccgcatattattccggttgagcgtgattacccggcgacctacgagcgtttcacctcgatcggcccgctgctggaaaccatcggcaacggcgggaaaggcatcgcctggaacacccagagcgagatggatctgctgcgtaagctcaactacaccaaggcggaaggcccggcgaaaggccagccgaagctggaaacggccatcgacgccgcggaaatgatcctcaccctggccccggaaaccaacgggcaggtggcggtgaaagcgtggcaagcgctgagcgagatcaccggtcgcgagcatacgcacctcgcgctgaacaaagaagacgagaagatccgcttccgcgatattcaggcgcagccgcggaagattatctccagcccgacctggtctggcctggaagatgagcatgtctcctataacgccggttacaccaacgttcacgagctgatcccgtggcgcacgctgtccggccgtcaatcgctgtatcaggatcatcagtggatgcgcgactttggcgaaagcctgctggtctatcggccgccgattgacacccgttcggtgaaagcggtgatgggcgagaagtccaacggcaacccggagaaggcgctgaacttcctgaccccgcaccagaaatggggtatccactcgacctacagcgataacctgctgatgctgaccctgtcgcgcggtgggccgattgtctggatgagcgaagcggatgcgaaagatctgggtatcgaagataacgactggatcgaagtcttcaacgccaacggcgccctgacggcgcgtgcggtggtgagtcagcgcgttccagccgggatgaccatgatgtatcacgcgcaggaacgtatcgtgaacctgccgggctctgaaatcaccggtcagcgcggggggatccataactccgtcacccgtattacgccgaaaccgacccacatgatcggcggctacggccacctggcctatggctttaactactacggcaccgtcggttccaaccgcgatgagtttgtggtggtacgtaagatgaagaacattaactggttagacggcgaaggcaacgaccaggtacaggagagcgtaaaatga

SEQ ID NO: 3226 - DNA, 1938 bp, Klebsiella pneumoniae
ggacataaaatgcctgtaattacgcttcctgatggcagccaacgccattttgaccacgcagttagtccgatggatgtcgcgctggatatcggtccaggcctggcgaaagctaccattgccgggcgggtaaacggtgaactggtagacgcctgtgacccgatcgaatccgattccactctctctatcatcaccgcgaaagatgaagaagggctggagatcattcgtcactcctgcgcgcacctgttaggccatgccatcaaacagctgtggcccaacaccaaaatggctatcggtccggttgtcgataatggtttctactatgacgtagacctcgaccacaccctgacccaggaagatatcgacgcgctcgaaaaacgtatgcatgagctcgccgagaaaaactacgacgttatcaagaagaaagtgagctggcatgaagcgcgtgaaaccttcgtgaaacgcggcgaaagctataaagtttctattcttgatgaaaacattgcccatgatgacaagcctggcctgtatcatcatgaagaatatatcgatatgtgccgcggtccgcacgtaccgaacatgcgcttctgccatcactttaagctgatgaaaaccgccggagcctactggcgcggcgacagcaacaataaaatgttgcagcgtatctacggcaccgcgtgggcagataaaaaagcgctgaatgcctacctgcagcgtctggaagaagccgccaagcgtgaccaccgtaaaatcggtaagcagctcgacctgtatcacatgcaggaagaggcgccggggatggtgttctggcacaatgacggctggaccatcttccgtgaactggaaacgtttgttcgttctaaactgaaagagtaccagtatcaggaagtaaaaggtccgttcatgatggaccgtgtgctgtgggaaaaaaccggccactgggacaactacaaagatgcgatgttcaccacctcttctgagaaccgtgaatactgtatcaagccgatgaactgcccgggtcacgtgcagatcttcaaccaggggctgaaatcctaccgcgacctgccgctgcgtatggcggaattcggtagctgccaccgtaacgaaccgtctggcgcgctgcatggtctgatgcgcgtgcgcggctttacccaggatgatgcgcatatcttctgtactgaagatcaggttcgcgatgaagtgaacgcctgtattcgtatggtctacgatatgtatagcacctttggcttcgagaagatcgtcgtcaaactgtcgactcgcccggaaaaacgtatcggtagcgacgagacctgggatcgcgcggaagcggatctggcggtggcgctggaagaaaataacatcccatttgaatatcaactgggtgaaggggcgttctacggcccgaaaattgaatttaccctgtatgactgcctcgatcgtgcatggcagtgcggtaccgtacagctggacttctctctgccgcagcgtttaagcgcctcctatgtgggcgaaaacaacgagcgtcaggtgccggtcatgattcaccgtgcgattctcggttctctggagcgcttcattggcatcctgaccgaagagttcgcaggcttcttcccaacctggattgcaccagtgcaggtagtggtcatgaatatcaccgattctcaggctgaatacgttaacgaattgacgcgtaaactacaaaatgcgggcattcgtgtaaaagcagacttgagaaatgagaagattggctttaaaatccgcgagcacactttacgtcgtgtcccgtatatgttggtctgtggcgacaaagaagtcgaagccggcaaagtggccgtgcgcacccgtcgcgggaaagacctcggcagcatggacgtaaatgaagtgatcgagaagctgcaacaagagattcgcagccgcagtcttcaacaactggaggaataa

SEQ ID NO: 3227 - DNA, 645 bp, Klebsiella pneumoniae
aacactttgattggggtcacgcagccgatggcacaactttatttctactactctgcaatgaatgcaggtaagtcgaccgctctgttgcaatcttcgtacaattaccaggagcgggggatgcgtaccgtcgtttataccgctgaaattgatgaccgctttggcgccggaaaagtcagttcacgtatcgggctctcctcgccggcccgattgtataatccacagacctcgttatttgacgatattgcggcggagcaccagctaaagccgattcactgcgtgctggtggatgaaagccagtttctgacgcgtgaacaggttcatgagctgtccgaagttgtcgatacgctggatattccggtgctttgctatgggttgcggacggactttcgtggtgagctctttaccggcagccagtatttactggcctggtcagataagctggttgagctgaaaacgatctgcttctgcggccgcaaggccagcatggtattgcgcctcgatcaggaggggcgtccttataatgagggtgagcaggtcgtcatcggcggtaatgagcggtacgtatcggtctgccgtaagcattataaagaggcgctgagcgtcggttcgttaaccaaggtacaaaaccagcaccgtccctgctga

SEQ ID NO: 3228 - DNA, 399 bp, Klebsiella pneumoniae
acgcggctgatcgcccgcgggccgcttggagcagtaacggtgggtttagccgctgcggtcgaggtgcttggcgctgtacgcgccggcgccgtattgttgttttcaaacggcgaggccggacgcggctctgctgccggcttcacttcccgcttcggctgttcaacctttttctccggcttaggcttgggtttaggtttgggcttcggcttaggttccggtttatggatcaccaccggcgcctctttcggcggttcaggcactacctctggctccggctcaggttcgggttcaacaacgggctccacgacaggctgcgccgccggaggcggctcaagatcggccggcgccaccattgtgatctctatcggctgcgtcggagaaggctgttcaataacctga

SEQ ID NO: 3229 - DNA, 294 bp, Klebsiella pneumoniae
cgatatgtgatgagtttacgcatcagtatttttctggcaaataaaaacgcagcgaaagcggtagtcagttgctggcagaggtttataatgggggctgttttcactcgtagagtcgttgcaatgaagcgtagtagaacggaagtagggcgctggcgcatgctgagacaggtgaatcgccgtaaagcgcgctggctggaagcccaatcgcgccgcaatatgcggatcctcgctatcaggaagggactggtgaaacggcagcgtcatgccctgctgtttatcttccctgacagctaa

SEQ ID NO: 3230 - DNA, 507 bp, Klebsiella pneumoniae
attattgcgataaagagactagggacagagggatcatctgaaatgcgcttctggttcatgttggcggcggcgttaattttagccggctgcagcagccatcgggcaccgccgccgaatcctcggctggcagactccattacggtggtggcgaatctgaacgagcagctgcgtagctggcgcggcgcgccgtatcgctacggcggcatgacgccgcgcggcgttgactgctccggcttcgtggtgcgcacgtttcgcgataaatttgccctccagctgccgcgtgaaacccgcgagcaggcggaaatcggcacccgcatcgataagcgcgatctgctgcccggcgatctggtgttcttcaaaaccggctcaggggagagcggtctgcacgttggcatctacgataccgacaaccagtttattcacgcctccaccagccagggcgtcacccgttcctcgctggataacgtctactggaacaaaaagttctggcaggcgcggcgaatctga

SEQ ID NO: 3231 - DNA, 1320 bp, Klebsiella pneumoniae
agtcgggcgatttctctctggtcaaacagttggaggagcagggctatggctggcttaccgaacagcagtaacgcgctgcagcagtggcaccatctgtttgaagcgcagggcggcccgcgtaccccggaggccagtcagcatctgcagcagctgctgcgccttgggctgccgacgcgcaagcacgaggactggaaatacactccgctggatgccctacttaacggtcgctttgtcgccgatgagggggcctctctcagtgctgaacagcgtgatgcgctggcgctgccgctggacgcctggcggctggtgtttatcgatggccgctatcatcctcagctgagcgacgatcttgccgccagcggcgttgaggtcagtgtcgataatcagcgccagcatctgccggatgccctgcagccggaggtgtttctccacctgaccgaaagcctggcccagacggtgacccgtattcgcgtgccgcgcaaccgccgcctggataaaccgctgctgctgatgcatatcaccagtggcctggccggcgatgcgctgaataccgcccactatcgccatcatctggcgctggagagcggggcggaggcgacgattgtcgagcattacctgagcctcaatgagcagccgcatttcaccggcgggcgattgaccatgacggtggccgataacgcgcacctccagcatatcaagctggcatttgagaatgcccgcagctatcacttcgcccataacgacctgctgctgggccgcgacgcctcggccttcagcagcagtttcctgcttggcggccaggtgctgcgtcaccagaccagcacccgcctgggcggcgaaaacagcaacctgcgcctcaattcgctggcgatgccggtgaaaaatgaggtctgcgatagccgcacctggctcgaccatcaggtcggctactgcaccagccgccagctgcacaaaaccattgtcagcgataaggggcgggcggtgtttaacgggctgatcaacgtcgcgccgctcgcgctgaaaaccgacggccagatgaccaacaataatctgctgctcgggcggctggcggaggtcgacaccaaaccgcagctggaaatttacgccgatgacgtgaaatgcagccacggggcgacggtggggcgcattgacgaagagcagctgttctatctgcgctcgcgcggtatcgaacagcaggcggcgcagcagatgatcctctacgccttcgccgccgagctcaccgaggctatccgcagcgacgcgctcagagagcaggtgctggcgcgtattggacagcgtttgccgggaggcacagtatga

SEQ ID NO: 3232 - DNA, 756 bp, Klebsiella pneumoniae
ggaaaaaagatgttaagtattcaagatttacacgtcgccgtcgaagataaagcgatcctgcgcgggctgaaccttgaggtgcgcccgggagaggtccacgccattatggggccgaacggctcaggcaaaagtacgctttcggccaccctggccgggcgtgaagattatgaggtgactggcggtcgcgtcgaatttaagggcaaaaacctgctcgaactcgctgcggaagatcgcgccggggaaggtatctttatggccttccagtatccggtagagatccccggcgtcagcaaccagtttttcctgcagactgcgctgaatgccgtgcgcaactatcgtggccaggaggcgctggatcgtttcgatttccaggacttaatggaagaaaagatcaagctgctgcagatgccggaagatctcctgacccgctcggtgaacgttggcttctccggcggtgagaaaaagcgcaacgatattttgcaaatggcggtgcttgagccggagctgtgcattctcgatgaatcggattcggggttggatatcgatgccctgaaaatcgtctcccagggagtgaatgccctgcgcgacggcaaacgcgcctttatcattgtcacccactatcagcgcatccttgactatatcaagccggactatgtccatgtgctgtatcagggacggattgtgaagtcgggcgatttctctctggtcaaacagttggaggagcagggctatggctggcttaccgaacagcagtaa

SEQ ID NO: 3233 - DNA, 624 bp, Klebsiella pneumoniae
gctaaacggatgacgaaaaatacccccacccctgcaagccgtggtccccatgaccacagcgttcgggaccagattcttgacgcggccatggcgcactttagtcgctatggctatgagaaaacgacggtcaccgatctcgccaaagcgataggcttttccaaagcctatatctataaattctttgactccaagcaggcgattggcgaggcgatttgcgccagccggctggagaagatcatggtggccgtcagcgaggccatcgccgatgcgccgtccgccagcgagaaactgcgccgcctgttccgggcgctgaccgaggccggcagtgaactgtttttcgaggatcgcaaactgtacgacatcgccgccgtcgcggcgcgcgataaatggccttcaacggaacagtatgccggtcatctgcagcagctgattggtcaaatccttgtcgaaggccgccaggcgggtgagttcgagcgcaaaaccccgctggatgaagcgaccctggcggtgtatatggtgatgtgtcctttcatcaacccggtgcagttgcaatacaatctcgacaccgcgcccaccgcggcggtgctgcttgcctccctgatcctgagaagtctctccccctga

SEQ ID NO: 3234 - DNA, 1689 bp, Klebsiella pneumoniae
aacattattgtgaacagattattttcctcacatgtgatgcctttccgcgccctcatcgacgcttgttggaaagaaaagtacaccaccgcccgcttcacgcgtgacctgatcgccgggatcaccgtcgggatcattgcgattccgctggcgatggcgctggcgattggcagcggcgtgccgccgcagtacggcctctatacctcagcggtggcagggattgtgatcgccttgaccggcgggtcacgctttagcgtttccgggccgaccgccgcctttgtggtgatcctctatccggtgtcccagcagtttggtctggcgggactgctggtggcgacgctgatgtcggggatctttttaatcctcttcggcctggcgcgctttggccgcctgatcgaatacatcccgctgtcagtcaccctcggcttcacctcggggatcggtatcaccatcggcaccatgcagattaaagatttcctcggcctgcagatgccccatgtgccggagcattatctgcagaaagtggcggcgctggcgatggccctaccgaccattaacgttggcgatgccgccatcggcgtcgttactcttggcattctgatcctctggccgcggctgggtatccgcctgccgggccacctcccggcgctgctgggcggctgcgcggtcatgctggtggtcaacttgctcggcggcgatgtcgcgacgatcggctcgcagttccattatcagctggcggacggcactcagggcaatggcattccgcagctgctgccgcagctggtattgccctgggatatgccgggctcaaactttaccctgagctgggcctcgctgcaggctctgctgcctgccgccttctcaatggcgatgctcggcgccattgaatctctgctgtgcgcggtggtgcttgatggcatgaccggcaccaagcacaaagccaatagcgagctgattggccaggggctgggcaacattgtcgcgccgttcttcggcgggatcactgccaccgcggcgattgcccgctcggcggcgaacgtccgcgccggcgccacatcgccggttgccgccgtgatccacgccctgctggtgatcctggcgctgctgatcctcgccccactgctctcctggctgccactgtcggcgatggccgccctgctgctgatggtggcatggaatatgagcgaggcgcataaagtcatcaatctgctgcgccacgcgccgaaggacgacatcgtggtgatgctgatgtgcatgtcgctaacggtgctgtttgacatggtgatcgctatcagcgtcgggatcgtgctggcttcgctgttgtttatgcgccgtatcgcacgcatgactcatctggcgccggtcaacgtcgaggtgccagacgatgtgctggtgctgcgggtaattgggccgctgttctttgccgccgccgaaggcttgttcaacgatctggagacccggatcgccggcaagcgcatcgtggtgctgaaatgggacgcggtgccggttctcgacgccggtggcctggatgccttccagcgctttgtgaacaagctgccggaaggctgtgaattgcgcgtatctaacctcgagtttcagccgctacgcacgctagcgcgcgccggcgtcaagccgctgcccggacgcctgagcttctaccccgatcgtcaggccgcgctggctgacctgtga

SEQ ID NO: 3235 - DNA, 252 bp, Klebsiella pneumoniae
cgccggtctgttcaaccatctgcggctcggcggcatgcatctcgttcaggcgggtcagaaactccggacgcccggccgtatcctgctccaggcgctccatccagcgcgtcgccagacgcatcgcctgcggactgtccgtcgggcagccgctcgccatcagcgtctgcacctcctccgttagctcgcgccacgcctgcgcccgctgttcatcctgtgccgcaaacggcagcgcggctaactcctgttgactaa

SEQ ID NO: 3236 - DNA, 2454 bp, Klebsiella pneumoniae
ccagttaatgttcttcatcttacgtaccaccacaaactcatcgcggttggaaccgacggtgccgtagtagttaaagccataggccaggtggccgtagccgccgatcatgtgggtcggtttcggcgtaatacgggtgacggagttatggatccccccgcgctgaccggtgatttcagagcccggcaggttcacgatacgttcctgcgcgtgatacatcatggtcatcccggctggaacgcgctgactcaccaccgcacgcgccgtcagggcgccgttggcgttgaagacttcgatccagtcgttatcttcgatacccagatctttcgcatccgcttcgctcatccagacaatcggcccaccgcgcgacagggtcagcatcagcaggttatcgctgtaggtcgagtggataccccatttctggtgcggggtcaggaagttcagcgccttctccgggttgccgttggacttctcgcccatcaccgctttcaccgaacgggtgtcaatcggcggccgatagaccagcaggctttcgccaaagtcgcgcatccactgatgatcctgatacagcgattgacggccggacagcgtgcgccacgggatcagctcgtgaacgttggtgtaaccggcgttataggagacatgctcatcttccaggccagaccaggtcgggctggagataatcttccgcggctgcgcctgaatatcgcggaagcggatcttctcgtcttctttgttcagcgcgaggtgcgtatgctcgcgaccggtgatctcgctcagcgcttgccacgctttcaccgccacctgcccgttggtttccggggccagggtgaggatcatttccgcggcgtcgatggccgtttccagcttcggctggcctttcgccgggccttccgccttggtgtagttgagcttacgcagcagatccatctcgctctgggtgttccaggcgatgcctttcccgccgttgccgatggtttccagcagcgggccgatcgaggtgaaacgctcgtaggtcgccgggtaatcacgctcaaccggaataatatgcggcgcggttttcccggggatgagatcgcattcgccttttttccagtctttgacatccagcggctgcgccatttccgcggcggagtcgtgctggatcggcagggtcaccacgtcggtttctttaccgaggtggcccacgcacacttcagagaatttcttcgcgatacctttatagatctcccagtcgctcttcgattcccaggctggatcaacggcggccgacagcgggtgaataaacggatgcatatccgaggtattcatgtcgtctttttcgtaccaggtggcggtcggcagcacgatgtcggagtagagacaggtgctcgacagacggaaatcgagggtcaccaccagatccagtttgccgtcgaggccgttatcccgccattcgacttcttccggcttcacgccgccctgcttgcccaggtctttgccctgaatgccgttctcggtacccagcaggtacttgagcatgtattcatggcctttaccggaggagcccagcaggttggaacgccagataaacaggttacgcgggtggtttttgccattttccggctgctcggccgcaaagcgaatcgagccctctttcagcgacttcacggtgtaatccaccggggtcatgccggcttttttcgcttcgtccgcgatacgcagcgggttgacgccaagctgcggcgccgacggcagccagcccatccgctctgcgcgcacgttaaagtcgatcaggtggccgctgtaacgggatttatccgccatcggcgacagcagttcctgcgcggtcaccgtttcatagcgccactggctggagtggttatagaagtacgaggtactattcatgtgacgtgccggacgctgccagtcaagggcgaacgccagcggctgccagccggtctgcggacgcagtttttcctggcccacatagtgcgcccaaccgccgccgctctgaccaacgcagccgcagaagatcagcatattgatcaggccgcggtagttcatgtcgaggtggaaccagtggttgaggcccgccccgacgataatcatcgaacgaccgtgagttttatcggcgttatcggcaaattcacgggcggtacggatgatatgcgcgcgggagacgccggtgatcttctccgcccacgccggggtgtaggctttcacttcatcgtagccggcggcgcagttgtcatcgttcagaccgcgctccaggccgtagttagccatggtcaggtcatacacggtggtgaccagggcggtagagccgtcggccagctgcaggcgtttggccggcagtttgtgcagcagaatgttttccagatcgactttgttaaagtgctcagacccttcgccgccgaagtacgggaagccgacgttcgccacttcatcatggctgcccagcaggctcagacgtag

SEQ ID NO: 3237 - DNA, 300 bp, Klebsiella pneumoniae
caacggggtgtagagatgagtaatgagattaccgcctgggtcgtcagcgtgaccttccatgaacaggcgctgacggagatcaatgaggtcagcaaccattttacccgtgccgggtttgtactgacgctcaatgatgaagagggcacgccccatgagctgggtaccaacaccttcggcctgctgagcggccagacggccgaggaagttaaggccctcagcgctggcctggcggaagcggcccttggccgcccggcggaaatcgctgtggccacattcgccgagtggttaaaagctcaataa

SEQ ID NO: 3238 - DNA, 231 bp, Klebsiella pneumoniae
caatgcgaagtggaagttattaaaatgccaaaaattaagaccgtacgcggtgctgctaagcgcttcaaaaaaaccggtaaaggtggttttaagcacaagcacgctaacctgcgtcacattctgactaaaaaagctaccaagcgtaaacgtcacctgcgtccgaaagccatggtttccaaaggcgatctgggcctggtctatcgcgtgcctgccgtacgcataagtcgttaa

SEQ ID NO: 3239 - DNA, 819 bp, Klebsiella pneumoniae
tttaagagagttttagtgatgaagaagttgtttagcctggcgttaatcgccacctctgtcgccctgctgagcgcctgctccccggatgaagataataaagtaaaagtcgctatcaataccgggccggacgaagccatctggaaagtggtggagcaggtggcgaaggataaataccacctcgacgtcgaagtggtctccttcaatgattatgtgctgcccaacgaagcgctgaacaacaaagatgtcgatgccaacgccttccagaccctgccgtaccttgaggcgcagtcgaaagaacgcggctataaatttgcggtggtcggtaaaacctttgtcttccctatcgccgcctattctcaccggatcaaaaatatcagcgaactgcccgaaggggcgacggtgaccatttctaatgaaaccaccaccctgggccgcagcctgctgctgcttcaggcgcaggggttactcaagctgaaaccgggcgtcggctatttacccaccacgctggatatcatcgacaatccgaaacagctgaaaattgttgaagtggataccccgcagctgacccgtacccttgacgatccgaacgtcagcctgtcaatcattaacaccaacttctccgcccaggcgggcctgtcggccgcccgcgacggtctgtttatggaggggccggattccccatacgtgaatgcgatagtcgcccgcgaggataataaggacagcaagaaaattcaggaattaaaagccgccttccagaccagcgaagtcgcggaaaaagcgaaggaagtctacaaaggcgacgcgatcaaaggctggtaa

SEQ ID NO: 3240 - DNA, 183 bp, Klebsiella pneumoniae
cctgcaatattaagaccactcgccggccaccagcgtatgcacattaaaggcgtcgctcatggattttccggtggtaggagcgccgggcgcaatattcgaaccagcctcaacgtcagtggctttggcgatacctacctgggtatgatcctgatgacccgatggcggaacgggcgtggcggctga

SEQ ID NO: 3241 - DNA, 651 bp, Klebsiella pneumoniae
caaatgttttcaataagccctgtatttttttgggctaacatttatgtacctgccgattttgaggattattgtgtgaataccctgaaaaaaaccgcattgctttctgtacttgccttatatattcctgtgtcgcaagccgcggctaaggaatacagtcttgatccacagcatacctcggttgtgatctcctggaaccatttcggcttctcaaaccctaccgcctatatctctgatgtttcagggaaactggcctttgataaagagaatccggagaaatcctcggtgaacgtcacgctgccagtgaaaaccattgacgctcacgtcaaggcgttaacggatgagtttttaggcaaagagtattttgatgttaaaacgtttcccgacgccactttccagagtaccaaagtggaaagcaaaggcgacaataaatatgatgtggaaggtaatttgaccattaaaggcatcaccaaaccggtggtcctgcatgccgtcctgaataagcaggatatgcacccaatggtgaaaaaagaggccattggatttgatgccaccggggtgataaaacgttcagactttaagcttgataaatatgtgccggcggtaagtgataacgtcaccatcacgttatccacggaagcttatgcaaaataa

SEQ ID NO: 3242 - DNA, 186 bp, Klebsiella pneumoniae
gaagatgaattgaattttcagggccactatttgtacgccccgttacgctactggcgcggtaaccattgtcttttcgtgcttatagaccggttgcccatgggctataagcagggctgccggttgttttatattaagccttgtaaccaaaaatgcgctaatactgacgagggttatttacccatgtaa

SEQ ID NO: 3243 - DNA, 1428 bp, Klebsiella pneumoniae
actaacacttctatccatttttgtgagcttgcgcaaactctgttaatgcctgtgtcgttccgtttgttgccaacgttgacctttctcctgctgttgccgggcgttcccgtctgggcgctgaccgccagcgacaccacccgccctgcgcaagcgcaagatccgctgcccgatatggggattgctccccaggttgatgacgacgcccggcactttgccgaagtggcgaagaagtttggcgaggccagcatgagcgacaatggtctgacggcgggtgaacaggcgcagctgtttgccatcagtaaaatcggcaatgaagtgagtcatcagctggagagttggctctcgccgtggggcaacgccaatgtcgacctgctggtcaataaagaggggaaattcaccggcagtaaagggagctggttcgtgccgttgcaggataacgaccgttatctgacgtggaaccagtactcggtgacccggcgcgagcacgatctggtgggcaacatcgggcttggccagcgttggcgggtcggcggttggctgctgggctataactcgttttacgataaagtgctgagcgaaagcctggcgcgcggcagcgttggcgccgaagcgtggggagaatatctccgcctgtcggcaaactattaccatccgctgggcgactggcagctacgcgataatcagactcaggagcagcggatggccgcagggtatgacgtcaccgcccaggcgcggctgccgttctaccagcacatcaacaccagcgtcagcgtcgaacagtatttcggcgatagcgtcgatctgtttcactccggcaccggctaccataatccggtggccgtctccgttgggctcaattacaccccggtcccgctggtcacggtgaccgctaagcataagcagggggaaaatggcgtcagccagaacaatgtgggcctgaagctaaactaccgctttggcgtaccccttaagcagcagcttgcggcagacgaggtggcgatcagcaactcgctgcgcgggagccgcttcgatagtccggagcgggataatctgccggtggtggagtatcgtcagcgcaaaaatctgacggtctatctggccacgccgccctgggatctgcagtccggggagacggtgcagttgaagctgcagatccatagtctgcatggcatcaaggcgctgcactggcagggagacacccaggccctcagcctgacgccgccggtagatgccagcagccccgatggctggagcatcattatgccggtgtggaacagtgaaccgggcgccgcgaaccgctggcgcctgtcggtggtggtggaggataaacaggggcagcgcgtctcctccaatgagatcgccctggcgctgaccgagccgctggtcaagtttaccacgccaggcgtctcctggacggactcgccttag

SEQ ID NO: 3244 - DNA, 432 bp, Klebsiella pneumoniae
cctccacattcgcgaggaaaaaagaagattcagaggattcgcgccgcctgggattgttccgcctgccggcaccctctactcttttgggacttgcttattgaggaatcccggatgaaaaaagctctgcttgccctgttcgctatcgccaccgttaccgccgccagcgcctttgcggctgataaaaccgacgtcccggcgcctgtcatcgataacggagtccgcccgccgatggagagggatcgtggccccctgccgccgttcccgccgcagcttccgccgcacagaccggtgctgttttcagccacggtagcaaccgatacgccagcggaaaccattaacaaactgaccgcgctgatccccgccggccaggcgaaacactacgaagtgcacgttgaggtggtgccggttggcgagggaaccgacagacaatag

SEQ ID NO: 3245 - DNA, 618 bp, Klebsiella pneumoniae
cagggtcaatcccacaatgaaagaggcgatattcatatgcaaagcgaggcgataaccggcgtcgtgctggcgggcggcagggccacgcggatgggcggcattgataaaggattacaggcgctaaatggtcgccctctctggcgacacgttgcggaagcattagccccgcaggtagatgagttagtcattagcgccaatcgtcatcttgaacagtggcgtgccagcggatttccggtctttcgagacatacaggagggttatcaggggccgctggccggaatgcttgctgtgatgcagcaggtcgcgagcccatggtttgttttttgcccctgcgacacgccgttcattccgtcctttttggtggagcgctttatccagcagagaggggacgcaccggtcgtttgggcccatgacggcgaacgggatcatcctgccgttgcattagttcatcgtcaaatcattcctgaactggaggcttatctggcacatggagagcgcagggtgatggtttttatgcgacaaatgggtgggcgcccggtgaatttcagcgatgtgaaaactgctttcattaatgtaaatacgctcgaagatttgcagcagatgcaggagccatcatga

SEQ ID NO: 3246 - DNA, 549 bp, Klebsiella pneumoniae
tgtaaatacgctcgaagatttgcagcagatgcaggagccatcatgatcccattactggcgatcgccgcatggagcggtaccggaaaaacaacattattaaagcgtcttatccctgagctttgcgctctaggattacgcccgggactgataaagcacacccatcatgatatggacgtggataagccgggcaaagatagctatgaactgcgtaaggcgggcgctgcgcaaactattgtcgccagcgaacagcggtgggcattgatgaccgagacgccagagaagccggaattagatctcacgtggctggtcagtcgaatggatgccagcaaactggacctggttttagtggaggggttcaaacatgaacccgtgccgaagatcctgctttttcggcaaaacagcggccatcgtgtagaagagctggtaattgatgagcataccatcgccgtggccagcgatgtatcgatcgcgacctcacttccgctgctggatttaaatgatgtaccacagatcgcgacatttattgtgagttggttagagaggcaatag

SEQ ID NO: 3247 - DNA, 963 bp, Klebsiella pneumoniae
aatcagcctcttgcgcagcttaaaggcgctctttgtcagcctaactttctgaataaactaactatgtcgagattactcgctgcgataacacttccgctgagtatcgccttaaccatcttagtcaccattatctgctctgtaccgatcatcgtcgccgggctgattaaactgctggtccccattccagcggtatggcgctctatatccgttttttgcaattttatgatgtactgctggtgcgaaaggctggcgctgctgttgcatctcaatccctggctaaaatgggacgtccagggtctggaaggcctgaacaaaaagaactggtatctgctgatcagcaaccaccacagctgggcagacatcgtggtgctgtgcgtgctgttccgcaagcatattccgatgaataagtacttccttaaacaacagctggcgtgggtacccttcattggcctcgcctgctgggcgctggatatgccttttatgcgccgctactcgcgcagctatcttattcgtcacccggagcgccgcggtaaagatgtcgaaaccacccgccgttcgtgtgaaaaattccgcgcgcatccgacgactatcgtcaattttgtggaaggctcgcgttttaccgaagaaaaaaagcgcgaaacgcgctctccttaccacaacctgttaccgccgaaagccgctggtatcgccatggcgctcaacgtactcggttcgcagttcgataaactgctgaacgtcacgctgtgctacccggataatcatacaagaccattttacgatatgttaagcggccgcctgacgcgcattgtggtccgtatcaatctggtccctattggcgaagagctgcacggcgattacgttaacgataagaactttaagcgcagcttccagcgctggctgaatggcctatgggaagagaaagaccgtcagttgactgacatcatgagggacaaagaacggtag

SEQ ID NO: 3248 - DNA, 489 bp, Klebsiella pneumoniae
ctaactcatctacctgcggggctaatgcttccgcaacgtgtcgccagagagggcgaccatttagcgcctgtaatcctttatcaatgccgcccatccgcgtggccctgccgcccgccagcacgacgccggttatcgcctcgctttgcatatgaatatcgcctctttcattgtgggattgaccctgttaacttgtccctatcaagagtaaggagcatgaccatgaaatgtaaacgtctgaatgaagtaattgaactcctccagccagcctggcaaaaagagcctgaactgaacctgatgcaatttttgcagaagctggcgaaagaggccggctatgatggcgaactgagcgatctttccgacgatattctgatctatcacctgaagatgcgcgactcttccaaagatgctgtcatcccgggtattcagaaggattatgaagaggactttaaaaccgcgctgctgcgcgcccgcggggtaataaaagagtaa

SEQ ID NO: 3249 - DNA, 387 bp, Klebsiella pneumoniae
gtcgacaaacagtggtccgtcgcgccagaggatattaccggcatggcagtcaccgtgcaggcgcaacgtgttcccgcggccgtgccattgctccatgacggcagcaatgagtttatcggtcgccttcaggaaatcggccttcaggccagaggggatcagcgtcgcctgctcaaacacctgacgcggttccagcaggtactcctgcacgccaatttccgggcgggcagtaaagcgctgtttgcagcccgtctggtgcaggcgccccagatagcggccaacccattccatctgatcaaggttatccgcttcgaactgacgaccgccaaggcttgggaaaacggcaaagtagaatccctgatgctgatgaagcgtgctgtcattaaataa

SEQ ID NO: 3250 - DNA, 201 bp, Klebsiella pneumoniae
aagggtcctaaggtagggaatttccctgtcgagttagtttccgccctgcccgaatggcgtaattattgcccagcctgtctccacccgaaaccacaggaatttgaacctcccgggaagatgcaagtgtacccgcggcaagccgataagacccccgtgaccctttactatagcttgacactaacatttggccctgatgtgtag

SEQ ID NO: 3251 - DNA, 315 bp, Klebsiella pneumoniae
cggctcctcctatctttatcgggcgtatcatgcgtttccgccgctgagctaacagcgcaagggagcccaccggggctaatgaccggcgtactgaatatgctgcgcagtttgatactgcagtatcaaccgactcatgccgtcgtggtctttgatgcgaaagggaaaaccttccgtgatgaattgttcgagcattacaaatctcaccgcccgccgatgccggacgatctgcgcgcgcagattgagccgttgcataagatggtgaaagcgatggggctgccgctgatggctgtcccgggcgtcgaagctgacgatgtg

SEQ ID NO: 3252 - DNA, 627 bp, Klebsiella pneumoniae
atcatgaaaaaagtttggctggcgctggctggtatgattctggcttttagtgcatccgctgcccagatcaccgacggcaagcagtacatcacccttgataagccgattgctggcgagccgcaggtgctcgagttcttttcgttctactgcccgcactgctaccagtttgaagaagtgctgcatgtctctgacaatgtgcgccagaaactgccggaaggcactaaaatgaccaaataccacgttgagttcctgggtccgctgggcaaggatctgacgcaggcatgggcggtggccatcgcgctgggcgttgaagacaaaattactgcgccgatgttcgaagccgtgcagaaaaaccagactgtgcagagtgtggctgacattcgtaaagtgtttgtcgacgctggcgtgaaaggggaagactacgatgccgcatggaatagcttcgtggtgaaatctctggtcgctcagcaagagaaagcggcagccgatctgcagctgcagggcgtaccggctatgtatgttaatggtaaataccagctgaatccgcaggggatggacaccagcaatatggatgtcttcgtcgctcagtatgcggataccgtgaagcaactggtagagaagaaataa

SEQ ID NO: 3253 - DNA, 1023 bp, Klebsiella pneumoniae
tatcctgaactattcgtacgattatcggatgtcaggatgcacgataaggcttttacttttcagacgcttcgcccggataccattatcgatgggttattcgatctgggtatgcgggtggactccggtctcaccccgctaaacagctatgagaaccgcgtttatcagttccaggacgaagagcgccatcgctatgtggtaaagttctatcgtcctgagcgctggtccgcagaacagatccttgaagaacaccagtttgcgcttcagcttgtagaagatgaagtgcccgttgctgcgccgctcttatttaatgacagcacgcttcatcagcatcagggattctactttgccgttttcccaagccttggcggtcgtcagttcgaagcggataaccttgatcagatggaatgggttggccgctatctggggcgcctgcaccagacgggctgcaaacagcgctttactgcccgcccggaaattggcgtgcaggagtacctgctggaaccgcgtcaggtgtttgagcaggcgacgctgatcccctctggcctgaaggccgatttcctgaaggcgaccgataaactcattgctgccgtcatggagcaatggcacggccgcgggaacacgttgcgcctgcacggtgactgccatgccggtaatatcctctggcgcgacggaccactgtttgtcgacttagacgatgcgcgtaccggcccggcgattcaggatctgtggatgctgctcaacggcgataaggctgaacagcgtatgcagctggagactattgtcgaggcctatgaggaattcagcccctttaacagcgatgaaatcgcgctgattgaacctttacgcgctatgcgactggtttattatctggcgtggttgctcagacgctgggacgatcccgctttcccggtcaatttcccctggttaaccggggaggattactggcgggggcagacgtcgacttttcttgagcaggtgaaggttctacaggaacccccgcttcagttaacgccaatgtattaa

SEQ ID NO: 3254 - DNA, 261 bp, Klebsiella pneumoniae
tgcaacggcaggatgatcccgttcgccgtcatgggcccaaacgaccggtgcgtcccctctctgctggataaagcgctccaccaaaaaggacggaatgaacggcgtgtcgcaggggcaaaaaacaaaccatgggctcgcgacctgctgcatcacagcaagcattccggccagcggcccctgataaccctcctgtatgtctcgaaagaccggaaatccgctggcacgccactgttcaagatgacgattggcgctaatgactaa

SEQ ID NO: 3255 - DNA, 585 bp, Klebsiella pneumoniae
cggccgttttttcggcggtccaacttcaccgctctcatagtcctttataacaatgcctggcacttccgccaccatcctactacggtgattgcaccccgatttacccgatgcaggaaaactatggcaaacaaacaacctgttcccctacccgcacaggttaccgacggcgactgggtggtcgttcgcggcggcggcgaacacaatcttaaaaacgtcaacgtcgctataccgcgcaacgcactggctgtgttttccagcgtgtcgggttccggcaagtcttcgctggcgtttggcactatatatgccgaggcgcagcggccctactttgaatcggtcgcgccctatgcccgcggattatcgatcatgccggcgtgctcgacgttgactgccgccggcggttgcgcttcagcagcagaacggtgccagcaacgcgtgctcgtcggtgggcaacgtgaccacgctttcaagccaggtacggatgatgtactcgcgggcgggcccctatccgtcggccagccgttgctgaatgccgaggacttttcggccaatacgccccaggtgacctgcccgtccagcacggcctag

SEQ ID NO: 3256 - DNA, 456 bp, Klebsiella pneumoniae
cctggcgcatcattttgcacaaaaaataaccgtattatggaaagggtaaaggacgacagaggaggaaccgtgatgaccgttgacagactataccgccaccttctgcagaagcttattaacgccaatatcgatattgacgcctatctgcaactgcgaaaggccaaaggctacatgtcagtcagcgaaaatgaccatctgcgtgataacttgtttgagctttgccgtgaaatgcgtgcgcaggcgccgcgcctgcagaatgccatttcaccggaggagagggatgtccttcgcctggccggcgaatcggtcgccgccgctgcactatgcctgatgagcgggcatcatgattgtccgctatacatcgctgttaacgtagagaagctagaacgctgtctgacaggattgacctcaaatattcataaattgaataaattggcgccaatcactcatgcctga

SEQ ID NO: 3257 - DNA, 1245 bp, Klebsiella pneumoniae
aacatgacgtccggtaaaagaaactaccttctgttgagtcttttcgatttcctctacctgttcgcctggtcgtcgaccatggctttcttcgttatctggaccacccagcatcttggcatcagcgccacgaagaccgggctgctttactcggtcaacgcctttatcgccctgctgatgcagcctttcttcggctttatctctgacaagttcggcctgaaaaaacggcttatctggctgctggtcgccctgctcctgccggtgggccccttctttatctacgtttacgcgccgctgctggtgcacaacttttggtttggcgccttgctgggagggatctatctggggatcatctttaactccggctgcggagtaatcgactcttatatcgataagatttcccggcgctatcagttcgaatatggtcgtgtgcggatgtggggctcgttaggctgggcagcggcggcctggattgtgggtaaatatatagacagcaatcctaatctggccttctggctcgccagcctcgccattgtcatcgccaccatctgctttatgctaaccaaaattgaattaaccgacgccgatgtggcgcgaagcgaatcgctgaaggtctctcatgcccttgagctggcgaagaatggtcagttctggatgctgctgctctttaccctgttcgtcacgcagatttacgacacctacgatcagcagtttgcccagtacttctcgctacagttcccgacgccggaggaaggcaaccgctggtacgggatcctcgcgtctattcaggtctgcggtgaaaccctgttcctctgcctgatgccatggtttgttaaccggaccggcgccaaatgggcgctgatcatcgccgggctgatcatgtcggtacgtattgtcggctcagccgtgcccctcggcccggtgtggattggtgcggtgaaaatgatgcatgctctggagaagccgttgattctggtatcggtctttaaattcatcgccgccaacttcgaccacaagctctcttcgacggtctatttgctggtgctgttcgtcgcctcgatcgccaccgctatttactctccgctggcaggctatctgtacgataccattggcttcgccaacacctatctgattctcggcagcgtcgccgggctctttaccctgatctctattttcacgctgcaggataagcgcgagccgaaaaaaaccggcgccacgccctccgcagccattaacccggcgcaataa

SEQ ID NO: 3258 - DNA, 192 bp, Klebsiella pneumoniae
agtctccggtctttcttccatctcacaaagaggcacatcgccatgcgaaagacccgctataccgaagaacagatagcatttgcgctgaaacaggccgaaaccggcactcgggtggaggaagtctgcagaaagatgggcatttctgaagccacattttacatgtatggactacctccgttttgcaagtactga

SEQ ID NO: 3259 - DNA, 792 bp, Klebsiella pneumoniae
aaacactttccgggccctgtgacccaggagtgcccctggctgaagggagtaagcataaaaacctttaataacagccaaataaaaaagcttgccggatttttaactttatcccaacatgatcgccgatcgcgctgcaacagcagtgaaacaaactcaggagcgaaaatgattacactgtggggacgtaataactcgaccaacgtgaagaaagtacgctgggtgctggaggagctggatctgccttatcagcagatcctcgccgggctggagtttggtctcaatcatgacccggaatatctggcgatgaacccgaacgggctggtgccgttgttaaaggacgatgccaccggggtagtattgtgggaatcaaatacgattattcgctaccttgcggcccagtatggcgttgaccgtctgtggctggccgcgccggcgcagcgcgcgcaaggggaaaagtggatggattggtccaacggcaccctctctcccgcccatcgcccggtattaatgggcctggtgagaacgccgccggagcagcgcgacccggcggccatcgccgcggggatcagcgcctgcgaagcgctgttcgccatgctggacgacgaactggccaaaatgccgtggctctccggcgagcagttcggccttggcgatattgccgtcgctcctttcgtctacaatctgttgtcgatcctcgacagctggcaaccgcggccccatctgcagcgctggtatcagcagattagccaacgtcctgcctggcgcgaagtagtgcagatcccggtgacctga

SEQ ID NO: 3260 - DNA, 354 bp, Klebsiella pneumoniae
agcggaaatccccttctttcgcccgccgctcgatcgccgccaccacctcattgccgaccaccaggcagcggatatcgcaccctttcgcttcggcaatgtattcctgcaccagaatatgagcgttcagtccgcgaaaggcgtcgatcacgctctccgccgcctggcgggtctccgccagcaccacgccgatcccctgggtgccttccaccagcttcaccaccagcggcgcgccgcccaccatggcgatcagatcgctggtgtcatccggggagtgagcgatgccggtcaatggcagatcgatgccctggcgcgccagcagctgcagcgagcgcagcttatcgcgagcgcgggtaa

SEQ ID NO: 3261 - DNA, 1425 bp, Klebsiella pneumoniae
gtcagcgatcccagcggcacattcgcgcaggtggcgattttacggtgcgtcaccgcatggatgccgtgcgccgcgatggtatccagcgtcgcctgcaggatgcgctcgcggcgctgcggatcgtttggtctacgggccatgattttcctcttccggtttatgtacaaatgtacacatacttgctactgttgtcttcactcttctcctttaaggcgtttacggatgacgacgcaattctcgcgcagagcgctgcagcttcggttatgggcgctgtttatgttctttttcatccccggcttgttaatggcctcctgggccacccgcacgccggcgatccgcgatctgttggcgctatccaccgcagagatgggcgtggtgctgtttggtctgtcggtggggtcgatgagcggtattctctgctcggcgtggctggtgaagcgctttggtacccgcaaggtcatccgcaccaccatgtccttcgccgtgcttggcatgctggtgctcagcctggcgctgtgggtcacttccgccccgctgttcgccttcggtctggctatcttcggcgccagcttcggctccgcagaggtcgctattaacgtcgaaggcgcggccatcgagcgggagatgaataaaacggtgctgccgatgatgcatggcttctacagctttggcaccctgttcggcgccggggtgggcatggcagtgaccggattcggtctgccggccgccccgcacatcctggcggctgcgctggtggctatcctgcccatcgccattgctatccgcgccattcccgacggcaccggtaaaaatgccgccgaagtcgcccacggtgaggcgaaaggtctgccggtctggcgcgacgcgcagctgctgctgatcggcgtcattgtcctggcgatggcctttgccgaaggctcggccaacgactggctgccgctgctgatggtggatggacacggctttagccccacctccggctccctgatttatgccggtttcaccctcggcatgacgctgggccgctttaccggcggctggtttatcgatcgctacagccgggtggcggtggtccgcggcagcgcagtgatgggcgccctcggcataggcctgatcatcttcgtcgataacccctgggtggcgggcatctcggtgctgctgtggggcattggcgcctcgctcggcttcccgctgaccatctccgccgccagcgataccgggccggacgcgcccaagcgcgtcagcgtggtggcgatcaccggctatctcgctttcctcgtcgggccgccgctgctgggtttcctcggcgaacacttcggcctgcgcagcgccatgatggtggtgctgggtctggtgatggtggcggcgctggtcgcccgcgcggtggctaagccacaatctgaacccgttatggagaacagctaa

SEQ ID NO: 3262 - DNA, 489 bp, Klebsiella pneumoniae
cggtcgtccccgggtcccgcgtggcactttataaccatgtatggcctgtatcctgtttttcctcatgattttggcgacccggtttctgctgcacacttcaccaatttcacgaagatcgccgtgaattcggcgataaccataaaccccaccactcagcgtataggagtcgcggatgagcgccagcagtcgctggttatccttttctccggcagatacagggttatggagccagacataaaatccggcacgggcaaccttgagaacccgacacattgtaacgatcgaccagatttcacggtgatcgttgataaagcggtacttcagtcgggctcccttgcaaagtaccgcgctgcctttttcagaatatcccgttcttcctcagtgcgtttaagctgcgctttcagcctgagaatttctgttctggcatccagtaagtcctgtgcctgttgcccattgttgtcaggcttaacagcgcggagccatttataa

SEQ ID NO: 3263 - DNA, 204 bp, Klebsiella pneumoniae
cgcacgtgcccttgttgcttccggatctctcgtgcgcaactgcatgccatgttcagtaggtcgaagtactggcaggatcgtcgacgcaggcgcatgtcggatgatactgaagcgctggcccgtatccatactgttatcggggctctgcccacctatggttatcgtcgtgtatgggcactgctgcgcaaacaatcagaaacatga

SEQ ID NO: 3264 - DNA, 327 bp, Klebsiella pneumoniae
gccgcaccgttatccgtcagccactcaacaggtgatgccggcaggctgttaccgaagcgacgctctactgcaaccagcatcacgtcctgtacggtttcactgtcatatccaccggtacttgccgccctgtacagtgcttcacgatcgcagcagtccagggcgaacgtgacctgcagtttttcgccattatcacagctgaatccgaagccgtcagagcaccaccgctggttactctttccctgtatgcgcccgcttcgatggcggtattgccggtttacgctcaagcagcagcgcattctgatgcatgatgaggtattttggcattga

SEQ ID NO: 3265 - DNA, 636 bp, Klebsiella pneumoniae
ctaattcgacctcaggagttttttaagatgataacactggaaaatgaagctcaaccccggtctatacagactcaggaaagcatttttattgaagaaaaagcttttcgttcccggatggtattagtgttcggtaacatcactgatacaattgcatctgagactgttcgcaggttgctgacactggacgcagaatcaagcgcccccattacaatgataatatcgtcacccggaggacatcttgagtcgggcgatgtaatacatgatgtgtcccgttttgtgtcttcaccggtcaatatggtaggtacagggtgggtaggtagcgcagccacgcatctataccttggcgccccccgtgaaagacgattctgcctaccgcagacgcgttttctcattcatcagccaagtggtggaactggaggggccgccagtgatatagcacttcaggctgcagaaatcattaaggcgcgagaacgcattgctcgtgtgattgctcgggaaagtggtcaaccgttagagcgggtacttgaggatattgaacatgatttgtggatgtccgcatctgaagcagttgaatatggattggtctctcgcatcattacccgtcgtgaagagcttctccatattgatgatcgctga

SEQ ID NO: 3266 - DNA, 840 bp, Klebsiella pneumoniae
gttctgaggccggctcagaagcgtcaggcggtgcattttctgcggcaggcttaccgtatcagtgtccgacggggatgcggactgctgatgcagagcagaaccgtataccactggcagagccggcgggatgatcgggcgataaccctgcgtatccgggaaatagcggaaacccggatccgctacggttgcccgcgtattcatattcagctgcgacgggaaggctggcctgttaaccacaagaaaacacaccggatttactgtctggaaaacctcaacatgcgaagaaagcgcccccgcaggcatgtcagtgcagcacatcgtcagcaacgtccggtcctgaccggagtcgatcagtgctggagtatggatttcgtgtcggataacctgtttaacggacgacgtttccgggcgctgactgtagtggataattttagtcgggagtgtgtggcgatccatgccggaaagtcgctgaaaggtgaggatatggtcggtgtgatggaaaggttgcgggtgctgggcaagcgcctgccggtacgtattcagacagataacggcagcgagtttatttcgaaaagtctggataaatgggcgtatgagcacggggtcacaatggacttctcccgccccggaaaaccaacggataacccgtttattgaatcatttaacggcagtctgcgggatgaatgcctgaacattcactggtttctctcgctggaagatgcgcaggacaaactcgacaactggcgcagggaatataatcatgaaagaacgcattcatcattaaatgacatgactccggctgaattcatccggagtctccggaaagacgaagatctctga

SEQ ID NO: 3267 - DNA, 330 bp, Klebsiella pneumoniae
tcgtgggtcaccatcacgcaggtcacgccaacgcgctcaagaatatccaccacctcgagctgcatgcgatcgcgcagctttttatccagcgcccccatcggttcatcaagcagcagcagcttgggccgtttcgccaggctgcgcgccaacgcgacgcgctgccgctggccgcctgagagttggtgcggcttacgtttggcaaactcctgcatatgtaccagggccagcatctcctgcacccgggcggtgatttccgccttaggcaggcggtcctgcttcaggccgaaggcaatattctgctcaacggtcatatggggaaacagggcatag

SEQ ID NO: 3268 - DNA, 1329 bp, Klebsiella pneumoniae
actttaaaaactttaccaactcgctgtttctttcaggtcatttgtacgctttactcaccggttgctgcggcgcggtcagagtggcgcggcatatttctgtttggaaaggatacttgggtggctcttatgatgcatgacgctttttcccttcgcggcctcgcggcaggttgcgcgctgttatttcttgtcgcacctgcggtgcaggctgcggaacaactccccgacgccccttcaattgacgctcgcgcctggatcctgatggactatgccagcgggaaggtgctcagcgaaggcaatgccgatgaaaaactcgacccggccagtctgacgaagatcatgaccagctacgtggtagggcaggcaataaaagcgggaaaaatcaaactgaccgatatggtgaccgttgggcgcgatgcctgggcgaccggcaacccggcgctgcgcggctcatcggtgatgttcctcaagcctggcatgcaggtttccgtagaagatctgaacaaaggggtcatcattcagtccggtaacgacgccagcattgcgattgctgactacgtagcgggcagccaggacgctttcgttagcctgatgaacggctacgccaaaaagatggggctgaccaacaccacctttatgaccgtccacggccttgacgcgccggggcagttcagcaccgcccgcgatatggcgctgctgaccaaagcgatgatccacgacgtaccggaagagtacgcggtacataaagagaaagagttcactttcaataaaattcgccagccgaaccgcaaccgcctgctgtggagcagtaacctcaacgccgatggcgtgaaaaccgggaccaccgccggggccggctataacctcgtctcctcggccactcagggtgatatgcgtttgatcgccgtggtgctggggaccaaaaccgaccgcattcgctttaacgagtcagaaaaactgctgacctggggcttccgcttctttgaaaccgtgacgccgattaaaccagatgccaccttcgttacccagcgcgtgtggtttggcgatagcaatgaagcgaaactgggggctggcgaggcgggctctatcactttgccgaagggccagctgaaaaacctgaaagccagctataccttaaatcagccgcagcttaccgcgccgctggagaaggggcaggtggtcgggactatcgactttaagctaaatgataaaaccattgaacagcgtccgctgattgtcatggagtcggtaaaagagggcggcttcttcagccggatgatcgacttcgtgctgatgaaactgcacggctggttcggcagctggttctcctga

SEQ ID NO: 3269 - DNA, 183 bp, Klebsiella pneumoniae
gtcagttccgcctgtctggtgtggggcaacaagaatatcagcacccagcaatgctgttatgcgcgcattctcaacaagattattgtcccagcaaatgagaataccaatacgcaccccccaaggcgtatcaaaaacagtaaaattatttccactggaaatgtttggatgctcaaaagcatgtaa

SEQ ID NO: 3270 - DNA, 273 bp, Klebsiella pneumoniae
tgccggcaggctgttaccgaagcgacgctctactgcaaccagcatcacgtcctgtacggtttcactgtcatatccaccggtacttgccgccctgtacagtgcttcacgatcgcagcagtccagggcgaacgtgacctgcagtttttcgccattatcacagctgaatccgaagccgtcagagcaccaccgctggttactctttccctgtatgcgcccgcttcgatggcggtattgccggtttacgctcaagcagcagcgcattctgatgcatga

SEQ ID NO: 3271 - DNA, 636 bp, Klebsiella pneumoniae
accattgttctatggttgctggtcggaggatatttcatgtcaacagaaattctgatcgcatttattatttatgcatttgttacctcaattacacccgggcctaataacactatgttgcttgcatcaggtctgaattatggttttaaacgtagccttccccatgttcttggcatcagcattggttttgctctaatggtcattgccgttggtactggtcttggtcgtgtgtttgaaaattggcctcaggtgtatatagccttacggatatgcggtgcgacttatttaatatatctggcatggaatatagccacagcgttgccgatgtcgaaaatatctgaatcatcagcgcgcccatttagcttctgggaagcagcaggatttcagtgggttaatcctaaagcatggattatggcaactggcgccattactacttatttacctcagggagagaatgttcgctctgtaatatttttatcgattttattcgcaagtattaatgcgccaagtgttagtatatgggtcacttttggagcgactctgcgtcactggttaaatgacataaagtatctccggattttcaacgtgtgtatggcaatgcttttattagcatctctttatcctttgctatttttatga

SEQ ID NO: 3272 - DNA, 1014 bp, Klebsiella pneumoniae
atgaggaaatatatgatggaaaaatgcattcgtgccgctacagtccaattttgtcaccgggccgatgacaagcagtacaatttatcggtcatagaaaatttcattattcaggctcatcgagaaaatgtgcagctccttgtatttccagaaatgtgcattactggatattggcatgtaccaaatctcacaactgaaactttaaatgacctggcagaacgagttgaagacagtccatcgttgtccagaattgtcactaatgccgtaaattatcatatggccataggtgtaggtttcatagagaagggaagcgacgatatattatataattcttacgcagtctgtatgccggatggtaagatccatatacataggaagttacatgcttttgagcatccaaacatttccagtggaaataattttactgtttttgatacgccttggggggtgcgtattggtattctcatttgctgggacaataatcttgttgagaatgcgcgcataacagcattgctgggtgctgatattcttgttgccccacaccagacaggcggaactgactcacgaagcccattcggtatgaaacctattgaggtcagtctctgggagaataggcataatgatccggagaagttaatggctgcttttcgaggagatagcggccgggggtggctaatgcgctggttgccctcacgggcacatgacaatggattcttcattctattcagcaatggtgtaggcctggataacggagaaatccgcactggtaacgcgatgattattgatccttacggcaggatcgtcagtgaagcattttcatatgaagatacgattgtatacgcagaacttgatcttggtctgcttactatgtccaccggacgcaggtggatccacggacgtcggccagaattgtacggtattatgtgtgaatctcagggctacgaacgggatgccagaacagctaggttttctgatgaagatccatctttttgtgccgaaaatggaagattattttag

SEQ ID NO: 3273 - DNA, 405 bp, Klebsiella pneumoniae
aggcaacatcaggaggatacggtgaaatctgagcgtagttgggccggcattatctgtggcttcgttctgttcattgtggtgtgcttatcgttgttgttacatatgaaaggggcatttcgcgccagcggcaacccggagctgggcctgctcttctttttgctgccaggggcggcggcgagctgtctctctcccggacggcgggtgctgcgtcctttgctcggcgcgatactggcggcgccggtctgcatggtgacgatgcggctgttcttcgtgacccaccggacgttctggcaggagatggcgtgggtgttgagcgccgtgttctggtgcgcgcttggggcattgtgctttttgtttatctgcgcctggcttgatacctggcgcagtcattcatcgagcaaataa

SEQ ID NO: 3274 - DNA, 768 bp, Klebsiella pneumoniae
cgcactctccaaagcctgaatccttgtctgacagagaaaaacgtaatgacgccgaccattgagctgctgcgcagccaccgttccatccgccacttcaccgatgcccccgtgagcgacgaacagcgcgcagagattatcgccagcgcgcaagcggcatctacctcgagttttttacagtgcacctccatcatccgtattactgacccggccctgcgtgaacgtttggtcccgctgaccggcggccagcagcacgtcgcccaggcagcggagttttgggtcttctgcgccgactttaatcgccacctgcagatctgcccacaggcgcagctggggctggcggaacagctgctgatcggcgttgtcgatacggcgctgctggcgcaaaacgcgctgaccgccgccgagtccctcggactagggggcgtctatatcggcgggttgcgcaacagcattgaggccgtcacagagctgctggagctgccgcagcacgtcctgccgctgttcggtctttgccttggctggccggcggataacccggacatcaagccgcggatgccggcggccatgctggtgcatgagaaccgctatcagccgctggataacgcgctgctggcggagtatgacgaacagctggcgcactattatctgtcgcgcggcagcaacgcccgccgcgatacctggagcgaccatatccggcgcactatcgtgaaagagagtcgtccgtttattcttgactatctgcataagcaggggtgggcaacgcgctga

SEQ ID NO: 3275 - DNA, 189 bp, Klebsiella pneumoniae
cttaatatccacgggttggctcctatatttccatacactttttatcacttaacccattactggtccgccgccgcagatattcccgtggcgaacgatacctcggtgtactatgcggatgccattcgttgtaatgttcgaaggcctccgcaaggttctttaccgatgttaacccatcgggtttcggcatga

SEQ ID NO: 3276 - DNA, 510 bp, Klebsiella pneumoniae
ttgtttgcgcagcagtgcccatacacgacgataaccataggtgggcagagccccgataacagtatggatacgggccagcgcttcagtatcatccgacatgcgcctgcgtcgacgatcctgccagtacttcgacctactgaacatggcatgcagttgcgcacgagagatccggaagcaacaagggcacgtgcgctattcacttttttggtggccatattcaacggcctctttcagcagctcgttttccattgtcttcttgcccagcagacgctgcagctgtttgatttgcttcatcgcagaagccagctccgacgcgggtacaacctgttctcctgcgacaacggcggtgaggctgccttcctgatactgcttacgccacaggaacaactgactggcagcaacaccatgctgacgggcgaccagcgacacggtcattccgggctcaaagctctgctgaacaatggcgattttttcctgaacgctgccccgtctgcgcttttctggacctag

SEQ ID NO: 3277 - DNA, 183 bp, Klebsiella pneumoniae
aaatccggcaagcttttttatttggctgttattaaaggtttttatgcttactcccttcagccaggggcactcctgggtcacagggcccggaaagtgtttttactattttacaggagtaatatctatagggtgttacgctacgaaggaaagggcgtgattatggtgtatcttattgataattaa

SEQ ID NO: 3278 - DNA, 1296 bp, Klebsiella pneumoniae
tgtgagggcaaattcatgagcaattcagtatcagttctagctttaagtttagagcaaaagcagtatgtaggtgatttcctggattgcatagtaggaagcctagacttatcagaaacacagtacagcttaatcaagagggcctatgaatcggtgggggcttatcttgctgggggagacgatcctatcctcgttggggcggagatttattctcaagggagtgttagattaaacactactgttaagcctaaaggaagcgaacagtatgacgtagatctgctttgttatctgccaaacgcaagtgttgcatccggttgggctgaagttcttgaagccgtgcgtgcacgacttgcaagtcatggtacctatagcgaaatgcttacccctttgccaagagggcaccgcattatgtacgctggcgaataccatctggacatcacacctggaattgacttcggttataactcttcagagcacagccatcctctcttgattcctgattcgcgtctccaggattggaaggaatcaaaccctgcaggttatgcgacatggtttgataacattacagagaaattaccgatatttgtaaggcttgaggttgcgtctgaaagcttcatcaaatcagcggcagtcaggcccttacccgatcatacccgtaagaaacttctgaaccgaatcgtgcaaattttcaaacggcatcgggatgtatgggctgctgaaggtgggaaagagcggattgatttaaaacccatctccgctatcattactacgctcgcggggcaagcctacagcaaaatttgtgatgaaggcaggagctattccactgactttgatgtactgctggatgtccttgagctgatgcctgactacatcagatacagttacggtctgtattttgtgcctaatccgagcatgccagaagagaactttgctgaaaaatggaacgttgaagagtccagaaaaggagaaaaactcagaaaaaattttgagttatggcataaaacgatcactgataacattacagaaattgcatcatctgttggagaagatcaacttcttgataatcttagtaaatacttcggagaaagacctgtcaaagcagttcgtgaggctatggttgtaggtgttaacgcggcacgtgatagcaatgatttgcgtgttttagcccttacaggagcgcttagcgcaggtgcagcaaatgtgcctgcaatggcacggacagtcccagagaatacattttacggtgggaatgctctttcttctgcccctgtgaaaaagaatacattttttggggactaa

SEQ ID NO: 3279 - DNA, 492 bp, Klebsiella pneumoniae
ctgaccatgaatgtctttttgcctaatcggcgccttacgcttgctgaacagtatcacgggcttcgcgcccgtttccctaactcacattgctacttaactggaaataataaaaaactggtctgggagggaaaactttcgccaggaccgtacagtcggtcgtatcttgtccggattgaatacgctcctccagaaactcccgattgctatgttatttccccaaatcttaaagaactggccaagagcaagaggatcccccacacatacgcgactgactcggaatcaaataaaacacaactatgtctttttttgccaaaacagaggcatccagaaaagcatgctgaatggcgtcctcagctccagttatccgacaccatcctcccgtgggcatcactatggctgttttattttgaacagtggctattttccggaaaatgggaaggtggcggggcgcatccgaatgaagatgatgcaggtatctactatgaagattaa

SEQ ID NO: 3280 - DNA, 1125 bp, Klebsiella pneumoniae
cgaaaggagaatgccatgcgtccgatcccactgctgttgatattgagcgccttagcgctaccagccctgagccaggccgcggtgcgggtggaggtattgcaaaaccggctggcccagccgtggggcatggcctttctgcctgacgatcagggcatactgatcaccctgcgcggcggcgagctcaagcgctggcagccgggtaaaggtctgtcggcgccgatagccggcgtgccgcaggtatgggccaacggccagggtggcctactggacgtggcgctggccccggatttcgcccagtcgcggcgggtgtggctgagctatgcggaaagcgacgccagcggtaaggcgggcaccgcggtgggctatgggcggttgagcgaggatgccacgcagctgacgaactttaccgtggtctttcgccagcagccgaagctctccgtcggcaatcattttggcggcaggctggtgttcgacggcaaaggatatttgtttatcgggctgggcgaaaataatcagcgcgccaccgcccaggatctcagcaagctgcaggggaaagtggtccgcctgacggagaccggaggtgtaccgccggataacccttttgtcggccgggctgacgccaggccggagatctgggcttacggcatccgtaatccacagggcatggcgatgaatccctggagcgaggcgctgtggctgaacgagcatggcccgcgcggcggagatgaaattaatattccgcaggcggggaaaaattacggctggccgctggcgacgcacggtattaactacagcggcctgcccattccggaagcaaaaggcaaaacggttccggggaccgaacctcccctgtatgtctggccggtctctcccggggtgagcgggatggccttttattcggcgccgacctttccccagtggcagcataagctgtttatcggcgcgctgaaggagacatcgctgattgtcctggcggtggacggtaatcaggtccgcgaggaggggagattactggaggcgcgcggaaaacgcatccgcgatgttcgcgtgggacccgacggctatctgtacgttttaaccgacgagtctaacggcgagctattgcggttgagtcccgaggcttag

SEQ ID NO: 3281 - DNA, 771 bp, Klebsiella pneumoniae
cgcagagggaatatggaaactcgccgtgacgaacgtatcagtcagctcattcaggcacttaaacgcagcgataagctgcatctgaaagaagccgcttccctgcttggggtgtcggaaatgaccattcgtcgcgacctcaatggccacagcggcccggttgtgctgctcggcggatacattgtgctggagccgcgcagcgccacccattacctgctcagcgatcaaaaaacccggctggtcgaggaaaaacgccgtgccgctcgccatgcggccgcgctgctggaggcccatcagatggccttcttcgactgcgggaccaccacgccgtggattattgacgccattgacgatgccctgcccttcaccggcgtctgctactccctgaacacctttctggccctgcaggaaaaaccccagtgccgcgcggtcctgtgcggtggggagtttcatgccagcaacgcgatttttatgccgctgagccttgaggataccctcagccatctgagccctgatatcgccttttactcggcggcggggatcgactgcgagcagggggcgacctgctataacctggaagagctgccggttaagcactgggcgatgcgtcacgcgcgctatcacgtgctggtggtcgaccacagcaagtttggcaaagtgcgtccggcgcgcatgggggcgttagcgaaatttgacgtgatcgccagcgatatctgcccggatgatgagctggtcgcgctggcgaaggcgcagcagatttccctactgtattga

SEQ ID NO: 3282 - DNA, 303 bp, Klebsiella pneumoniae
ttagattttgacataacaaaattactaacctcacatgtatctatcaaacaaacggccatcgggccgtttgttctatctttagctatcagggatgagagtatccgtaagggtaagcgcctctgtgaaggatccgacaacttcatgggggatagtaaatatatatgtcgaggctgctccttggagtatgatactctctcggatatctttatcagtaataatagtgataatggaccgacaatattcagacaacaactgctgattgtgcttcatccactcgaaacggtagatacgatcttcctttga

SEQ ID NO: 3283 - DNA, 795 bp, Klebsiella pneumoniae
acaaaatgtgaaggctttgcgccgctgaaatcgggtaagcttgatgcagcatgttttgttattggtagggggaatctaatggccaaaaccattctgctggtggaagatgacgaggatatagccacgctgctgcggctcaatcttcaggatgagggctatcagatcgtccatgaagccgacggcggccgggccctcgcccggctggagacgcaggtctgggatgcggtgatcctcgatttgatgctgcccggcgtcgatggtctggagatctgccggcgtatccgccagatgacccgctacctgccggtgattatcatcagcgctcgcaccagtgaaatgcaccgcgtgctgggcctggagatgggcgccgacgactatctggcgaagcccttttcactgctggagcttatcgcccgcgtcaaagcgctgtttcgtcgccaggaggcgatggggcagaatctgctgatggacgccgggcgcctgtcctgccatggcctgagcatcgacccgctgtcgcgcgaagtgaagctgcgcggcgagacggtggacctcacgccgcgtgaattcgacctgctgtattacttcgcccgccaccccggggaagtgttttcccgcctggcgctgctggagcaggtctggggatatcagcacgagggctatgagcataccgtcaatacccatatcaaccgcctgcgcagtaaaatcgaacgtgacccggccgagccggacatcattcttaccgtctggggaaaaggctataagttcgccccggtgacgcaagaggccgccccgtga

SEQ ID NO: 3284 - DNA, 225 bp, Klebsiella pneumoniae
attgtgggtgacaccgcacaatattacgagccgtgcgccatcgtcccgcatctcccctgttattcagcctgtgtatatattccgtttatgtttcagcaatgtgacaaacgatatactgacgtttttcaggctgttagccgtagactttatggtagtggatttcataacaacctgatctttaagacaatgccgcctttaactccgcaccgcttttatttagggtag

SEQ ID NO: 3285 - DNA, 1749 bp, Klebsiella pneumoniae
gcaaccttagaccaaataaccatttccttcaacaacttactagtaaatgagaagttggctttcgtgaatataaacgtcgcagatttgttaaacgggaattacatcctgttattattcgttgtacttgcattaggactatgcctgggaaaactgcgtctcggctcagtacaacttggtaattccattggcgttttagtcgtttctctattattaggccagcagcatttcgcgattaacaccgatgcccttaatctcggctttatgctgtttattttttgcgttggcgtagaagccgggcccaactttttttctatttttttccgcgacgggaaaaactacctgatgctggcgctggtgatggtcggcagcgcgatgctgatcgccatggcgctgggtaaagtgttcggctgggatatcgggctcaccgccggtatgctggcaggcgccatgacctccaccccggtgctggtgggcgcgggcgacaccctgcgccatttcggcctgcccagcgatcagctggcgcagtcgcttgaccatctgagcctcggctatgccctgacctatctggttggtctggtgagcctgatcgtcggcgcccgctatatgcccaagctgcagcatcaggatctgcagaccagcgcccagcaaatcgcccgcgagcgcggcctcgataccgattccaaacgtaaagtctacctgccggtgatccgcgcctaccgcgtcggcccggagctggtggcctgggcggatggcaaaaatctgcgcgaactgggtatttaccgccagaccggctgctatattgaacgcattcgtcgcaacggcattctggccaacccggacggcgacgcggtgctgcagatgggtgacgatattgcgctggtgggttacccggacgcccacgcccgcctcgacccgagcttccgcaacggtaaagaggtgttcgaccgcgatctgctcgacatgcgcatcgtcactgaagagattgtggtcaaaaaccacaacgccgtcggccgccgcctggcgcagctcaagcttaccgaccacggctgcttcttaaaccgggttattcgcagccagatcgagatgcctatcgacgataacgtcgtactgaacaaaggcgacgtgctgcaggtcagcggcgacgcccgccgcgtaaaaaccgtggccgaccgcatcggctttatctccattcacagccaggtgaccgatctgctggccttctgcgccttctttatcgttggcctgatgatcggcatgatcaccttccagttcagctccttcagcttcggcatcggcaacgccgccggactgctgttcgccggcatcatgcttggcttcctgcgcgccaaccacccaaccttcggctatatcccgcagggggcgctgaacatggtgaaagaatttggtctgatggtatttatggccggggtcggactcagcgccggcgccgggatcaataacggtctgggcgctgtcggcggccagatgctggcggcagggcttatcgtcagtctggtgccggtagtgatctgcttcctgtttggcgcctacgtgctgcgcatgaaccgggcgatgctgttcggcgccatgatgggagcccgcacctgcgccccggcgatggagatcatcagcgataccgcgcgcagcaacattcccgcgctcggctacgcgggcacctacgccatcgccaacgtgctgctcaccctcgccgggacgcttattgtgatcatctggccagggctacaataa

SEQ ID NO: 3286 - DNA, 1248 bp, Klebsiella pneumoniae
tacataatagatttcatgcaaaattattcgctttcaggccgccgcctcggaaggcaggcgctgttgttcccgttatgtctggtgctgtacgagttttccacttatatcggcaacgatatgattcagccgggcatgttagccgtggtgcaggaatttcaggtgggcaacgaatgggtacctacctcaatgactgcctatctggcaggcggcatgtttttacagtggctgctggggccgctgtcggatcgtattggccgccgtccggtgatgttgaccggcgtagtatggttcatcgtcacctgcctggcgacgctgctggcgcagaccattgagcagtttaccctgctgcgcttcctgcaggggatcagcctgtgctttattggcgcggtgggctatgcggcgatacaggagtcctttgaggaggcggtgtgtatcaaaatcaccgccctgatggctaacgtggcgctgattgccccgctgctggggccgctggtgggcgccgcctgggtgcatatcctgccgtgggagatgatgtttgtcctgttcgccgtgctggcggccatctcgttcttcggcctgcagcgggcgatgccggagaccgcgacgcggctgggcgaaaagctgtcggtgaaagagctgggccgcgactatcggctggtgctgaagaacctgcgcttcgtcgccggcgcgctggccaccggctttgtcagcctgccgctgctggcgtggattgcccagtcgccggtgattattatcagcggcgaacaggccaccagctatgagtacggcatgctgcaggtgccgattttcggggcgctgattgccggcaacctggtgctggcgcgcctgactgcgcgccggaccgtgcgctcgctgattatcatgggcggttggccgatcatgtttggcctgatcctctctgcggcggcgaccgtggtctcttcccacgcttatctgtggatgacggccggtctgagcttctacgccttcgggattggcctcgcgaacgccggcctggtgcgtttaaccctgttcgccagcgagatgagtaaaggcacggtctcggcggcgatgggaatgctgcagatgctgatcttcaccgtcggcatcgagctcagcaaacatgcttacgagctgggcggcaacgggctgttcagcctgtttaacctgctgggtggggtattatggctggggctgatgatttactttctgaaagataaaagcgtcggcaattcgcagcaggggtag

SEQ ID NO: 3287 - DNA, 429 bp, Klebsiella pneumoniae
aaccctggcctctggtataatgtgaacattatgaacaaatacactgctggactcagatttcacgatatctctgctttcccagcctgcgttttcattccggaaaggatatattcaggttatggagcgaaatggggaaaggaattactctatctatttagtttcaagaagccttttactttagtgttcattaacgcctttaacgaatcaaaggaagatcgtatctaccgtttcgagtggatgaagcacaatcagcagttgttgtctgaatattgtcggtccattatcactattattactgataaagatatccgagagagtatcatactccaaggagcagcctcgacatatatatttactatcccccatgaagttgtcggatccttcacagaggcgcttacccttacggatactctcatccctgatagctaa

SEQ ID NO: 3288 - DNA, 939 bp, Klebsiella pneumoniae
ggcccgccagagcgggtcttttcgcagaggtgcaggatgaaaattgccatattatcccgggatggaacgctttattcatgtcggcgcctgcgcgaagcagcgcaacagcgcggtcatcagatcgagatcctcgatccgctttcctgttatatgaacgtcagcccggtggcctcgtcgatccactacaaagggcgtcagctgccgcactttgatgcggtgatcccgcgcattggctcggcgatcacctactatggcaccgcggccctgcgccagtttgagctcctgggaagctatccgctgaacgaatcggtcgctattacccgcgctcgcgataagctgcgctcgctgcagctgctggcgcgccagggcatcgatctgccattgaccggcatcgctcactccccggatgacaccagcgatctgatcgccatggtgggcggcgcgccgctggtggtgaagctggtggaaggcacccaggggatcggcgtggtgctggcggagacccgccaggcggcggagagcgtgatcgacgcctttcgcggactgaacgctcatattctggtgcaggaatacattgccgaagcgaaagggtgcgatatccgctgcctggtggtcggcaatgaggtggtggcggcgatcgagcggcgggcgaaagaaggggatttccgctctaacctgcaccgcggcggcatggccacggtggcgcagattagcgacgaggagcgggccattgccatcaaggcaacgcaaactctcgggctggacgccgccggtgtcgatattttacgcgccgcccgcgggccgctggtgatggaggtgaatgcctcgccggggctggaaggggtggaaaccaccaccggcgtggatgtcgccggcaagatgatcgcctggatcgagcgccaggcgacgccggaattctgtttgaaaataggcggctaa

SEQ ID NO: 3289 - DNA, 207 bp, Klebsiella pneumoniae
agccctgcagaaggtcagaaatttgatttaattatcgacgagagggctctccggtcgccattcatttatgaagatatggggatcctcgcccctgctggtgaatgcttctatcatgcaaactcctcgttctatataagagttaattgcataatcttagcggccgttttttcggcggtccaacttcaccgctctcatagtcctttataa

SEQ ID NO: 3290 - DNA, 429 bp, Klebsiella pneumoniae
aaaataggagaaattaaagtgttgaagagagtcgaattgataatagaacataacgggatatggatcatagcgcgtatcttattagcgatggtgtttctttcatcgggtgcggcaaaaatgattgattttcaggggggaatgagcgaaatgcgtgctgcaggactacatcctgactggcttttcaacattgttacagcactgcttctgctcatcagctcactattcatcatactcgacaaagctctttgggtaggaacggtcgcattgagcattttcctactgctaacaattgtcgtggttcaccatttctgggatatgccgcaaccagattccacacaagccatgttctgggccgtggagcacgtttctcttgtaggtggattgctttcggctgctattgctagtcgctccagacgaaaacttatttag

SEQ ID NO: 3291 - DNA, 624 bp, Klebsiella pneumoniae
ttgctatcggaccaacgagcctggaagcctatgctggaaaaaattaactatgcgctgttcgccctgctcaacgcgacgcctgcctcgccgcagtgggccattgagatggcgatcttcatcgctaaagatctgattctgatcgtacctctgctggtggtgacattgtggctgtgggggcctgcccagcggcagatggtgtttaagctgatgctggcgctgacgatcagcctgaccgtgtcgtgggcgatcggccatctttatccgcacgatcggccgtttgtcgccggcgtaggctataacttcctgcaccacgcggcggacgactccttccccagcgaccatggcaccgtcagctttacctttgccctggccttcctgttctggcatcgcctgtggtccggcgccctgctgatggccattgccgccgccatcgcctggtcccgtgtctatctcggcgtgcactggccgctggatatggtcggcgggctgctggccgggatgtgcggctgccttggcgcggcgctgatctggcacacgttcggcccggcgctataccatcagctgcagcggctgtatcgtctctgcttctccttgccaatccgcaaaggttgggtgcgcggctaa

SEQ ID NO: 3292 - DNA, 759 bp, Klebsiella pneumoniae
cgaacaaaggagggtataaaaatgaaatttgaaaaatcatttaaaatcatggcaatactagcgttttcagtttcagtaagcgcaacagcgtctaacgccaccgtatacgcacttcctgatgcaaaatcatttggcatcgccagcgaagaccaaaaaggtttgatgtttctaggaatggacaggaatgcggacctaaagggtgtttgtttcgccatgctgaaacaggctgaatcaagcatcccttatgctgatgtcatcgcaaccacaaataataaagacttccgcatgcatggcctgcgccccaacattcgtgacaataccaaagaggttgtatgctcctttggttccgatgcattcgactacctggataacctgtcaaaatccagtatgagtttggtcagtattcgctttaatggtgaacagcgtaatttcagttttaacaccagctctttcagtaagttactgacgcccagtggagccaaaatcgcagaacaagccgctgatgattataagcgaggtatccgcgctcctgtcttttacaacaaggctccatcttcagtcacagaaaatgaggacaggtatgcactaagtgaccagaaacttaatgaaatctggaacaaactcccctcagaaacccgtagaaaattactgccatcgcagcgggagtggattaagcaaaaagatacctgccgtagggacacagaatgccttaccgacatgaccaacagacgcatcaagatactcgaggtggcaagataa

SEQ ID NO: 3293 - DNA, 972 bp, Klebsiella pneumoniae
cggtgtgaggagagggcgatgaataccgttgaatccccgtcaggggcgaaaaaaccgggcggcttcgcgctgtgggcggcgcgcctgcagatggcgcatggccgcaagctggtgattgcgctgccctatctgtggctgatcctgttgtttatgctaccgttcctgatcgtgttcaagataagtcttgccgagatggcgcgggcgatccctccctacaccgagctaatggagtgggcggacggccagttgacgctgacgcttaactttgccaacttcctgcagttgactgacgatccgctctattttgaagcttatctccagtcgctgcaggtggcgggtatctcgacgatctgctgcctgctgctgggctatccgctggcctgggcggtggcgcacagcaagccgtcgacgcgtaatattctgctgctgttggtgatcctcccgtcgtggacctcgtttttgatccgcgtctatgcctggatggggctgctgaagagcaacggggtgttgaataacttcctgctgtggttaggggttatcgatcagccgctggagatcctgcacaccaacctggcggtgtacatcggtatcgtgtatgcctatctgccgtttatggtgctgcctatctacaccgcgctgacccgcatcgactattcgctggtggaggcctcgctggatctcggcgcccggccgctgaagaccttcttccaggtgatcgtcccgctcaccaaaggcggcattatcgccggctccatgctggtgtttatcccggcggtcggcgagttcgtgatcccggaactgctgggcgggccggacagcatcatgattggccgcgtgctgtggcaggagttctttaacaaccgcgactggccggtcgcctcggcggtggcgattgtcatgctgctgttgctgatcgtgccgatcatgtggttccacaagcaccagcaaaaacagatgggagagcagggatga

SEQ ID NO: 3294 - DNA, 300 bp, Klebsiella pneumoniae
ccgcagcgggaagaggtagtccatcccattaactggaagaagaaattcgccggtctgggcgtgaccgaactgcggcgtctgcggcaactggaggatgaaaatcagaggcttaagaaactggcagacctgagtctggacaaggagatgctgcaggaagttatcaaaataagttctgaggccggctcagaagcgtcaggcggtgcattttctgcggcaggcttaccgtatcagtgtccgacggggatgcggactgctgatgcagagcagaaccgtataccactggcagagccggcgggatga

SEQ ID NO: 3295 - DNA, 576 bp, Klebsiella pneumoniae
cagactgtttgcatggttgaaaggaagtacaatcacatgaaagataaagaaatttttatttctgtagatattgaatcatcggggccaattcccggagagtatagccttctatcaattggtgcctgcttgctttccgacccaaaggaatcgttttatacagaattaaggcccgacagccaaaagcatgatccagaagctgtagccattacgggtcttgatctagcatctcttaccctgtctggcttaccaccgctcgaagcgatggagcaatttaattcatggatcaattccgtgtccaaaccaaagcaacaaaccatttttgttggttttaatgccccatttgattggtcgttcatcaactattatttccataaatatctaggttttaacccatttggatttaccgcaattgatataaaagcatactatatgggacttaataagtgctcttgggaagacacgaaatcatccaaaatagttgaaaaactacgtccccatcttcgaaacaatcacaacgcattagaagatgctaaatttcaggcagaactattttcattaatgcttgctaccgattga

SEQ ID NO: 3296 - DNA, 957 bp, Klebsiella pneumoniae
caaccgcgactggccggtcgcctcggcggtggcgattgtcatgctgctgttgctgatcgtgccgatcatgtggttccacaagcaccagcaaaaacagatgggagagcagggatgaacgacttgccggtagtacgctcgccgtggcgcattctgatcctcgtgctcgggttcaccttcctctacgccccgatgctgatgctggtgatctactcgttcaacagctcgaagctggtaacggtctgggccggatggtcgacgcgctggtatagcgaactgttccacgatgatgcgatgatgagcgcggtaggattgagcctgaccatcgccgcctgcgcggcgacagcggcggcgatcctcggtaccatcgccgcggtggtgatggtgcgctttgggcgttttcgcggctccaacggcttcgcgtttatgatcaccgcgccgctggtcatgccggacgtgatcaccggtctctcgctgctgctgctgttcgtggcgctgggacatgccatcggctggccgtcggaccgcggcatgttgaccatctggctggcgcatgtcaccttctgtaccgcctacgtggcggtggtgatctcctcgcgcctgcgcgagctggaccactccattgaagaggcggcgatggatcttggcgccgcgccgctgaaggtcttcttcgtcatcacgctgccgatgattatgccggcggtgatctccggctggctgctggccttcacgctgtcgctggatgacctggtgatcgccagctttgtctccggtcccggggccacgaccttgccgatgctggtcttctccagcgtgcgcatgggggtcaacccggagatcaacgccctggcgacgctcatcctcggcgtggtcggtattgttggttttatcgcctggtatttgatggcccgcgcagaaaagcagcgagtgcgcgatatccagcgtgcaagacaaggctga

SEQ ID NO: 3297 - DNA, 1362 bp, Klebsiella pneumoniae
tgtactaaatgtactacaatcaaattattgtcatggatacattcaatgaaaaacaagtacaaaatgattgttgataaatacgttgatttaattcgatccggagaattgacagcagggacccggttacctacacacagggatctggctgccagtaagcgtatttcactggctacagctacccgggtctatgctgagttggagacaatgggcttagtcagtggggagatcggacggggaacctttgtcagagaaatatcactacctcctggacatggtatcgatcagcatgatgtagcggcgggtataattgacctcaattttaattatccatccctaccgggacagggagagttatttcgtgaagctctcagacaaatatctggttctggcgatattgaatcgcacttgcggtgccaaccgcatgccgggaggttatctgacaggcaaattattgcagggcatctttcgcgcggtgattttgagccaaaagcggacaacgtgattatagtcaatggagctcagcatgggttaaccgtcacagtaatgggactcctgagaccgggggatgttgtcgctgtagatgcgctaacatactcaggttttaaagttcttggtgcattgtatcatttggaactgatacctatcccggtaaaaaacaacggaccagatcttgaagccttgcgtcaaatttgtaggttaagacatgttcgagccatatatgtaatgcccactttacataatcctctgggttgggtactaagccatgagcaacgtaaagaaattgttaatattgcgcgttcaaatgatctgctaataattgaggatgctgcgtatcattatctggttaaaacccaacccccggcagttgctttttttgctccggaaagaactatatacgtcaccggcttttccaaaaatgtggcgacagggttgcggattggcgtaattatctgtccagaggtttatcgtcccgctcttgaaagagcagtaagagcaacaacatggaatacaccatctcttatcgtatcactggtctgcaattggattcaggacgggactgtgtcacggtttgaaacgctgaaaaggcgtgatgcacgtgagcgacagaggatacttaaggaaacgcttggacacatgacctgtctatcacatcctgattcgtattttgcatggttccctcttccggaagatatgagggctgacaacgttgttaaagtattaatggaaaataatatttcggtttcaactgccgaacctttctgtatttctcagaatgtacctcaagctatacggcttgcgctaggatccgtcagttatgaaaatctgcataaagccctgcagaaggtcagaaatttgatttaa

SEQ ID NO: 3298 - DNA, 1260 bp, Klebsiella pneumoniae
gcgagttttcgtaaacaatcccaacgtaatgtcttccatgaaaacggcgccacagggtggcgccgaccggaggctgctgtaccgattttaggtggttcagccttgtcttgcacgctggatatcgcgcactcgctgcttttctgcgcgggccatcaaataccaggcgataaaaccaacaataccgaccacgccgaggatgagcgtcgccagggcgttgatctccgggttgacccccatgcgcacgctggagaagaccagcatcggcaaggtcgtggccccgggaccggagacaaagctggcgatcaccaggtcatccagcgacagcgtgaaggccagcagccagccggagatcaccgccggcataatcatcggcagcgtgatgacgaagaagaccttcagcggcgcggcgccaagatccatcgccgcctcttcaatggagtggtccagctcgcgcaggcgcgaggagatcaccaccgccacgtaggcggtacagaaggtgacatgcgccagccagatggtcaacatgccgcggtccgacggccagccgatggcatgtcccagcgccacgaacagcagcagcagcgagagaccggtgatcacgtccggcatgaccagcggcgcggtgatcataaacgcgaagccgttggagccgcgaaaacgcccaaagcgcaccatcaccaccgcggcgatggtaccgaggatcgccgccgctgtcgccgcgcaggcggcgatggtcaggctcaatcctaccgcgctcatcatcgcatcatcgtggaacagttcgctataccagcgcgtcgaccatccggcccagaccgttaccagcttcgagctgttgaacgagtagatcaccagcatcagcatcggggcgtagaggaaggtgaacccgagcacgaggatcagaatgcgccacggcgagcgtactaccggcaagtcgttcatccctgctctcccatctgtttttgctggtgcttgtggaaccacatgatcggcacgatcagcaacagcagcatgacaatcgccaccgccgaggcgaccggccagtcgcggttgttaaagaactcctgccacagcacgcggccaatcatgatgctgtccggcccgcccagcagttccgggatcacgaactcgccgaccgccgggataaacaccagcatggagccggcgataatgccgcctttggtgagcgggacgatcacctggaagaaggtcttcagcggccgggcgccgagatccagcgaggcctccaccagcgaatag

SEQ ID NO: 3299 - DNA, 444 bp, Klebsiella pneumoniae
tgcctgcaacgggcggggagggaaagaaggttctgccttttacttcgatggtttacggctatgtttgataaatgtcggactgtcaaaacccgtatactggcccgacggcgcggtggaattggctggcgcgccgcgtttatcaaccggagaggcgtgatgcgaaaatttgccccattgccgaaaagcatactgctggttgagatcctcgggatggggctgttaaccctcgcctggctctcccttaaccagtatgtccagctgcctgcgcccattgccagcccgaccgcggcgctggtgatgctctttgccgggatcgtgctgatgatccccgccgccctcgtcgtgatgtggcggatggcgcagatcgtggccccgcagttaacgcactctccaaagcctgaatccttgtctgacagagaaaaacgtaatgacgccgaccattga

SEQ ID NO: 3300 - DNA, 630 bp, Klebsiella pneumoniae
tggaaaagtaggatgcaaaaaactcacaaacatttgaccaaaatagttacaatttctctgtcattagcgtttgcagtgcttgttgttcatggtgtccttacatcacttccgaaccatgacacagaaactccaaatcttaaagcaacggtaactcaagtacctctaaaaccagcagaaccggaaatggtcaacgttgttaatcggatacatactcctgaagaggtttacaggcgtttccaggacaacgaattcagggctaccaatcacttcagaacttgccgattaatggtcacaggtagggtaaagaacattggaacagccacctttaccaaagatccattggtcactatagctatccctggctcagacgaagggatgaagtttatctttgagaacacctcaagtaactggaatgaagttgcggcattggaaattgatgacattttgaccatatcgggaatggatacccggaaaggccagtttggaggcttgtttctttcaaatgcagaaataatgaacactttgcattctagaaacagtagagagatgatggttgaacgtaatggtttctacgaccgtattttatgtgagaagagagcaatccaagcagatataagtgactataattaa

SEQ ID NO: 3301 - DNA, 1005 bp, Klebsiella pneumoniae
gccggcctcagaacttattttgataacttcctgcagcatctccttgtccagactcaggtctgccagtttcttaagcctctgattttcatcctccagttgccgcagacgccgcagttcggtcacgcccagaccggcgaatttcttcttccagttaatgggatggactacctcttcccgctgcggttaactgtacgaaatgtgctcaccaggagaatcaccatgaatatcgtatttctgggtattgatctggctaaaaatgtttttcagctctgcgggttaaaccaggccggcaaaccggtttttacaaaacgaactggccgaaaagaattgctccagacgctggcaaatattcctgcatgtctgattgggatcgaagcgtccagcggggcattttactggcagcgtgagtttgagaaactggggcacaaagtaaaggttatcagtcctcagtatgtaaaaccctttgtccgcgggcaaaaaaatgatggtaatgatgcacaggccatcgcagtggctctgatgcaaccgacaatgcagttcgtgccaccaaaaagccccgaacagcaggatatccaggctttacaccgggcaaggcagcgtattgtcaatcaccgcactgctacagtctgtcaaataagagggctgctacttgaccgggggatccccattggcagtgctgtctccagagctcgccgggctattcctcttatccttgaagatgcagaaaacggtctaagttcccgtatgagcagaacaattgccgagctctatgatctctttaacgatctcgagcgtcggatccatttttttgataaggaaattgaaacagtattcaggcaatcagaagcctgtcagcgtatcgccagagttaaaggcattggccctaaaacggccacggccgttgttgctgctattggcaaaggaactgtaagaatggccgccactttgctgcatggctgggtctggttccacgccagcattcgagtggcgacagacaggtgctga

SEQ ID NO: 3302 - DNA, 201 bp, Klebsiella pneumoniae
ttacaccccagcctgtcgctgggcttttttttcaaggcgactctggatggtgataaattttacaaatacattcataacagcgcatccacagccgtggcctttacagaagtattgctctcaaaaccccgggccgctctgattctgttgcccgttattaatcacgctggtttgatgaaaaggttaacatctcttcccgggtaa

SEQ ID NO: 3303 - DNA, 207 bp, Klebsiella pneumoniae
gacttctacagcagcaagtcagatgtggttattgtgagttcggaagttgaactgggcctcatggaatgcaaccgggccgacattttgagttttgtgaagggtatcagcagtaacaaccatccccggttctcaggtgaggggggtaggggcgaggcgactggatatcactggccaggctttcgcttacccaacacggccccgccataa

SEQ ID NO: 3304 - DNA, 537 bp, Klebsiella pneumoniae
aatcggtacagcagcctccggtcggcgccaccctgtggcgccgttttcatggaagacattacgttgggattgtttacgaaaactcgctcatcgcatgcccgccttaacgtccctgcgctggtgcaggtggcggcctttgctattattttgattcgtggcctggatctgctgatgatccttaatctgttgggcctgcaggggctgaacgaattcatacaccgcagcgttcagacctggaacctgacgctggtctttctcggcagcctggcgctggtgtttatcgagatctggtgcgccttctctctggtgaaagggcgcaactgggcgcgctggatctatctgctgacgcagattatcgctgccggctacctgtgggcggcgtcgctgggctacgggtatccggagctgttcagcattcccggggaatcaaaacgagagattttccactcgctggtgatgcaaaaactgccggatctgctggttctgacgctgctgttcgtgccggcgaactgccgtcgctttttccgcctgcaataa

SEQ ID NO: 3305 - DNA, 605 bp, Klebsiella pneumoniae
gtgataaaaagtgtatggaaatataggagccaacccgtggatattaagttattgcgtgcatttgttactctctcgcaactgaagcggtaccactcggcggctgaaaaactatgtgtcactcaaccggcattgactaagcagatacagacactagagtctttatcaggaataaccctatttcagcgaggccgtcatggggccagattgaccgttgcaggagaactgttactacaacgggcttctgaagtactggcatcctatgataatttccggactgatgtgtccagcattcagcaaggactagtgggtaaactgacggtaggcttcggtatttcatctttccgcgtggcccctgaaaaggttgctattttccgtgctctgtatccagacgtgcaagtgtccctgaatgatatgtcctcggcagtacagttccagaaactcgcagaagggcaacttcagacggggtttgttcggcttcctgcacctgaacgactggagagtaaaattctggcagaagaaaagctagttcttgccgtagcccacgagcatgatactgagttatctagtgcggcagagctgctaggttcgaggaagctcctgcaatc

SEQ ID NO: 3306 - DNA, 1137 bp, Klebsiella pneumoniae
cgggcgttgagaaggaaaagagatatgaccgcctttggtaaaaaatggttaacaggtctggttacgggtgcgctgatggccgtctctgccggttcgctcgccgccgaacaaaaaaccctgcatgtttataactggtctgattatatcgcgccggacacggtagcgaatttcgaaaaagagaccgggattaaagtggtgtatgacgtttttgattccaacgaagtgctggaaggcaaattaatggcgggtagcaccggtttcgacctggtggtgccgtcggcaagcttcctcgaacgccagctggcggcgggcgtgttccagccgctggataaaagtaagctgcccaactggaagaatcttgaccccgaagtgctgaagctggtcgccaagcatgacccggagaataaatacgccatgccttacctgtgggcgacgacgggtattggctacaacgtggataaggtgaaagccgttctcggcaaagatgcgccggtggacagctgggatctggtgctgaagccggagaacctcgaaaaactgaaaagctgcggcgtctccttcctcgacgcgccggaagagattttcgccaccgtgctgaactacctcggcaaagatccgaacagcagcaaagcggatgattacaccggcccggcgaccgatctgctgctgaagctgcggccgaacattcgctacttccactcttcgcaatatattaacgaccttgccaatggcgacatctgcgtggcgatcggctgggcaggggacgtctggcaggcggccaaccgcgcgaaagaggcgaagaacggcgtcaatgtctcctactttattccgaaggaaggcgcgctggcgttctttgacgtctttgccatgccggccgacgcgaagaataaagatgaagcctatcagttccttaactatctgatgcgtccggacgtcatcgccaaaatcagcgaccaggtgttctacgccaacggcaacaaggcttccacgccgctggtcagcgagactatccgtaacaacccggcgatttatccgccagcggatgtgttcgccaaactgttcacgctgaaggtgcaggatccgaagattgaccgcgtgcgcacccgcgcgtggaccaaagtgaagagcggcaaataa

SEQ ID NO: 3307 - DNA, 315 bp, Klebsiella pneumoniae
ttcaatatgaggtgttttgtgaaaagagttttcggtagattatcatcaatcaatgtacgtaaagtgctttggacatgtagcgaattgggcttgctgtttcaacatgaagaatgtgatattgatttgactgcatcagcgccgatgcaatcaggctttgtattcaccgaactaaaccccaatgctatagtacctatactgctggataacaagttcgtgctgtgggagtccaatatcatcatacgttaccttgctaatcgttatgaaggtactggaccctttttgggtcggtttttagaaccctggcctctggtataa

SEQ ID NO: 3308 - DNA, 282 bp, Klebsiella pneumoniae
ggtttaaggagagaagcaatgtttaccgttatttttggtcgtccaggctgcccttactgcgttcgcgctaaagaactggcagaaaaactgaccaacgagcgtgatgatttcaactaccgctacgtggatattcatgccgaaggcatcagcaaagctgacctggaaaaaaccgttggcaaaccggttgaaaccgtgccgcagattttcgtcgaccagaaacacatcggcggctgcaccgattttgaagcctgggcaaaagagaatctcggcctgtttgcctga

SEQ ID NO: 3309 - DNA, 189 bp, Klebsiella pneumoniae
caggtgtctggaaatataggggcaaatccacttgaaactgacgatgatctggccgcatttttcacatggcgggaaccgcgccgtgtttcaaaatccctgacggtacagtatgacaaagtactctatctgattgaagataatgaattaagccgcagagctcttgggaagtacattgaggtctggcattag

SEQ ID NO: 3310 - DNA, 834 bp, Klebsiella pneumoniae
acccgttatggagaacagctaatgagcatcaaactgattgcggtggatatggacggcacctttttaagcgatgccaaaacttacaaccggccgcgcttcctcgcccagtaccagcgaatgcgcgaacagaatattcgcttcgtggtcgccagcggcaaccaatattatcagctgatctcctttttcccggagatcgcccatcagatcgccttcgtggcggaaaacggcggctgggtggtgagcggcaatgaagacgtcttcaactgccaactgccggttcaccacttcaacgccgtggtcgaccatctgcagacgttgccgaatatcgaaatcatcgcctgcgggaagcgcagcgcctacaccctcaatcgctacaacgacgcgctgaagacggtggcggcgaagtattatcaccgccttgaactggtggatgattttaaccatctcgatgacaccatcctcaaatttggtctcaacgtgccagacagcctgatcccggaaattcagccgaagctgcacgtggcgctgggggacatggtcaccgcggtggccaccggctacggcagcatcgacttaattatcccgggtgtgcacaaagccaacgggctgcgcattttgcagcagcgttggggcattgaggatcacgaggtagtggcgttcggcgacagcggcaacgatatcgaaatgctgcagcacgccgggtttggctttgccatggccaacgcccgggaagacgtcaaagccgtcgcccgctatcaggcgccgcataacaacgaagaaggtgtcctgcagattattgataaggtgttggatcgcgaagcgccgttcgcctga

SEQ ID NO: 3311 - DNA, 1503 bp, Klebsiella pneumoniae
gttcgccccggtgacgcaagaggccgccccgtgatccgccgactgagcctcagccagcggctggcgctggtggtggtttccctgctgatgctatgcgcggtggcggtatgcgcggtccagttacacagcagcgcgcagtatggcaacgccatggtgcagcgtctgtcgtccgggctggctcaacagattgtcgcccgcgagccgttgctggacgcccacggcgaggtcaaccggcaaaccctgaagtcgctgtttgaccgactgatgacctttaatcccagcgtggagctctatctgctgtcgccggatggcgacctgctggccgatgcggcgccgccgggccatatccagcgccagcgtatcgacatggcgccggtgcaggcttttctcaccggcagtgcgtcgccggtgtatggcgacgatccgcgcagtcccgacggacgaaaagtcttcagcgccgccccgctgcgcgtcgacggccaactgcgcggctacctgtatatcattttgcagggggagacgtttaatcagctggcggccgacgcctggcaaaaaacgctgtggagcattgttctgtggacgctgctgctggtggccctgtttggcctgctggcaggggggctggcatggttctgggtcacccggccggtccgcctgctcaccgcccaggtggcggcgagcggccaggacagcatcagcgccatcaaaaccctggcggcccgcaggccggagccccggcctggtaacgaggtggcggtgcttgagaaccgctttattgaccttgcccggcagattgccgatcagtgggatcggctggccgacagcgatcgccagcgccgtgaatttgtggccaatatctctcacgatttgcgtacgccgctgacttcgctgctggggtatctggaaacgctgaccctgaaggatgaatggctgaccgccgaggagcgcaggcagtatctcaccatcgccctgcgccagggcaacaaagtgcgccatctttcgcagcagctgtttgagctggcgcgactggagcatggaggcattaagccgcagcgcgagcgtttcgcgatgggggagctgatttccgacgtggcgcagaagtttgaattaactgcccgcacgcgcgaggtgaacctgcatattgatgtaccgggaccgctgccgctgattaacgccgatgtgtcgatgattgagagggtggtgaccaacctgctcgataacgcgatgcggcatactcccgtcggcggggagatccgtctggcggtctggcaggagaatcaacagcttcaggtcgaagtggcagacaacggagcgggcgtcgatgccgcgttgcgcgacgatctgttccagcggccgtcggcgttgtctacccaggcatcgcgggaggatcgcggcgggttaggactgctgattgtgaaacgaatgctggagctgcacgggggcgatatcagactggtggagtcggtaagcggggcgcggttcaggttcttcgtgccactttga

SEQ ID NO: 3312 - DNA, 288 bp, Klebsiella pneumoniae
tggcgatacggcccgccatggtcatcgcctcttcctgatcgtgggtcaccatcacgcaggtcacgccaacgcgctcaagaatatccaccacctcgagctgcatgcgatcgcgcagctttttatccagcgcccccatcggttcatcaagcagcagcagcttgggccgtttcgccaggctgcgcgccaacgcgacgcgctgccgctggccgcctgagagttggtgcggcttacgtttggcaaactcctgcatatgtaccagggccagcatctcctgcacccgggcggtga

SEQ ID NO: 3313 - DNA, 345 bp, Klebsiella pneumoniae
aacggccacggccgttgttgctgctattggcaaaggaactgtaagaatggccgccactttgctgcatggctgggtctggttccacgccagcattcgagtggcgacagacaggtgctgatgaatatgacgaaaaaaggcgacaagcatctgcggacactttttattcatggtgccggcgctgtcgtcagggttgccacgagtaacaatgatgtctttatgaatcagtgggttaaccagttaaaggaacagcgcggatttaataaaacgaccgtggcggtcgctaacaaaaacgcgcgaataatctggtcgatgctgagaaatgagaccgagtatcaggtagtgtga

SEQ ID NO: 3314 - DNA, 261 bp, Klebsiella pneumoniae
tgtactcgcgggcgggcccctatccgtcggccagccgttgctgaatgccgaggacttttcggccaatacgccccaggtgacctgcccgtccagcacggcctaggccaaatgtatgacctgatagtgcccactccgaccctcagcatccgcgataaggctatcgcctcatggccgccggcctggcggggacaaaatctacgcgatattcaggtctcgctgggctatgacgtcgatacaccctggcaggcgctgccggagtag

SEQ ID NO: 3315 - DNA, 642 bp, Klebsiella pneumoniae
cgacatggcggtgatcaatgccaaaatacctcatcatgcatcagaatgcgctgctgcttgagcgtaaaccggcaataccgccatcgaagcgggcgcatacagggaaagagtaaccagcggtggtgctctgacggcttcggattcagctgtgataatggcgaaaaactgcaggtcacgttcgccctggactgctgcgatcgtgaagcactgtacagggcggcaagtaccggtggatatgacagtgaaaccgtacaggacgtgatgctggttgcagtagagcgtcgcttcggtaacagcctgccggcatcacctgttgagtggctgacggataacggtgcggcctaccgttctcatcagacgcgtcagttcgccagaatagtaggactggagcctgaacatacggcggtacgcagcccggaaagcaacgggatgacagagagcttcgtcaaaacggtgaagcgcgactacatcagtatcatgccgaaacccgatgggttaacatcggtaaagaaccttgcggaggccttcgaacattacaacgaatggcatccgcatagtacaccgaggtatcgttcgccacgggaatatctgcggcggcggaccagtaatgggttaagtgataaaaagtgtatggaaatatag

SEQ ID NO: 3316 - DNA, 495 bp, Klebsiella pneumoniae
gaggtcacaggcactatggattcactggtcgttccaggtctggatacgctacgtcgctggctggacgaaatcggcatcagcttttttgagtgcgattcctgtcaggcattgcacctgccgcatatgcagaatttcgacggtatttttgatgccaaaattgacctggtggacaacgtggtgctcttttccgccctggcggaggtgaagccgtctgccctgctggcgctgtcggcggatctctcggccatcaacgccagctcgttaaccgtgaaggcgtttatcgacattcaggacgataatttgcccaagctggtggtttgccagtcgctgtctatcggcccaggggtgaccatggagcagttcgcctggttcttccgccaaagcgaagagcagatctcgatggtaatcctcgaagccggcgcaaatcagctgctgtacaaaggcgaagaagaagagcctgcggcggaaaacgtgcaataccattttcttcactaa

SEQ ID NO: 3317 - DNA, 909 bp, Klebsiella pneumoniae
ggaagaacgggatattctgaaaaaggcagcgcggtactttgcaagggagcccgactgaagtaccgctttatcaacgatcaccgtgaaatctggtcgatcgttacaatgtgtcgggttctcaaggttgcccgtgccggattttatgtctggctccataaccctgtatctgccggagaaaaggataaccagcgactgctggcgctcatccgcgactcctatacgctgagtggtggggtttatggttatcgccgaattcacggcgatcttcgtgaaattggtgaagtgtgcagcagaaaccgggtcgccaaaatcatgaggaaaaacaggatacaggccatacatggttataaagtgccacgcgggacccggggacgaccgtcactgatagcgcctaaccgcgtacagcgtgaatttactgtagtaaagcccaatcaggtctgggtaacagatattacctatatccgcacctggcagggctggctgtatctggcagtggtcatcgatctcttcgcccgtaatgtggtgggctggtcgatgaaaccaacactgtcgcgcgagctagcactggatgcgttgctgatggcggtctggcggggtaagccctcagaagacgtcattgtgcacagcgatcagggtagtcagtatggcagtgatgactggcagcggttctgccgggccaacaatctggcgccaagcatgagccgtcgcggaaactgctgggataatgcagtggcagaatcgttcttcagttcactcaaaaaagagcgcatcaggaagcggatatataaaacccgggacatggcccgggcggatattttcgattacattgaagtgttctacaaccgtaaccgacgccacagccacctcggtggcgtcagcccggaggccttcgaaaaggcctcgccgtga

SEQ ID NO: 3318 - DNA, 1137 bp, Klebsiella pneumoniae
aggtcaattatgcattgcgcactctacgacgccggccgctgccgctcctgtcaatggctggagcggccggtcccgcaacagctcgccgataaaatggccgatctgcgcacgctgctggcggcgatcccggtcgcagcctggggcgagccggtcagcgggccggaggcggctttccgtaacaaggctaaaatggtggtcagcggcagcgttgagcgtccgctgctggggatgctgcaccgcgatggcactccggtggacctcaccgactgcccgctctatcccgccgagtttgccccggtttttgctgccctgaagccctttatcgcccgcgccgggttaacaccttacaacgtcgcgcgcaaacgcggggagctgaaatatctgctgctgaccgccagccagcagggggagatgatgctgcgcttcgtgctgcgctcagaggccaaggtggctcagctgcgcgccgcgctgccgtggctacaggcacagctgccgcagctcagcgtgatcacggcgaatatccagccggtgcatatggcaatcatggaaggcgagcaggagatcttcttcaccgaacagcaggcgctgggggaggtctttaatggggtgccgctgtggatccgcccgcaaagcttctttcagaccaatccggcggtagccagccggctgtacgccacggcccgcgactgggtgcgcgcgctgccggtccagcatatgtgggatctgttttgcggcgttgggggatttggcctgcattgcgcgacgccgacgatgcgcctgaccggtatcgagatcgccccggaagccatcgcctgcgctagacagtcagccgcgcagctgggactcagcaatctgcattttcaggcgctggactcgacgcagttcgccactcacgaagcggatgccccgcagctggtgctggttaatccgccgcgccgcggtattggcgctgaactatgcgactatttaagccgcatggcgccgccctatattatctattccagctgtaacgcccgcaccatggcgaccgatatcgctcgtcttagcggctatcgcgttgagcgggtccagctgtttgatatgttcccccacaccgcccactacgaagtgctgaccctgctggtccgcgaagtttaa

SEQ ID NO: 3319 - DNA, 294 bp, Klebsiella pneumoniae
gaggagtctatgggcacaccacgttttacccctgaatttaaggaagaagctgtccgccaaatcaccgagcggggctattccatctctgaagtatctgaacgactcggcgtttcggcgcacagtctttataaatggctccgcgctgttaagcctgacaacaatgggcaacaggcacaggacttactggatgccagaacagaaattctcaggctgaaagcgcagcttaaacgcactgaggaagaacgggatattctgaaaaaggcagcgcggtactttgcaagggagcccgactga

SEQ ID NO: 3320 - DNA, 1191 bp, Klebsiella pneumoniae
gcacgaagtatggcaccggaccatatggtgatcgtttttttgccggagagcacccgattgaacgacgtaatgccccgcccacaggcgaaagccccaaaagcgctgaccccgctactggaaatccgtaacttaaccaagtcgtttgatggccagcatgcggtcgacgacgtcagtctcactatctacaaaggcgaaatttttgctctgctgggcgcgtcaggctgcgggaaatcgacgctgctacgcatgctggcgggctttgaacaaccgaccgccgggcagattatgctcgacggcgtggatctggcgcgcgtgccgccctatcagcggcctattaatatgatgttccagtcctatgccctgtttccccatatgaccgttgagcagaatattgccttcggcctgaagcaggaccgcctgcctaaggcggaaatcaccgcccgggtgcaggagatgctggccctggtacatatgcaggagtttgccaaacgtaagccgcaccaactctcaggcggccagcggcagcgcgtcgcgttggcgcgcagcctggcgaaacggcccaagctgctgctgcttgatgaaccgatgggggcgctggataaaaagctgcgcgatcgcatgcagctcgaggtggtggatattcttgagcgcgttggcgtgacctgcgtgatggtgacccacgatcaggaagaggcgatgaccatggcgggccgtatcgccatcatgaatcgcggcaagtttgtgcagattggcgaaccggaagagatttacgagcacccgactacccgctacagcgccgagtttatcggctcggtgaacgtctttgaagggctggtgaaggagcgtctggaagacggtctggtgctaagctcgccgggactgatgcatccgctgaaggtcgaccccgacgcctcggtggtggacaacgtgccggtctgggtggcgctgcgtccggagaagatcatgctgtgcgatgaaccgccggcggacggctacaattttgccgtcggcgaggtgattcatatcgcctatctgggggatctctctatctatcatgtgcgcctgcaaagcgggcagatgatcagcgcccagctgcagaatgaacaccgccatcggaaagggacgcccacctggggcgatgaggtgcgtttatgctgggatgctgacagctgcgttgtgctgacggtgtga

SEQ ID NO: 3321 - DNA, 597 bp, Klebsiella pneumoniae
aattacgccatccgcattgttgctcatcgcatcaaaactattcaggaggggttaatgtcttcagttttgcaacatagtttcattcttactggtggcccagggtcaggcaaaagcacgataattgatacgattataaaacgcgggttttggtgttctcaagaagctggaagaggtgtgatacaagaccaggttaacatcggcggcgatgcattaccgtgggctaacaagaatgcatttgcagaactgatgctatcctgggaaatgcgttcgtggcatgaagcggaagggcaaacacaaccctgcttcttcgaccgtggtgttcctgatgttgcaggttatttacgtctttcggagcttaccataccgaggcatctggaaaacgccataaagaaatttcgctataaccgaatcgtatttattgctccaccctggcgtgacatatatgtacaggacacagagcgaaaacaatctttcgatgttgctgtcgcgacatatcacgcaatggtgaaaacgtatcgtatgtatgactatcaattaattgaattaccatgcacttcagtaggggaacgtgtggattttatcctttccaggatgtag

SEQ ID NO: 3322 - DNA, 375 bp, Klebsiella pneumoniae
gtgatagtcttaatactagtttttagactagtcgctggagttcggatgattgatgttctaggtccagaaaagcgcagacggggcagcgttcaggaaaaaatcgccattgttcagcagagctttgagcccggaatgaccgtgtcgctggtcgcccgtcagcatggtgttgctgccagtcagttgttcctgtggcgtaagcagtatcaggaaggcagcctcaccgccgttgtcgcaggagaacaggttgtacccgcgtcggagctggcttctgcgatgaagcaaatcaaacagctgcagcgtctgctgggcaagaagacaatggaaaacgagctgctgaaagaggccgttgaatatggccaccaaaaaagtgaatag

SEQ ID NO: 3323 - DNA, 195 bp, Klebsiella pneumoniae
ttgacctcaattttaattatccatccctaccgggacagggagagttatttcgtgaagctctcagacaaatatctggttctggcgatattgaatcgcacttgcggtgccaaccgcatgccgggaggttatctgacaggcaaattattgcagggcatctttcgcgcggtgattttgagccaaaagcggacaacgtga

SEQ ID NO: 3324 - DNA, 405 bp, Klebsiella pneumoniae
ggacacagaatgccttaccgacatgaccaacagacgcatcaagatactcgaggtggcaagataatggcttcagcaactcttatcaggctaaacaaagacgaatggcaaaaacttccagcaggccatttttataacggaaagtatcaggttggtccctttaccatcacctatgaatttatcgtcaaatatatggccctaatccacaaaacggaaataccggaatcctggcttaccgataacggtaccagtcttgatgaacgcagagttttgtacatggaagctagcgatattctgacaaaagatatcgtaagagaaattcgaaaaacagtgaaatcccctcaggaccaattacaggtttatcgcataaatgatcagatcataaccctcgaaatgatggaaaagtag

SEQ ID NO: 3325 - DNA, 870 bp, Klebsiella pneumoniae
ctagatggaatggatattaagttattgcgtgcatttgttactctctcgcaactgaagcggtaccactcggcggctgaaaaactatgtgtcactcaaccggcattgactaagcagatacagacactagagtctttatcaggaataaccctatttcagcgaggccgtcatggggccagattgaccgttgcaggagaactgttactacaacgggcttctgaagtactggcatcctatgataatttccggactgatgtgtccagcattcagcaaggactagtgggtaaactgacggtaggcttcggtatttcatctttccgcgtggcccctgaaaaggttgctattttccgtgctctgtatccagacgtgcaagtgtccctgaatgatatgtcctcggcagtacagttccagaaactcgcagaagggcaacttcagacggggtttgttcggcttcctgcacctgaacgactggagagtaaaattctggcagaagaaaagctagttcttgccgtagcccacgagcatgatactgagttatctagtgcggcagagctgctaggttcgaggaagctcctgcaattatccagggacagaggggagggtctgtcggaacagatattgcgttttctttcacttcgtcaactcactccgcagacagtctttccagcagatgacattcagactcttctggctcttgttgccaccaaaaatggtgtggccttattgcctgcgggagttttccatattcttccttgtggcgtcaggcttatacctcttgagggagaacatacaacctggcagacaggaattgcctggaacccgcaaataaaagaccctgtaagagataattttataaatatagtgacaccataa

SEQ ID NO: 3326 - DNA, 555 bp, Klebsiella pneumoniae
tcccctgagatatttactgggcatgaaaatttccgaactcaaggcggtgggaaaaaagttgaaaaaaacgtggctgataaacgcaccgcatctttatggtgtcaggccatcagggaagccgcaactccctatacctcttcggaaattctactggatgtcgataaagagtttggaaccaacacaaaatcattatggggtaagatcttcgatttgctgcccatatatgcgattttcaaagccgacagggaaagtagcgatggggattccgaagctaaaaactccttacagcaggccgtaaaagacgctcaggctgcgctgcaggacaaaattacagcacttgaaaaggatattcaggatagtgttcttgatgtcgcacagagaacgctggataaattacgtgaaatggcaccagaacttgccagtgaacttactccgcgatttaaggagtggagtgaccacgctccggtagacagtttctgtcctcacggcgaggccttttcgaaggcctccgggctgacgccaccgaggtggctgtggcgtcggttacggttgtag

SEQ ID NO: 3327 - DNA, 1122 bp, Klebsiella pneumoniae
tggactaggatggcagaaatgcatataagcagttactggaagcatcaattttcgaagatattggattatctgacacgccaaaaaaagccagctgttgtattgatgactgttgggggaacgatcctcggagggcagaaagtactcaactttgttcttaccggcaagtttagttggggttcactcacagtaggtacaaacgacgggaatttcatcagtgattacatcgtacccattgttgcgattatacttattgtaatgggtggcatactgatggtcttaaatgagtacttagcatttaaacagaactcacataagcgtattatcctggtggcagggaatggtctacgaacgacatctgaaacagggttggataagaaggttacttccatactgaaaggtaccatctatccagttgatattgatataactcagcaatacagagatgggtatgtctttgagcccgaactgactttcataagaaaaatattgccctctaaggataatctggcccaactccttgccaagggcagcgctgaaagtatacaggttggctacggtggttttttacccgtaccttttaccttttttataggtaatgtgcttgatgataaaagtaatgtgagtgtgtttgattgggatcgtgagaacgaacgctgggagcatatctcagagaagcacatcgacgatggcgagagtttcattagtgaaacaattcgtaccggagaattggacgaaatcgtacttgttgtttcatgttcatacagggtaaaaatgccacaagttggtgagtgtttcaaaggacttggcattgaacatctgacactggaaaccattgcatttgataatcattggtcattggtaaaacaacgccgtctttcaattcagtttgcagagaagattaaatcgctttcagatatggggatcagaacgattcacttgatactggcagcacagagcagtgtagtattgaatttggggcgacgatatgatagtagaaacatgtcagagcttattgtttatcagtatgagcaaaccaataagaacccttatccatggggaatttatgcactttctcatgggcatgaaaatggtggtttcattccacgtagcgaagaacagtag

SEQ ID NO: 3328 - DNA, 606 bp, Klebsiella pneumoniae
caagtatgtgtacatttgtacataaaccggaagaggaaaatcatggcccgtagaccaaacgatccgcagcgccgcgagcgcatcctgcaggcgacgctggataccatcgcggcgcacggcatccatgcggtgacgcaccgtaaaatcgccacctgcgcgaatgtgccgctgggatcgctgacctactatttcagcggcattgaggcgttaattgaggaggcgttcagcctgtttaccgccgagatgtcggcgcagtatcagcaaggcttcgtcggggtaacgaaccgggaacaagcctgcgatgccatcgcggatctgatcttcagcgcccaggtgaccacggcgcgcaatatggagctgatgtaccagctgtacgcgttctgcagcagtcagccggcgctgaaggcggtgatgcagaactggatgcggcgcagccagcagacgctggagcagtggttcgcccccgataccgcccgcggtctcgacgcctttattgaagggatgaccttgcactttgtcaccgaccgcgcgccgctgtcgaaggcggcaatccgcatgatggtcgggcagctggcgggggagagggcgcaggaagaggggcgctga

SEQ ID NO: 3329 - DNA, 192 bp, Klebsiella pneumoniae
acgggggtcgtccttccctactttacctatgatcgccttcaggaaattgaccagggcgctatcgtgaacaacaagcgcctcgggcggacacttgaatttattaagattgttcaggacaaacgcgacaacaaccggtcacaggctcttcctgctggagatggcccccccgcggagacggagaaaaccaactga

SEQ ID NO: 3330 - DNA, 222 bp, Klebsiella pneumoniae
aaaaccaccgtagccaacctgtatactttcagcgctgcccttggcaaggagttgggccagattatccttagagggcaatatttttcttatgaaagtcagttcgggctcaaagacatacccatctctgtattgctgagttatatcaatatcaactggatagatggtacctttcagtatggaagtaaccttcttatccaaccctgtttcagatgtcgttcgtag

SEQ ID NO: 3331 - DNA, 276 bp, Klebsiella pneumoniae
tgtttattatttaatatggcaccacatggtgtcgaacacttgtcaggaaacctcatgggaaagaaccaacatgttgtaccgcacaatggtgagtgggctgtacgtggagagggtaatgaacgggtaacatctacccatcgtacacaacaggaagcaatagatgcggctcgttcaatctcccgcaatcaggaaagtgaactggttattcatcgaccaaatggacaaatcagggatagagactcccatggaaaagatccattcccccctaaaggatga

SEQ ID NO: 3332 - DNA, 513 bp, Klebsiella pneumoniae
aagtccctttcttccacccaagggcgttttgaaatagcctgtgaattcgatggtctgcccgattttatcatgatcgacaacagggtgcagaccattcttccctcagaacatttgctgaataaagacggcaattttgaaataatcaaatcgtttaaagcaacgaccacaggaaaaactgagcagacctgcatcagctgcatccacccggatgataatcccctgagatatttactgggcatgaaaatttccgaactcaaggcggtgggaaaaaagttgaaaaaaacgtggctgataaacgcaccgcatctttatggtgtcaggccatcagggaagccgcaactccctatacctcttcggaaattctactggatgtcgataaagagtttggaaccaacacaaaatcattatggggtaagatcttcgatttgctgcccatatatgcgattttcaaagccgacagggaaagtagcgatggggattccgaagctaaaaactccttacagcaggccgtaa

SEQ ID NO: 3333 - DNA, 1965 bp, Klebsiella pneumoniae
caacaaacctcgggctttaagcctgcgcgctacgcaaaacagaagaaggggtgttttatgtcatccgatatcaagatcaaagtgcaaagctttggtcgtttcctcagcaatatggtgatgccgaatatcggcgcgtttatcgcgtggggtatcatcaccgcgcttttcattccgacagggtggttgccaaacgaaacgctggcgaagctggtcggtccgatgatcacctacctgctgccgctgctgatcggttacaccggcggtaaattagtcggcggcgaacgtggcggcgtggtcggggcgatcaccaccatgggcgttatcgtcggcgcggatatgccgatgttcctcggctccatgattgccggcccgctgggcggctactgcatcaagaaattcgataactgggtagacggtaagatcaaatccggttttgaaatgctggtgaataacttctccgccggcatcatcgggatgatcctcgccattctggccttcctcggcatcggcccggcggtcgaagttctgtcgaaaattctggcggctggcgttaactttatggtggcgcacgacatgctgccgctggcgtctatcttcgtcgaaccggcaaaaatcctgttccttaacaacgccatcaaccacggtatcttctcgccgctgggtattcagcagtcccacgagctgggtaaatccatcttcttcctgattgaagctaacccgggtccagggatgggcgttctgctggcgtacatgttctttggccgcggcagcgcaaaacagtctgcaggcggggcggctatcatccacttcctgggtggtatccatgaaatctacttcccgtacgtactgatgaacccgcgcctgatcctggccgttatcctcggcgggatgaccggtgtcttcaccctgactatcctcaatggcggtctggtttccccggcttccccaggctctatcctggcggtactggcgatgacgccgaaaggcgcctacttcgctaacatcgccgcgattatcgcagcgatggcggtctccttcgtggtctctgcggttctgctcaagaccagcaaagttaaagaagaagacgatatcgaagccgcaacgcgtcgtatgcatgacatgaaagcggaatccaaaggcgccagcccgctggcggccggtaatgtcaccaacgacctgagccatgtgcgtaaaatcatcgtcgcctgcgacgccgggatgggttccagcgccatgggcgccggggtactgcgcaagaaagtgcaggatgccgggctgagcaacatctcggtcaccaacagcgcaatcaataacctgccgccggatgttgacctggtcatcacccaccgcgacctgaccgagcgggcaatgcgccaggtgccgcaggcgcagcatatttcgctgactaacttcctcgacagcggtctgtacaccagcctgaccgagcgcctggtcgcggcccagcgccacatcgacaacgaagtcaaagtcaccgatagcctgaaagacagctttgacgatactaacaacaacctgttccagctgggcgcggataacatcttcctcggtcgcaaagccgccaccaaagaagaagccattcgcttcgccggtgagcagctggtgaaaggcggctacgtcgagccggaatatgtgcaggcgatgctggaccgagaaaaactgacctcgacctatctcggcgagtccattgcggtaccgcacggcaccatcgaagcgaaggaccgcgtgctgaaaaccggcgtcgtcttctgccagtacccggaaggcgtgcgcttcggtgaagaagaagatgaagtcgcgcgtctggtcatcggcatcgccgctcgtaataacgagcacattcaggttatcaccagtctgactaacgcgctggatgacgaaaccgtgattgagcgcctggcgaaaaccaccagcgtcgacgaagttctggcactgttaaataaataa

SEQ ID NO: 3334 - DNA, 1074 bp, Klebsiella pneumoniae
aaatgtcgatttaagctagaacgcgactatcggttaatgcccggcggcggcttcgccttaccgggcctgcaaaatagttacgccgccgcgcccgactaccatttcctgccccgccgcccggcgcgcgcgcatgctatgattcccctttgtcatatttcgcttgaggaaaagatgggctccagcaaaaaagggatgctgaacgtactgattgccgccgtgctgtggggcagttccggggtgtgtgcgcaatttattatgcaggaaagccagatgtcgtcgccgtttctgaccatgacgcgtctgctgttcgccgggctgatcctgctgatgctcggctttgttcacggcgaccgcattttccgcgtgctgcaaaaccgccgcgacgccctaagcctgctgtttttctcgctgtttggcgcgctaaccgtgcagttcacctttctgatgaccattgaaaaatccaatgccgccacggccacggtgctgcagtttctgtcgccgacgatcatcgtcgcctggttcgccctcgcccgcaaagcgcgtcccactccgctggtgctgggggctatctgcacctcgctggcgggcacctttctgctggtgacccacggcaacccaacgacgctgtcgatttcgccggcggcgctgttctgggggatcgcctcggcgtttgccgccgccttttataccacctatccttcaacgctgattgcccgctacgggacgctgcccatcgtcggctggagcatgctgttcggcggcgcgatgctattgccgttttacggcggccagggcaccgattttgtggttaacggcagcctgctgttagcttttttctacctggtggtgatcggtacttcgctgaccttcagcctctatctcaacggcgcgcagaagattggcggcgcaaaggccgggatcctcagctgcgccgaaccgctgagcagcgccctgctgtcgctcctgctgctggggatcaccttcacgctgccggactggctgggcactctgctgatcctcgcgtcggtggtgctgatcgccatcgactcgcggcggcgggtgagagccgcctga

SEQ ID NO: 3335 - DNA, 1002 bp, Klebsiella pneumoniae
ttgaagcgattcaggtttacaggattttggcgggacgcggcgcccgcgcaggggaaaatgatgtcgacaatcaatgatgtttcacgacttgccggggtttccaaagccacggtgtcgcgagtgttgagcggctcacgtggcgtgaaggaagccagtcgtcaggcggtgctgcaggcggcggaagcgctcaattaccggccaaacatgatagcccagtcgttgctcagccagtccaccggctgcatcggcgtcatctgcgcccaggacaacatcaaccaaaccaccagctatctctacgccctggaaaaacagctcagccagcaccagaaacacctgctgctgcgcttcgccaacaccagccacggcgtgatgaactctctggaggagttgacctgcgggctgtgcgataacgtgctaatcatcggcgcgcgttttcctctgaatattaaccgcccggacgtggtactggtggactgcctcgatagcgaaggcgacaacagtattcagttcgatcatgctttcgccgccgaaaccgcctgtcactatctgattagccaggggagacggcagattgcgctgattcatccgcagagcagcggctttgccgaccaggtgctgctgggctacaagcacgcgctggaaaaaaactttttgccgtttaatcgcaacctggtgtttctggataatacctcgccgtcggtggcggtgcaggagctggtcaataacgccacgacgctgaactttaacgcgctgctggtgagcgatgaacagcaggcgcagcgcgtggtgccgcagctgcaggcgtttaaccgcgccgttccgcaaaatgtcatggtgtttagcctcgccggatcgttacagctgcccggtatcccgactatcccggcgattgaatattccatggacgcgatggcatcgcggatcgtcaactggctgaccgagaaaacggacaacccgggcggcagcccgctgcgcggcgatttaattattccgaagcactaa

SEQ ID NO: 3336 - DNA, 1266 bp, Klebsiella pneumoniae
tatggtagattcctccatcgtttacgggatgtgccagtcacatattcttcatttctctttactcacaaagtattcatcgacatgaaacggcataagaacttcaatttgttgttgatgctggtactgctggtggccgtcggccagatggcgcagaccatttatattccggccatcgccgacatggcggtcgcgctgaacgtccgcgaaggggcggtacaaagcgtgatggcggcctacctgctgacctacggtatttcacagctattctacggcccgctctctgaccgcgtcggtcgccgcccggtgatcctcgtcgggatgtcgatttttatgctggcgacgctggtagctattaccacccatagcctgccggtgctgatcgccgccagcgccatgcaggggatgggcaccggggtcggcggcgtgatggcgcgcaccctgccccgcgacctgtacgaaggcgctcagctgcgtcatgccaatagcctgttaaatatgggtattctggtcagcccgctgattgccccgctgctcggcggcatcctcgacaccctgtggagctggcgcgcctgctacgctttcctgctggtcctgtgcgccggggtgaccttcagcatggcgaagtggatgccggaaacgcgcccggaaggggcgccgcgcaccaaacttctggccagctacaaaacgctgttcggcaacggcgcctttaactgctatctgctgatgctgatcggcggcctggcggggattgcggtattcgaagcctgctccggggtgctgatgggcgcggtgctcggcctgagcagcatggcggtgagtattctgtttattctgccgatcccggcggcgttcttcggggcgtggtttgccggccgccccaacaagcgtttcccgaccctgatgtggcagtcggtgatctgctgcctgctggcgggtctgatgatgtggatcccagggctgctgggcatcatgaccgtctggaccctgctggtgcctgcggcgctgttcttcttcggcgccgggatgttgttcccgctggccaccagcggcgcgatggagccgttcccgttcctcgccggaaccgccggggcgctggtgggcggcttgcagaatatcggctccggcgtgctggcctggctgtcggcgatgatgccgcaaaccggtcagggcagcctcggcctgctgatgatgctgatgggcctattgattctgctgtgctggctgccgctggcctcgcgcttcacccaccatcagcagccggtataa

SEQ ID NO: 3337 - DNA, 1077 bp, Klebsiella pneumoniae
gtccattcatcaagaagaggtttcgctatgctgatcaacgctattggtacctactccgccagccagccgctggaatcaatggccatcacccgccgcgacccggggccgcaggatgtacagatcgccatcgcttactgcggcgtctgccactccgatctccaccaggcgcgatcggaatgggcaggaacgctgtatccctgcgtgccggggcatgaaattgtgggtcgggtgaccgcggtcggcaacgccgtctcgcgctacgccgtcggcgatctggtgggcgtcggctgtatggtcgatagctgtcaacagtgcgaagagtgcgccgaggggctggaaaactactgcgaccacatggtgctgacctataacgggccgacccaggacgcgccgggacacacgcttggcggttattcacagcagatcgtggtcaatgaacgctacgtgctgcggataacccatcccgaagcgcagctggccgccgtcgcgccgctgctgtgcgccgggatcacgacatactcgccgctgcgccactggcacgtcgggccgggtaaaaaagtcggcgtggtcggcatcggcggcctcgggcatatggggatcaagttggcccacgccatgggggcccacgtggtggcctttaccacctccgaatccaagcgtaatgcggccagagcgctgggcgccgatgacgtagtggtgtcgcgcaatgaagacgaaatggcggcccacgtcaaaagcttcgatttcatcctcaacaccgtggcggcgccgcacaatctcgatgccttcaccacgctgctgaaacgcgatggtaccatgacgctggttggcgccccggccacgccgcatccgtcgccggaagtgttcaatctgatcttccgccgccggtcgattgccggctcgatgatcggcggtattccggaaactcaggagatgctcgacttctgcgccgaacacggcatcgtcgccgatatcgaattgatccgcggcgatgagatcaacgaagcctgggaaagaatggtcaagggtgacgtgaaataccgcttcgtgatcgacagtgcgaccctcgccggctaa

SEQ ID NO: 3338 - DNA, 474 bp, Klebsiella pneumoniae
gtgcgttcatcaggcatcctgatgttgttcagcaccttcgccagcctgctgctgcagatagttcatgaacagcgcgtcgaagttcactggcgcaaggttaagttgcgggaaggtaccgcgggaaaccaggctggtgatgcactcgcgcgcgtacgggaacagaatgttcgggcagtatgcgccgaggcagtgcgccatctgggtgccttcgatgccgtcgatggagaaaataccgccctgctgtacttcacagaggaacgcggtttcttcgcccagcgcagcggtcacggtcacacgcagcaccacttcataaacgccttcagccagctgggtggaggcggtatccagatcaagtttaacttccggctgccagtctttctggaaaacttgcggcgcgttcggcgcttcaaaagagatatctttggtatagatacgctggatctggaaggtcatttcggtgctgttttgttctga

SEQ ID NO: 3339 - DNA, 1074 bp, Klebsiella pneumoniae
ctacgatcatccgctggcctcccatctggcgcaggaagcacggattatcgcccaggcagaaggctatcgccctggcgagaaaattgtcgctgctcccccggtttactgtttcgaaccgcaccagccggagcagtgcaactggaaacccgatgtgttgctggacatcaccgccgtctgggagaaaaagtatcaggccattcagtgcatgcagggtcaggagcatctgtgggaatactacacccgcgtggcgctgcagcgcggggtgcaggccaagcgcaatatcggcatcacggccgcgcgcgatatcgttcacggcgaagccttccagagcatcttcccccgcgtaacggagaacctggcatgaacctgttaaataaaaaaggccttgtgatccgccacctgccgcgccatgacgaggcggttttgcgccgctgtgaggcggccggggtggcgacgctccatgaagcctgggatcgtcaggggctgatgggaccggcaatccgtccgattcagcagggcgtcagccgggcgggcaacgcggtaaccgtgctggtgacgcctggcgacaactggatgtttcatgtggcggtcgagcagtgccgcgccggcgatattctggtggtggccccgacctcgccgtgcggcgatggcttcttcggcgatctactggcgacgtctctccaatcgcgcggcgtggtcgggttggtgggcgatatcggcattcgtgattcgcaaacgttgcgggaaatgggattcgccgtctggtcccgtcaggtttatgcccaggggacggtgaaagagagcctcggttcggttaacgtcccggtgatatgcgcaggtcagcttgtacagccgggcgatgtcgtagtggccgacgacgatggcgtcgtggtgctgcctcacgcccgggtccgtgatgtgctccataaagcggaagcccgcatgagcaatgagcttgcgaaacgtgagcggatgcgcaatggcgagctggggctggatatttacgctatgcgtccgcgtctggcggaaaagggcctgcggtattacgaccgcgcagacgaggtggaggaataa

SEQ ID NO: 3340 - DNA, 327 bp, Klebsiella pneumoniae
ggatggtcgtcgatgtacaagattatgctgtgctgctctgccgggatgtccaccagtctgctggtcagaaagatggttgaggcggcgaatgaacgtgacctgccggtgcagattgacgcctatggcgtttccgaatttgacatgcagtttccgcagtatcaggtggtgttgcttggcccccaggtgaaatacatgttgaaaaccctgtctgacaaagcggcttccctgaacattcccgttcagcccatcgatacgatggactacggtatgcagcggggagacaacgtcctgaattatgctctgtcgctgatcccagcggcgcactga

SEQ ID NO: 3341 - DNA, 339 bp, Klebsiella pneumoniae
aagagaccgtcggcgagcaggaggcggtgctgttcgcccgctccgcctcggtgggcgcgcagcagttcccggtgcactggggcggcgactgctacgccaactacgaatcgatggcggaaagcctgcgcggcgggctgtcgatcggcatgtccggcttcggtttctggagtcacgatatcggcggtttcgaaaacaccgcgccggcccacgtctacaagcgctggtgcgccttcggcctgctctccagccacagccgcctgcacggcagcaaatcctatcgggtgccatgggcctacgatgacgagtcctgcgacgtggtgcgccacttcacgcagctga

SEQ ID NO: 3342 - DNA, 1227 bp, Klebsiella pneumoniae
ttaatttttccccagaaagcgctgtgccggatactatcttcgaaaaggttgcgtttaatgagtactttaaaagtgagtaacttcgccagacagggttactcgattgtctttcctttgtttttatttttcagcgcgattttttgcatgtccacccggaccaataatctgctgcatttatcgatcctgctgctattgctgtcgctggtacgccaggaaaaccgccaggcgctggccggggtgttacgcgagcagtggcagacctggacgctgctggcggctttctttatctattacgccctcagtaatgtgtggggccatacgccgcagcatattgactcgccgatcacccacggcgtgtatctgaccgggtatctgttgctgatgacgatgctgctcagggacggacgaacccgccgactggcgatgctggcggtggtcggcgggatcaccgtgctctccctgtggacgctgattatcgaccatacgctggttctcaccgaacgagcggtctcccccgagaaccccggaccaacgaacgttatcgaccttgccggttactgcggcatcggcattttaatttgcggcatgctactgaaagaaaaagccagccactggctctatctgccggtggtcattatgctggtgatgctgctgctcacccaaagccgcgggccgatcatcgccctggtgctggcggtcggctgtacgctgcacctgcacgtcttcacccgccgcaacctgctgatcgccgcggcgctggccgtgctggtagcgctgcttttggtcatgacgccggtgggcgacatgctgctcgcccgtttcgaggagctgggcacccaaagcgggctgcgcctgagcatctggcaccatacgctgtcggagatggccagccagccgtggctggggcgcggtttcagctatgaactggatttcatcaactacagcggcgagcacatcaccaccacccacagtgtgtatatgggcgccctgctgaaaggcggcatcgtggggttactgctgctgttggcgatcattgcctgcgggctatggcaggcgtggcgcaagcgccataccgacagccgctacagtctggcgatcctgttttacgcgctggtgtttatggcctcgcaggggatgtttatcatcagcaatccccgggaaacctgggtcctgttctggctgccgctgggcattgcgctcagcaaagggttggcggaaaaacgctaa

SEQ ID NO: 3343 - DNA, 1278 bp, Klebsiella pneumoniae
ctcgcatttcctgccaggaaaagagcgttgtccaaatggcaactcgtcttacggcgcgttcctcactatgctgaacgccattcacatcgcgaggatcccatgacacgctttcttctctgcagctttgccctggttctgctctacccctccggcattgatatgtatctggtcggcctgccgcgtattgctcaggacctgggagccagcgaggcgcaattacatatcgccttctcggtctatctggccggtatggcctccgcgatgctgtttgctggccgcatcgccgaccgctcggggcgtaagcctgtcgctattgtaggtgcagcgatctttgttatcgcctccctgctctgcgcccaggcgcataccagcagccacttcctcatcggacgctttatccaggggatcggcgccggcagctgctacgtggtggctttcgctatcctgcgcgatacgctggacgaccgtcgccgcgccaaggtgctgtcgttgctcaacggcatcacctgcattatccccgtcctggcgccggtgcttggccacctgattatgctgaaatatccgtggcagagcctgttctacacgatgaccggcatgggcgtcatggtcgctgtgctgtcggtctttatcctgcgtgaaacgcggccgacggcgcctccgcaggcagcgtcaccgcagcatgacgctggcgaatcgctgttgaaccgctttttcctcagccgcttactcattaccaccctcagcgtgacggtgatcctgacctacgttaacgtctcgccggtactaatgatggaagagatggggttcgaccggggaacttactcaatggcgatggctctgatggcgatgatcagcatggcggtctccttctcaacgccgttcgtcctgtcgctgtttaacccccgcaccttaatgctgacctcacaggtgctgtttctggcggcaggcgtgacgctgagcctcgccactcgccaggccgtcaccctgatcgggctgggcatgatttgcgccggcttctccgttgggttcggcgtcgcgatgagccaggcgctggggccgttcacgctgcgcgcgggcgtcgccagctcggtcctcggcatcgcgcaggtgtgcggttcatcgctgtggatttggctcgccgccatcatcggactcagcgcaatgaatatgctgatcgggatactcattgcctgtagcatagtgagccttgttttgttactggtcgtcaccccgccgcgggttgcgcaatacgatgaagaagccgctgtcgagtcttga

SEQ ID NO: 3344 - DNA, 1446 bp, Klebsiella pneumoniae
ttgttgactccctctcccgtcgggaggggggaaaataacttaccgccaggcccattcatgactaccgaaattcgtgcgctttatacccggcttccggccattgaccgcttactacgcgaccccgctttttctcccctgctggcgcagcacggccattcgcaggtggtggcgcagctgcgccagatgctcgatgaggcgcgggagcaaatccgccagtatcagacactgccggactggagccatgactggccgagcgcctgcgcgcagcggctcaccgccggccagcggagcgccctgcgtccggtgtttaatctcaccggtacggtattgcataccaatctggggcgcgccatccaggcggagtcggccgtggaggcggtcgccagcgcgatgcgcgcgccggtgacgctcgaatatgatctcgacgacgccgggcgcggccatcgcgatcgcgccattgccgatctgctgtgccagatcaccggcgcggaagatgcctgtatcgtgaacaacaacgcggcggccgttctgctgatgctggcggccaccgccagcggtcgcgaagtggtggtctctcgcggcgaactggtggagatcggcggggcatttcgcatccccgacgtgatgcgccaggcgggttgccagctgcaagaagtgggtaccaccaaccgcacccatgccaaagattatcgccaggcggtgaatgacaataccgcgctgctgatgaaggtccacaccagcaactacagtattgagggctttaccaaagccgtcgacgaagcggagttggcggccattggtcgcgaactggatgttccggtggtagccgacctgggcagcgggtcgctggtggatctcagtcagtatggcctgccaaaggagccgatgccgcaggagatgatcgccgccggggtgagcctggtcagtttctccggcgacaagctgctcggtggcccgcaggccgggattatcgtcggcaaacgcgcgctgattgcccagctgcaaagccatccgctgaagcgggccctgcgcgccgataaaatgaccctcgcggcgctggaggctacgctgcgcctctatcagcacccggaggcgctgagggagaaattgccgacgctgcgcctgctcacccgtccggcggaggagatccgccggctggctgaacgcctgcagcctgacctggcggcacactatgctgattttgccgtcagcgtggcagcctgccagtcgcagattggcagcggctcgttacccgtcgaccgcctgcccagcgcggcgttgacctttaccccgcatgacggccgcggtagccggctggaggcgctggcggcccgctggcgcgcgctgccgtgtccggtgattggccgcatttatgacggtcggctctggctggacctgcgctgtctggaagatgaaacccgctttatggagatgttgttacgatga

SEQ ID NO: 3345 - DNA, 1602 bp, Klebsiella pneumoniae
aaaaccgctccctgtacctacaaaaatataaaaggatcaatcatgcctgaaatacgtcagcgtattctggagaatatgcaaaaattctcccgggccatgatcggcgccgtattgttcttgccggtcattggcttaattctggccctcagttcagtattaactaatccgacattaattgctgaaaccagtttcttacatcagcttgggcaaatgctcggcgacaccttttggcctttatttggcaacctcggcttattattttgcgtcggcatcagctatggcctggcaaaggataaaaaaaccgaagtcgcactggtttcagtgatgtgctttattatgtttcttggcgccaaccactcctggctggaacacacccatggactcgccgaaaaaattaacggtgaatattatggcaccgggcaaacccagctgctgggctttgtggtggtggatatgggcgttttcctgggcattattctcggctgcacgattgcgtgggtgcacaataaagtctctgccattgagctgcctggcgcgctgtcgatgtacggcggcgccaagctgacgctggtggcgatgacgccggtggttatcttctacgccatcgcctttacctggatttggccctttatgacccacggcatctccgccctcaccggttttatgaaaaatgccggggtcgccggggtcttcgtctatggtttctttgaaaaattccttatccccaccggcctgcaccatttcgtctggtcccccttccagctcacccagattggcggcacgctgaacgtggatggtcaggtggtctccggcacccaggccattttcctcgcctatatgcgccatcccgacctgacgccggtcatgaacgacgcattacgtttttcgcagcaagggatgaccactatctttggcctggcgggcgcctcgctggcgttctaccacaccgcgaaaccggagaagaaagcgatggcgaaggcgattctgctgccggcgattatcacctcgatgctgaccggcatcaccgagccgattgagttcaccttcttatttgtctcaccgctgctgtgggtgatccacgcgacgttaaccgccgcctcgcaggccatttgcgacatattcaccgtacgtccctggggagcatcgggcctgatcgagtttctgatctataacctgccgctgccggtctccttaacgcgctggccgggctatgtccttatcggtatcggccagttcgccgtctactacgtgattttccgcaccctggtggtgaagctgaacctgaaaacgccgggccgggaagatgacgagaacgtgaagctctacagcaaagcagagtaccgccagaaagtcgcgcaaccgcagtcggtcaccgatgacattatccgcggcctcgggggcaaggagaatattctctccgtcgataattgttttactcgcctgcgcgtggccgtgcgcgatatggcgcgggttgatgacacgcaattaaaaaataccggcgccaacggcgtcgtacgcaatcgaaatgaagttcaggttatttatggcgtcaaagtgggacaggtacgttcccgggttgataactggttagcagaaaattaa

SEQ ID NO: 3346 - DNA, 1008 bp, Klebsiella pneumoniae
cgcctcctgttgtctggcgccatcatggactgtactgtgaagaatgataatacgggtaaagtggcaatcatctttccgcaaaacgggagaataatggatcgattaagcgcgatggcgctgctggtgaaagtgaccgagctggggagcatgtcggcggcagcgcgggcgctgaatatgccgttgaccaccgtcagccgccatattggcgaactggagagcgcgctgggcgtacgcctgctggcgcgaaccacccgcaaactgacgctcaccgacgccggggtcgattatgttgccgccgcccggcggatccttgaggaggtggaaaacgccgaacgccaggcgacgggcgaatatcaggagccaaaaggcgagctggtgatctccgcgccaacgatgtttggacgccagcacgttcttccggtaatcagtgaatttatcgcccgctacccgctaattcgcgtccgtttgctgctcagcgatcgcaatgccgacctggtgagcgaccatgtcgatctggcggtgcggattggcgacctggcggacagcagcatggtggccacccgcctcggcaccatgcggattgtggcctgcgcccatccggcgctgctggcgaaatacggcgagccgcagcggccgcgcgatctggcggcgctgccgatcatccgcattgaatcgccgatgccctatcgcggctggcgctttcgcgccgctgagcgcgaggaccagctgattaacctgccgccggtgctatccgtcaccacgccggagagcgccgccgatgccgcgcggctgggggtgggggtggcccgcttactgcattatcaggcgctggatggcctgcgccacggggagctccgtctgctgctggaaaacgtcgagccggattcggcgccggtccatttgctgtataccgctcgggatctggcgccgcttaagctgcgaaaatttatcgattttgccgcaccggcgctgcgtcaggcactgctgcgcatcgccggggccgcttaa

SEQ ID NO: 3347 - DNA, 384 bp, Klebsiella pneumoniae
aagcgcgatccagcgccaggcgaaaccgctgctgctgcgggcgggggcgctccgcaagctgcagcagatggctgcgcagttccgcaataccgatgttttccgccgccgcggtgggaaagaaagcgacggcgtcaaagcccagctcgcccagggtctgctcgacctcagcctgaacctccgccaccctggcggccgccacgcggtccgttttggtcagcgccacggtcagcgtcggctttccggtcaactgcaggatcgccaggtgttcgcgggtttgcgccatcaccccgtcatcgcaggccaccaccagcagcgcatggtcaataccccccacccccgccagcatgttggacaaaaacttttcgtgcccgggaacgtcaataa

SEQ ID NO: 3348 - DNA, 1383 bp, Klebsiella pneumoniae
ggaagtcaccctatgaatcacacgaacgttgtcgatgtgaaagcgtggatagatacccgcccggtctcgcgctttcaatggaacgtgctgctgctctgtttcatcatcattatgctggatgggtatgacgccgcggtgatgggctttgtcgccccggcgctcatcgaagactggggcatcagccgggccgaaatggggccgattcttggggcggccatgttcggcgtcgccattggcgccctggtagcgggtccgctttctgaccgctacggccgaaagcgaattttactctggtcggtggcgctgtttgcgctgttcagcctggccggcgccgtggcgcaaagcccgacgcagctggcgctgatgcgttttctcaccggccttggccttggcgccgtaatgcccaactgcgtcacgctggtggcggaatatatgccggagcggcgtaaaggggtgatgatcaccctgatgtacagcggttttaacgtgggttccggcctcggcggctttatcgccgccggtttgttatcgcattacagctggcactcggcgctggtttttggcggcgtgctgccgctcgtggtgctcccctttatgatcgtgatgttgccagagtcggcgatgaacatggtggcgcgccgactaccgggcgagcagattgccagggcgcttaaccggcttgggggccagtttacggctgaaaccgttttccagctgaatgcgccgcccatcacgcggagcagcaaagtggcgcagctgttccggcatggctatgcccgcggcacgatagcgctgtggttaacctattttatggggctgttcgtgatttacctgctgaacggctggctgccaaccattctccgctccggcgggctgtcgctgcagcaggcggcgatgatgaccggcttgttccagctcggcggcccgctgggcgggatccttgtcggtatgctgatggatcgcgcttcggcgaaagccgtgattgcggcaacctatttcctcggctgtctgtgcctgttgtcccagggggtgatggatttcggttcggcggcgctgtcggtgctgatttttatcagcgggatgtgcattaacggcgcgcagaacggtctgcaggcctattcgcccgcctattatcaaaccgagatccgcgctaccggagtcagctggatgcatggtatcggccgtaccggggctatcctcagctccacgctgggcgggatgctgatgctggccgtgccgggacactcgtcgatctttttggtgcttgcgctgccggcctgcctggcggggatctgtattttgttgcaccgtatgaatcacgctaagcctcgactcacagaggcagaacttgacgctttgtcatcccccctcgaacaccgataa

SEQ ID NO: 3349 - DNA, 2451 bp, Klebsiella pneumoniae
cggattaacccaagattaaatgagcgagaaacgttgatgtcgaattcttatgactcctccagtatcaaagtcctgaaagggctggatgcggtgcgtaagcgcccgggtatgcatatcggcgacacggatgacggcaccggtctgcaccacatggtattcgaggttgtggataacgctatcgacgaagcgctcgcgggttactgcaaagatatcgttgtcaccatccacagcgataactccgtctccgtccaggatgacggccgcggcatcccgaccggcattcacccggaagagggcgtctccgcagcggaagttatcatgaccgtcctgcacgctggcggtaaattcgatgataactcctataaagtttccggcggtctgcacggcgtaggcgtctcggtggttaacgccctgtcgcagaagctggagctggttatccagcgcgataacaaagttcacaagcagatgtacgaacacggtgtgccgcaggcaccgctggccgtgactggcgaaaccgacaaaaccggcaccatggtgcgtttctggccaagcctggaaaccttcaccaatgtcaccgaatttgaatatgacatcctggcgaaacgcctgcgcgagctgtcgttcctgaactccggcgtctctatccgcctgcgcgataagcgcgacggcaaagaagaccatttccactacgaaggcggcatcaaggcgttcgttgagtatctcaacaagaacaaaacgccgatccacccgaatattttctatttctccaccgaaaaagacggtatcggcgttgaagtggccctgcagtggaacgacggcttccaggaaaacatctactgctttaccaacaacattccgcagcgtgacggcggtactcacctcgccggcttccgcgcggcgatgacccgtactcttaacgcctatatggacaaagagggctacagcaaaaaagcgaaagtcagcgccaccggcgacgatgcgcgtgaaggcctgattgccgtggtatccgtgaaggtgccggatccgaaattctcctcgcagaccaaagacaagctggtctcctccgaggtgaaatcggcggtggagcagcagatgaacgaactgctgagcgaatacctgctggaaaacccatccgatgcgaaaatcgtggtcggcaaaattattgacgccgcgcgcgcccgtgaggccgcacgtcgcgctcgtgagatgactcgtcgtaaaggcgcgctggatctggcaggcctgccgggcaaactggcggattgccaggagcgcgacccggcgctgtccgaactgtacctggtggaaggggactccgcgggcggctctgcgaaacagggccgtaaccgtaagaaccaggctatcctgccgctgaagggtaaaatccttaacgtcgagaaagcccgcttcgataaaatgctctcttctcaggaagtagccacgcttatcaccgcgctgggctgcggcatcggccgcgatgagtacaacccggataaactgcgctaccacagcatcatcatcatgaccgatgcggacgtcgacggctcgcacattcgtaccctgctgttgaccttcttctatcgtcagatgccggagatcgttgagcgcggccacgtctacattgcccagccgccgctgtacaaagtgaagaaaggcaagcaggaacagtacattaaagacgacgaagcgatggatcagtatcagatctccatcgcgctcgacggtgcgaccctgcacaccaacgccaatgcgccggcgctggcgggcgaaccgctggaaaaactggttgccgagttcaatgccacccagaaaatgattggccgcatggagcgccgcttcccgaaagcgctgctgaaagagcttatctatcagccgaccctgaccgaggccgacctggcggacgagcagaaggtgacccgctgggtgaacaccctggtctccgagctgaacgagaaagaacagcacggcagccagtggaaattcgatctccacgagaacaaagaactgcagcattttgagccggttattcgcgtacgtacccacggcgtggataccgactatccgctggataacgagttcattatggggccggaatatcgtcgtatttgtgccctgggcgagaaactgcgcggcctgatggaagaagatgcttacatcgagcgcggcgaacgtcgtcagccggtagccagcttcgagcaggccctggactggctggtgaaagagtcccgtcgcggtctctccatccagcgctataaaggtctgggcgagatgaacccggatcagctgtgggaaaccaccatggatccggacagccgtcgcatgttgcgcgtgaccgtcaaggatgccatcgctgccgatcagctgttcaccaccctgatgggtgatgccgttgagccgcgtcgcgcgtttatcgaagagaatgccctgaaagcggcgaatatcgatatttaa

SEQ ID NO: 3350 - DNA, 1098 bp, Klebsiella pneumoniae
cgccctggcccaaagaacgctgatatgtcactgacgcgcttgctcatcaaagacttccgcaatattgaaagcgcggatctcgctttatctcccggctttaacttcctggttggcgcgaacggcagcggcaaaaccagcgtgctggaagctatctatacgcttggccacggccgggcatttcgcagtttgcaaattggccgagtgatccgccacgagcaggatgcgtttgttctgcatggccgtctgcagggcgaagagcgggaaaccgccatcggcctgaccaaagacaaacagggcgacagcaaggtgcgtatcgacggcaccgacggccacaaagtggcggagctggcgcacctgatgccgatgcagctgattacgccggaggggtttactttactcaacggcggccccaaatacagaagagcattccttgactggggatgctttcataacgaagccggattcttcaccgcctggagcaacctgaagcgcctggtcaagcagcgcaacgccgcgctgcgtcaggtcagccgctatgcccagctgcggccttgggatctggaattaatcccgctggcggagcagatcagccgctggcgtgccgaatacagcgccgctatcgtcgaagacatggcggatacctgtcagcaatttttaccggaattcacgctcaccttctctttccagcgcggctgggaaaaagagaccgactacgcggaggtgttggagcggaatttcgagcgcgacagaatgttaacctacaccgcccacggcccgcataaagcggattttcgcattcgcgccgacggagcgccggtggaagataccttgtcgcgcgggcagcttaagctgctgatgtgcgccctgcgtctggcgcaaggagagttcctcacccgcgtcagcgggcggcgctgcctgtacctgatagatgattttgcctcggaacttgatgatgcccgccgcggtctgttatccagccgcctgaaagcgacgcagtcgcaggttttcgtcagcgcgatcagcgctgaacacgttatggacatgtcggacaaaaattcgaagatgttccgcgtggaaaaaggtaaaataacggattaa

SEQ ID NO: 3351 - DNA, 720 bp, Klebsiella pneumoniae
ttaaagtcacccgtaaccgaaactagctttatgaactcaaagcgctacgagcgtatctgcgagatgctcgccaggcgtcagcctgacctgacggtctgcatggagcaggtccataagcctcataacgtctctgcggtcatccggaccgcagatgccgttggcgtacacgaagtgcatgccgtctggccgagcagccggatgcgtaccatggcctccgccgccgcgggcagcaacagctgggtgcaggttaaaacccaccgcactatcgcagatgccgtcggccacctgaaaggccagggcatgcaaattctcgccactcacctttccgacaaagccatcgattttcgtgaaatcgactatacgcgtccaacctgcgtcctgatgggccaggagaaaaccggcatcacccacgaagcgctggcgctggccgatcaggacatcattatcccgatgatcggcatggtgcagtcgctgaacgtttccgtcgcctcggcgctgatcctctacgaggcgcagcgccagcggcagaatgccgggatgtaccaacgcgccaacagcatgctgccgccacaagagcagcagcgcctgctgttcgaaggcggctatccggtgctggcccgcgtcgccagacaaaaaggtctgccttacccccacgttaacgagcagggcgaagtagaagccgatgccgcgtggtgggctaccatgcaggctgcgaggtaa

SEQ ID NO: 3352 - DNA, 909 bp, Klebsiella pneumoniae
cgccagccaccaccctcctttacgcattgcagtcccctcctccatcacctcgcggagagtctgcggcagaatgccgcgagccgcgacggaagctttttcgccttgcgaagcgccttccaggatttacgcctcattgcagcaacggctggcgaattcaggaaaacggcaggcaaaatgaaagaaacagcggcaaaaagtgtgacaatgactgcgtcacgccgcggcgacgtgtataataggctcgtatgtaggacctctttcgataaccacatacaaaagacactcatggctcaaggcacgctttatattgtttccgcccctagcggcgcgggtaaatccagcctgattcaggctttattaaaaacccaaccgttgtatgacacccaggtatcggtctcccataccacgcgggcgccgcgtccgggtgaagtgcacggcgaacactatttcttcgtgaatcacgacgaattccgctcgatgattggcgaaaacgcgtttctggaacatgcagaggtctttggcaactattacggcacgtcgcgtaaagcgatcgagcaggtgctggcgaccggcgtcgatgtcttcctcgatatcgactggcaaggcgcgcagcagatccgtaaaagcatgcccggcgcgcgcagtatttttattctgccgccgtcaaaagatgaactggaccgtcgcctgcgcggccgcggccaggacagcgaagaggtgatcgcgaaacggatggcccaggccgttgcggaaatgagccattacgcggaatatgattacctgattgtgaacgatgattttgacaccgccctgagcgacctgaaaaatatcatccgcgctgaacgtctgcgcatgagccgccaaaagcagcgacatggcgctttaatcaccaaactattggcagactga

SEQ ID NO: 3353 - DNA, 252 bp, Klebsiella pneumoniae
aaatctccgccacctataccggggcgtccgccgaaaccctggagaacagcgtcacccaggtcatcgagcagcagctcaccggcctcgaccatctgctctacttcagctccaccagcagctccgacggctcggtcagcatcaccgtcacctttgagcaggggaccgacccggacaccgcccaggtgcaggtacaaaacaaagtgcagcaggcggaatcgcggctgccgagcgaagtccagcagtccggcgtaa

SEQ ID NO: 3354 - DNA, 1209 bp, Klebsiella pneumoniae
acttacccgccgggcgaccgagcccggcctctacaaggaatcgttatggcacgtgtttccctctcctgggcgctgatcctcggcctgctgtcgggtatcggcccgctgtgcacggatttttatctaccggcgctgccggagatcactcagcagctgcaggccaccagcacccagacccagctgtcgttgaccgccgcactgattggtctcggcctgggtcagctgtttttcggcccgctgagcgaccgcattggccgcctgaaaccgctggcgctgtctctgctgctgtttatcttctcttcggcgatgtgcgcccagacccgcgatatcaacatgctgattgtctggcgctttttacaaggctttgccggcgccggcggctcggtgctgtcgcgatccattgcccgcgataaataccagggcaccctgctgacccagtttttcgccctgctgatgaccgtgaacggcattgcgccggtgctgtccccggtgctgggcggctacgtcatcaccgccttcgactggcgaattctcttctggacgatggccgccattggcggcgtgctgctggtgatgagcctggcgatcctgcgggaaacgcgcccggccacagcggcgcatgccagccgccaacggcccggccagccggtgctgaaaaatcgccgctttctgcgcttctgcctgatccaggcctttatgatggccgggctgttctcctacatcggctcttcttccttcgtgatgcagagcgaatacggcatgagcgccatgcagttcagtctgctgttcggtctgaacggtatcgggctgatcatcgccgcgatgatcttttcccgtctggcgcgccgctttagcgccgaaagcctgctgcgcggcggcctgacgctggccgtgagctgtgcggcgatcatgctgctgtttgcctggctgcatctgccgatgctggcgctggtcggcctgttctttaccgtgtcgctgatgagcggcatcagcaccgtcgccggcgcggaggcgatgagcgccgtcgacgccgcgcagtccgggaccgcgtccgcgctgatgggcaccctgatgtttgtcttcggcggcatcgccgcgccgctggcgggtctcggcggcgaaacgatgctgaaaatgagcctcgcgatggccatctgctacctgctggcgctgctgctgggcctcagcaaaccgcgcgacgcacgctaa

SEQ ID NO: 3355 - DNA, 525 bp, Klebsiella pneumoniae
tcacagccgccgccaggccggtccacgccgggccgacgccgtgccagctctcggtcacccatagcgagaggaccaccgccagcagccacgccagacgtttctcgtcgcggctcatcggcggcagcggcgccaggtcgcgcggtggatgcggcttgccgggaaacagccagcaaatcagcgccaccagcaccgcccctttcagccagccaagcaccggcgtatgcagcagtaaatagggaacataattcagatggataccgtacgagccttccgccgcgccactcatcaccagattcggcacgttggcgggcaaaatcgtcgccgacagctgaaaggtgccgaaccccaccgccagcgccaggccgaaccagccgcggctaccgtcggcaatgcccgcgcggcgggccatcgccgccacgatcggcatcagcagcgcgatgcgccccatgttggagggcatcacgaacgccagggcgtagctcaggagtaccacgctggcgaccatccgcggccaggagtcggtga

SEQ ID NO: 3356 - DNA, 621 bp, Klebsiella pneumoniae
tccccacagccactccctaccaacctgagccccccaaactcatcatcccagccaatcatttttatccaaaccctgcgttattttgtctctcgcaaacccgttacactggcgcggtggccgcgtgccgttaccaaccgaaacaggagagccataatgacccccgaactcagacactgtttttccattaccatccaggttgataaaccgataatcgtctcccgcagcccgcagaccggtaagcgccagctgatcccgattgtcggcggcagcgtctcgggtcaacttcgcggccacgtgctgcccggcggcgtcgacagccagataatcgaacccgacggcacctgcaggctgtccgcccgctatgccctgcaggtggcggaaggcacggtctatgtggaaaacaatggcatccgccgggtgccggcccagtatcatgaccagcttttcgccgacgatatgcgcttttttagcgatattccgccagaagccatctattttcgcaccgtgcccacctttgaggtggatgctcccgcgctcagctggctaaccacctcgctgtttatctgcgccggtggccggacccaggatggggtgatgctcgacttctatcaggtgggctga

SEQ ID NO: 3357 - DNA, 1488 bp, Klebsiella pneumoniae
cggttgcggcctgccgccggggtcgaatctgcaggggttcggcctgaccggcatgcgcgagcgcgtgaccgccctgggcggcacactgacgatctcctgcacccacggtacccgggtgtgcgtcaatctaccgctgcgttacgcctgagaggatcgccgatgttcgcctttttaaaagccccgccggacgctgcgccgattagcgataaacgcgagcttgatgcgcgttatcgctactggcgtcgccatatcctgttgaccatctggctgggctacgcgctgttctatttcacccgcaaaagctttaacgccgcggtcccggaaattctcgccagcaacgtcctgacccgcagcgatattggcctgctggccacgctgttctatatcacctacggactgtcgaaatttttctccggtatcgtcagcgaccgctccgacgcccgctattttatggggctggggcttatcgccaccggggtggtgaatattctgttcggtttttcttcctcactatgggctttcgcgctgctatgggcgctgaatgccttcttccagggctggggctcgccggtctgcgcccgactgctgacggcctggtattcgcggaccgagcgcggcggctggtgggcgctatggaatacggcgcataacgtcggcggcgcgctgatcccgatggtggtgggagcggcggcgctgcactacggctggcgtgccgggatgaccatcgccggctgtctggcgatcctcgccggactgtatctgtgctggcggctgcgcgatcgcccgcaggcggtggggttacccgccgtgggcgactggcgtcacgatgcgctggaaatcgcccagcagcaggaaggcgctgggatgtctcgtaaagcgatcctgacccgctacgtgctggccaatccctacatctggctgctgtcgttgtgctatgtgctggtgtacgtggtgcgggcggcgattaacgactggggcaatctgtatatgtcggagacgctcagcgtcgatctggtgaccgctaactcggcggtgaccatgtttgagctgggcggttttatcggcgcgctggtggcggggtggggttcggataagctgtttaacggcaaccgtgggccggtgaacctgattttcgccgccggaattttgctgtcggttggcggcctgtggctgatgccgttcgccagctatgtcatgcaggcggcctgcttcttcactaccggtttcttcgttttcggcccgcagatgctgatcggcatggcggcggcggaatgttcgcataaagaagccgccggggcggcaaccgggtttgtcggcctgttcgcttatcttggcgcctcgctttccggttggccgctggcgcaggtgatggatatctggcactggaccggattcttcgtggtgattgcgattgccgccggcatttccgcgctgctgctgctgccgtttttaaacgcgcaggcgccgcgtaccgccagcgaagcgtga

SEQ ID NO: 3358 - DNA, 1422 bp, Klebsiella pneumoniae
cgctttgagttcataaagctagtttcggttacgggtgactttaatcacgtccggcatgacgcggattttgcgcatgatattcgccagatgcacgcggtcgcgcgcggtcaggcggataaaggcgctgtatacgcggccatctttctcttccgtattcaggctctggatattggaagacgcggtgttgatcgccgccgtcaggttagccagcgcgccctggtggttaaacatgtccaccttgatttcggtgatgaactcctgagcggtctctttatcccactcaaccgccataaatttctccggctctttctggtagccgcgaatgttacgacaggattcatggtggataaccaaccctttacccgggctgacgtgggcgataatcgggtcacctggaattggacgacagcacttggcgaaggtgatcaacacgccatcggcgcctttgattggcagatgaccgtggttcgacgcgttagccggtaccggcgccgcagcggcttcgccctgctgcaggttttttgccaccacgacgctcatggcgttgcccagaccgatttccgccagcagatcgtcaagcgaggccagcttcatgcgatcgagttcgcgctggatattctccggtgggatctcggcgagtttgcggcttccgcccagcgcgtgattgagcagacgacggccaaggctgaccgaatcgtcgcgcttaaggtttttcagcagctgacggatcttggcgcgcgctttcgagctgacgacaaagttcagccaggcggcgttcgggcgagcgcccggcgcggtgataatttcgacagtctgaccgctggagagcggctgcgacagcggatagggctgacggtcgacgcgcgcgccgacgcaggcatgaccgatatcggtatgcaccgcgtaggcgaagtccaccggcgtggcgccggcaggcagttcgacaatgcgcccttccggggtgaaaacgtaaatctcatcggggaacagatcggattttacgctctcgataaattcaaacgagctaccggcgctctgctgcagctccagcaggctttgcatccagcgctgagcgcggatttgcgcggtggtgctgctttcgccgccgtgctctttataagcccagtgcgccgctacccccatctccgccatctggtccatgtcttcggtacgaatttgtacctcgaccgggacgccgtgggggccgatcatcgaggtgtgcaaagactgatagccgttagctttcggaatggcgatgtagtctttaaaacgacccggacgcggtttgtagaggctgtgcatctggccgagcacgcgatagcagatgtcggcatcatggacgataacgcggaaggcgtagatatccatgatcgagtgaaaacgttgctctttgagcaccattttacagtagatggagtatag

SEQ ID NO: 3359 - DNA, 552 bp, Klebsiella pneumoniae
cagcaggagttaaccatgagccgtttagcagatatccgtgaacaagacgccaccggcaaagccgccgatattttcgccgggattaaaaaagcgatgggcaaagtgccgaacgcctacctgaccatcggcggccactcgccggcggcgctgcagcaggcgctggcgcacaatgcgatgctccataaaggcagcctcagcgcccaacagctggaggcgattaatctgtcggtcagcgaagccaccggctgtgactactgcctggccgcgcacaccctgatggcgaaaaaagccggcttcagcagcgagcagatccatgccctgcgccgcggggagtatgcggaagaggcacagcttgatgcgctggtgaaattcgcgcagaccctggtgaccaccaccggtacgctgccggaagccgacgtcgccgcgctgcgcaacgccggttttagcgaccagcaggtgattgagattatcagcgccatcagcgccatcctgttcaccaacatggtgaaccgggttaacgacacggtggtcgacttcccgaaagccgattaa

SEQ ID NO: 3360 - DNA, 327 bp, Klebsiella pneumoniae
ataataaatacctcaggaatacacatgattgaattagaagatgcggtaatggaaattatcgttaatgcgggacagtcacgctcattatgttttgaagcgctgcatgcggcccgaatcggaaatatcgacgaagcgcgcttactcttaaacgaggccgacggctacgcccgccgggcgcatcagatgcaaacccagctcatcgggcaggatgccggtgaagcgcgtcagcccatgacgctgattatggtacatgcccaggatcatttgatgaattcgctgctggcccgcgagttctcagaagaattaatccatctgtaccagcgttaa

SEQ ID NO: 3361 - DNA, 228 bp, Klebsiella pneumoniae
cgacgctgtactgtattaacgtccccaagccgcagctctctgaggccaggccaataccacccgcgtgtcgacggaacgcgatcgcttgaacaagggctatcagcattacccgatggtatctacgcgcaggtggcggtctactccgaccatttcgcccacgtctcggtgatgcgtaaagtgctgctgcggatgaccagctggatgcactacctctatctcgatcattaa

SEQ ID NO: 3362 - DNA, 372 bp, Klebsiella pneumoniae
ttctgcaccaccatcgccagcccgcgtttgtacggcggcaactgggtgacgtcagtatcgccgatcaggatccgcccgccagccggttgcacaaaaccggcaatcgcccgcagcaccgtggttttcccggaaccggaagggccaatcagcgccagcacctcaccgggctcaatggtcaatgacagcggttttaagaccacgttgccgtggtatgaaacgcgcagcgagtccagggtgatcccggacgtccccgccagcgacggggaagaagtgacggtggttttcatcaacatcaggcttactcgctatcggtcactttatgccagcgggcaatgtcagccgacagcgatacggcgacatcgtcccagttag

SEQ ID NO: 3363 - DNA, 423 bp, Klebsiella pneumoniae
tcgacaaccacactatcaaaaccacccttggcgaacactacggcgccatcaccgccgccaatctgcagaaagcgcatcgccagctggaaaccggacgcgccgtcggcaagatcgtgctggaggggttttaagatgatatcgcttatcgccgtgctcaaggcgaaaccgggccaaacggacgccctgcgccaggccctgcaggcgctgctcctgccgacgagacaggagccgggcaacctcgactatgccctgtttcagctgcgcgacgcgccggacaccttctatatgcgcgaggcgtggcagggacaggacgccctcgatgcccatgtcgcgatgccctattttcaggcgtttatgacgcagatggagtctctgctggctgagccgctgcggctggactttctgacgccggttgagccttag

SEQ ID NO: 3364 - DNA, 1428 bp, Klebsiella pneumoniae
atggatcgcacccgttgtagcccggctaagcgtagcgccagccgggaacgctccttcaacaacgctatcgcatcagaaccacgcctcaaacatcccgccgacgttcagcgaatccagctgctggtctttggtgttgttgaccttcgcggtatgctcgttgtccacctggccgccggtgacgtagaagcgcagcatcgggcggaactccggccccatgccgatggcgatgttctgcgacagcgtcagcttccagccgtggttatccccgccctggtcgtagtccacgcgctggtagcccgcttccagccaggtggagtgcacgtcgttccagaagtacatcggccgcacgatggcaccgtagtttttacggttgtcggtgttgtccttgccgttgtcgtagtcgtggaaggccagcagatattccacctgcgcctgctgggtgaacttatggctgccctcgaagctggcgtagaccgtggtcaggtcgtcggttttgttgtagacgctgttatccgagttgtcggagtagcgcaggatcaccttgttcaccccgctgtcgttggtgtggctcagcaccaggccgccctgccaggcttcgaggcgcgcgtcgctgtccaccgccttcgagtcaaagccgtagttggcgtacacctcgacgtcgatcggcccggccttgatgttgtgggttttggtggtcagcgcgtagtggccgttgtcgccggtgtcggagctgccggtacaggtgatgcgcgacgggttggtttcatcggccatcacttccgggctacaggatttcacctgcgacaccgccgccacgtcgaactgcacgccgccgatatcaaagttcttcaccccggcgccctggccgtcgtggttcatccagaagtagtcgttgatcccctgttgcggacgctggtggaagtcgcggccggcccagatataggcgttggggttggattccagcacgttggtgaccccgacgtaggccttcttcaggttaacttcgtcgctccagtggtcgaacatcacgttaagatcccagatagccccctgcgcgcttttgaaggccttgctgatctggaattcgccgccgttgctttcgttgcccagacggccgatcgccgaggcgccgttataggagccgtcgacgccgacatatttctggtcgccggtctggaagtgggcgccatagcgggcgtagccgctgaacttgaggccgaacggaatggccatatccggcgaggcggcggtggtttccgggttagtaatcacgtcgacctttttgttggccgcggcgtcgatttttgcctggcggtcggccagcgctttatcaacggctttggcgacgatggcatcgatctgttcctgcgtaaattcttgcgccatgacagaaattgggcacagcgcggcgaccaccgccatggctaa

SEQ ID NO: 3365 - DNA, 801 bp, Klebsiella pneumoniae
cctgagcggttcccggattacggcgcgttgcgccttatccgggctacatttctgtgcttagcagcggcaaatggcaatacatcaaatcccatcgccgtactcgaaggtgtggtggatgccattgaaatgctgatccatatccatcgccggcttgtcgctctccggcttgccgacgatacgcgccggtacgcccgccgcggtggtgtgcggcggaaccggctgcaataccaccgaaccggcgccaatcttcgcgccacgcccgacttcaatattgccgaggatcttcgccccggcgccaatcattacgccttcgcgaattttcggatgacggtcgccgctggttttaccggtcccgccgagggtgaccgactgcagaatagagacgtcatcttcaatcaccgccgtttcgccgaccacaatgccggtggcatggtcgagcatgatcccgcggccgattttcgccgccgggtggatatccacctggaaagagacggagacctgattttgcaggaaaatcgccagcgcgcgtcgcccctgagtccacagccagtggccgatacgataggcctgcagggcatggaaacccttcagatagagcaacggcgtggagtatttatccaccgccgggtcgcgcgtgcgcaccgcctgaatatcgcaggcggcggaggcgatcatttccggatcggcggcgtaggcctcttccaccacttcgcgaatggcgatcgccggcataatcggggaagccagcttgttggccagcatatagctcagcgcgctgccgagattttcatgcttgagtag

SEQ ID NO: 3366 - DNA, 1392 bp, Klebsiella pneumoniae
agcgagataaccatgaatactgtaaaaaaactgcctttagccatggcggtggtcgccgcgctgtgcccaatttctgtcatggcgcaagaatttacgcaggaacagatcgatgccatcgtcgccaaagccgttgataaagcgctggccgaccgccaggcaaaaatcgacgccgcggccaacaaaaaggtcgacgtgattactaacccggaaaccaccgccgcctcgccggatatggccattccgttcggcctcaagttcagcggctacgcccgctatggcgcccacttccagaccggcgaccagaaatatgtcggcgtcgacggctcctataacggcgcctcggcgatcggccgtctgggcaacgaaagcaacggcggcgaattccagatcagcaaggccttcaaaagcgcgcagggggctatctgggatcttaacgtgatgttcgaccactggagcgacgaagttaacctgaagaaggcctacgtcggggtcaccaacgtgctggaatccaaccccaacgcctatatctgggccggccgcgacttccaccagcgtccgcaacaggggatcaacgactacttctggatgaaccacgacggccagggcgccggggtgaagaactttgatatcggcggcgtgcagttcgacgtggcggcggtgtcgcaggtgaaatcctgtagcccggaagtgatggccgatgaaaccaacccgtcgcgcatcacctgtaccggcagctccgacaccggcgacaacggccactacgcgctgaccaccaaaacccacaacatcaaggccgggccgatcgacgtcgaggtgtacgccaactacggctttgactcgaaggcggtggacagcgacgcgcgcctcgaagcctggcagggcggcctggtgctgagccacaccaacgacagcggggtgaacaaggtgatcctgcgctactccgacaactcggataacagcgtctacaacaaaaccgacgacctgaccacggtctacgccagcttcgagggcagccataagttcacccagcaggcgcaggtggaatatctgctggccttccacgactacgacaacggcaaggacaacaccgacaaccgtaaaaactacggtgccatcgtgcggccgatgtacttctggaacgacgtgcactccacctggctggaagcgggctaccagcgcgtggactacgaccagggcggggataaccacggctggaagctgacgctgtcgcagaacatcgccatcggcatggggccggagttccgcccgatgctgcgcttctacgtcaccggcggccaggtggacaacgagcataccgcgaaggtcaacaacaccaaagaccagcagctggattcgctgaacgtcggcgggatgtttgaggcgtggttctga

SEQ ID NO: 3367 - DNA, 1947 bp, Klebsiella pneumoniae
aaacgtaaaacctgtgtttgtataaattcagcttatttttcgacacaacaggtccctaatgaacgcaaccctgatcgcttcgaccctactaaaaaccgcgccagccgcggtggtcgtcgtgtctgtggtggtcgtcgtcggcaatgcgccgtagggtccggaacaacacgaattccaaaccccgccggcgcaaaccgagcggggttttttgttggcgagccccccggtaaagtcggcccagaagaaaaggactggagcatggcaagttcgggcaccacatcaaacacaatgcgctttaccggcgcgcagctggttgttcatttactggagcgccagggtatcactatggtcagcggcattccgggcggctccatcctgcctatctacgatgccttaagccagagcacgcagatccgccacatcctggcgcgccatgagcagggcgcgggctttatcgcccaggggatggcgcgtaccgaaggcaagccggcggtctgtatggcctgcagcggcccgggggcgacgaacctggtgacggcgatcgccgatgcccgcctggattcgattccgctggtctgcatcaccggccaggtaccggcctcgatgatcggtaccgacgccttccaggaagtggacacctacggcatctctatccccatcaccaaacataactatctggtgcgcgacattgccgagctgccgcaggtgatcagcgacgccttccgtattgcccagtccgggcgtcccgggccggtgtggatagacattcctaaagacgtacagtcggcgaccattgagctggaagcgctgcctgagcctggcgagcgcgccccggcaccggcattcgcgcctgaaagcgtgcgtgaagcggcggcaatgatcaacgcggcgaaacgcccggtactgtatctgggcggcggggtgattaacgcgccgcaggcgatccgtgagctggcggaaaaagccaacctgccgaccaccatgaccttaatggcgctgggcatgctgccgaaggcgcacccgctgtcgctggggatgctggggatgcacggcgcgcgcagcaccaacttcattctgcaggaggcggatttactgattgttttaggcgcccgttttgatgaccgggcgattggcaagaccgagcagttctgcccgaacgcgaagattatccacgtcgatatcgaccgcgccgaactgggcaaaatcaagcaaccgcacgtggcgattcagggcgatgtggcggaagtcttagcccagctgaacccgcatattgaggcgcagccgcgcgaggaatggcgccagctggtggccgacttgcagcgcgaattcccctgcgccatcccgcaggaaagcgacccgctctcccattacggcctgattaacgccgtggccgcctgcgtggatgatgaagcgatcatcactaccgacgttggccagcaccagatgtggacggcgcaggcctacccgctcaatcgtccgcgccagtggctgacctccggcggcctcggcaccatgggcttcggcctgccggcagccatcggcgcggcgctggcgaatccgcagcgcaaggttatctgcttctccggcgacggcagcctgatgatgaatattcaggagatggccaccgccgccgaaaatcagctggatgtaaaaattatcctgctgaacaacgaagcgctggggctggtgcatcagcagcagagcctgttctatcagcagggcgtttttgccgccacctatccggggatgattaactttatgcagattgccgccggttttggcctgcaaacctgtgatttaaataatgaagtcgatccgcaggcggcgctgcaggcgatcatcgaccgtccggggccggcgctgatccacgtgcgcatcgacgcacagcagaaagtgtatccgatggtaccgccgggtgcggccaatactgaaatggtgggggaataa

SEQ ID NO: 3368 - DNA, 1452 bp, Klebsiella pneumoniae
tctggaaaaacgcctgtactttccgtttacgctggcgcctgggacgccgttatctgcgtattaagcgttatcgccacgcgggatagaccaaaaactcgctgtttccgccaaagagatagctttacgcgggctaaatgcttagaatttgcccgccaaaacagagaacggataaatagtttggaattgctttataccaccctactttaccttattcagccgctggtgtggctgcggctgctgctgcgcagtcgtaaggctcctgcctatcgcaaacgctgggcggaacgctatggcttctgtcagaacaaggtagagccggatggcattctgctgcactccgtttccgtcggcgagaccttagccgccattccgctggtccgcgccctgcgccaccgctacccttctctgccgatcactgtcaccaccatgacgccgaccggctccgagcgcgccatgtcggcgtttggcaaagatgttcatcacgtctatctgccctacgatctgcccggcgccatgaaccgcttcctgaacaccgttcagccgaagctggtgatcgttatggagaccgagctgtggccgaatatggtggccgcgctgcataagcgtaagatcccgctggtgatcgccaacgcgcgcctgtccgaacgttccgccaaaggctatgccaaactgggcggctttatgcgccgcctgttgagccgcattacgcttatcgccgcgcagaatgaagaagatggtaaccgcttcctctccctggggctgaagcgcaaccagctggcggtcaccggcagcctgaaattcgatatctccgtcacgccagagctggcggcccgggcggtgacgctgcgtcggcaatgggcaccgcaccgcaaggtctggattgccaccagcacccacgacggtgaagaacaaatcatcctccaggcgcataaaaaactgctggagactttcccgaacctgctgctgatcctagttccccgccatccggagcgcttccctgacgcccgtgagatggtacaaaaggctgggatgagctttactctgcgcagcaccggcgagatcccttcctccagtacccaggtagtcattggcgataccatgggcgagctgatgctgctctacggcattgccgacctcgccttcgtcggcggcagcctggtggagcgcggcggccataacccgctagagccggcggcgcacgccattccggtgctgatgggtccgcataccttcaacttcaaagatatctgcgccaagctgcagcaggacgatggcctgatcaccgttaccgatgccgattcgctggtcagggaggtgtccacgctcctgaccgatgaagattaccgtctgtggtatggccgtcacgcggtggaagtgctgcaccagaaccagggcgcgctgtcgcgtctgctacagttactgcaaccttatctgccgcagcggagtcattaa

SEQ ID NO: 3369 - DNA, 1110 bp, Klebsiella pneumoniae
caactcagaactaacatcatacttttcatgaatatataccaccgtttgatgttggttacgctgccattcgcctctgttcagatttgcgcggccgcggaaccaacggcgccgctcgaaccggcgtatgcctatcacggcgcagagcccgcggatctgccggcgccagaaagtcgccaacctgcggccgcagcatcgtcctcgctactccctttgctaggcgatgaggccagaaagcgcggctacgtcctgccgctgccgtttggcgtcagcattaactatatggatatgcggcagaatattaatgtcgacagcataaacttcaccgggctgtcgctggatggccgcaatatcgattgcggtaaggatcctgtctgcaagcacgccgtgaataacattttcgctaatgggccggtctcgctggataacgctttccagattggcgttggtcatacgcgggaaagcagcaaaaccgagacgctcaagctggatgcctggctgctgccgtttatgaacgtttatggcctggtggggcacaccgaagggcattcaatttcgcagatagctgtcggcctgaagggaccgaacggtaaagtggtgcccctgccggggatgcaggatctcgactttcgtctcgattttaaaggtactacctacgggatgggcaccaccctggtgggcggcgtcggcaattggtttaccgtgctggacgccaactacacgcaaacgcgctttgatatcctcgacggcagcatcgatgcgcttaccttttcgccacgcgttggctatcgtttcagtacgccatcggtcgatgcgctgcatctccccgccggaaagctaaatctgtgggttggcagcatgtatcaggatgtgcagcaggagtttaaaggcagcctcagcgatctctcgatgccgtcgccgatgctgcagaatatggttaatctggccaaccaggacaataacggtcgcttcgatgtgaagcagcatctgcagtcgccatggaacgttctggtgggcgcgcaatacgagctgacgcagaattttaatattactaccgagtttggctttgccgaacgtaacagtttctttattgccggcgagtatcgcttttga

SEQ ID NO: 3370 - DNA, 1665 bp, Klebsiella pneumoniae
taccagagaacactaacgatggattcgcaacgcaatcttcttatcatcgctttgttgttcgtgtctttcatgatctggcaagcctgggagcaggacaaaaatccgcagccccagcagcagaccacgcagactacgaccacagcagcgggtagcgccgccgaccagggcgtaccggccagtggccaggggaaactgattacggttaaaaccgacgtgcttgagctgactatcaacaccaacggtggcgatattgagcaggcgctgcttctggcgtatccaaaaacgctgaaatcgaccgaaccgttccagttactggaaaccacgccgcagtttgtctaccaggcgcagaacggcttaaccggccgtgacggtccggataacccggcaaacggcccgcgtccgctgtacaacgtcgataaagaggcgtttgtgttggccgatggccaggatgagctcgttatcccgctgacctacactgacaaagccggcaacgtcttcaccaaaaccttcaccctgaagcgcggtggctatgcggtgaacgtgggttacagcgtgcagaatgccagcgagaagcctctggaagtctcgaccttcggtcagctgaagcagaccgctgcgctgccgaccagtcgcgatacgcagaccggtggcctgtccacgatgcatactttccgtggcgccgcgttctccactgcggattcgaaatacgagaaatataaattcgataccattctggataacgaaaacctgaacgtcagcaccaaaaacggttgggttgccatgctgcagcagtacttcaccaccgcatgggtgccgcggaataacgggacgaataacttctacaccgccaacctcggcaacggcgttgtcgctattggctacaaatcgcagccggtactggtgcagccaggccagaccgacaaactgcagagcacgctgtgggtcggcccggctattcaggacaaaatggctgccgttgcgccgcatctggatctgaccgtcgactacggctggctgtggttcatctcccaaccgctgttcaagctgctgaaattcatccacagcttcctcggcaactggggcttctcgatcatcgttatcacctttatcgttcgtggcatcatgtacccgctgaccaaagcgcagtacacctccatggcgaagatgcgcatgctgcagccgaagattcaggccatgcgtgagcgtctgggcgacgataaacaacgtcaaagccaggagatgatggcgctgtataaagcggaaaaagtaaacccgctgggcggctgcttcccgctgattattcagatgccgatcttccttgcgctgtattacatgctgagcgcctcggttgaactgcgtcatgcgccgtttatcctgtggatccacgacctgtctgctcaggacccgtactacatcctgccgatcatcatgggcgcgaccatgttcttcatccagaagatgtcgccgaccaccgtgaccgacccgatgcagcagaagatcatgacctttatgccggtcatcttcacggtgttcttcctgtggttcccgtctggcctggtggtgtactacatcgtcagcaacctggtcaccattattcagcagcagctgatttaccgtggtctggagaaacgtggcctgcatagccgcgagaagaagaaatcctga

SEQ ID NO: 3371 - DNA, 1215 bp, Klebsiella pneumoniae
aggggtatgaccggggttagagcaggaacattatctatgtttgaaaagcgtcaccgtattacgctgttatttaacgccaacaaagcttatgaccgccaggtagttgaaggtgtcggcgagtatctgcaggcctcccagttggaatgggatatctttattgaagaggactttcgggcacgcatcgaaaacatcaaagagtggttgggcgatggcgttatcgccgactatgacgatcccgaaatcgaaaagctgctggccgatgtccacgtgcccatcgtcggcgtcggcggatcttatcatcagccagagcagtacccgccggtccactatatcgccaccgacaacgccgcgctggtggaaagcgcttttctccatttgaaggaaaaaggggtgcaccgcttcgcgttttacggactccccgcctccagcggtaaacgctgggcggtagagcgcgagtatgccttctgccagctggtcgcgaaggagaagtatcgcggcgtggtctaccaagggctggagacagcgccggagaactggcagcacgcgcaaaaccggctcgccgactggctgcaaaccctgccgccgcaaaccggcatcatcgccgtcaccgacgcccgtgcccgccacgtcctgcaggcctgcgagctactgcatatcccggtgccagagaaactgtgcgttatcggcatcgataacgaggagctaacccgctatctctctcgcgtcgccctctcctctgtcgcccagggcacccgccagatgggttatcaggcggcaaaattactccaccggctgttgaataacgaggccctcccgctgcagcgccagctgatcccgccgatgcgcgtcgttgagcgacgctccaccgactaccggtcgttaaacgatccctccgtgatacaggcgatgcattacattcgcaacaatgcctgcaaaggcatcaaggtggaacaggtgctcgacgccgtgggcatctctcgctctaatctggaaaaacgcttcaaagaggaggtcggggagaccatccacacggtgatccacagcgaaaaactggaaaaggcgcgcagcctgctggtgtccactagtctgtcgatcaatgagatttcgcagatgtgcggctatccgtcgctgcaatatttctattcggtgtttaagaaggagtacgacgtgacgccgaaggagtaccgcgatcggcacagcgaggtgatgctgtag

SEQ ID NO: 3372 - DNA, 297 bp, Klebsiella pneumoniae
tgcccgatgactttgtcatgcagctccaccgattttgagaacgacagcgacttccgtcccagccgtgccaggtgctggctcagattcaggtggtgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagcctgtcatacgcgtaa

SEQ ID NO: 3373 - DNA, 351 bp, Klebsiella pneumoniae
cccctgacgacgcaggctggcagccacggttttcacgttgaaccggtaaccctgggcacgaagctcatccgtcaggcgtggcgctccatagcgttgttttgcgtcactgaatgcttcccggacgacgttatcacagacaaggcggaactgctgacgccggtttacctgataacgacgctgatgccagatgtaccagccactacgggtaacctgaagtacacggcacatggctttgatactgaactcagcctgatgtttttcgatgaaaacatacttcatttcaggcgcttcgcgaagtatgtcgcggccttttggagaatggccagttcctcatcccgttctgccagttga

SEQ ID NO: 3374 - DNA, 651 bp, Klebsiella pneumoniae
tggcgccagacaacaggaggcgctatggcagcaacctttctcgatatcgctatcaccccggacgtgatggatgtgcagcatgaaatgggcagcgactcgctgtggcaaacgccgcgcagtcgccgccaggccgaccgcttcggcgacagcgaagcggggatgatcgccacccgcgacagcttttatctggcgacggtgtcgcagagcggctggccctacattcagcatcgcggcggcccgccggggtttctgcatctgttggatgacaccaccctggcgatggccgatttcggcggtaaccgccagtacattactaccggcaatctgcgcggcagcgaccgggcctgcctgtttttgatggattatccgcgccgtgccaggctgaaaatctacgccaccgtcgaggtcctggcggcagaggaccacccgcagctgctggcgcaggtgacgccggccaactatcgcgcccgcattgaacgtctgtttctttttcatttgcaggcgtttgactggaactgcccgcagcacattacgccgcgctacagcgcgcagcaggtggcggagtacagccagaacctgcagcaacgtattcatgacctggagcaggagaatcagcgcctgcagcagcaattagcccgtagaggagagtaa

SEQ ID NO: 3375 - DNA, 966 bp, Klebsiella pneumoniae
ggggaagggacgatgaaactcaccgacgtggcgattgtcgctgtagagggctttagcccgtttcactacgccgtcccctgcatgctgtttggcgattcggtttcggaaatcaaacgctttaatctgcacatttgcgccgagcggccggggctgctgcgcgcccgcgatggttttgcgctgtacgccaccggcgattatgccgcgctggaacaggcggatatcgtggtggtgccttactggggcgaggtcgatcgacgtccgccgcaggcgctgcttgatagcctggtgcgggcccgggataacggcgcggagattgtcggcctgtgcctcggcgcgttcgtcctcggctacgccgggctgctggacggcaggcgagcggcgactcactgggagttcgagcaggatttccagcgccggtttccgcaggtgcagctggatatcaacgccctgtacgtcgacgaccagcggatcattacttcggcgggcaccgcggcggcgctggactgttgcctctacatcatccgccagcgtttcggcagcctcgcggccaaccagatcgcccggcggatgattgtttcgccgcaccgcgagggcggccaggcgcagtttatcgcccagccggtgccgaaaaacacccgcgatgcgcgaatcaactgcctgctggattatctgcagcagcatattgccgagccgcacagtctcgattcgctggcccgggtggtggcgatgagccgccgtaccttgacccgccacttcgcccgggcaaccgggatgagcattaccgactggctgaccgccgaacgtctgcgccgcagccagactctgcttgaggcgggcgatctgccggtcgagcaggtggcggaggcagtgggctatctttcagcggtcacctggcgccagcagtttaaagcgcgctttggcgtcagcccgacggaatggcggcgtacctttcgtcgcggcgcttag

SEQ ID NO: 3376 - DNA, 1059 bp, Klebsiella pneumoniae
cgcgcttttgccgcgctgcgggcaatttttctacacaacgagtggattatgaaacgagaactggccatcgaattttcgcgtgtcaccgaagccgccgcgctggcgggctataaatggctgggccgcggcgataagaataccgccgacggcgcagcggttaacgccatgcgcattatgcttaacctcgtcaatatcgacggcaccatcgtcatcggcgagggcgaaatcgatgaagcgccgatgctctatatcggcgaaaaagtgggtaccggcaagggcgatgcggtagatatcgccgtcgatcccatcgaaggcacccgcatgacggcgatgggccaggccaacgccctggcggtgatggcggtcggcgataagggctgcttcctcaacgcgccggatatgtatatggaaaagctgatcgtcggcccgggcgctaaaggcgctatcgatctcaatctgccgctggaagagaacctgcacaatatcgcccgcgccctgaacaagccgctgggcgagctgaccgtcaccgtgctggcgaaaccgcgccacgacgcggtcattgcccagctgcagcagctgggcgtgcgcgtgttcgctattcccgatggcgacgtcgcggcctctattctcacctgcatgccggatagcgaagtcgacgtactgtacggcatcggcggcgcaccggaaggggtggtttccgccgcggtgatccgcgccctcgacggggatatgcaggggcgcctgctggctcgccaccacgtgaagggcgataacgaagagaaccgccgcatcggtgaaaatgagctggcgcgctgcaaaaccatgggcattgaagcgggcaaagtgctgcgtctggatgaaatggcgcgcagcgataacgtcgtcttctccgccaccgggatcaccaaaggcgatctgctggacggcatcacccgcaagggcaacatggccaccaccgagacgctgctgatccgcggcaagtcgcgcactatccgtcgtattcagtcgattcattacctcgaccgtaaagatccggacattcagcagcacatcctgtaa

SEQ ID NO: 3377 - DNA, 687 bp, Klebsiella pneumoniae
ctgctatctgctgatgctgatcggcggcctggcggggattgcggtattcgaagcctgctccggggtgctgatgggcgcggtgctcggcctgagcagcatggcggtgagtattctgtttattctgccgatcccggcggcgttcttcggggcgtggtttgccggccgccccaacaagcgtttcccgaccctgatgtggcagtcggtgatctgctgcctgctggcgggtctgatgatgtggatcccagggctgctgggcatcatgaccgtctggaccctgctggtgcctgcggcgctgttcttcttcggcgccgggatgttgttcccgctggccaccagcggcgcgatggagccgttcccgttcctcgccggaaccgccggggcgctggtgggcggcttgcagaatatcggctccggcgtgctggcctggctgtcggcgatgatgccgcaaaccggtcagggcagcctcggcctgctgatgatgctgatgggcctattgattctgctgtgctggctgccgctggcctcgcgcttcacccaccatcagcagccggtataagcgcggcggccgttccccggatggcggctgacgccttatccgggctaccggactggtcgtctgccggcccgcgcatgcgcagtgccgtcattttgccgggtggcggctcacgccttacccggcctccctaa

SEQ ID NO: 3378 - DNA, 681 bp, Klebsiella pneumoniae
atcaagcctgctgaacgccctggcggggccgcgaagcggcgatcgtcaccgatatcgccggtaccacccgcgacgtgctacgcgagcatatccatatcgacggcatgccgctgcatatcatcgataccgcagggcctgcgcgatgctaatgacgaagtggaacgtatcggcatcgagcgcgcctggcaggagattgcccagcccgatcgggtgctgtttatggtcgacggcaccaccaccagcgccgttgacccggcggagatctggccagactttatcgagcgcctgcccgctaaactgccgattaccgtggtgcgcaataaagccgatgtcaccggcgaagcgctcggtatcagcgaagtaaatggccactcacttattcgcctgtcggcacgtaccggcgaaggcgtggaggtgctacgtaaccacctcaagcagagcatgggcttcgataccaatatggaaggcggcttcctcgcccgccgccgtcacctgcaggccctggaagaggcggcgaaccatctgcagcaaggcaaagcccagctgctgggcgcctgggccggcgagctgctggcggaagagctgcgcctcgcgcagcaggcgctgagcgagatcaccggggagttcacttccgacgatctgctgggccgcatcttctccagcttctgtatcggcaaataa

SEQ ID NO: 3379 - DNA, 1599 bp, Klebsiella pneumoniae
cgccccgctgcggggcgtcattttcatcccgccggatatcactgttgcggagtctttatgacctggctactcgaaatgaagaacatcaccaaaaccttcggcgctgttaaagccgtggataacgtcagcctgcgcctgaacgcaggcgaggtggtctcgttatgcggtgaaaatgggtcggggaaatcgacgctgatgaaggtgctgtgcggtatctatccgcacggaagctatgagggcgagattatttttgccggcgaaacgctgcaggcaaaccatattcgcgataccgaacgcaaaggcatcgccattattcatcaggagctggcgctggtgaaacatctcaccgtgctggagaatattttcctcggcgccgagatatcccgccatggtctgctggattatgaaaccatgacgctgcgctgtcagaagctgttggcgcaggtcaatctgcccatttcgcccgatacccgcgtcggcgacctcggccttggtcagcagcagttggtggagatcgccaaggcgctgaataaacaggttcgcctgctgatcctcgacgaaccgaccgcctccttgaccgaacaagaaaccgcgacgctgttggcgatcgttcgcgatctgcaaaaccacgatatcgcctgcatctatatctcgcataagctcaatgaggtcaaagcgatctccgatacgatctgcgtgatccgcgacggccagcacatcggcacccgcgatgccagcggcatgagcgaagacgatatcatcaccatgatggtcggccgcgagctcaccgcgctctatcccagcgagccgcacgcccacggcgaggagatcctgcgggttgaacatttaaccgcctggcacccggtaaaccgccatattaaacgggtcaatgacgtctcattttccctgcgtcgcggagaaatcctcggcatcgccgggctggtcggcgccggacgtaccgaggcggtacagtgcctgttcggcgtctggccggggcgctggcaaggggagatctttattgatggccagccggtgagcatctctaactgccagcaggccattgcccacggcatcgccatggtgccggaagaccgcaaaaaagacggcatcgtgccggtgatggcggtgggcaaaaacattaccctcgcggcgctcaaccagttcaccggcgcaatgagcagcctggacgacgccgccgagcagcactgcatccagcagtccattcagcgtttgaaaattaaaacctcctcgccggagctggcgattggccgtctgagcggcggcaaccagcaaaaggcgattctggcgcgctgtctgctgctcaatccgcgcattctgatcctcgacgaacccacccgtggcatcgatatcggggcgaagtatgaaatttataaactgattaaccagctggtgcagcagggcatcgcggtcattgtcatttcatccgaactgcccgaggtgctcggtctcagcgatcgggtgctggtcatgcacgaaggcagactaaaagccaatttggttaatcaacatctgacccaggaacaggtgatggaagccgcgctgaggagcgaacgccatgtcgaagaacacgtcgtctga

SEQ ID NO: 3380 - DNA, 963 bp, Klebsiella pneumoniae
tctatggctgcaaccaagcctgcatttacccctccggggaaaaagggtgacatgattttcagtgcgctggtaaaactggctgcgctgattgtgctattgatgctgggcggcatcatcgtttccctgatcatctcttcctggccgagcattcaaaagtttggctttgcctttttgtggaccaaagagtgggatgcgcctaacgagatcttcggcgcgctggtcccgatttacggaaccctggtcacctcttttatcgcgctgctgatcgccgttccggtgagcttcggcatcgcgctgtttctgacagaattgtcccccgcctggctcaagcgtccgctgggcattgcgattgagctgctggcggcaatcccgagcatcgtgtacggcatgtggggcctgtttattttcgccccgctgtttgcgacttacttccaggagccggtcggcaacgtcctgtcgaccatcccgttcgtcggcgcgctgtttgccggcccggcttttggtatcggtattctcgccgctggcgtcattctggccatcatgatcatcccttacatcgccgcggtcatgcgcgatgttttcgagcagaccccggtgatgatgaaagagtcggcctatggcatcggctgcaccacctgggaggtgatctggcgcatcgttttaccgttcactaaaaacggggtgatcggcggggtgatgctcggtctgggccgcgcgctgggtgaaaccatggcggtcacctttatcatcggcaacacctaccagctcgacagcatctcgttgtatatgccggggaacagtattacctccgcgctggctaatgagttcgccgaagcggaaaccggcctgcacgtggcggcgctgatggagctgggcctgatcctgttcgttatcacctttatcgttctggccgcgtcgaagtttatgattatgcgcctcgcgaagaatgagggggcacgctaa

SEQ ID NO: 3381 - DNA, 288 bp, Klebsiella pneumoniae
aatattgatgcgcccaatatcttcccgcacccagcggtgaaagactgcgcagagaaactctccccaaagcgcggcgtcgccggccgccagctgcggaataaaatggatagcggtgagcccctgttgacgaagctgcgcatagaacgcctgcggttgatggcaatgatgcgcctccaccacgacagcctgaaagggagtgtcatgttgctggccgggggcatgagtgagaggcaaattcgccggacatcctgtcatgacatatccctaatgaataaaacgatcggttga

SEQ ID NO: 3382 - DNA, 1410 bp, Klebsiella pneumoniae
gggaatagtgcgcatatgaaagatcacattttgtccgtcaaagagaaaattggttacggcatgggtgatgccgccagccacattatttttgataacgtcatgttgtatatgatgtttttctacactgatatttttggtatccccgccggctttgtcggcaccatgttcctgctggcgcgcgcgctggacgcgatttccgacccgtgtatgggtctgcttgccgaccgtacccgcagccgctggggtaagttccgcccatggatcctcttcggcgctatcccgttcggcctcgtctgcgtgctggcctacagctcgccggatttaagccacaacggcaagctgatttacgccgccgtgacctacacgctgctgaccctgctctataccgtggtgaatatcccctactgcgcactgggcggcgtgatcaccgacaacccgacgcagcgcatctcgctgcagtcctggcgcttcgtgctggcgacggcggggggcatgctctccaccgtgctgatgatgccgctggtcaactttatcggcggcgaagacaaagcgctcggcttccaggggggcatcgcggtgctgtcgatgattgccttcctgatgctggccttctgcttctttaccaccaaagagcgtgtcgaagcgccgccgagcagtacctcgatgcgtgaagacctgcgagatatctggcgcaatgaccagtggcgggtggtcggcgtgctcaccatcctcaatatcctcgcggtctgcgttcgcggcggcgcgatgatgtactacaccacctggatcatgggctcggcggcgctgtttaccgccttcctcacgacctactgcgtcggcaacctgattggctcggcgctggcgaaaccgctgaccgactggaaatgcaaagtcagcgtcttctggtggaccaacgccctcctggcggtgctcagcgtggcgatgttcttcgtaccgatggacgccgaaatcactatgtttgtctttatcttcgtcattggcgtactgcaccagctggtgacgccaatccagtgggtaatgatgtccgacaccgtcgactacggcgaatggtgtaacggcaaacgcctgaccggcatcagcttcgccggtaccctgtttgtgctcaagttagggctggcgctgggcggcgcgctgatcggctggatgctggccggcggcggctatgacgccgccgctaaaacccagaacagcgccaccctcaccatcattatcgccttgttcaccctcgttccggcggtgtgctacctgctgagcgcggtgatcgccaaacgctactacacgctgaaaacgccgttcctgaaaaaaatgatggccgagctggccgagggcgcgcgtcgcaacgaacaagaattcaccgccgccccgatcgacaaagaatggcaaaactaa

SEQ ID NO: 3383 - DNA, 1458 bp, Klebsiella pneumoniae
agcgcgggtgcgcttcttcggcatgcagtcggagacattgcccttctatcaaatggccgatggtctgctgctgccgaccctctacgatccgttccccaacgtcattctcgaagcgatggcctgcggtctgccggtgatcaccaccaccggctgcggcggggcggagtttatcgtcgacggccacaatggttacgtctgcgacgctctggatatcccggcgctacagcaggcggtaatggccctgcccgcgcgcgcgctgggctctgcgcaaggcggtcacgcccgcgagcgcattatggcctgcaccagcgagcgactctcaacccagctgctttctctttatcaggatctggtgaattaacgatgcgcatcttatttgtgattgacggcttacccggcggcggcgcggaaaaagtggttctgaccctggcggcacagttcctgcgcgacggcgatcgggtgtcgctcatttcgctgcgcgatgtctgcgagtacccattgcccgaggggctcgactaccaggtagttgccgatcgctgccgtaaaccgtggcgcaagctgaccgagctgtcccgccgcgcccgccagctggatgccgcagtcgtgcgggccgaacagcaggggcaatttgaccttgtgctctccaacctgcacaaaaccgaccgtatcgtcgcccgcagccgggcgctgcgcgagcgtaacgtctggttctgtctgcacggcgtcttttcggcctcctatctcggacaccgcaccggctttgaccgctggatgaagcagcagaaaattaagcgaatttatcagggtcgcaacgtggtgacggtttccgacgcggtggggcgagatctggtggaagagtttgccctgcgcccggcacagctgaaaaccatctacaatcccttcgatatcactgccctgcgcgttgaggcggaagccgatagcgagcgcccggacggtgactacctgattcacgtcggtcgcttccatccgggcaaacgccatgaccgcctgcttgaagcctatgcgcagagcggcatcgacgcaccgctggtgctgctaggccagggaaaaccggagcaagagcagcgcctgcgccagctggcaaaaacgctgcacattgacgatcgggtgtggttcaaaggctttcagaaaaaccccttaccgtggataaaaggcgcacggatgctggttttgagctccgatagcgaaggattcggcaatgtggtggtggaggcgctgctgttacatactccggtcgccagcacccgctgccccggcggcgtcaccgagatcctcaccggcgaacttgcccgcggtctggcggatctgaccagtccggcgctggctcagacgatgcaaagcatttaccataacccgccggccatcgacgatgccgcgctggaaaaattcagcgtcgtatccatttgtcagcagtaccgtcagctgcagcgcacctga

SEQ ID NO: 3384 - DNA, 735 bp, Klebsiella pneumoniae
gaggagcccgccatggacgtagaaaatatctttcgtgacgtgaagctaagcaaaacggaaatgaccgtgctgcgctttattcagaacgacccggagcagtgtatccgccagggagttcgcgctgtggccgaacagtgctacagcaacccctcttccctggtccggctggcaaagaaactgaagttcagcggctggctggagctggtctatttcatcaagttcaatatcaccatgccgaagctcgatgtcaccaacgatatcgactacatgagcgttcagccggaagaagcgctgacgccgctgctggcaagccttaaccagcagcgcatcctgatccacggcagcggcttttcacagctgatcgcccagtatatttacaacaagtttctcgtcaccggcgtgaatgccagcctggcgctgtggcccgattacgaaatcctcgaacagaaaaacgccgcctgcttcgactccatctggatcatttctaaatccgggcgcagcagctcggcgctcaactgggttaaggccctggaggggaaggagattaatctggtctgctttaccggcgactaccaaagcccgctggcgcaggccgcggatacggcgtttattattcacgacccgcagaagttcgatgatgatatttactggagcaacccgtttttcggctactgcatcttaggctttgagcgactattgaagatgtggtttaccagtctacgtagcaatagttag

SEQ ID NO: 3385 - DNA, 306 bp, Klebsiella pneumoniae
ggcgggaccgcgtatacgaaacacgagtttctatcaacgccttgcaagttcaggagaggtatgacgatgtcattagaagtgtttgagaaattagaatctaaggttcagcaggcgattgataccatcactctgttgcagatggaaatcgaagagctgaaagaaaagaacaacaccctggtgcaggaagttcagagcgcgcagcatggtcgtgaagagctggagcgcgaaaacagccagctgaaagagcagcagcagggctggcaggaacgtctgcaggcgctgctgggtcgcatggaagaagtctaa

SEQ ID NO: 3386 - DNA, 639 bp, Klebsiella pneumoniae
ggcgtttacgccgccatccggcgttttcaggcaccaggacacaccatgaccaccatcgcccttattgacgatcatttgattgtccgctccggctttgctcagctgctggggctggaagctgattttcaggttgtcgccgaatttggtagcggccgcgaggcgctgacggggctaccggggcgcggcgtgcaggtctgtatctgcgatatctccatgccggatatttccgggctggagctgctcagccagctgccgaaggggatggcgatcatcatgctgtcggtacacgatagcccggcgctgatcgagcaggcgttgaacgccggcgcgcgcggcttcctgtcgaaacgctgcagccccgatgaacttatcgccgcggtacgcacggtggcggcgggcggttgctatctcacgccggatatcgccatgaagctggccgccgggcgccaggatccgctcaccaaacgcgagcgtcaggtggcggaaaagctggcgcagggcatggcggtgaaagagattgccgccgagctcggtctgtcgccgaaaaccgtccacgtacaccgcgccaacctgctggaaaagctgggcgtcagcaacgacgttgagctggcgcgccgcatgttcgatagctggcaatga

SEQ ID NO: 3387 - DNA, 1194 bp, Klebsiella pneumoniae
ggagcgaacgccatgtcgaagaacacgtcgtctgaaatcaaactcaccccaaccgcccccgcggccctgccggcgctgaaggggctgaatctccaggtcttcgtgatgatcgccgccatcgtcgtcattatgctgtttttcacctgggttaccgatggcgcctacctgagcgcacgcaatatctccaacctgctgcggcagacggccatcaccggcatcctcgccgtcggcatggtgtttgtgattatttcggcagaaatcgacctctccgttggctcgatgatggggctgctgggcggcgctgcggcgatctttgacgtctggctcggctggccgctgccgctcaccattctggtgacgctggtgatgggcctgctgctcggggcgtggaacggatggtgggtagcctatcgcaaagtgccctcgtttatcgtcacccttgccgggatgctggcgtttcgcggcattctgatcggcatcaccaacgggaccaccgtctcgcccaccagtccggcgatgtcgcagatcggccaaagctacctgccagacggcatcggcttcggcatcggcgttgtcggcatggcggtgtttatcgtctggcagtggcgcgggcggatgcgccggcaggcgttaggtctggcgacctcgtcctccaccgccgccgtcggccgccaggccattaccgcggtgattgtgctgggcgcaatctggctgctcaatgactatcgcggcgtaccgaccccggtgctgatcctcgccgccctgctgctggcgggcctgtttatggccacccgcaccgcctttggtcgccgcatctacgccatcggcggcaacctggaggcggcccgtctgtccgggattaacgtcgagcgtaccaagctggcggtgtttgccattaacggcctgatggtcgctattgccgggctaatcctcagctcacggctcggcgcggggtcgccttcggcgggcaatatcgccgaactggacgccatcgccgcctgcgtcatcggcggcaccagcctggcgggcggcatcggcagcgtcgccggggcggtaatgggggcgtttattatgtcggccctggataacggtatgagcatgatggacgtcgccaccttctggcaatatatcgttaaaggcgccattttgctgctggcggtgtggatggactctgccaccaagcggcgcgcataa

SEQ ID NO: 3388 - DNA, 1746 bp, Klebsiella pneumoniae
ttattgtgcgccaggcagcatacaatccgcctggccgcggtcataatccctgttaataataatgttattcacagggacggtaccatgagtgagatagcattgacggtcagcgtactggcgctggtggcggtggttgggttgtggatcggcaatgtcaaaatccgcggcgttggctttggtattggcggcgtgttatttggcggcattatcgtcggtcactttgtcgatcaggcgggcgtcgccctcagcagcccgatgctgcattttattcaggaattcggcttgatcctgtttgtctacaccatcggcatccaggtgggaccgggctttttcgcctcgctgcgggtctctggcctgcggctcaatctgttcgctatccttatcgttatcctcggcggcctggtgaccgcggtgctgcataagctgttcaatattcctctcccggtggtgctcggtatcttctccggtgcggtgaccaacacgccagcgctgggggccgggcagcaaattctgcgcgatctgggggtgccgttcgaggtggttgatcagatggggatgagctacgcgatggcgtatccgttcggcatctgcggcattctgctgaccatgtggctggtgcgtctgttctttcgcatcaatgtcgagaaagaggcccagcggtttgaggagagcagcggtaacggccacgcccatttacacaccatcaacgtgcgggtggaaaaccccaacctcaaccagatggcgattcaggatgtgccgatgctcaatagcgacaacatcgtctgttcgcggctgaaacgcggtgagctgttgatggtgcctgcgccgggcacccttatccaggctggcgacctgctgcacctggtggggcgacctgaggatttgcacaatgcgcagctggtgataggccaggaggtggcgacctcgctgtcgacgcgcggcaccgatctgaaagtggagcgggtggtggtcactaacgaaaaagtgctgggaaagaaaatacgcgatctgcacgtcaaacagcgctatgacgtagtgatctcccggcttaaccgggcaggcgtcgagctggtagccagcagcagcgccagcctgcagtttggtgacatcctcaacctggtcggccgtccggaggcaattgacgccgtggccgccgaactgggtaacgctcagcagaagctgcagcaggtccagatgctgccggtgtttatcggcatcggactcggggtactgctgggatctatcccgttgtttattcccggcttccctgccgcattgaagctgggactggccggtgggccgctgattatggcgctgatccttgggcgtatcggcagtatcggcaagctgtactggtttatgccgccgagcgccaacctggcgctgcgcgagctggggatcgtgctgtttctggcggtggtcgggctaaaatcggggggtgactttgtcgccaccctgacccagggcgatggtctgagctggatcgcttacggcattttcatcaccgccatcccgctgctgacggtgggcatcctcgcgcgcatgctggcgaaaatgaactatctgacgctgtgcggcatgctggccggctccatgactgacccgccggcgctggccttcgccaacaacctgcacgccaccagcggcgcagcggcgctctcgtatgccaccgtctatccgctagtgatgttcctgcgcattatcaccccgcagctactcgccgtgctgttctggggactgagctag

SEQ ID NO: 3389 - DNA, 1377 bp, Klebsiella pneumoniae
atcaggtgcgcaagccgaccctggatctgccgctcgatgtgcggcgcaaaatgtggttcaaacctttcatgcagtccctatctggtggttttcatcggctacctgaccatgtacctgatccgcaagaactttaacatcgcgcagaacgacatgatctccacctacgggctgagcatgacccagctggggatgattggcctgggcttctccatcacctacggcgtgggcaagacgctggtctcttattatgccgacggcaaaaacaccaagcagttcctgccgtttatgctgatcctctccgccatctgtatgctgggctttagcgccagcatgggggcgggttctaccagcctgttcctgatgatcgccttctatgcgctgagcggtttcttccagagcaccggcggctcgtgcagctattccaccatcaccaagtggacgcccagacgcaaacgcggcactttcctcggcttctggaatatctcccacaacctcggcggcgcgggcgcggcgggcgtggcgctgtttggcgccaactatctgttcgacggccatgtgatcggcatgtttatcttcccgtcgattattgcgctgatcgttggctttatcggtctgcgctacggtagcgactctccggaatcctacggcctcggcacggcggaagagctgtttggcgaagcgatcagcgaagaggacaaagagaccgaagaaaatgcgatgaccaagtggcagatctttgttgagtacgtgctgaaaaacaaagtgatctggctgctgtgcttctccaacatcttcctctacgtggtgcgtatcggtatcgatcagtggtccaccgtgtatgccttccaggagctgaagctgtctaaagaggtggcgattcagggctttaccctgtttgaagtcggcgcgctggttggcacgctgctgtggggctggttgtcggatctggccaacggccgccgcgcgctggtggcctgcatcgcgctggcgctgattatcgccaccctcggggtttaccaacacgccagcaaccagtacgtctatctggcctctttatttgcgctgggcttcctggtgtttggtccgcagctgttgatcggcgtcgccgccgtcggtttcgtaccgaaaaaagcgatcggcgccgccgatggaatcaagggcaccttcgcctatctgatcggcgatagcttcgccaaactgggtcttgggatgatcgccgacggcaccccggtcttcggcctgaccggctgggccggcacctttgcggcgctggacgccgccgccgtcggctgtatctgcctgatggccatcgtggctatctttgaagagcgtaaaattcgccgcgagaaaaagaaccgtattttgcagaccgcctga

SEQ ID NO: 3390 - DNA, 1203 bp, Klebsiella pneumoniae
acgtaccgcgcagcaggcagccgcattcgtaaaagcgtatcgagaggcagtgaaatgaaaataaccaatatcaccacgtaccgtttacctccgcgttggatgttcctgaagattgaaaccgatgaaggcatcgtcggctggggcgaaccggtgattgaagggcgcgcccgtacggtggaggcagccgttcacgaatttggcgattacctgattggtcaggatccggcgcggattaatgacctgtggcaggtaatgtaccgcggcggcttttatcgcggcggcccgattatgatgagcgccatcgccggtattgatcaggcgctatgggatattaaaggtaaggtcctgaatgccccggtgtggcaactgatgggcgggctggtgcgcgacaaaattaaagcctatagctgggtgggcggcgaccgccccgccgaagtgattgacgggattaagaagctgcgcggcattggtttcgacacctttaaattaaacggctgcgaagagatgggtatcattgataattcccgcgcggttgatgccgcggtgaataccgtggcgcaaatccgtgaagcgtttggcaatgaaattgagtttggtctcgattttcacggccgcgttagcgcgccgatggctaaggtattaattaaagagctggagccatatcgcccattatttattgaggagccggtattagccgagcaggcggaatattatccgcggctggcggcgcaaacccatattcccattgccgccggcgaacgtatgttttcgcgctttgaatttaaacgggtcctggaagcgggcggggtggctattttacaacccgatctgtcgcacgcaggcggtattaccgaatgctataaaattgccggcatggcggaagcctatgacgttgggctggcgccgcactgtccgctggggccgatcgcgctggcagcctgtctgcacgttgatttcgtttcgcataacgcggtcttccaggagcagagcatggggatccattacaacaaaggcgccgaactgcttgattttgtgaaaaataaagaagatttcaatatggaaggcggcttctttaaacctctgatgaagccggggctgggcgtggaaattgatgaggcccgcgtgattgagttaagtaaaaacgcgccggactggcgaaatccgttgtggcggtatgaggatggatctgtcgccgaatggtaa

SEQ ID NO: 3391 - DNA, 528 bp, Klebsiella pneumoniae
tttttgcgcgctttccctggcggaagcgcgtatttaaggacaacacgaaagggttttactatgtcagaacaaaacagcaccgaaatgaccttccagatccagcgtatctataccaaagatatctcttttgaagcgccgaacgcgccgcaagttttccagaaagactggcagccggaagttaaacttgatctggataccgcctccacccagctggctgaaggcgtttatgaagtggtgctgcgtgtgaccgtgaccgctgcgctgggcgaagaaaccgcgttcctctgtgaagtacagcagggcggtattttctccatcgacggcatcgaaggcacccagatggcgcactgcctcggcgcatactgcccgaacattctgttcccgtacgcgcgcgagtgcatcaccagcctggtttcccgcggtaccttcccgcaacttaaccttgcgccagtgaacttcgacgcgctgttcatgaactatctgcagcagcaggctggcgaaggtgctgaacaacatcaggatgcctga

SEQ ID NO: 3392 - DNA, 210 bp, Klebsiella pneumoniae
ttcgccagcgcatccagtttgatcagctcttcatcagtgatgacgttgccggtcgggttggtggggcgcgagacgcagatcatcccggtctcttccgtcacctgcagatgctcaaaatcaacatggtacttaaactggccttccggcagcagttcgatgttcggccgggtggcaacgaacagatcctcttccagaccggcatcggcgtag

SEQ ID NO: 3393 - DNA, 264 bp, Klebsiella pneumoniae
cgtagaagcgcagcatcgggcggaactccggccccatgccgatggcgatgttctgcgacagcgtcagcttccagccgtggttatccccgccctggtcgtagtccacgcgctggtagcccgcttccagccaggtggagtgcacgtcgttccagaagtacatcggccgcacgatggcaccgtagtttttacggttgtcggtgttgtccttgccgttgtcgtagtcgtggaaggccagcagatattccacctgcgcctgctgggtga

SEQ ID NO: 3394 - DNA, 363 bp, Klebsiella pneumoniae
tcttacccagcaatagtggacacgcgactaagtggagtaaactctcaaccagaggtgactcacatgacaaaaccaacatcaaccaccaaaaagccacgcaagcagcacactcctgaatttcgtcaggaagccctgaaactggctgaacgcatcggggtggcagctgccgcccgcgaacttaacctgtatgaatcacagctctacaactggcgaagcaaacagcaaaatcagttctcttcttctgaacgcgagcaggacatgtccgctgagatcgcccgtctgaaacgtcaactggcagaacgggatgaggaactggccattctccaaaaggccgcgacatacttcgcgaagcgcctgaaatga

SEQ ID NO: 3395 - DNA, 192 bp, Klebsiella pneumoniae
ataagcccagcaacacggaatctgcatcccaacgcgcataacgcaataacattaccgcaagccctggtttgcggtcgcgttgtggatgtctgcctgacaagtgcttattttcaggggtattttaaaacatggcagaaaagcaaactgcgaaacggaatcgtcgcgaagaaatacttcaatctctggcgctga

SEQ ID NO: 3396 - DNA, 573 bp, Klebsiella pneumoniae
caaaaaacagcgctgattccattcaggatcaaagcgcgggcagggactattctggcaccctgcggttttatccccagggagcagaggatgaaccagtttcttattgccaatgcccagcggtgcatcggctgtcgtacctgcgaagtggcctgcgcggtggcgcaccagcaggcgcaggatgtcgccgccctgtcgacgaaccatttcgcgccgcgtatccgggtggtgaaaagcggtgacatatcgacggcgatggcctgtcggcagtgcgaggatgcgccctgcgccagcgtttgcccacagggggcgattcagcgcgacaatgacgtctggtgggtcgaccagcggcgctgcatcggctgcaaaagctgcatggtggcctgcccgtacggcgcgatgaccgttatggtaatgaaccagcaggcgcaggcgctgaaatgcgatctatgcgctcaccgcgccgaaggaccggcctgcgtggccgcctgcccgacgcaggcgctgcgggtgatggttcccgcggagctggaagcgctatgcgcgcaaaaacgccagcggctggcgctggcgtga

SEQ ID NO: 3397 - DNA, 399 bp, Klebsiella pneumoniae
gcgaatgaagcccctttattaacagatcaaatcaccatgaaagaagtcgaaaagaatgaaatcaagcgtctgagcgatcgtctcgacgccatccgccaccagcaggccgagctgtcgctggtggaagccgccgataaatatgctgaactggaaaaagaaaaagccactctggaaacggagattgaacgtctgcgttccgtccagagccagaagctgagcaaagaggcgcagaagctgatgagcctgccgttccgccgcgcgattaccaaaaaagagcaggccgatatgggcaagctgaagaaaagcgttcgcggcctggtggttgtccatccgatgaccgccctgggccgggaaatgggtctgaaagagatgaccggtttcgcccgcagcgaattttga

SEQ ID NO: 3398 - DNA, 582 bp, Klebsiella pneumoniae
tccaaaggagcaatcatgtcagataccttgaaagtggttacgttactcggcagcctgcgtaaagggtcgtttaatggaatggtcgcgcgcaccctgcccggcatcgcgccagcgggcatggatatctccgcgctgccgtcgatcggtgatatcccgctgtacgatgctgatatgcaggaggaagaaggttttccgcagcgcgtgcaggagattgcgcaacagatccgcgaggcggatggggtagtgatagtcactccagaatataactattccgtgcctggcggcctgaaaaacgccatcgactggctgtcacgcctgcccgagcagccgctgtccggcaaaccggtactgatccagaccagctccatgggcgctatcggcggggctcgctgccagtatcatctgcgccagattctggtcttcctcgatgcgatggtcatgaacaagccggagtttatgggcggcgtcatccagaacaaagtggatccgcaggcgggtgaagtggtcgatcaaagcaccctcgaccatctgcgcggccaactgaccgctttcggcgactatattcggcgggttaaagcataa

SEQ ID NO: 3399 - DNA, 1434 bp, Klebsiella pneumoniae
ttcaatttggctcatctgaaaggtcatttatatcgtttgtcagcccatgccgagtttctgttcaataaccacacgttacttacggcgaggtggggtatggaatcgcaaatttgggttgtgagcacattgctgattagcatcgtgttaattgtattaaccatcgtcaaactgaagtttcatccgtttctggcgctgctgctggcgagctttttcgtcggggcgatgatgggaatgggtccgctggagatggtcaacgccattgagagcgggatcggcggtacgctgggcttcctggcggcggtgatcggtctcggcaccattctcggcaagatgatggaggtctccggcgcggcggagcgcatcggcctgacgctccagcgctgccgctggctgtcggcggacgtgattatggtgctggtcggcctgatctgcggcattaccctgtttgtcgaagtcggggtggtgctgctgatcccgctggcattctccatcgccaaaaaaaccaatacttcgctgctgaagctggctattccgctgtgtaccgcgctgatggcggtgcactgcgtggtaccgccgcatccggccgcgctgttcgtggcgaataaactgggggctgatatcgggacggttatcgtctatggcctgctggtcggtctgatcgcctccctggtcggcggcccgctgttcctcaggctgctcggcaaccgcctgccgtttaaaccagtgccagccgagttttccaacctcgacgttcgcgaagaatcgacgctgccgtcgctcggcgctacgctgtttaccgtgctgttaccgattggcctgatgctggtgaaaaccgtcgctgaactgaatatggcgaaaggcggcacgctgtatacagtgctggaatttatcggcaaccccatcaccgcgatgtttatcgccgtctttgtcgcctattacatgctcggcatccgtcggcaaatggggatgggcgttctgctgactcataccgaaaacggctttggttccatcgccaacatcctgctgattatcggcgccggcggcgcattaaacgcgattttgaaatccagcggcctggccgatagcctcgcggtgatcctgtcgaaccttgatatgcacccgattttgctggcctggctggtggcgcttatcctgcacgccgccgttggctccgccaccgtggcgatgatgggcgctaccgccatcgttgccccgatgctgccgctttatcccggcgtaagcccggagatcatcgccattgccatcggttccggcgccattggctgcacgatcgtcaccgattccctgttctggctggtaaaacaatactgcggcgccagcctcagtgaaacgttcaagtactacacgacagcgacatttatcgcatcgctacttgcactggccgccaccttcctgctttctttcattatctga

SEQ ID NO: 3400 - DNA, 1440 bp, Klebsiella pneumoniae
cgggcaatggcaaaaataacgaaagagatgatagcgcggatcctcgcccacgtgggcggcgccgcaaacgtcgcgcaggcgggcaactgcatgacgcgcctgcgcttgaccctgcgcgatgaaagtctggccgacagcgccgccatccgccagattgacggcgtgatgggggtgatcgtcagcgacgagcagttccaggtggtgctcggccccggcaaggcgcaaaccgccgccgaaatgatgaacggcctgctggagccggcgcccgccgccgcgccgacgctggccgacgtcgcggcggagaaaaagcaggcgctgaagggcaagcagaccagcgcggtgcagaagtttctcgccaaattcgccaccatctttacgccgctgatccccggctttatcgccgtcgggctgctgctgggcttcgccaccctggcggaacaggttttcgtgctggagaacgcccatccgaacgccagcctggtggcgctgattggctatatgaaggtcttcagcaaagggatgttcacctttctgagtatcctgatcggctataacgcgcagaaggcgttcggcggctccggcgtgaacggcgcgattatcgcctcgctgttcgtgctgggctacaacccggaggcaaccagcggcttctacgccggcatttccaccttcttcggccatggcatcgatccgcgcggcaatatcatcggcgtactgatcgccgctatccttggcgcgtgggttgaacgccaggtgcggcgggtgatgccggccaacctcgatatgatcctcacttcggcggtgacgctgctgatcatgggcgcggtgacctttacggtgatcatgccgattggcggctggttgtttaccggcatgtcatggctgttcctgcatcttaacggcaacccgtttggctcggcggtgctggccggcctgttcctgctggcggtgatgttcggcgtccatcaggggtttgtcccggtctattttgcgctggtggacgcccagggctttaactcgctgttcccgatcctggcgatggccggggccgggcaggtgggggcggcgctggcgctgttctggcgggcgaagcgcgattcgctgctgcgaacccagattaaaggggcgattattccgggcttcctcgggattggcgagccgctgatctacggcgtcaccctgccgcggatgaagccgtttgtcaccgcctgcctcggcggcgcctgcggcgggttcttcgtcggactgatcgcctggctggggctgccggtcggcctgaacacggtgttcggtccgtccggtctggtggcgctgccgctgatgacctccggcagcggaatttacgccgggatggcggtctacgccggcgggctggcggtctcctacctgtgcggctttgtcctcacctggctgttcggcagtaaaaatgtcgatttaagctag

SEQ ID NO: 3401 - DNA, 678 bp, Klebsiella pneumoniae
tatggaaaggctatgactcaaccagaagcagtattttttgactgtgacggcacgctggtcgacagcgaggtgatttgctcccgcgcctacgttcacatgtttcaggaattcggcattacgctggacctcgccgagatttttaagcgcttcaaaggtgtgaagctgtacgaaattatcgacaccatcaacgctgagtatggcgttaatctgcaaaaggccaccctggagccgatttaccgggcggaggtcgctcgcctgttcgatagcgagctggaggtgattcccggagcccaggcgctgctggatgcggtaagcgtcccgatgtgcgtggtttccaatggcccagtcagtaagatgcagcactcgctcggacgcaccggcctgctgcgccatttcactgaccgcttgtacagcggctacgatattcagcgctggaagcccgacccggcgctgatgtttcatgcggcagaggccatgcaggtaaaagccgaaaactgtattctggtggatgactccagcgccggcgctcagtcggggattgccgccggcatggaagtgttttatttctgcgccgatccgcacaaccagccgatcgatcatcccaaagtgacgacctttaccgatctggcagagctgccggcattgtggcaggcgcgcggctgggatatcacgcgttaa

SEQ ID NO: 3402 - DNA, 360 bp, Klebsiella pneumoniae
atggctgaggcgttcatcaatatcctgattttcttgcattatgtctttgcgtacttctatctcttgcgcaccgaagctgtattcaccttcagtacgcttgctggttccttcagggttgtcaccatacactttttcaaatgcgccgaggtgtgggtctgtgccaaagtcttgtggcgcaaacccaatgtcggcatcaccaaagggtgtgcgcttaccaaaactaggcatattggtacgcaggtcgtatacccaaacattctcagtacagttttcttgctgatatttgttttttgcggtccctttagtgaaaaacaatacattggtttttacgccatgtgcgtaaaagataccagttggtaa

SEQ ID NO: 3403 - DNA, 660 bp, Klebsiella pneumoniae
cgcctccgggctcattattttttgaaggtacttaccgtgctcaacaaactttctcgtctgctggatgaagcgggtatttcgctcaccgatcaccagaaaaatcagctggtggcttacgtcgggctgctcgataagtggaacaaagcctataacctgacctccgttcgcgatccgaatgagatgctggtgcgtcatattctcgacagcatcatcgtggcgccttatctgcagggctcgcgctttatcgatgtcggtacggggccggggttgccggggatcccgttggccatcgtatgtccggagtcacatttcaccctgctggacagccttggcaagcgcgtgcgcttcctgcgtcaggtgcagcacgagctgaagctggataacgtcaccccggtgcagagccgcgtggaagccttcccggccgagccgccgtttgatggcgtgataagccgcgctttcgcatcgcttaatgatatggtgagctggtgccatcatctgccggcagcgaatggtcacttctatgcgctcaaagggttagcgcaaaaagaagaaatggaaagtctgccggaagggtatgacattgtcgaggtgattgagctgcatgttcctcggttggaaggggagcggcacctggtggtgattaagccaaaatcgagttaa

SEQ ID NO: 3404 - DNA, 1434 bp, Klebsiella pneumoniae
tatcgattttatgttcgagtggagtccgccgtgtcactttcgctttggcagcagtgtcttgcccgattgcaggatgagttaccagccacagaattcagcatgtggatccgcccattgcaggcggaactgagcgataacacgctggcactgtatgcgccaaaccgttttgtgctcgactgggtaagggacaaatacctcaataatatcaatggactcctcaatgatttttgcggtgcggacgccccgcagctgcgttttgaggtgggcgctaagcccgccagctcgctgcagaaaggggcggtaagcccggctgcggcggccattccggcggcgcaggtgcagaccgcgcgcgcggcgccgacgatcgtgcgccctggctgggataatgtcccggcgccggcggagccgacctaccgctctaacgttaacgtgaaacacacgtttgataacttcgtcgaaggtaaatctaaccagctggcccgcgcggcggcgcgtcaggtggcggataacccgggcggcgcctacaaccccctgttcctctatggcgggacgggtctgggtaaaactcacctgctgcacgcggtggggaacggcattgtggcgcgtaagccgaacgcgaaagtggtctatatgcactccgagcgtttcgttcaggacatggttaaagcgctgcagaacaacgccatcgaagagtttaagcgttactaccgctccgttgacgccctgctgatcgatgacattcagttctttgccaataaagaacgatcccaggaagagtttttccacaccttcaatgcgctgctggaaggtaatcagcagatcatcctgacgtcggatcgttatccaaaagagatcaacggcgttgaggatcgtctaaaatcccgcttcggctgggggctgacggtggcgatcgagccgccggagctggaaacccgcgtcgcgatcctgatgaaaaaagctgacgagaacgacatccgcctgccgggcgaagtggcgttctttattgccaagcgtctgcgctcgaacgtgcgtgagctggagggggcgctgaaccgcgttatcgccaacgccaacttcaccggccgggcgatcaccatcgatttcgtgcgcgaagcgctgcgcgatctgctggcgctgcaggaaaaactggtcaccatcgacaatattcaaaagacggtggcggagtactacaagattaaggttgcggacctgctgtccaaacgccgctcccgttcggtggcgcgtcctcgccagatggcgatggcgctggccaaagagctgaccaaccacagcctgccggaaatcggcgatgcgtttggcggtcgcgaccataccaccgtgctgcacgcctgccgcaagattgagcagctgcgtgaagaaagccacgacattaaagaagatttttccaatttaatcagaacattatcctcgtga

SEQ ID NO: 3405 - DNA, 1077 bp, Klebsiella pneumoniae
cagtttctttattgccggcgagtatcgcttttgagccgattgtttatcacttttctgctgctgatggtctgcccgacaggcagccaggccgaggcgctcagccgcgagaaaatcgacggctggctgcagcatctcggcgccagcgataagttcgacgccagcaaaggcatcgactggggcgtgatgcccggtccgttctatacgccggaactagggttgggcattggcaccgctgtcgtcggcctgtatcgtcccgacccgcaggataccaccagccagaactcgaccctgacgctcagcggctacgccagctctaccggcgcctttggcctcaacgtgaaaaactacacctttttcgatcgtgatctgtggcgcgtttttgtcgaagggtcgatagccaatacgcccaccctttatcggcagcttatcgatcatgtttatctcggggcgggatggtcgctggcggcgcagaatgccgatgagatggaccatgacgatcggccgaagatagaaaacactccgcaggggccgtcggtattcagctccggcgccagcatcgatattaactgggacgatcgcgactttgtacctaacccgcgccggggtcagtatgccaacctccgctatacccactatgcgcccggattaggtagcgatacccgctttgaggaatttcagctgcactatagccattatcatgccctgagcgagaaaagcgtgctcgcctgggaggccgatggcgccttcacccagggcgaggtaccgtggagcatgatgccgctgctcggcagcgatgaacggatgcgcggctactaccaggggcgctaccgggataaaaacgtcgtcagcggtcagctggaatatcgccggcagctcacctggcggcacgggattgtcgcctgggccggggcgggaaccatggggccctcactgtcgtcgctgaataatggccgctggctgccttcggcgggcgttggctaccgctttgaattcaaacctcgcgttaatgttcgcctcgactacggtatcggcaatggcagcagcggcttttacttccaggtcggcgaagcgttttaa

SEQ ID NO: 3406 - DNA, 1869 bp, Klebsiella pneumoniae
aacccgctttatggagatgttgttacgatgattattgccaccgctggacatgttgaccacggcaaaacgacgctgctgcaggcgataaccggcgtgaatgccgatcgtttgccggaagagaaagcgcggggaatgacgatcgatctcggctatgcctactggccgcagccggacgggcgggtgctgggatttattgacgttcccgggcacgaaaagtttttgtccaacatgctggcgggggtggggggtattgaccatgcgctgctggtggtggcctgcgatgacggggtgatggcgcaaacccgcgaacacctggcgatcctgcagttgaccggaaagccgacgctgaccgtggcgctgaccaaaacggaccgcgtggcggccgccagggtggcggaggttcaggctgaggtcgagcagaccctgggcgagctgggctttgacgccgtcgctttctttcccaccgcggcggcggaaaacatcggtattgcggaactgcgcagccatctgctgcagcttgcggagcgcccccgcccgcagcagcagcggtttcgcctggcgctggatcgcgcttttaccgtcaaaggcgcggggctggtggtcaccgggacggcgctctccggcgaagtacgggtcggggataccctgtggcttaccggcgtcaacacgccgatgcgcgtccgcggcctgcatgcccagaatcaagcggttgagcaggcgcacgccgggcagcgcattgcgctgaatattgtcggcgatgcgcaaaaagaggcagtgcaccgcggcgactggctgctctcctcaccaccgccggagccagcagaacgggtgattgtcgagctgcagtgccatacgccgctcagccagtggcagccgctgcatattcaccatgctgccagccacattaccggccgggtgtcgctccttgagggcaacctggcggagctggtgctggatactccgctgtggctggcggataacgaccggctggtgctccgcgatatctctgctcgcttgacgctggcgggcgcacgggtggtgacgctggatcctccgcgtcgcggcaaacgtaaaccggaatatctgcagtggctgcacgccctggcagcggtcggcgctgacgatgcgcaggcgctggagctgcatctgcagcgggatgccgtccggcttgagcacttcgcctgggcgcggcagctcagcgaagccggaatggcggccctgatccagcgaccggactatctgcaggccggacagcgcctgcttagcgcgccgcttgccgcccgctggcagcgaaaattgctggatgcccttgcgcgctaccatgagcagcatcgagacgagccgggccctggccgggagcgcctgcgccgcatcgcgctgccgatggaagatgaagcgctggtgctgctgctgattgagcagatgcgcgagagcggcttagtccacagtcatcacggctggctgcatttgccggagcataaagccgggtttaccgacgagcagcaggcggtctggcagaaggtggagactctgttcggcgacgatccgtggtgggtgcgcgatcttgcgcgcgaagtccatgttgaagagtccctgatgcgcgcggtgctgcgccaggcggcgcagcaggggatgattaccgcgatcgtcaaggatcgttactaccgcaacgatcgcattgtgcagttcgcccagcgggtgcgcgagctggatcggctgcgcggttcaacctgcgcggcggatttccgcgataccttaaacgtagggcggaagctggcgatccagatcctggagtatttcgatcggattggcttcacccgccgtcgcggtaacgatcatatcctgcgcgataaggcattgttccggtaa

SEQ ID NO: 3407 - DNA, 804 bp, Klebsiella pneumoniae
agattatattactggccgctacggttgatttgcccttgtgctttcaggctctcaccagttgggcaatcaggagacaccatggacaacctaaatcttaacaaacatatttccggccagttcaacgctgaactggagtatatccgcacccaggtgatgaccatgggtgggctggtggaacagcagctctctgatgccatcaccgccatgcataaccaggacagcgatctggcgaaacgcgtcatcgacggcgacaagcaggtcaacatgatggaagtggctatcgatgaagcgtgcgtgcgcatcatcgccaagcgccagccgaccgccagcgacctgcgcctggtgatggcgatcatcaagactatcgctgagctggaacgcattggcgacgtggcggataaaatctgccgcaccgcgctggagaagttttcccagcagcaccagccgctgctggtgagcctcgaatcgctgggccgccacacggtgcagatgctgcatgacgtactggatgcgtttgcgcgtatggatctcgacgaagcggtacgtatctatcgcgaagataagaaagtcgaccaggagtatgaaggcatcgtgcgtcagctgatgacctacatgatggaagactcgcgcactatccccagcgtcctgaccgcgctgttctgcgcgcgctccatcgagcgtatcggcgaccgctgccagaatatctgcgaatatattttctacttcgtcaaaggtcaggatttccgtcacgttggcggcgatgagctggataaactgctcgctggcaaagatccgaaagagtaa

SEQ ID NO: 3408 - DNA, 1125 bp, Klebsiella pneumoniae
tcagaacattatcctcgtgacgctatgaaatttaccgtagaacgtgaacatttattaaaaccgctgcaacaggtgagcggtccgttaggtggtcgtccgacgctgcccattctcggtaacctgctgcttcaggtcgcggacggcgcgctgtcgctgaccggtaccgatcttgaaatggagatggtggcgcgcgtggcgctggttcagccgcacgaagcgggcgcaacgaccgttccggcacggaaattctttgatatctgccgcggcctgccggaaggcgcggagatcgcggttcagttggaaggcgatcgcatgctggtgcgttccggccgcagccgcttctcgctgtcgaccctgcccgccgccgatttcccgaatctggatgactggcagagtgaagtggagtttaccctgccgcaggcgaccatgaagcgtctgatcgaagccacccagttctcgatggcgcaccaggatgttcgttactacttaaacggcatgctgtttgaaaccgaaggcagcgaactgcgcacggtggccaccgatggtcaccgcctggcggtctgttcgatgccgctggaagcgtcgctgccgaaccattcggtgatcgtgccgcgtaaaggggtgattgagctgatgcggatgctcgacggcggcgataccccgctgcgcgtgcagattggcagcaacaatatccgcgcccacgttggcgattttatcttcacctctaagctggttgatggccgtttcccggattatcgccgcgtattgccgaaaaatccggataaacacctcgaagcgggctgcgatattctgaagcaggcttttgcgcgcgcggcgattctctccaacgagaaattccgcggcgtgcggctgtacgttagcgaaaaccagctgaaaatcaccgccaataacccggaacaggaagaagcggaagagattctggatgtgacctacgccggaacggagatggagattggcttcaacgttagctatgtgctggatgtgctgaatgcgctgaagtgcgagaatgtacgcattctgctgacggattcggtgtcgagcgtgcagattgaggatgcggcctctcaatccgcagcctatgtcgtcatgcctatgagattgtag

SEQ ID NO: 3409 - DNA, 939 bp, Klebsiella pneumoniae
gatgaattctataaaaaggattttaatatggacgctatctttgacagagtcgtaagggaattttttccaaatacaaccatacctttttggaaaaaatggctgttcaggacggcatttggcaataaggtattttctcgcttaatatataacgagcgactcgttaataaaaatggggtcgagtgggttaatgcagttgttgaactccttgagttgaaatgtgaaagcgaacaccaccaatttaacaacatacctgagcatggggctacggttgttatttcaaatcatccgacggttatcgatggacttagcttaatacatacggtctcccgagtcaggagcgatataaaaataatagccaatcacgttttgccaattatattcccccaggtatcggaacttaccattggaattgagaatatggccggtaagatgagccataaaaaattccgcgagatgaacgatcacctgcgaaaaggaggcgtattgattatatgtcctgcgggtaagctggctaactggtctctttccgggttacaggagcataagtggaaccccggttttttacagcttgctatgagaaataatgcagcattggtaccaattcatattacgggagcaaacagtaagatttattatcttactgcaacattctggcggcaactgtcgaacatgatggttattcgtgaagctctccgccatcatggcaagaccatgaaaatcaatataggacagcaaatagccttatcctcgtttaaagaatacaataaagatctttctgccgcggcaaatgtatgtttgacgcacctccagagtatagcgaagaatggcccggctatgttagatacgattgcgccgcaagaattagaaccaggtaaagaggagctaattagcgcaatagaggagtgcgaaatattaaggcagtttgaagacggtagataa

SEQ ID NO: 3410 - DNA, 1176 bp, Klebsiella pneumoniae
tttaattcctaccgacgccgtgatcgcggcggcgaaaaaggtactggcatgagtaaattcaggctggctctggtgcggcagaagtaccgcccggacggcggcgcagaacggtttgtctcccgcgcgctggaagccctcgacagcagtcatctgcaactgaacgtcatcacccgcgaatggcaggggccggtgaaaccggactggcagatccatatctgtaacccacgtaaatgggggcgcatcagccgcgagcgcggctttgccaacgccgcgcgcgcgctctggcagcgcgagtccttcgacctggtgcagagccatgaacgtattcccggctgcgatctctaccgcgctggcgatggcgttcatcgccgctggctgcagcagcgctcgcgcattttaccggcctggaaaagccgcctgctgttcgccgaccgttaccaccgctacgtcatgcaggcggaacgcgagatgtatgaagactcacacctgcgcggggtgatctgcaacgccgagatgatcaagcgcgagattatcgaagactttggcctgccggcggagaagatccacgttatttacaacgccattgacaaccagcgcttcctgccgccagacgaagagacctttgccgccttacgcgccaaatggcagctgccgctgcaggcgacctgcctgatctacgtcggctccggctttgaacgtaaagggctggcggcggcgatccgcgccatcgctcccaccgatcgctacctgctggtggtcggcaaagataaggatcagcctcgctatcaggcgctggcgaagagcctgaactgtgaagcgcgggtgcgcttcttcggcatgcagtcggagacattgcccttctatcaaatggccgatggtctgctgctgccgaccctctacgatccgttccccaacgtcattctcgaagcgatggcctgcggtctgccggtgatcaccaccaccggctgcggcggggcggagtttatcgtcgacggccacaatggttacgtctgcgacgctctggatatcccggcgctacagcaggcggtaatggccctgcccgcgcgcgcgctgggctctgcgcaaggcggtcacgcccgcgagcgcattatggcctgcaccagcgagcgactctcaacccagctgctttctctttatcaggatctggtgaattaa

SEQ ID NO: 3411 - DNA, 930 bp, Klebsiella pneumoniae
cactatgcctacatggcaatatggtcgtctgtgaccaccctacatacaataatcatcaccacgcttcaggattcgattatgagccaaacatcaaccttaaaaggccagtgcatcgcagagttcctcggtaccgggttgttgatctttttcggcgttgggtgcgtggctgcgctcaaggtcgcgggagccagcttcggacaatgggaaatcagcatcatctggggtctgggcgtcgccatggcgatctacctgaccgccggggtctccggtgcgcaccttaacccagcggtgactatcgcgctgtggctgttcgcctgcttcgaaggccgcaaagtggttccttttattatttcgcaattcgctggcgccttttgcgctgcggcattagtttacgggctttactacaatcttttcctcgattatgaaaccacccaccatatgattcgcggcagcgtggaaagcctcgatctggccggcattttctccacttacccgaacccgcacatcaattttgtgcaggccttcgcggtagagatggtgattaccgctatcctgatgggcgtcatcctggcgctgaccgacgatggcaacggcataccgcgcggcccgctggcccctctgctgattggcctgctgattgcggtgattggcgcctccatgggaccgctgaccggcttcgccatgaacccggcgcgtgacatcggcccgaaagccttcgcctggctggcggggtggggtgacgtcgccttcactggcggcaaagatattccttatttcctggtgccgctgtgcgcaccggtggtcggcgcggcgctgggcgcattcagctatcgtaagctgattggccgtcacctgccttgcgacacctgcgtggaggaagagcaacagagcccctcctcttccaccgctcaacataaagcttcgctgtaa

SEQ ID NO: 3412 - DNA, 363 bp, Klebsiella pneumoniae
actgaccactatttgcgtgttttcgcgcctgcgcatatagttgacggaagcgattacggaaggagaagcctgatgaaagcatgttggatggtatgcctggtcaccgccctgagcgccacgtcggcgtgggccgaatcaccgctgcaaagcctgcagttcgagcagcaaaaacagcaggtgctcaaagcggtgaaggaaaaatgcgcgccagcaagccacctcagcgacaacgattttgccaataaagtgctggcgaccgacggtaacaagaacgcggtccgcgaagcaacgctggcgaaggagcgcaataaccagaaaagctaccaggccgcaatcgacaaaatcgtctgtccggccaaatag

SEQ ID NO: 3413 - DNA, 789 bp, Klebsiella pneumoniae
ctagtgatatatcgctgtaatactaaccgaacctcacccattattgatgagttagggcgcttacgcgaacgctgttatcacgatattggtgccggaactggtaacgaccgagataacgatgtttttgatgaaagttattatcatatcattttatgggatccttctgatgtggaaatcctgggagcatatcgtgttatgcccgttggcgagcagctggcccaacatggtgtaacaggcctctatagcaacagcttgtttaaataccatgataatgcctattcctgtttagagaagtgtgtggaaattggccgcggctttattcagaaaccttatcaaaaaagtaaggtgcttgattatttatggcaagggatatttgactttataaaaagatatccggactataaatacttgctgggtgtgctgaccattcctggaacttttcctgaaaaagtacagaaactcatcatcagtttctataatatatacttttcctcgacagctgatttttgtacgccgatagcattgttcactgccgaaaatgtacatgatgatactccattttgtggcgaagattttagagcagactggagcatgcttaatcacctgctgagagaagaaggttatgaacttccctggccttttaaacagagtgctaaatggttctccccgggcggatcgtcgattcttgcattcacaaaagattattcttttaattcgatagctgggttaaatcttagctctatagataaattgaatgaaagctacgttaagcattatttaagagattaa

SEQ ID NO: 3414 - DNA, 288 bp, Klebsiella pneumoniae
ccgtgctctctcggaagcgttggaaaaattatggcgccgccattgtcgcctggctcgcgggtcctgatcggcctgattcgagtttatcagcgcctgattagtccgctactcgggccgcattgtcgtttcaccccaacctgttctcaatacggaattgaggccttacgcaggtttggagtgataaaaggcagttggttgacgatgaaacgcgtattaaaatgccaccctttacaccctggtggtgacgatcccgtcccgcctggaccatttgataccagagaacactaa

SEQ ID NO: 3415 - DNA, 1005 bp, Klebsiella pneumoniae
aaaccagcatatcgtgcggccggaaaacagcgccagcaccggcgatattgcggccagccggattcatcttctcctgcaaaatcaggggctgctctgatgggatccctgtttaagcagatctaccgctatacgcgccctcgcgcgtatcgccacaatgaaaatctgtggccttttacccgtattgcgcgtgcgccaagcggcgaaatcagcgcgttacgctataaagggaaaacggtgccgctggtcagcctgagcgcgctgaaaaacagtatgcagggcgaagtcctgctgaccgccaccggcccctcaacccgcaatatcgatttttccctgttgtcgaaaacgatcccggtgatgggcgtcaatggcgcctggcatcttgccgaccggctgcacttttcgctctataccatcgtcgacatggaatttttcgataagaagccggacattatccgcgccattgtcagccagccggatattttgctgttcaccaccatgcacgggatcgccaaaatcgtcgatcgctatggggacgcgctgcgctgccgtttggcgttgattgaggacggttgctataagatttaccagccgaaagtcgccagcgaagcgataaagcgcacttaccagcagaatgcggcgatgtgctttcatcctcagcgcccggatatctgttttagcaccgatattcgccagggcatctttgatgccggcacggtggtctactgggcgctgcaaattctcgcctggctgggcttcaatactatcctggtgagcggcctggatatgaccaactttaaccagccgcgattctacgaaacacaacaagaaaaattgccttcttacctggcaacaaaagtggataccctcgtcatgccctcctttgcgcatgccgcgcaggtactgcagcaacgccagattcgggtgattaatttttccccagaaagcgctgtgccggatactatcttcgaaaaggttgcgtttaatgagtactttaaaagtgagtaa

SEQ ID NO: 3416 - DNA, 1293 bp, Klebsiella pneumoniae
aatccccctctgactcctcatgatgagaagctaaagacaccaggaatatcgtcgcgtgtgaatggatcatgcgcccataaggagctttttatgtttcatctcgataccttatcgacgctcgttgccgcaacgctcgtgctgttactcggcagaaaactcgtacaaaccgttcccttccttaagaaatacactattcctgaacccgttgccggcggtctgctggtggcgctggcgctgctggcgctgaaaaaaagcatggatatcgaaattgatttcgatatgagtctgaaagatccgctgatgctggcgttcttcgccaccatcggtcttaacgccaacctcgccagcctgcgggccggcggcaaggtgctgggcactttcctgatcgtggtggttggcctgctgctgctgcagaacgccctcggtatcggcatggcgacgctgctggggctggatccgctaatgggtctgctggccgggtcgattaccttatccggcggccacggcaccggggcggcgtggagtaagctgttcgttgagcgctacggttttgccaacgccaccgaggtggcgatggcctgcgcgactttcggcctggtgctgggcggcctgatcggcggcccggtggcgcgttatctggtgaagcactcttcctcaccggacgggacaccggacgatcaggtggcgccaaccgcctttgaaaagccggacgtggggcgggtgatcacctcgctggtgctgatcgaaagtatcgccctgatcgccatctgtctgacgctgggcaaggtggttgcgcaactgctggcggggagcgtcttcgagctgccgaccttcgtctgcgtgctgtttatcggcgtgatcctcagcaacagcctggcgctggcggggttgtatcgggtgttcgatcgcgcggtatcggtgttgggcaacgtcagcctgtcgctgttcctcgccatggcgctgatgagcctcaagctgtgggagttggcctcgctggcgctgccgatgattattatcctggcggtgcaggcgctggcgatggcgctgtatgcggtgttcgtcacctatcggatgatgggcaaaaactacgatgccgcggtgctggcagccgggcattgcgggtttggcctgggggcaacgccgacggcgatcgccaatatgcaggcgattaccgaccgtttcgggccatcgcatatggccttcctggtagtgccgatggtgggggcgttctttatcgatatcgtcaacgcgctggtgattaagctgtacctgctgctgccgatatttggctga

SEQ ID NO: 3417 - DNA, 192 bp, Klebsiella pneumoniae
gcgagaaaataccttattgccaaatgccgtcctgaacagccattttttccaaaaaggtatggttgtatttggaaaaaattcccttacgactctgtcaaagatagcgtccatattaaaatcctttttatagaattcatcttaaacgactatactagcgttctttcagtcggacaataccgcataaaactttaa

SEQ ID NO: 3418 - DNA, 207 bp, Klebsiella pneumoniae
ctcactgaatattcagtgagagtaaatttggataattatattaagttcataatactaaccggaggtaatatgtctgaacgttttgaagatagcccagagtatgacgactggatccaggaaacaggcggaagagatgaagactattcggattactataatcaatgggagcgcagaaaacttatagaatcattgcgtaagaaaaattaa

SEQ ID NO: 3419 - DNA, 456 bp, Klebsiella pneumoniae
tgcttgactcttcgtcttaaaggacgttttatacgacacgcgacatacctcaaagggagcaggagtaaaaacgtgatgtcagtgtcgctcttgagtcgaaacgttgctcgcaagcttctgtttattcagttactggcagtaatggcaagtggactgctgttcagcctcaaagaccccttctggggcatttccgctgtatgcggcggtttggcagtggtcttgccaaatctgatgtttataatttttgcctggcgtcatcaggcgcatacaccagcaaaaggccgtgtggcctggaccttcgccttcggtgaagccttcaaggtgttgctgaccttcgcccttctggcggtggcgctggccgttttaaaagtggtatttttgccactgatcgtgacgtgggttttggtgctggtggtacaagttctggcgccagctgtaattaacaacaaagggtaa

SEQ ID NO: 3420 - DNA, 939 bp, Klebsiella pneumoniae
atccacacgtatccagcacgaaatcatatgcaaaagtttgataccaggaccttccagggcctgatcctgaccttacaggattactgggctcgtcagggctgcaccattgttcaaccactggacatggaagtcggcgccggcacctctcacccgatgacctgcctgcgcgcgttagggccggagccgatggcgaccgcctacgtacagccttcccgtcgtccaactgatggccgctatggcgaaaacccgaaccgtttacagcactactatcagttccaggtggtgattaaaccctctccggacaacatccaggagctgtacctcgggtcgctgaaagagctgggtatggacccgactatccacgacattcgctttgtcgaagacaactgggaaaacccgacgctgggcgcctggggtctgggctgggaagtgtggctcaacggcatggaagtgacgcagttcacctacttccagcaggtcggcggcctcgagtgtaagccggtgaccggcgagatcacctacggtctggagcgtctggcgatgtacatccagggtgtggacagcgtctatgacctggtctggagcgatggcccgctggggaaaaccacctacggcgacgtgttccaccagaacgaagtggagcagtccacctataacttcgaatatgccgacgtcgacttcctgttcacctgcttcgaacagtatgagaaagaggcccagcagctgctggcgctggagaccccgctgccgctgccggcctacgagcgtattctgaaagcggctcacagcttcaacctgctggatgcgcgtaaagccatctccgtcaccgagcgtcagcgctatatcctgcgcattcgcaccctgactaaagcagtggcggaagcgtactacgcttcccgtgaagcgctcggcttcccgatgtgcaacaagaataaataa

SEQ ID NO: 3421 - DNA, 489 bp, Klebsiella pneumoniae
ttaaagaggtattgtgctgtgaacatgaacgcaacaatcctcggccaggccatcgcgtttgttatcttcgtatggttctgcatgaaatacgtatggccgcctttaatggctgccatcgaaaaacgccagaaagagatttctgacggtttagcttctgcagaacgcgctaagaaagatttggaccttgcacaggccaacgcgaccgaccagctgaaaaaagcgaaagcggaagcccaggtaatcattgagcaggcgaacaagcgccgctctcagattctggacgaagctaaagctgaagcagaacaggaacgcaccaaaatcgttgcacaagcgcaggctgaaattgatgctgagcgtaaacgtgcacgcgaggagctgcgtaagcaggtcgctatcctggctgttgctggcgccgagaagatcatcgaacgttccgtggatgaagctgctaacagcgacatcgtggataaacttgtcgctgaactgtaa

SEQ ID NO: 3422 - DNA, 1344 bp, Klebsiella pneumoniae
agcgatgggtatcactatcgaaaacactatgattacgcaatgtttaagtctcgtcctttattcttttatttttcctttttaaggcctgagaaaatgagcgtcgccgccgggaataaaaatcatctgatccgcctgatagccgtggtattaaccgggattctggccggtctgtccggcatggttttggcactaattttacacgcgattcagcacctggcttttggttacagttatgggcagatcgtcggttcggtgtcatttttacagggcgtcacggagtcgtcctggccacgccgcatcgtggcaatcgtggccggcggcgccgtcgccggatttggctggtggctgcttggtcgctatgggcagaggcgggtttccattgcggcggcggtggccaacccctgcgtacccatgcccgcgggcaccacgacgatccacgcgctcctgcagatcgtcaccgtagcgctgggctccccgcttggccgcgaagtggcgccccgggaaatgggcgcgctgggggcgaggatggtggtgcgtaagctgcgcctgctggaagatgaaacccgcacgctgattgcctgtggggcgggcgcgggtctggcggcggtctataacgtcccgctggccggggcgttgttcagccttgaggtcatgctgctgtcgtttagctgggaaaaaacgctggcggcgatgatgacctcggcgattgccgcctggacggccaccctggggttaggggatgaatcgcaataccattttgtttccagcgtacttccgcacacctttctctggtgggcgattctggcgggcccgattcttggcaccggcgcctggctctttcgcaaagcgaccagcgcggcgcgttcacgcgcgcgaagtaactggcagatgccggtgttctgtctgctggggttttctcttcttgccatcctgagtctttatttccccgagcttccgggcaatggcaagggtccaatgcagctggcgctcagcgacgggctgcctctctccatggtcgctgtcctgttagtattgaagatggtggtgattctggcggtgctgcgcggcggcgcggagggtggattgttaaccccagggctggcggtgggcggattggtcagcctgctgctctgcgcgctctggcagctcggcttccctggcggtgataaaagcagcttcgctgtggtgggggcggccgcgtttctcgccgcctccatgcagatgccgctgaccgcggtggcgctggtgatggagtttacccacatggatcacagctatctggctccggcgctgctgtgcgcggcaggggcgtttttaacctgccgggtgctggataaaaaatag

SEQ ID NO: 3423 - DNA, 1191 bp, Klebsiella pneumoniae
cgctttcatctcatacccttattaggcgatgacgcccagttgtttgccgatgcgggtaaaggcttccaccgcacgctcaatttgttcaggggtatgcgccgccgacatctgggtgcgaatacgcgcctggcctttcggtaccaccggatagaagaagccggtgacatagatcccttctttctgcagctcgcgggcaaagttctgcgccaccaccgcctcacccagcatcaccggaatgatggcgtggtcggcgccggccagcgtgaagcctgccgcggtcattttttcgcggaacagacgcgcgttagcccacaggcgatcgcgcaggtctgccccctcttcaaccatctccagcactttgatggaggcggccacgatggccggcgccagagagttggagaacagatacggacgggagcgctggcgcagccactcaaccacctctttgcgcgcggcggtgtagccgccggaggcgccgcccagcgctttacccaacgtgccggtgatgatatcgacgcgccccatcacatcgcagtattcgtgggagccgcggccgttttcgccgacgaagccgacggcgtgggagtcatcgaccatcaccagcgcatcgtatttatccgccaggtcgcaaacgccttgcaggttggcgatcacgccatccatcgagaacacgccgtcggtggcgatcagcacgtgacgcgcgccggcctcgcgagcttctttcagacgcgcctccagctcttgcatatcgttgttggcatagcggaagcgcttcgctttacacagacgcacgccgtcgatgatcgaggcatggttcagggcgtcggagataatggcgtcttccgggccgagcagcgtttcaaacaggccgccgttggcgtcgaaacaggaggagtagaggatcgcgtcttccataccgaggaaatcggccagcttcttctccagctgcttatgcgtatcctgggtgccgcagatgaagcgtaccgaggccatcccgaaaccgtggctgtccatgccggatttcgccgcggcaatcagttccgggtggttcgccagacccagatagttattggcgcagaagttaatcacgtggctgtcgccgacggtaatgtccgcctgctgcgccgaggtgatgatgcgctcttctttgaacaacccttcggcccgagcggtctccagattgctagttaa

SEQ ID NO: 3424 - DNA, 2049 bp, Klebsiella pneumoniae
cgcgcgtttcaccgctttcttccagccgctgtaacgatagttacgctcagtagtttcaatacccgggcggaattcgcgctcaatcaccgctttctcctgcagttcatccagattctgccagaaaccgaccgccagaccggccagataggccgcgcccagcgccgtcacttcgcgtacttccggacgctcgacacgggtgccgaggatatcggactggaactgcatcaggaagttgttagccaccgcgccgccgtctacgcgcagggcgtgcagacgaatgccggagtcagcctgcatcgcttccagcacgtcgcgggtctgaaaggcgatggactccagcgtcgcacggataatgtggttggagttcacgccgcgggtgaggccgaaaatcgcgccgcgggcatacgggtcccagtacggtgcgccaagaccggtgaacgcgggtaccacgtatacgccgttggtatccttcactttggtggcgaagtactcggagtcgaaggcatcgctgatgagcttcatctcgtcgcgcagccactgaatagacgcgccggccataaacaccgccccttccagagcgtagttcacctcgccgcgcgggccgcaggcgatggtggtcagcagaccgtgggtggaggtgaccgctttttcgccggtattcatcagcataaagcagccggtgccgtaggtgtttttcgccatcccttctttgacgcacagctggccgaacagggccgcctgctggtcaccggcgatcccggcgataggaatacgggtcccgcctttaccaccgatgttggtctggccgtacacttcggaagacttgcgcacttccggcagcatggcgcgcggaatgtccagcgcgtcgagcatcttgtcgtcccagtcgaggtcgtggatgttgaacagcatggtacgcgaggcgttggtgtagtcggtgacgtgcacgcggccctgggtcatcttccagataagccaggtgtcaacggtgccgaacagcagctcgccgcgcttcgcacgctcacgggaaccttcgacatggtcgaggatccatttcaccttggtgccggagaagtacgggtccaccaccaggcctgtggccttgcggatatactcttccatcccgtcacgcttgagctgctcgcagatctccgcggtacggcggcactgccagacgatagcgttgtagatgggtttaccggtctctcgctcccacaccaccacggtctcacgctgattggtgatgccgatggccgcgatctgatcggagttgatatccgctttggccagcgcttcgaccagcgtcgagctttgggaagcccagatttccatcgggtcgtgttcgacccagcctggcttaggataaatttgttcaaattctcgctgggagacgctgacgatattggcatcatgatccatcacaacggcccgggagctggtagtgccctggtcaagcgcaacgatatattttttgtcggtcatagtcggtgtcccgtagtcagattacagcgaagctttatgttgagcggtggaagaggaggggctctgttgctcttcctccacgcaggtgtcgcaaggcaggtgacggccaatcagcttacgatagctgaatgcgcccagcgccgcgccgaccaccggtgcgcacagcggcaccaggaaataaggaatatctttgccgccagtgaaggcgacgtcaccccaccccgccagccaggcgaaggctttcgggccgatgtcacgcgccgggttcatggcgaagccggtcagcggtcccatggaggcgccaatcaccgcaatcagcaggccaatcagcagaggggccagcgggccgcgcggtatgccgttgccatcgtcggtcagcgccaggatgacgcccatcaggatagcggtaatcaccatctctaccgcgaaggcctgcacaaaattgatgtgcgggttcgggtaagtggagaaaatgccggccagatcgaggctttccacgctgccgcgaatcatatggtgggtggtttcataatcgaggaaaagattgtagtaaagcccgtaaactaa

SEQ ID NO: 3425 - DNA, 843 bp, Klebsiella pneumoniae
cctgatcttcacctgcatggtggggctgatcaccacgctgcaggcctacgttttaacctggatgatcccgtgatagtgatgcctaaacgcctggccgacgacgtggcgcgtcgcgtccgggcgctgattgaagaacaacagctggaggcgggcatgcgactgcccgccgagcgccagctcgccgcccagctcggcgtctcacgcaattccctgcgcgaagcgctggcgatgctggtcaatgaaggggtgctgttgagccgtcgcggcggcggcaccttcgtccgctttcagcatgagccgtggtcagagcaaaacatcgtccagccgctgaagacgctgctggccgatgacccggactacagcttcgatatcctcgaagctcgccacgccatcgaagccagcaccgcgtggcacgcggcgatgcgcgccaccgacgccgataaagaaaaaattcgtctgtgctttgaagcgacccagagtgaagacccggatatcgcctcgcaggcggatgtccgctttcacctggcgatcgccgaagcctcgcataacgtggtgctcctgcaaaccatgcgcggctttttcgacctgctgcactcctccgttaagcagagccgccagcgcatgtatcaggtgccgccggtgtttgcccgcctgaccgaacagcaccaggccgtcatggaggcgattgtcgccggcgacgccgaggcggcgcgccaggcgatgatgggccacttaggctttgtccacgccaccatcaaacgttttgatgaagaccaggcccgccaggcgcgaattacccgcctgcccggtgaccacaatgaaaattccagggagaactcgtga

SEQ ID NO: 3426 - DNA, 951 bp, Klebsiella pneumoniae
gttttgcttcaatttcgcgcaattgctcttgccgtagccggttcgctggctctggcggcgccagcgttcgctggcaaactctccatcgttattgacgattttggctaccgcccgcagaccgagaatcaggtgctggcgctgccggcaactatctccgtcgccgtgctgccgaacgcgccgcacgcccgggaaatggccactaaagcgcataatcagggccatgaagtgctcatccatctgccaatggcgccgctcagcaaacagccgctggaaaaagacaccctgcgtcccgaaatgagcagcgaggagatcgagcgcattattcgcgaggcttacggcaaagtcccttacgccgtcgggctgaataaccatatgggcagcgcgatgacctccaacctgtttggcatgcagaaggtgatgcaggccctggagcgctacaatctctattttctcgacagcgtcaccatcggcaacacccaggccatgcgcgccgcgcagggtaccggcgtgaaggtgattaagcgcaaggtgtttctcgacgatacgcagaatgaagccgatatccgcaaccagttcaatcgcgccatcgccctggcgcggcgcaacggttcggcgatagccattggccatccgcatccgacgacggtgcgggtgctgcagcagatggtctataacctgccgccggatatcacgctggtgcgcccgagcagcctgctgaacgagccgcaggtcgacaactcgacgccaaactacgcccagccgcctgcgcaacaaacgcagcagaagccgcgtaatccgttccatggcgtgaagtcttgcaaaccgaagcgcccgctggagcctgtgaacgccagccgcttcttcactatcctcagcgatagcatcagccagagcgcgctgatccagtactatcgcctcaaatggcagggctgggacaaccccggcaactag

SEQ ID NO: 3427 - DNA, 330 bp, Klebsiella pneumoniae
acccacattcagtatcatgcccagtcatttcttcacctgtggagcattttaagtatggcacgcgtaactgttcaggacgctgtagagaaaattggtaaccgttttgacctggtactggtcgccgcgcgtcgcgctcgtcagatgcaggttggcggaaaggatccgctggtaccggaagaaaacgataaaaccaccgttatcgcactgcgcgaaatcgaagaaggtctgatcaacaaccagatcctcgacgtacgtgagcgccaggaacagcaagagcaggaagccgctgaattacaagccgttaccgcgattgctgaaggtcgtcgttaa

SEQ ID NO: 3428 - DNA, 1737 bp, Klebsiella pneumoniae
gcttctcctcaatgccttgcggcctgccctaagacagaccgccagacgttaccaggactgggttgctttgaaggaatcgaggatgcctttcagcttgccttcgatttcgtcgttatagccaccggactggttaatctcttgcatcagcggagcgtgatcacggtcgacgtaagccagcagagcggcttcgaagctaccgattttcgccagttctacatcagccaggtaaccacgttctgctgcgaacagaaccagagactgctgcgcgacggacatcggcgcatactgtttctgtttcagcagctcggtcactttctgaccgtggtccagctgtttgcgggttgcatcgtcaaggtcggatgcaaactgggagaacgccgccagttcacgatactgcgccagcgcggtacggataccaccggacagtttcttcatgatcttggtctgcgctgcaccaccaacacgggatacggagatacccgggttaaccgcaggacgaataccggcgttaaacaggttggtttccaggaagatctgaccatcggtaatagagattacgttggtcggaacgaatgcggaaacgtcacccgcctgcgtttcgataatcggcagcgcggtcagagaaccggttttccctttcacttcacctttggtgaaggcttcaacgtattcggcgttaacacgcgcagcacgctccagcagacgagagtggaggtagaatacgtcgcccgggaacgcttcacgtccaggcggacgacggagcagcagggagatctggcgataagcaacagcctgtttagacagatcatcgtaaacgatcagcgcatcttcaccgcggtcgcggaagtattcgcccattgcgcaaccagcgtatggcgccaggtattgcagtgcagcagattcagatgcagtcgctaccactacgatggtgttagccagcgcgccgtgctcttccagtttacgcaccacgttagagatggtggacgctttctgaccgatagcgacatagacgcacttgatgccggaatcacgctggttgatgatggcatcgatagccagcgcagttttaccggtctgacggtcgccgatgatcagttcacgctgaccacgaccgattgggatcatggcgtcaacggatttgtaaccggtctgtaccggctgatcgacggactgacgttcgattacgcccggtgcgatcgcttcaacggcggagaaaccgtcattttccagcggacctttaccatcaattggcgcgcccagggtgttaaccacgcggcccagcaggccacggcctaccggaacttccaggatacggccagtacatttcaccttcatgccttcggcgaggtcagcgtacggacccattaccaccgcacctacggagtcgcgctccaggttcagtgcgatagcgtaacggttacccggcagggagatcatctcgccctgcatacattcggcaaggccgtggatgcggataacaccgtcacttacagaaacaatagtaccttcgttatgagcttcgctcacaacattgaactgagcaatgcgctgcttgatcagttcgctgatttcggtggaattcagttgcatgctccagtccccttaagactgcaagacgtctgcaaggcgctcaagacggccgcgtacgctgccatcaatgaccatatcacccgcacggatgataatacctgccataacagacttatcgattttgcaattcagcttaactttgcgtga

SEQ ID NO: 3429 - DNA, 834 bp, Klebsiella pneumoniae
agaactcctcactctcctggcgttagcccgaggggggatcgagtccattatcacgacgcagaaggcggcgttagaaaattaatgattaaggcgactgagaagtcgccttttttttgcgctttatccttcatcacacctgcgaaggggagcgcgcagtctgacaatgatgaaaagtaccaaaggagcgaatccatgaagccgtatcagcgccagtttattgagtttgcgcttagcaagcaggttcttaagtttggcgaattcacgctgaaatccgggcgcaagagcccctatttcttcaacgccggcctgtttaacaccgggcgcgatctggctctgctgggccgtttttatgccgaggcgctggtggattccggaattgagtttgacctgctgtttggcccggcctacaaaggaatcccaatcgccaccaccaccgcggtggcgttagccgagcatcatgaccgcgatctgccttactgctttaaccgcaaagaggcaaaaacccatggcgaaggcggcaatctggtcggtagcccgctgcagggccgggtaatgctggtggatgacgtgatcaccgccggtacggcgattcgcgaatccatggagattatccaggcccagggcgcgcagctggcgggcgttctgatctccctggatcgtcaggaacgcggccgcggcgagatctccgccattcaggaagtggagcgggattacggctgccaggttatctcaatcatcactctgaaagagctgattacttatctggaagagaaacccgagatggcggaacacctggcgtcagttcgcgcctatcgtgaagcctacggcgtctga

SEQ ID NO: 3430 - DNA, 1248 bp, Klebsiella pneumoniae
gtctcgcatcagggtatcgtcatgaaacaagtcacttttgctccccgtcatcaccagcttaccaatattaatacctggactcccgacagccagtggctggtattcgacgttcgtccgtccggcgcatcgtttaccggcgaaaccattgagcgagtgaacgtaaacagcggtactgtggagaccatttatcgtgccacgcagggcgcgcacgtgggcgtggtaaccgtgcatccaacccaggagcgctatgtgtttattcatggccccgagcggccggatgcgcagtggcagtatgattttcatcatcgccgcggggtggtggcctttcagggggctgtcgagaatctggacgccatggacattacccccccctacacgcccggcgcgctgcgcggcggcagccacgtccatgtctatagccccaacggtcagtttgtcagttttacctacaacgatcacgtgctgcacgagcgcgatccggcgctggatctgcgcaacgtcggcgtggcggcgccctatggaccggtgacgccgcagggacagcatccgcgcgaatatggcggcagccactggtgcgtgctggtaagccgcacgacgccggcacccgcgccgggcagcgatgagattaatcgcgcctatgaggagggctgggtcgggaaccatactctggcgtttattggcgatacgctggcggaaaatggcgataaagtgcctgagctgtttattgtcgatctgccgcaggatgaagccggctggaagcagcctggcggggcgccgctggccggtaccgcaaccacaatgccggcgccgccggcgggcgtcagccagcgtcgtttgaccttcacccaccatcgccgctacccgggactggtgaacgtcccgcgccactgggtgcgcgccaatccccaggcgacggcgatagcctttctgatgcgcgacgacgccggcgtagtgcagctgtggcttatttccccgcaggggggcgagccgcggcagttgacgcatcacgcgtcgggtatccagtcggcgtttaactggcatccgtcgggagagtggctgggttttgcgctggaggatcggattgcctgctgccatgccggtacgggagatatcacctttttaaccgatacgcatgcgcatgcgccctcggcggacgcgatcgtcttttcgccagacggtaaacagattgcctggatggaggaggtggacggttatcgtcagctgtgggttacgcagaccggacgataa

SEQ ID NO: 3431 - DNA, 285 bp, Klebsiella pneumoniae
ggcttcagtcacccgctcggcgataagccccctgggctgcttttgcgcccgcaggccgaaagcaacgttatcttccaccttcatatgcggaaacagcgcgtagttctgcaccaccatcgccagcccgcgtttgtacggcggcaactgggtgacgtcagtatcgccgatcaggatccgcccgccagccggttgcacaaaaccggcaatcgcccgcagcaccgtggttttcccggaaccggaagggccaatcagcgccagcacctcaccgggctcaatggtcaatga

SEQ ID NO: 3432 - DNA, 1746 bp, Klebsiella pneumoniae
aagatagcccactgcctccgccacctgctcgaccggcagatcgcccgcctcaagcagagtctggctgcggcgcagacgttcggcggtcagccagtcggtaatgctcatcccggttgcccgggcgaagtggcgggtcaaggtacggcggctcatcgccaccacccgggccagcgaatcgagactgtgcggctcggcaatatgctgctgcagataatccagcaggcagttgattcgcgcatcgcgggtgtttttcggcaccggctgggcgataaactgcgcctggccgccctcgcggtgcggcgaaacaatcatccgccgggcgatctggttggccgcgaggctgccgaaacgctggcggatgatgtagaggcaacagtccagcgccgccgcggtgcccgccgaagtaatgatccgctggtcgtcgacgtacagggcgttgatatccagctgcacctgcggaaaccggcgctggaaatcctgctcgaactcccagtgagtcgccgctcgcctgccgtccagcagcccggcgtagccgaggacgaacgcgccgaggcacaggccgacaatctccgcgccgttatcccgggcccgcaccaggctatcaagcagcgcctgcggcggacgtcgatcgacctcgccccagtaaggcaccaccacgatatccgcctgttccagcgcggcataatcgccggtggcgtacagcgcaaaaccatcgcgggcgcgcagcagccccggccgctcggcgcaaatgtgcagattaaagcgtttgatttccgaaaccgaatcgccaaacagcatgcaggggacggcgtagtgaaacgggctaaagccctctacagcgacaatcgccacgtcggtgagtttcatcgtcccttccccttacgcatgttaataaacgacggtttctccatcctgcgggatagaaaccacatcggcaatctgattatccagcgcatactggcgcatctcttcccggctcaccagacagtggttgaccgcctcgaggtggatagccatgatttttgcttccggcagggtgaagtgcacgttcaggagatcttccttgcccatgataatcgggccaaagccgatgacgtgggcgtagccggcgttgaggaccaccacgtccgggcgcagcttcagcaggtcggctgcaatgtcatcgcgccagatagtatcccccaccagccacagcgtcttctcctgcggatggcgaaacaccacgccgcaggcctcgcccaggcgttcagccatcgccggcaccgcgtaggtgcggtcgctgccgtgttggccggaggtggttttcagcagacgcacgccggcaaattcgctgtctgccgacagcaggcgcagatcctgaaatccctggctgcgcagcagcgcggcgtcggcctcatgctggacgaacaccggcagggttttcgggatcgcggcgatcgctgccgcgtcccagtgatcgtcatgggtgtgggtgacgatcaccgcgtcaacgtcgacaattttatcgcgggaaaacggcagctcaaccagcggattgcgcagttcgctgcgcgcggtgcccggaaaacccggccaggcgcctttgtccgccagcatcggatcgatgagaaatcttttcccggcgtagtgaataatctgggtcgcattacggatgtgggtgatgttcatgttggcgttcctctggggtcatctgacgaacatcgtactgagtccccgcctggctcaacaggggcgtttgggcaatga

SEQ ID NO: 3433 - DNA, 780 bp, Klebsiella pneumoniae
gctttttgccatgaaattcgtataatgcgccctcacattcgtttcaagccggagatttctatcatgcgtccagcaggccgtagcgctaatcaggtgcgtcccgtcaccctgacccgtaattacacaaaacacgctgaaggctccgtgctggtcgaattcggtgataccaaagtgctgtgcactgcctctattgacgaaggcgttccgcgtttcctgaaaggccagggccagggctggatcaccgctgaatacggcatgctgccgcgttctacgcacacgcgtaacgcgcgtgaagcggcaaaaggcaagcagggcggccggacgatggaaattcagcgcctgattgcccgcgcgctgcgcgcagcggttgacctgaaagcgctgggcgaattcacgattactctcgactgcgatgtactgcaggccgacggcggcacccgcactgcctccattaccggtgcctgcgtggcgctggccgatgcgctgaataagctggtcgccgccggcaagctgaaaaccaatccgatgaaagggatggtggccgcggtctccgtcggtatcgtaaatggcgaagccatctgcgatctggagtacatcgaagactccgccgcggagaccgacatgaacgtggtgatgaccgaagatggccgtattattgaggtgcagggcactgcggaaggtgagccgtttacccatgaagaactcctcactctcctggcgttagcccgaggggggatcgagtccattatcacgacgcagaaggcggcgttagaaaattaa

SEQ ID NO: 3434 - DNA, 645 bp, Klebsiella pneumoniae
cctgcccgccattacctggggggatctatgctgcttcatgttctgtatttaatcggtatcaccgcggaagccatgaccggcgcactggctgccgggcgccggcggatggatacgtttggcgtcatcattatcgccactgcgaccgcgctgggcgggggttccgttcgcgatatcctgctggggcactatcctcttggttgggtgaagcatcccgaatatgtcatcattgtcgccgtcgccgccgtcctcacgaccattgccgctccggtgatgccgcaccttcgtcggctgtttctggtgctggacgcgctggggctgatcgtgttttccatcatcggcgcgcagatcgccctgaacatgggcgaaggcccggttatcgcctctattgccgccgtgatcaccggtgtcttcggcggcgtactgcgcgatatgttctgcaaacgcattccgctggtcttccagaaagagctgtatgccgggatctcctttgccgcagccgtactctatattgctctgcaacattacgtcagcagccacgatgtggtggtgctggctacactgctgttcggctttaccgcccgcatgctggcgctacgctggaaactggggctaccggtcttccactacacccatgacgcccactaa

SEQ ID NO: 3435 - DNA, 918 bp, Klebsiella pneumoniae
ggaactggccattctccaaaaggccgcgacatacttcgcgaagcgcctgaaatgaagtatgttttcatcgaaaaacatcaggctgagttcagtatcaaagccatgtgccgtgtacttcaggttacccgtagtggctggtacatctggcatcagcgtcgttatcaggtaaaccggcgtcagcagttccgccttgtctgtgataacgtcgtccgggaagcattcagtgacgcaaaacaacgctatggagcgccacgcctgacggatgagcttcgtgcccagggttaccggttcaacgtgaaaaccgtggctgccagcctgcgtcgtcaggggctacgggcgaaagcttcacgaaagttcagtccggtcagttaccgcgaacatggtctgccagtctcagagaatctgctgaagcaggacttttacgccagcggcccgaatcagaagtgggtgggtgacatcacgtatcttcgcactggtgaaggctggctttatctggccgtggttatcgatctgtggtcgcggtcagtcattggctggtcgatgtcctcacggatgacagcacagcttgcctgcgatgcgttacagatggcgctgtggcggcgtaaacgtccggaaaacgtcatcgtgcatacagacagaggcggtcagtactgttcaacggattaccggagcttgctgaaacgccataatctgcgggggagtatgagcgccagaggttgttgttacgacaatgcctgtgcggaaagcttcttccatacgctgaaggtggaatgtatccacggagaggactttgtcagccgggaaatcatgcggacagcagtgtttaattatattgagtgtgattacaatcggtggcgtcgtcacagtgcctgtggcggtcttagtccggaacaatttgaaaaccagaacctcgcttag

SEQ ID NO: 3436 - DNA, 1104 bp, Klebsiella pneumoniae
cccgccggccatcgacgatgccgcgctggaaaaattcagcgtcgtatccatttgtcagcagtaccgtcagctgcagcgcacctgacgccgttagttaaccaggaccgaagatttatgagtcaaacgcctttattgagcatcgtggctgccgtctacaacggtgagaaatttctagcgcaattctttgagtgcattgaacagcagcagctggacagctatgaactgatcctggtgaacgatggttcgacagacaacagcctggcggtgatcgccgaatggcaggagcggctgcagaacgtccaggtgctggagcaggaaaaccagggcgtctcggtcgcgcgcaataccggcctcgccgccgccagcggcaaatatctcgcgtttccggatatcgacgacaaactctatccgggcatgtatcgcacgctgctggagatggccgagaaagaacatctcgatatcgctacctgcaacggcacctatgtgtacgaaaagcgccgcgagagccacccgatcttcccactggatcgcctgccctcgacggatgtgctgccgggccatgtctggcttaagcaggccctggactcgcggaagtttctgcacgtcacctggcttaatatttatcgtcacgactttatccgccagcatcacttccatttcgagcctggcctgcgccatcaggatatcccatggaccacagaagccctgctggccgcggagcgcgtgcagtacaccagtcagcagttctatgattactacattcactctgagtcggtgtcgcataagccggacaacgacgacacgctgatgcgttcggcgcgccactatatgaagattctggagatgctggaggcgattaaccagcgctacccggataaagtacgccatatcgccgcctgtcgctggcagatcgccaaagaaggcctggggatcatccataccttcgatagcatgaaagatgagtccaaaaagcatgttattattaacgaattcttcgaccgcggtatctggcggttaatctggaaaaacgcctgtactttccgtttacgctggcgcctgggacgccgttatctgcgtattaagcgttatcgccacgcgggatag

SEQ ID NO: 3437 - DNA, 252 bp, Klebsiella pneumoniae
tgtttgatacatgaggttgcggatacgttacagattcttaacgcggaaagcagggctggcaattaccggttcttattttgccgttatgaaatttcgtttaatgtgcaaattatgacggcgatcgtattttattcatgcacgctcttattattgcactggactgtctctgacaaagcggcgcaacggcgactggatattatttttgcgagctggcgcacgtttgtggattctctcaatggcggtgtgaaataa

SEQ ID NO: 3438 - DNA, 720 bp, Klebsiella pneumoniae
agcagtacacatagagcacaaggactctccatgactctcaataagaccgatcgcattgtgatctcgctgggcaaacagatcgtcagcggtaaatacgtcccgggttcggcgcttccggccgaagcggaactctgtgaggagtttgaaacctcgcgcaacatcattcgtgaagtgtttcgttccctgatggcgaagcggctgattgaaatgaagcgctatcgcggcgcgtttgtcgctcccagaaaccagtggaactacctcgacaccgaggtgctgcagtgggtactggaaaatgactatgacccgcgtcttatcagcgcgatgagtgaagtgcgcaacctggttgaacccgccatcgcgcgttgggcggcggaacgcgccacctcaagcgatctggcggaaatcgagtcggcgctcaatgacatgatcgccaacaaccaaaaccgggatgcctttaacgaagcggatattcgctaccacgaggcggtgctgcagtcagtacataacccggttttgcagcagcttagcgtggcgatcagttcgctgcagcgggcggtatttgaacggacctggatgggcgatgaaggcaacatgccgaaaaccctccaggaacataaagcgctatttgacgccattcggcatcaggatagcgacgcggcggagcaggcggcgttgacgatgatcgccagctcgacacgaaggcttaaggaaatcacatga

SEQ ID NO: 3439 - DNA, 879 bp, Klebsiella pneumoniae
gccaacacacagggagaggcgcgtatggtacgccaacggcaggctgacctgctgctgattgccgcgacggtgattgccgcctgcggctggatattttcccgcgaggcgatcgccggcatgccggtgttcgcgtttcttgggctgcgttttttcttcgccgcgctgcttctgctgccgttctgccgcggttttcgcccgcaaaagcagcactggccaaaactcatcatcagcggactctggtttgcgctcaacctctgcctgtggatctattcggtctccacgacggcgtcgctcggcgaaggggcgtttatcatgagcctgtcgatgatgttcgtcccgctgaccgcatgggtgatgatgaaggtgcgcccgccgcgcgcctggtgggagtgcctgccgatcgcggtggttggcctggggctgctcagtctgcatatgccgatagccttccaccccagccagggctggtttttgctgacggcgctggtgcagtcgatctggttctgttacaccagccgctgcgcgcgtgaagtaccgctgatccccctgaccaccgtgcagctggcgatcaccggtatcgtcgggttgaccatctccgctgccgttgaacgctgggaccagccgatgaccctgccgactctcggctggttggtggccagcattgtcatcgctaccagcctgcgcttcggtctgcagatgaaggggcagaagtacgcggcggtggccagcgcggcgatcatcatggtgctcgaaccgctgctgacggtcattgccgccgcgctgtggtacggcgaacagctgccgctgcagaagattatcggcggcgtgctgatcctcgtggcccagctgtggttccgctggcggatgcttaagccgtaa

SEQ ID NO: 3440 - DNA, 954 bp, Klebsiella pneumoniae
actggcggtcttcgtctcacctttttgtcttatcgtctcaggagaagcatggacagtctcagtcatctgctggcgctgctggcgccacgctgcgaagtgaacctgcactgtcgcttcggcggccgctggcaggccgggcaccagcaaatgcgtagcggcgtggtgccctggcacgtggtgctgcgcggcgaggggcggctcaacgtcggcggccagacccatcacctgcgcgcgggagatgtcgtcctcctgccccacggttcgccgcacctgatggagagcctggtggagtggggccaggtgctgccggtggcgcaccggtttaacggcacggtgacggaaatgcgcgccggcccggcggagggggcgctggagatgctgtgcggcgaattctattttggtccgcacgtcagctggctgttcagtgaagcatcgacgctgatccatctccataccgatgcgcgtgaagactgcccggagctggacgcgctgcttaatatactggtgcgcgagagcctggcgcagcgtcccggcggcagcgctatcgtgcgcagcctcggcgatacgctgctggtgctcctgctgcgcatgctgcttggcgagcaacagccgcccggcgggctgctgcgcctgatgagcgatgaacgcctgatgccggcggtgctggcggtgatggcgaccccggagcaaccgtggacgctggagagtatggccgcccgcgcgtttttatcacgggccacctttgcccgtcattttgcccgcgtctatcacctgacgccgcaggcgtggctgtcgcagttgcgaatggcgctggccgcccggctgctgcgcctggagcgtcagaccaacctcgaggtcattgccgaacgctgcggctttcagtcgctggcgtccttctcgaagcgcttcaaaatgcgctatggcgtgacgccgggcgagtggcgacggggctag

SEQ ID NO: 3441 - DNA, 1326 bp, Klebsiella pneumoniae
aaaaaacgacaggagacaggcatgtcgctctggcttacccacccgctgttccttccttcattgattgtcggcgtcaccatcgtgctgtgggcgacgtcgctgctgccggaatttatcaccgcgctgctgttcttcgcagcggcgatgatggcgaaaatcgctccgccggaggtgatcttcggcggctttgcctcttcggcgttctggctggtgttcagcggctttgtgctcggcatcgccatccgtaaaaccggactggcggaccgggcggcgcaggcgctgtcggccaggctcaccgactcctggccgcggatggtcgccagcgtggtactcctgagctacgccctggcgttcgtgatgccctccaacatggggcgcatcgcgctgctgatgccgatcgtggcggcgatggcccgccgcgcgggcattgccgacggtagccgcggctggttcggcctggcgctggcggtggggttcggcacctttcagctgtcggcgacgattttgcccgccaacgtgccgaatctggtgatgagtggcgcggcggaaggctcgtacggtatccatctgaattatgttccctatttactgctgcatacgccggtgcttggctggctgaaaggggcggtgctggtggcgctgatttgctggctgtttcccggcaagccgcatccaccgcgcgacctggcgccgctgccgccgatgagccgcgacgagaaacgtctggcgtggctgctggcggtggtcctctcgctatgggtgaccgagagctggcacggcgtcggcccggcgtggaccggcctggcggcggctgtgatcacgctgctgccgcgggtgggctttattaacggcgaggagtttgccagcggggtgaatatgcgcacctgcatttacgtcgccgggatcctggggctagcgatcgccgtcacccaaaccgggattggcggcgcagtgggcaatgcgctgctgcaggtgatgcccctggataaagacaatcctttcaccagctttctcgccctgaccgggataaccagcgcgctgaactttattatgaccgccaacggcgtgccggcgctctacaccacctttgcccagagctttgccgacgccaccggcttcccgctgctaagcgtgattatgattcaggtgctgggctattccacgccgctgctgccctatcaggcgtcgccgatcgtggtggcgatggggttaggcaaggtcccggcgagggcggggatgcaactgtgtctggcgctggcggcggtgagttatctggttttactgccgctggactacgcctggtatcagctgttggggaaactgtaa

SEQ ID NO: 3442 - DNA, 1197 bp, Klebsiella pneumoniae
ctgaacggacacaacgaaagaggaacaacgatgaaacgacatgcaatttatttcgccctggcgctggcgggcgcggcgtttaccctccaggcggcgccattacccgcgatgccggacccaagcctgccggtgagccactttatcacccaggttaacgcggataagagtatcacttaccgcttgtttgcccctgatgcccggcgggtctcgatagtgaccggcgccacgccggactcctttgtctcgcacgacatgaccaaagcagcggacggagtctggacatggaaaagcgagccgatgaagcccaatctctatgaatactatttcgatgtggatggcttccgctcggtagataccggcagccgctatcagaagccgcagcgccaggtgaacaccagtttgattctggtgccgggcagtattcttgacgatcgggaggttgcgcatggcgatctgcgcaccctcacctatcactcgaaggctctgaacgccgaacgtcgtctctatgtctggacgccgccgggctatagcggaaccggcgatccgctgccggtgctctatttctatcatggctttggcgacagcggcctgtcggccatcgatcaggggcggatcccgcaaatcatggataacctgctggcggagggcaagattaagccgatgctggtggtggtcccggataccgaaaccgatatcccggaagcggtcgcggaaaacttcccgccgcaggagcggcgcaaaaccttctatccacttaatgcgcaggcggcggataaagagctcatgcaggatattattccgctgatcgatgcccgatttaacgtgcgtaaagatgccgacggtcgggcgctggcgggcctctcgcagggcggttatcaggcgctggtttccggaatgaatcatctggagagctttggctggctcgccacctttagcggcgttacgactaccacggtgccgaatgccggcgtggaagcgcagctgaagcagcctgacgcgatcaataagcagctgcgtaactttaccgtggtcgtcggggaaaaagattctgtgaccggtaaagacattgctggtctgaaaagcgagctggaaaaacagcagattaaatttgattaccaccagtatcccggcctgaaccatgaaatggacgtctggcgcccggcctacgccgagtttgtgcaaaaactgtttaaataa

SEQ ID NO: 3443 - DNA, 438 bp, Klebsiella pneumoniae
ccccccatgcaagaaattatgcaattcatcggccgtcacccggtcctgagcatcgcgtggatcgcgctgctgggtgcggtagtgttcaccaccttcaaggggctgatgtcgaaagttaaagtcatcacccgtggtgaagcgacgcgtcttatcaataaagaagatgcggtggtggtcgacctgcgtcagcgtgacgatttccgtaaaggccatattgccggcgctattaacctgctgcccagcgatatcaaagccaataacgtcggcgagttggaaaaacacaaatcgcaacccattattgtggtagacggttccggcatgcaggcgcaagagcccgccagcgcgctgaacaaagccgggtttgaaaaagtctttgtactgaaagagggcattgctggctggagcggcgaaaacctccctctggtacgcggcaaataa

SEQ ID NO: 3444 - DNA, 1524 bp, Klebsiella pneumoniae
ccggcgccgcaaccaggatgctctgttcgcgccacgctcagccgtggcgcgcgtttaaggagagggagtatgtatatcggcatcgatctggggacgtcgggcgtcaaagccatcctgctcaatgagcagggtgaggtagtggcatcgcataccgaaaaactcaccgtctcgcgtccgcatccgctgtggtcggagcaagatcccgaacagtggtggctggcgacggacacggcgatgaaagccctgggcgcgcagcatagcctgcgcgacgtgaaggcgctgggcattgccggacagatgcacggcgccaccctattggataaatcgttacaggtgctgcgtccggccattttatggaatgacggccgctgcgccgaagagtgccagctgctggaagacaaagtcagcgcttcccggcagatcaccggcaacctgatgatgccgggctttacggcgccgaagctcttatgggtacagcgccacgaggcggcagtgttcagccaggtcgataaagttctgctgcccaaggattatctgcgcctgcgcatgaccggcgagctcgccagcgatatgtctgacgccgccggcacgatgtggctggacgtcgcccggcgcgactggagcgacgagatgctcgccgcctgcgatctcagtcgggatgcgatgccggcgctgttcgaaggcagcgacgtcaccgggcaactgcgacctgaggtggcgcaggcgtggaatatgccgccggcgctggtggtgggcggggggggcgacaacgccgcgggcgcggtcggggtcggcatggccgatgccggtcaggcgatgctgtcgctgggtacgtcaggcgtctacttcgccgtcagtgaagggttccttagcaaacccgaaagcgcggtgcacagcttctgccatgccctgccgggccgctggcatttgatgtcggtgatgctcagcgcggcctcctgtctggactgggcggcaaaattaaccggtctcgccagcgtgccggcgctgatcgcggcggcgcagacggcggatgaaagcgccggtccggtgtggttcctgccctatctgtctggcgaacgcacgccgcacaacaacccgcaggctaagggcgtcttttttggcctgacgcatcagcatgggccggcagagctggcgcgggcggtgctggaaggggtgggctatgcgctggcggatggtatggacgtggtgcacgcctgcggcatcaagccgcagagcatcacgcttatcggcggcggggcgcgcagcgcttactggcggcaaatgctggcggatatcagcggcctgcagctcgattaccgtaccgggggcgatgtcggcccggcgctgggggccgccaggctggcgcagctggcggttcacgacgaggcagaccgccccgggctgctgaagccgctgccgcttgaacaagcccatcgcccggacgatcgccgtgtggcccactatgcgccgcagcgggaaaccttccgccagatttatcagcaactgaaaccgctgatgtcttag

SEQ ID NO: 3445 - DNA, 894 bp, Klebsiella pneumoniae
ggcaggccgcaaggcattgaggagaagctcatggccggcgcaaaagagatacgtagtaagatcgcaagcgtccagaacacgcaaaagatcactaaagcgatggagatggtcgccgcttccaaaatgcgtaaatcgcaggagcgcatggcggccagccgtccttacgcagatactatgcgcaaagtgattggtcaccttgcgaacggtaatctggaatataagcacccttacctggaagaacgcgacgttaagcgcgtgggctacctggtggtgtcgaccgaccgtggtctgtgcggcggcttgaacattaacctgttcaagaaactgctggcggaaatgaaagcatggtccgataaaggcgttcagtgcgacctcgcaatgatcggctctaagggcgtttctttctttaactccgtgggcggcaacgtggttgcacaggtgaccggtatgggggataacccatccctgtccgaactgatcggcccggtaaaagtgatgttgcaggcctatgatgaaggccgtctggacaagctgtacgttgtcagcaacaaatttattaacaccatgtctcaggttccgacgatcactcagctgctgccgttaccggcatcagaagatgctgatctgaagcgtaaatcctgggattacctgtatgagcccgatccgaaagcgctgctggataccctcctgcgccgctacgtcgaatctcaggtttatcagggcgtggttgaaaacctggccagcgagcaggccgcccgtatggtggcgatgaaagccgcgaccgataatggcggcagcctgattaaagagctgcagttggtatacaacaaagctcgtcaggccagcattactcaggaactcaccgagatcgtctcgggggccgccgcggtttaa

SEQ ID NO: 3446 - DNA, 420 bp, Klebsiella pneumoniae
gctggcacgcaaaatgggcgttacccgcgcggtgaacgtggccaaagagaacttaatgacgtgatggccgagctggggatgaccgaaggtttcgatgtgggtctggagatgtccggcgcgccgccggcgtttcgcagcatgctggataccatgaaccacggcggccgtatcgcgatgctgggtatcccgccgtcggatatgtccatcgactggaccaaggtcatcttcaaagggctgtttatcaaaggtatctatggtcgcgaaatgttcgaaacctggtacaagatggcggcgctgatccagtctggtctggatctctcaccgatcatcacccaccgcttcggcattgatgacttccagaaaggttttgacgcgatgcgctccggccagtccggtaaagtggttttgagctgggaataa

SEQ ID NO: 3447 - DNA, 363 bp, Klebsiella pneumoniae
gcaatggcgcaggccgtggaaatggtcgccagattaacctcgtcgccgcgcagcgttccgtctgccgcgcaggcttccagcctgtcgagaccgcgagccactttctcccgctggcggagcagctcttgctctgactgttgcgcgcccgggcgagccttttcacgcaccagcgcctgggcggcctccatcacgccatccgccagcgcctctagctggcgcatcctgagagcggctctggggtcggcggggatcatcggcggcgccacgcccagcagctccagatactgggcgatgaccggggagtcaaaccagcactcaccgtcgtccgtcaccagcgccggtaccttgcccagcgggttatag

SEQ ID NO: 3448 - DNA, 711 bp, Klebsiella pneumoniae
gcccatcagcatcatcagcaggccgaggctgccctgaccggtttgcggcatcatcgccgacagccaggccagcacgccggagccgatattctgcaagccgcccaccagcgccccggcggttccggcgaggaacgggaacggctccatcgcgccgctggtggccagcgggaacaacatcccggcgccgaagaagaacagcgccgcaggcaccagcagggtccagacggtcatgatgcccagcagccctgggatccacatcatcagacccgccagcaggcagcagatcaccgactgccacatcagggtcgggaaacgcttgttggggcggccggcaaaccacgccccgaagaacgccgccgggatcggcagaataaacagaatactcaccgccatgctgctcaggccgagcaccgcgcccatcagcaccccggagcaggcttcgaataccgcaatccccgccaggccgccgatcagcatcagcagatagcagttaaaggcgccgttgccgaacagcgttttgtagctggccagaagtttggtgcgcggcgccccttccgggcgcgtttccggcatccacttcgccatgctgaaggtcaccccggcgcacaggaccagcaggaaagcgtagcaggcgcgccagctccacagggtgtcgaggatgccgccgagcagcggggcaatcagcgggctgaccagaatacccatatttaa

SEQ ID NO: 3449 - DNA, 567 bp, Klebsiella pneumoniae
caggcgcagcagatcctgtcgtttaatcatttcgcacatcattgccggcccgatgccgccaggggcgaggctgataataccgttcatgttgctgatggcggtgatgattttttcgttggcgatgataatcccgcagcggctgcccggcaggcccagcttggacaggctcatacacagcacgatgttcggattccacagcggtcgggcgtcgctaaagataatgcccgggaacggcacgccgtaggcgttatcaatcaccagcgggaccccgtgctgattcgccagcgcatccagtttgatcagctcttcatcagtgatgacgttgccggtcgggttggtggggcgcgagacgcagatcatcccggtctcttccgtcacctgcagatgctcaaaatcaacatggtacttaaactggccttccggcagcagttcgatgttcggccgggtggcaacgaacagatcctcttccagaccggcatcggcgtagccgatgtattccggcgtcagtgggaacagtaccttacgggtggtgccatctgcccgacggcctgcaaacagattaaataa

SEQ ID NO: 3450 - DNA, 813 bp, Klebsiella pneumoniae
tcgcagtttaactttgtaactatcatgcttaaactctccgtatgcttactgacctgtaactctgcgcgcctgctgatggaggtgctgccgcctctgctgaaggtggccgatgaatgtatcgtcgtcgactccggcagtaccgacgaaaccgtcgctatttgtcagcagtttggtctcaccgtccatcaccatgcctataaagcccacggcgcgcagatgaactatgccatcgggctggccagccatgactgggtgctgtgcatggacagcgacgaaattcttgataatgacgtggtgacggccattcaggcgctaaaagcgggggaggagcctgacccgacctgcgcctggcgtctgccgcgctactggtttgtgctaggcaaacaggtacggactatctaccccatttcctcaccggattatccggtgcgcctctttaaccgccagcaggcgcggtttaacgatcggccggtggatgaccaggtggtcggacacgcgagctccgtcaggctgccgggcttcgttcgccacgataccttttattcgctgcatgaagtgtttaataagctgaacagctataccacccggctggtgaagtaccagcagatcaaaccttcgctgacgcgggggatcgtcagcgccattggcgctttctttaagtggtatctgtttagcggggcgtggcgctatggcaaggtcggcgtggtgaccggcctgtacgcgacgttttacagctttctgaaatattttaaggcgtggtacgcccacgaagataaccaggcgcccgtcgcgcaaaagcgaacggacccctga

SEQ ID NO: 3451 - DNA, 1785 bp, Klebsiella pneumoniae
catctgattaaccattcattgtcatcaaccctgatacccttaattggccgggccaattttaccttcggtgggatcggcaatgagcgcagactcagccctcctctcctggcggcccgatggagaccctgcatgaatctctggcaacaaaactacgatcccgccggtaatatctggctatccagtcttatcgcatcgctaccgattctgtttttcttttttgcgctgattaagctcaaactgaaaggctacatcgctgccacctggaccgtcgcaatcgcgctggtcgttgcattactgttctataaaatgccggtggaccgcgccttagcctcggtggtctacggcttcttctacggcctgtggcctatcgcgtggattattatcgccgcggtcttcgtctataaaatctcggtgaagaccggacagttcgacatcatccgctcatcgattctgtcgattacgccggaccagcgcctgcagatgctgatcgtcggcttctcgttcggcgcctttctcgaaggggcggcgggtttcggcgcaccggtggcgattaccgccgcgctgctggttggtctcgggtttaacccgctgtatgcggctggcctgtgcctgatcgtcaacaccgcgccggtggccttcggcgcgatgggcatcccgattctggtcgccggccaggtgaccggtatcgatagcttcgccatcggccagatggtgggccgccagctgccgttcctgaccattatcgtgctgttctggatcatggcgattatggacggctggcgcggcattaaagagacctggccggcggtgatagtcgcaggcggttcgttcgctattgcccagtacctcagctctaacttccttggcccggagctgccggatatcatctcgtcgctggtctccctggtctgtctgaccctgttcctcaaacgctggcagccggtacgcatcttccgcttcggcgatctcggcgcctcgcaggtggatatgacgctggcccgcacacgctacacggcgggacaagtgatccgcgcctggtcgccgttcctgttcctgaccgccaccgtgaccctgtggagcgtgccgccattcaaagcgctgttcgctcctggcggcgcgatgtatgacttcgttatcaatatttcggtaccattcctcgacaaaatggttgcccgtatgccgccggtggttagcgccgcaacgccctacgccgcggtatataaattcgactggctgtcggcaaccggcaccgccattctgttcgccgccctgctgtccatcgtctggctgcgcatgaagccgaaagatgcgctgaccaccttcgccgggacgctgaaggatctggcgctgccgatctactctatcggcatggtgctggcgttcgcctttatctctaactattccgggctgtcgtcgacgctggccctggcgctggcccataccggccacgcgtttaccttcttctcgccgttccttggctggctgggggtattcctgaccggttcggacacctcgtctaacgccctgttcgccgcgctgcaggcaacggcggcgcagcagattggcgtctccgatattctgctggtcgcggctaataccaccggcggcgttaccggcaagatgatttccccgcagtcgatcgccatcgcctgcgccgcggtaggcctggtgggcaaagagtcggatctgttccgctttaccgtcaaacatagcctgatcttcacctgcatggtggggctgatcaccacgctgcaggcctacgttttaacctggatgatcccgtga

SEQ ID NO: 3452 - DNA, 1164 bp, Klebsiella pneumoniae
ttgaaggttaatactatgaaagcattacattttggcgcaggtaatatcggacgtggctttatcggtaaattgctggccgacgcgggcatcgaactgacgtttgccgatgtcaatcagaccgtacttgatgccctgaatgcccgtcatagctatcaggttcacgtcgtcggtgagaatgagcaggtggacaccgtctccggcgtcaatgccgtcagcagcatcggcgatgaggttgtggacctgatcgctgaggtggatctggtcaccaccgccgtcggtcccgtcgtgctcgagcgcatcgcgccagcgatcgccaaagggctggcgcagcgcaaagcgcagggcaccgaacgcccgctgaacatcatcgcctgcgaaaatatggtgcgcggcaccacgcagttaaaaggccacgtgtttaacgcgctggcggaagaagataaagcgtgggtggaagcgcatatcggctttgtcgactctgccgtagaccgtattgtgccgccatcggcttccgccactcatgacccgctggaagtcaccgtggaaacctttagcgaatggattgtcgataagactcagttcaagggcgcgctgccgactatcccgggaatggaattaactgataacctgatggcatttgtcgaacgcaagctcttcaccttgaacaccgggcatgctataaccgcctacctcggaaaactggcgggccatcagacgattcgcgacgcgatcctcgacgagaaaattcgtgccgtcgtgcagggcgcgatggaagagagcggcgcggtgctgatcaaacgttacgcctttgacccgcagaagcacgcggcttatatccagaaaatacttggccgtttcgagaacccgtacctgaaagacgatgttgagcgcgttggccgtcagccgctgcgcaaactgagcgctggcgaccgtttaattaagccgctgctgggtacactggaatacgggctgccgcaccgcaacctggtgaaagggattgcggcggcgatgcatttccgtagcgaagacgatccgcaggcgcaggagctggcggcactgatcgccgacaaggggccgcaggccgcgctggcgcagatttccggcctggatgccgcaagtgatgtcgtcgcggaggccgttaacgactacaacgcggaaaaatga

SEQ ID NO: 3453 - DNA, 333 bp, Klebsiella pneumoniae
caacttgctaacaaggcggtggaggagaacgtggtgaaaggtgttgtttccgtcatgctggtgctgctcctcgcgggctgcagcgagaccgtctccccgccgacgcaaaaagcgcagcgcgctcgtattacgccgcaaaccacgctcaatatggcgcagctttgcaaggatcaggcggctatccgctataacacgcaaacgcagctcgttgacgtgaaccactttgaacaattccaggcgagctatgagctttctggccgtaccggcaagaatgagcgtttcatctgttcctttgacccggacggccagtttatgcatctttcgatgcgctga

SEQ ID NO: 3454 - DNA, 192 bp, Klebsiella pneumoniae
cacgccgccaataccaaagccaacgccgcggattttgacattgccgatccacaacccaaccaccgccaccagcgccagtacgctgaccgtcaatgctatctcactcatggtaccgtccctgtgaataacattattattaacagggattatgaccgcggccaggcggattgtatgctgcctggcgcacaataa

SEQ ID NO: 3455 - DNA, 954 bp, Klebsiella pneumoniae
aaatcggccaaccgtttgatgtggagattattggcgatgaataatctttgtattgatgtaaaaaatctcaataaacattttggcgagcatcacgtcgtaaaggatttctctttacaggtggcaaaaggcgaaatctatggttttctcggtccgaacggtagcggaaaaacgacatcgattcgaatgatgtgtggtttgattacgccggattctggtgaaggtacttgtctgggtatggatatctttacgcagcgggaaaaaataaaaaaaaagataggctacatgacccagtatttctcaatgtggggaaatttaactattcgggaaaacttactttttattgcgcggttatatagcctcgatcggcgtagagagcgggttgaacgtgcgctttctgagttaggcctcactgcccgacagcaccagctggctaaggagctttctgggggctggaagcaaagaatggccctcgccgcctgtatgttgcatgaacctgttttgctatttctggatgagccgactgctggcgtggatcccaaggcgcggcgagagttctggcaaatgctgcaccagctctctgaccgggggatctcgctactggtgagcacgcattatatggatgaggctgagcgctgccataaggttgcctatctctcatatggtcggctgctggcgaatggcactattgcgtcgattatcgcctcccagaatttgatcaccatgcgaaccagcggcgccggtctgacgctgcttgaaagccagctacagcgcttgccggatattgagcaaacggtcatttttggcaatcagctttatattacatccagagatgaagcgaagttaaaatccgcgctttttgcctttacgcaacagggttatgagttctgtaaggtggataccaatctggaagatgcatttacctacttgatgaaaaataattgtgaaaaaaattaa

SEQ ID NO: 3456 - DNA, 1080 bp, Klebsiella pneumoniae
cctcgaaacaatgatttacgaatcccagcaggagacattatgaacgttatgcgtaccaccgtcgcaacagttgtcgccgcgaccttatcgatgagcgctttctctgcctttgcagcagcaagcctgactggcgcaggcgcaactttccctgcgccggtgtatgccaaatgggctgatacctatcagaaagaaaccggcaataaagtgaactaccagggtattggttcctctggtggcgttaagcagattattgccaacaccgttgatttcggtgcttctgatgctccgctggctgatgacaaactgacccaggaaggtctgttccagttccccaccgtgattggcggcgtggtactggcggttaacctgcctggcgtgaaatccggcgaactggtgctggacggcaaaaccctcggtgatatctacctgggtaaaattaaaaaatgggatgacgaagcgatcgctaagctcaacccgggcctgaagctgccgtcgcagaacatcgccgtggtccgccgcgccgatggttcaggtacctccttcgttttcaccagctacctgtccaaagtgaatgaagagtggaaatcgaaaatcggcgccggctctaccgtaaactggccaaccggtctgggcggtaaaggcaacgatggtatcgccgcctttgttcagcgtctgccgggctcgattggttacgtcgaatacgcttacgctaagcaaaacaacctggcctacaccaaactggtctctgccgacggcaagccggttagcccgactgaagacaacttcgctaacgccgcaaaaggcgttgactggagcaagtctttcgctcaggacctgaccaaccagaaaggcgagaatgcatggccgatcacctcaaccaccttcatcctggtgcataaggcgaccaacaagccggaacagaccgctgaagtgctgaagttcttcgactgggcttataaaaacggcgggaaagaagcgaatgcgctggattacgcgacgctgccggaaagcgtggtagagcaggttcgcgcggcatggaaaaccaacgtcaaagacagcagcggtaaagcgctgtactaa

SEQ ID NO: 3457 - DNA, 666 bp, Klebsiella pneumoniae
ctttttgacaagcgccgcgcttcccgatttaatcgtcagcaggcaaaaaaaggaacgacgggcatgaagaagtggacaattttgtggttaagtgggctgatgggccttgccgtcggcccgcacgcgttgtccgcagagagcgaatcgacgaccgcggcagcgccctacctgctcgccggcgcgccgagctttgaccagtcgatcagtcagttccgcgagaaattcaacgccgataacccaaagctgcctctgaacgaattccgttccatcgccaccagtcgcgatcgggctaacctgacccgcgccgccagcaaaattaacgaaaatctctatgcctccaccgcgctggagcgcggcacgctgaagatcaaatccatgcagatcacctggctgccgatccaggggccggagcaaaaggcggccaggaccaaagcgctggagtatatgagcgccatgatccgcgccttcgtgccgacttttagccaggcgcaaagccagcaaaaactgcagaaactgctggccgccggcaagggcaagcgctacttcgccgataccgaaggcgccgtgcgctatgtggtggcagatcatggggaaaagggcctgaccttcgccattgaaccgattaagctggcgctatctgaaacgctggaaggtaacaataaatga

SEQ ID NO: 3458 - DNA, 1071 bp, Klebsiella pneumoniae
cgtatccgcaacctcatgtatcaaacattattttccgttcgtcttacctacccttacaaaaaaggtatcgttattatgaagataaagaacctttgccttacgctttgcgccagctccctcctgctcgccagcatggcggggatggcgaaagaagtgaagattggcatggccatcgacgatctgcgtctggagcgctggcagaaagaccgtgatattttcgtcaataaagcggaatccttaggcgccaaagtttttgtccagtccgctaatggcaatgaagaaacgcagatgtcgcaaattgaaaacatgatcaaccgcggcgtcgatgtgttagtcattattccttataacggccaggtactcagtaacgttattaaagaagccaagcaggaaggtattaaagtcctggcctatgaccgtatgattaataatgccgatattgatttctatatatctttcgataatgaaaaagttggtgaaatgcaggcgcaaagtctggtcgacaaagtaccgcagggtaattatttcctgatgggcggctcgccggtggataataacgctaaactgttccgcgccggacagatgaaagttctcaagccgtatgtcgatgatggcaaaattaagattgtcggcgatcagtgggttgacggctggctgccggagaacgcgctgaaaataatggaaaacgcgctaacggcgaataataacaagatcgatgccgtggtcgcctccaatgacgccaccgccggcggcgccatccaggccttaaccgcccaggggctggccggcaaagtggcgatctccggtcaggatgctgacctggcgggcgtgaagcgcattatttccggtacccagacgatgaccgtctataaaccgattaccaccctggccaccaacgccgctgaaatcgccgttgagctgggtaacgataagcagccgaaggccgataccacgctgaataacggcttaaaagacgtcccttcgcgcctgttaacgccaattgaggtgaataaagagaatatcgacgccacggtgattaaagacggtttccataaaaagagtgaactgtaa

SEQ ID NO: 3459 - DNA, 1380 bp, Klebsiella pneumoniae
ttattaataaaaaacaaaaacaccctctgtaaattaccgggcatggtgagcggcttcgctatgcccaaaatctggagacagattgcgatggatatttcagttaccgctgtaaaaaccgggcgtcgccgttatctgacgctcatcatgatctttattaccgtggttatttgttatgttgaccgtgccaacctcgccgtcgcctcggcgcatattcaggaggagtttggtattagcaaagcggaaatgggctacgtattttccgcctttgcctggctgtataccctctgccagatccctggcggttggttccttgaccgcgtgggatccaggcttacctactttatcgctatatttggctggtcggtggcgacgttgctacaaggcttcgccaccggtttaatgtcgcttatcggtttacgcgccattaccggcatcttcgaagcgccagccttcccgaccaacaaccgcatggtgaccagctggttcccggagcacgagcgcgcttccgccgtcgggttttatacctcggggcaatttgtgggtctggctttcctcacgccgctgctgatctggatccaggagctattgagctggcactgggtgtttatcgttaccggcggtatcggcattatctggtcgctgatctggttcaaggtttatcaaccgccgcgcctgactaaaagcatcagtaaagccgaactcgactatatccgcgacggcggcggcctggtggatggcgatgcgccggtgaagaaagaggcgcgtcaaccgttatcgaaagcggactggaagctggtttttcaccgcaagctggttggcgtttaccttggacagttcgcggtaacctcgacgctgtggttcttcctgacctggtttccgaactacttaacccaggaaaaaggcatcaccgcgctgaaggccggctttatgaccacggtgcccttcctcgccgcgttttttggcgtcctgctgtctggttggctggcggataagctggtgaaaaaaggctactcgctgggcgtggcgcgcaaaacgccgatcatctgtggactgttgatctccacctgcatcatgggggcaaactacaccaacgaccccatctggatcatggcgctgatggcgctggcgttcttcggtaacggttttgcgtctatcacctggtcgctggtctcctccctggcgccgatgcgcctgatcggcctgaccggcggggtgtttaactttgttggcggcctgggcggcatcaccgtcccgctggtgattggctatctggcgcaggattacggctttggcccggcgctggtttatatctccgtggtggcgttaataggcgcgctgtcttatatcctgctggtcggcgatgtgaaacgtgtaggctaa

SEQ ID NO: 3460 - DNA, 354 bp, Klebsiella pneumoniae
ttaaaagtaaagaactggtggagatttgcgatgacagcaaaaaataaatacaaaagcccggctttcgaagcgatccatagcgctgcgtcggggctattcagcgttggcgcaatcccacaggaaacaatgcgccattttgatgaatcatgtctcggtagcgtagccgcacttcaacccattgaaattaaagcgctacgtgaacaactcaatgttagccaacccgtgttcgctcgttatctgaataccagcgtgtctaccgtgcaaaaatgggagactggcgctaagcgaccaagcggaatgtcattaaaattgcttagcgtcgtacaaaaacacggcctgaaaatcctactgtag

SEQ ID NO: 3461 - DNA, 840 bp, Klebsiella pneumoniae
  unsure (209): Identity of nucleotide at the above locations are unknown.
ttaacaacaaagggtaaaggcatcatggcttcagaaaatatgacgccgcaggattacataggacaccatctgaacaaccttcagttggacctgcgtacattctcgctggtggatccgcacaaccacacagccaccttctggacgctcaacattgactccatgttcttctcggtggttctcggtctgctgttccttgccatgttccgtancgttgctaagaaagcgaccagcggcgtaccagggaaattccaaaccttcatcgaaatgatcatcggcttcgtccatggcagcgtcaaagacatgtaccatggcaagagcaaggttatcgcgccgctggcgctgaccgtgttcgtctgggtcttcctgatgaacctgatggacctcttgcctatcgatttcttaccttggatcggtgagcacatactcggcctgcctgcactgcgcgtggttccgtctgccgacgtgaacatcaccctgtcgatggcgcttggcgtgttcatcctgattattttctacagcatcaaaatgaaaggcgttggtgggttcgttaaagaactgaccatgcagccgttcaatcactgggcgttcattcctgtcaacttaatccttgaaggggtaagcctgctgtccaaaccggtctctctcggtctgcgactgttcggcaacatgtatgccggtgagctgattttcattctgattgctggtctgttgccgtggtggtcacagtgggttctgaatgtgccttgggccatcttccacatcctgattattacgctgcaagccttcatcttcatggttctgacgattgtctatctgtcgatggcatctgaagagcattga

SEQ ID NO: 3462 - DNA, 291 bp, Klebsiella pneumoniae
gccatgcaaaaacaatgtgataacgtcattctggaactcaccgtccgcaaccatcccggcgtcatgacccacgtgtgcgggctttttgcccgtcgcgcgtttaacgtcgaaggcattctctgtctgccaattcagggcagcgaacacagccgcatctggctgctggtaaatgatgaccagcgactggggcagatgattagccagattgaaaagctggaggatgtcaccaaagtggcgcgtaaccagtccgatcccaccatgtttaacaaaattgcggtgttcttcgaatag

SEQ ID NO: 3463 - DNA, 576 bp, Klebsiella pneumoniae
actgcaaaaaaaattgccctcaatcccttgaaaagcacggggagaaacccattttataggtgtaacccactgagaatacgcctgaggggtattccggattaccgcggcctgtccacgatggaaggtcatttgattctcgctgattttcaggagctatttactatgcgtaacttcgatctttccccgctatatcgttcagccattggtttcgaccgcctgttcaacctactggaaaacaatcaaagccagagcaacggcggctaccctccgtataacgtcgagctggtagacgaaaaccactatcgcatcgctatcgcggtggctggctttgctgaaagcgagctggagatcactgcccaggacaatctgctgatcgtcaaaggcgcccacgccgccgagcagaaagagcggacctacctgtatcaggggatcgccgagcgcaacttcgagcgcaaattccagctggcggaaaacattcacgtccgcggcgccaatctggtgaacggcctgctgtatatcgatctggaacgggtgatcccggaagcgaacaagccgcgccgcatcgaaatcaactaa

SEQ ID NO: 3464 - DNA, 1548 bp, Klebsiella pneumoniae
gttaaagaaaacatgaaacaagagacaatcattcaaaaaatttggagtttatgtaacatcctgagaggtgatgggatcacctattatcagtatgtatctgaactcagctatctactgtttctcaagattgctcaggaaaatggttcagaaaaattgatacccaaaggctatcgatgggctgacctagagtcccatgaagaagaaggcttactagggttctatcaagagatgctcacacatttgggtgcaaatgttgaaaatgaagttataagagcgatttatgcattccctacaacggttttttctcattccgaaaatttaaaagctgtcatagacggtatttcaaaaatagagtggcatcaagtaggaaaagatggatttggtgacctctacagcggcttaatcgataagagcgctcaagatactcgttcgggggctgggcagtatttcactccacgctctttagttaatactattgtgagattaatacaaccatcccttggcgaattaattcaggaccctgcgatcggaagtggtggtttcttagtctctgctgatagcttcattcgaaataaatattcacataaagaatatcaaactaaccctccaaaatatcaaggtgtagaaatagagaagaatactcgtcgaatttgcttgatgaatacttttttacatcgtttagacgcaaatattatttatggtgatgcgctaactgatgacgcagcggaattggataaagctgacgtaatcgtagccaaccctccctttggtaacaaggccgggggacagcgtcctttgcgcagcgatattccatttcctaatacaaataaacaacttgcttttttgcagcatatttatctggggcttagggctggtggtcgggcagctgtagtgttgccagataacgtactatttgagtctggtgttggtacggatgttcgccgtgatttaatgaataaatgtaacctccataccatcttgcgcttaccaactggtatcttttacgcacatggcgtaaaaaccaatgtattgtttttcactaaagggaccgcaaaaaacaaatatcagcaagaaaactgtactgagaatgtttgggtatacgacctgcgtaccaatatgcctagttttggtaagcgcacaccctttggtgatgccgacattgggtttgcgccacaagactttggcacagacccacacctcggcgcatttgaaaaagtgtatggtgacaaccctgaaggaaccagcaagcgtactgaaggtgaatacagcttcggtgcgcaagagatagaagtacgcaaagacataatgcaagaaaatcaggatattgatgaacgcctcagccattcacgctggcgctgctttagccgtaaatggatcactgacatcaaaggtgactcgttggatatctcttggctaatagataaagatagcgtggatgccgccaatttgcccgagcctgacgtgcttgcgcgagaagcaaaagaagaactggaaaccgcgctgaatgagctggattggttgttggcggcgttggaaggggctaattaa

SEQ ID NO: 3465 - DNA, 234 bp, Klebsiella pneumoniae
gcgcccttgaagctgtgtcacgatatgatcggagaagaagcttggtttgaacatactctcgatgatgagacaacaaaagcacaggtggcaggatgcggccatctgttagctgcaatcagaaagcgggttttcatgatgcgcttacgcacgatgattaacgaactggatacgctggtagcaacaaggcactggttctgtgtgtggtgccagtcgcactatcgagagatactgtaa

SEQ ID NO: 3466 - DNA, 726 bp, Klebsiella pneumoniae
gtaaacatgaaatcaccctctggcgagatgccgcaatacctgatgattaaggcgcagctgcaggcgcgtattcaaaacggcgccctcaaaagcggcgacaagctgccttccgagcgcgagctgtgcgcgctgttcaacacgacccggattacggtgcgtgagagcctggcgcagctggaggccagcggcgtgatttaccgcgctgaccgtcgcggctggttcgtgacgccggagcgtctgtggctggatccgacgcaaaataccaacttccacaagctgtgtctcgaacaggggcgcgaaccgaaaacggtgctgcttgatggccgcctggctgccgtgccgctggacgtaatggcgccgctggcgctgcagcccttcgatcaggtctacctgctgacccggctgcgctatgccgacgggcggccggtatgctactgcgaaaaccactgtctgcccgcgcgggtgcctgagctgctgcgccacgatctcaacggcagtctgaccgagatttatcaaactcactacgacctgatctataccagtatgcatctgtcgttttatcccacctcaatgccgccgcaggccgccgaggcgctgggggtgatggaggggcgcccggcgctgctgttgcgcaggctgaattacgatcagcacgggcgtattctcgattacgatattgaatactggcggcatgatagcctgcggatcgaagtcgatacccattga

SEQ ID NO: 3467 - DNA, 1509 bp, Klebsiella pneumoniae
ctggcaatgaaggccgtcgtctcacgattgctgtcggtcatcggctgcgcctttatcttcgcggccgcctggttctgcctgtggagcatcagtctgcatttggtggaacgcgcggatttagcggtgctgctgtttccctttggcctgcggctggggttaatgctgcaatgcccccgcggctactggccagtgctgctgggaaccgagtggctgcttatcttctggctggcgcaggaggtggcgctggcgcacccgataattttgatgaccggaagcctgctgactctgctgccggtggcgttgatctcgcgctaccggcagcagcgcgactggctgacgctgctgcgtcagggcggggcgttaatggccgccgcgctgctgcaatcgctgccgtggctggcggagggggacgaggggcttaacgccctgctgttgacgctgaccggcggcctgacgctggcgccgacctgcctggttttctggcactatcttaccagcaccgtctggcggccgctggggccggcgctggtggcgcagccggttaactggcgcgggcggcatctgatctggtatctgctgttattcaccattagcctgtggctgcagcttggcctgcccgccgagctctcccgctttaccccgttttgtctggcgctgccgattatcgccctcgcctggcactacggctggcagggcgcgctgatcgccaccctgatgaacgctatcgccttgattgccagccagacctggcacgatcacccggtcgatttattgctttccctgctggcacagagcctcaccgggctgctgttgggggcggggatccagcggctacgcgagctgaaccagtcattacaaagcgagctggcgcgtaatcgtcggctggcggaacgcctgctggagaccgaagagagcgtgcggcgagacgtcgcccgcgagctccatgatgatatcggccagaccatcaccgcgatccgcacccaggccgggatcgcacagcggctggcgccggacaacgccagcgtgcgccagagcggtcagctgatagaacagctgtcgctgggagtttacgactcggtgcgtagactgctaggccgtctgcgtccgcgtcagctcgacgacctgccgctggagcaggcggtacgttcgttgatgcgcgagatggagctggaggaccgcggcattgtcagccatctcgactggcggattaacgaggcgggactgagcgagaaccagcgcgtgacgctgtttcgcgtttgccaggaggggctgaataatatcgtcaagcacgccagcgccagcgctgtcactctgcagggctggcagcaggatgagcgactaatgctggtgctggaagatgacggttgcggcctgccgccggggtcgaatctgcaggggttcggcctgaccggcatgcgcgagcgcgtgaccgccctgggcggcacactgacgatctcctgcacccacggtacccgggtgtgcgtcaatctaccgctgcgttacgcctga

SEQ ID NO: 3468 - DNA, 777 bp, Klebsiella pneumoniae
cagggaatgaaaatgagaagagtaagatactttttgctggcgctgctggtggcgatcctcgcggcgctggcgggcggctactactggctgcactctggcaacccggacgcattacgcaagattgtcctgcagcagtgcgtaccccatcagcaacagcagcaaaacccgtcgccgtgcgcggaaatgaacctcaagggcggctatgtgctgtttaaaaaccgtaacggcccgctgcaatatttgctgatgccgacctaccgcatcaacggcaccgaaagcccgctgctgctggatccgttgacgccgaactttttctggcaggcctggcaggggcgtgaaatcatgagccagcgccacggcgcgccggttcctgataacgcggtatcgctggcgatcaactcgcgcagtggacgtacgcaaaaccatttccatattcatatctcctgcctgcgccccgatgtgcgcgcgcagttagataaggatgccgcagcgatcagcagccgctggctgccgctaccgggcgggcttcagggccacgaatacctggcgcgccgggtgacggaggcggagctggcccagcgtagcccgttcctgatgctggcggaagaggtgccggaggcgcgccagcatatgggacgcttcgcgctggcaatggcgcaacagagcgacggctcgctggtgctgctggcgacggagcgtaacctgctgaccctgaaccgggcttcagcggaagaaattcaggatcatcgctgcgccatccttaacgcaaaccactag

SEQ ID NO: 3469 - DNA, 186 bp, Klebsiella pneumoniae
actctcccgaagtcaataaatcccgttgtaatcccttatatatcaggcattccttgtatcccgaggtcaatcgacttcaacctgcatcaagcggtttttgggggtgcattcgggggtactattccacctttaaaacaccagcacccccataatggtaaaaatgtgagttataacaaagggttttaa

SEQ ID NO: 3470 - DNA, 858 bp, Klebsiella pneumoniae
ttttgcacgaaaaaaacaatgacagtcaggacagacagggtgaagaggatgagattacgtttacgggccgccgccgcggtaatgctggcgggtctggcgctggtcggctgcgaccaaaagggtaatgaagcgaagcacattaaggtcggtgtgattaacggcgccgagcaggatgtagcggaagtggcgaagaaggtggccaaagagaagtacggtctggaggtcgagctggtgggattcagcggctcgctgctgcctaacgaatcgaccaacgccggggatctggacgccaacgtcttccagcatcggcctttccttgagcaggacaacaaagcgcataactatcatctggtggcggtcgggaataccttcgtcttcccgatggccggctattcgcgcaagatcaagtcagtcgccgaactgaaagacggcgcgacgatcgctatccccaacgatccgaccaacctcgggcgggcgctactgctgctgcaaaaagagaagctgattaccctcaaagccgggaccggcctgctgccgacggcggtggatatcaccgacaacccgcataacctgaagatcatggagctggaaggggcgcaactgccgcgcgtactcgacgatcccaaagtcgacgtggctatcatcagcaccacctacctgcagcaaaccgggctgtcgccggttcgtgacggcatctttatcgaagataaaaactcgccctacgtgaacatcatcgtgacccgagaagacaataaagacgcggaaaacgtgaaggagtttatgcagtcgtaccagtcgccggaggtggcgaaggcggcagagactatcttcaacggcggcgcggtgcctggctggtaa

SEQ ID NO: 3471 - DNA, 1686 bp, Klebsiella pneumoniae
cagtgccagaacttcgtcgacgctggtggttttcgccaggcgctcaatcacggtttcgtcatccagcgcgttagtcagactggtgataacctgaatgtgctcgttattacgagcggcgatgccgatgaccagacgcgcgacttcatcttcttcttcaccgaagcgcacgccttccgggtactggcagaagacgacgccggttttcagcacgcggtccttcgcttcgatggtgccgtgcggtaccgcaatggactcgccgagataggtcgaggtcagtttttctcggtccagcatcgcctgcacatattccggctcgacgtagccgcctttcaccagctgctcaccggcgaagcgaatggcttcttctttggtggcggctttgcgaccgaggaagatgttatccgcgcccagctggaacaggttgttgttagtatcgtcaaagctgtctttcaggctatcggtgactttgacttcgttgtcgatgtggcgctgggccgcgaccaggcgctcggtcaggctggtgtacagaccgctgtcgaggaagttagtcagcgaaatatgctgcgcctgcggcacctggcgcattgcccgctcggtcaggtcgcggtgggtgatgaccaggtcaacatccggcggcaggttattgattgcgctgttggtgaccgagatgttgctcagcccggcatcctgcactttcttgcgcagtaccccggcgcccatggcgctggaacccatcccggcgtcgcaggcgacgatgattttacgcacatggctcaggtcgttggtgacattaccggccgccagcgggctggcgcctttggattccgctttcatgtcatgcatacgacgcgttgcggcttcgatatcgtcttcttctttaactttgctggtcttgagcagaaccgcagagaccacgaaggagaccgccatcgctgcgataatcgcggcgatgttagcgaagtaggcgcctttcggcgtcatcgccagtaccgccaggatagagcctggggaagccggggaaaccagaccgccattgaggatagtcagggtgaagacaccggtcatcccgccgaggataacggccaggatcaggcgcgggttcatcagtacgtacgggaagtagatttcatggataccacccaggaagtggatgatagccgccccgcctgcagactgttttgcgctgccgcggccaaagaacatgtacgccagcagaacgcccatccctggacccgggttagcttcaatcaggaagaagatggatttacccagctcgtgggactgctgaatacccagcggcgagaagataccgtggttgatggcgttgttaaggaacaggatttttgccggttcgacgaagatagacgccagcggcagcatgtcgtgcgccaccataaagttaacgccagccgccagaattttcgacagaacttcgaccgccgggccgatgccgaggaaggccagaatggcgaggatcatcccgatgatgccggcggagaagttattcaccagcatttcaaaaccggatttgatcttaccgtctacccagttatcgaatttcttgatgcagtagccgcccagcgggccggcaatcatggagccgaggaacatcggcatatccgcgccgacgataacgcccatggtggtgatcgccccgaccacgccgccacgttcgccgccgactaa

SEQ ID NO: 3472 - DNA, 270 bp, Klebsiella pneumoniae
ggcctaaagaaaagccaaaaaatactcgactatatgggatcgactgagctcgcggccaacctgtttcgtgctacccaaacggaagaaaaactacgtcgggacgcggttgattcgaagcaactcgccaacaaaacgcattatgacgtagggcaaaaagtacgccagactattaaagacctgggtggcactatgcctgaagcacttccttccccggagaaaagtattcagcaactcactatcgcagcgaaaaataagaacgcgcctgagtag

SEQ ID NO: 3473 - DNA, 2523 bp, Klebsiella pneumoniae
cggcaaaagaaaagcccgatcgcgcgatgcgaccgggcttatacatcctgttgccccggtaaaactcgttaccgggaaacatgcggcttaaatatcgatattcgccgctttcagggcattctcttcgataaacgcgcgacgcggctcaacggcatcacccatcagggtggtgaacagctgatcggcagcgatggcatccttgacggtcacgcgcaacatgcgacggctgtccggatccatggtggtttcccacagctgatccgggttcatctcgcccagacctttatagcgctggatggagagaccgcgacgggactctttcaccagccagtccagggcctgctcgaagctggctaccggctgacgacgttcgccgcgctcgatgtaagcatcttcttccatcaggccgcgcagtttctcgcccagggcacaaatacgacgatattccggccccataatgaactcgttatccagcggatagtcggtatccacgccgtgggtacgtacgcgaataaccggctcaaaatgctgcagttctttgttctcgtggagatcgaatttccactggctgccgtgctgttctttctcgttcagctcggagaccagggtgttcacccagcgggtcaccttctgctcgtccgccaggtcggcctcggtcagggtcggctgatagataagctctttcagcagcgctttcgggaagcggcgctccatgcggccaatcattttctgggtggcattgaactcggcaaccagtttttccagcggttcgcccgccagcgccggcgcattggcgttggtgtgcagggtcgcaccgtcgagcgcgatggagatctgatactgatccatcgcttcgtcgtctttaatgtactgttcctgcttgcctttcttcactttgtacagcggcggctgggcaatgtagacgtggccgcgctcaacgatctccggcatctgacgatagaagaaggtcaacagcagggtacgaatgtgcgagccgtcgacgtccgcatcggtcatgatgatgatgctgtggtagcgcagtttatccgggttgtactcatcgcggccgatgccgcagcccagcgcggtgataagcgtggctacttcctgagaagagagcattttatcgaagcgggctttctcgacgttaaggattttacccttcagcggcaggatagcctggttcttacggttacggccctgtttcgcagagccgcccgcggagtccccttccaccaggtacagttcggacagcgccgggtcgcgctcctggcaatccgccagtttgcccggcaggcctgccagatccagcgcgcctttacgacgagtcatctcacgagcgcgacgtgcggcctcacgggcgcgcgcggcgtcaataattttgccgaccacgattttcgcatcggatgggttttccagcaggtattcgctcagcagttcgttcatctgctgctccaccgccgatttcacctcggaggagaccagcttgtctttggtctgcgaggagaatttcggatccggcaccttcacggataccacggcaatcaggccttcacgcgcatcgtcgccggtggcgctgactttcgcttttttgctgtagccctctttgtccatataggcgttaagagtacgggtcatcgccgcgcggaagccggcgaggtgagtaccgccgtcacgctgcggaatgttgttggtaaagcagtagatgttttcctggaagccgtcgttccactgcagggccacttcaacgccgataccgtctttttcggtggagaaatagaaaatattcgggtggatcggcgttttgttcttgttgagatactcaacgaacgccttgatgccgccttcgtagtggaaatggtcttctttgccgtcgcgcttatcgcgcaggcggatagagacgccggagttcaggaacgacagctcgcgcaggcgtttcgccaggatgtcatattcaaattcggtgacattggtgaaggtttccaggcttggccagaaacgcaccatggtgccggttttgtcggtttcgccagtcacggccagcggtgcctgcggcacaccgtgttcgtacatctgcttgtgaactttgttatcgcgctggataaccagctccagcttctgcgacagggcgttaaccaccgagacgcctacgccgtgcagaccgccggaaactttataggagttatcatcgaatttaccgccagcgtgcaggacggtcatgataacttccgctgcggagacgccctcttccgggtgaatgccggtcgggatgccgcggccgtcatcctggacggagacggagttatcgctgtggatggtgacaacgatatctttgcagtaacccgcgagcgcttcgtcgatagcgttatccacaacctcgaataccatgtggtgcagaccggtgccgtcatccgtgtcgccgatatgcatacccgggcgcttacgcaccgcatccagccctttcaggactttgatactggaggagtcataagaattcgacatcaacgtttctcgctcatttaa

SEQ ID NO: 3474 - DNA, 798 bp, Klebsiella pneumoniae
ccccagaggaacgccaacatgaacatcacccacatccgtaatgcgacccagattattcactacgccgggaaaagatttctcatcgatccgatgctggcggacaaaggcgcctggccgggttttccgggcaccgcgcgcagcgaactgcgcaatccgctggttgagctgccgttttcccgcgataaaattgtcgacgttgacgcggtgatcgtcacccacacccatgacgatcactgggacgcggcagcgatcgccgcgatcccgaaaaccctgccggtgttcgtccagcatgaggccgacgccgcgctgctgcgcagccagggatttcaggatctgcgcctgctgtcggcagacagcgaatttgccggcgtgcgtctgctgaaaaccacctccggccaacacggcagcgaccgcacctacgcggtgccggcgatggctgaacgcctgggcgaggcctgcggcgtggtgtttcgccatccgcaggagaagacgctgtggctggtgggggatactatctggcgcgatgacattgcagccgacctgctgaagctgcgcccggacgtggtggtcctcaacgccggctacgcccacgtcatcggctttggcccgattatcatgggcaaggaagatctcctgaacgtgcacttcaccctgccggaagcaaaaatcatggctatccacctcgaggcggtcaaccactgtctggtgagccgggaagagatgcgccagtatgcgctggataatcagattgccgatgtggtttctatcccgcaggatggagaaaccgtcgtttattaa

SEQ ID NO: 3475 - DNA, 291 bp, Klebsiella pneumoniae
ctccctgggaaatgcgagcttaaccacgcagggttagctttattacttggaaacggtcagacgagcgcggcctttagcacgacgacgtgccagaacctgacgaccatttttagtagccatacgagcacggaagccgtgagaacggttgcgcttcagtacagacggttgaaaagtgcgtttcatggcgatttctacctaaacttgaataaattcactgacttttgcgtagacccgaacgaacttcgaacgacttacgcctcagcgtgggtgattaaagaggccggattgtaa

SEQ ID NO: 3476 - DNA, 345 bp, Klebsiella pneumoniae
aatccagggaatgaaaaatgcccggtatcgtccgtccaaagatccctaattaaggtcaatttttttcacaccccgcgggattctaaaagccaccgctttaaaagcaaatttatatcagagggtctgttttttccccgggccaaaatcaacgggaccccccggttaataaaaaggcggcgggcccaaggggctgttggccggaatttaacgccgacccgtttttttgaggaaaaagaagggttgggccccgcgtcgcgaatcaggctttcctacggcgtgttgggagataacctttgcaccctgggtaccaaagaccggtccgggattgttacttcccggcgttaa

SEQ ID NO: 3477 - DNA, 1194 bp, Klebsiella pneumoniae
cttcagcaccttatcgacactgggcgtaaaacgaatttcgatgggcaattttatttatgctgcgacgcaggccagactgaaagacttattatgtcaggtgcaaacccaacactctttctcaggtgttttttgaccatgaaaattaccgacagcatgcagtgcgatatctggtatcaggcgctgcttgaacgcgcggtggaattcaccggcgtttttttcgtcggcgtgaaaaccaccggcgtattttgtatctcggtctgtcgggcgcgaaaaccccggcgggaaaacgtcgaattttataatgactttaaatccgcgctggatgccggcttccggccatgcaaagtctgtcgcccgacggagaatgcccggacggcccccgcctttgttgaacaagcgctccgcctgctgcgagaagctccaaaggtccgcctcagcgatagcgagctacgtcagcacgatattagcccggaacgcgttcgccgctggttcctgcaaaaccacgggatcacctttcaggcttttcaacggatgcagcgtttgaatatggcgcttcaggaattaaaagcaggccgctcaactaccgatgtcgctttcgatagcggttacgagtccttaagcggcttcggctatacctgcaaaaaattgaccggtttcgcacccagcgcgcaacgccaggttgttttaattcatcgttttaccaccccgttagggccaatgtttgtttgtgcaacgcaacggggaatttgtctgctggagtttgtcgacagacgagcgctggagtcagaattcagcgacctgcagcggcggttcaacgccagtatcatcgcaggtgaaaatgcccacaccaggcaggcgcaacaggaaataacggagtatttcgccggacagcgtcaatcgttcgaggtggcgcttgataccccaggcagcgagttccagcgagcggtctggcgccgtttacagcacgttagcttcggtgagacgacgcattatcaatcgattgcgatggagataggtaaaccaacggccacgcgcgcggtggctgctgcaaacggcgctaaccgcgtcgcgattatcatcccgtgccatcgaattatcggcaaagatggttcgatgaccggttacggcggcggcattgcacgaaaaatatggcttattaaccatgaggcaaccatcagggaaaaacgcggctga

SEQ ID NO: 3478 - DNA, 390 bp, Klebsiella pneumoniae
aatcccgctgaactcgccgcagtgggagaaaagtattccgcaggtcgtcgacgcttacggcgagcaggcgcttatcggcgcgggcacggtgctgcaaccggagcaggtcgacaggctggcggccatgggctgtcggctgattgtgacgccaaacattcaaccggaagtgatccggcgagcggtgggttacggtatgaccgtgtgtccaggctgcgccaccgccagcgaagccttcagcgccttggatgccggtgcgcaggcgctaaaaattttcccgtcatcggcttttggcccggattacatcaaagcgttgaaagccgtgctgccgcccgaggttccggtctttgccgttggcggcgtgacgccggaaaacctggcgcagtggattaa

SEQ ID NO: 3479 - DNA, 525 bp, Klebsiella pneumoniae
tatggccatgaatggcgttggatgccgggcaaccgcccgcattatgggcgttggcctcaacacgattttccgccatttaaaaaactcaggccgcagtcggtaacctcgcgcatacagccgggcagtgacgtcatcgtctgcgcggaaatggacgaacagtggggatacgtcggggctaaatcgcgccagcgctggctgttttacgcgtatgacaggctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcaccacctgaatctgagccagcacctggcacggctgggacggaagtcgctgtcgttctcaaaatcggtggagctgcatgacaaagtcatcgggcattatctgaacataaaacactatcaataa

SEQ ID NO: 3480 - DNA, 810 bp, Klebsiella pneumoniae
tctatttttttagaaaaaagagcacaaagcgacatccccttttcctgcacaagaggactactggtgatctacaaatccattgctgaccgcctgcggctgcggctgaattccgccgacttcgccatcggcagcccgctaccaggagagaaaaaactggccgaggagttcggggtggcgcgcatgactattcgcaaagccatcgatctgctggtggactggggattggttgtgcgtcgccacggctcgggaacttacgtggcgcgtaaagacgtccatcatgaaaccagcaatctgaccggcctggcggaagtgctgcgcaagcagggtaaagaggtggtgagtcaggtgctggccttcgaggtgatgcccgccccgccggccatcgccagtctgctgcggattaaaattgatgaacggatctacttctcacggcgggtgcgctacgtcgacggcaagccgctgatgctggaggatagctatatgccggtgaagctgttccgcaacctgtcgctgagtcatctggaagggtcgaaatttgattatattgagaaggagtgcgggatcatcatcagcgggaactatgaaacgctgacgccggtgctggcggacaagcagctggcgcgctcaatgaacgtcccggagcagacgccgctgctgcgtattacctccctttcctacagcgacagcggcgagtttcttaactattcggtcatgttccgcaacgccagcgagtatcaggtggactatcacctgcgccgcgtccaggcgcaaagcccgctagctcagtccccagaacagcacggcgagtag

SEQ ID NO: 3481 - DNA, 969 bp, Klebsiella pneumoniae
cctgccggtgaccattttcaaatttgccatgagtccgtttgcggagtggcagcaactggcatgggccggggtgttgattatcaccctgtgcgtcttgctgctgaacatcctggcgcgcgttatcttcgccaagaagaaacacggttaattttttgcggcgcagcaactgctgcgctgaatgaggaagagattgagatgagtatggtgaatacagctccgggtaagatttcagttcgtaacctgaacttctactacggcaaattccatgccctgaagaacatcaacctggatatcaccaaaaaccaggtgacggcgtttatcggtccgtcaggctgtggtaaatccaccctgctgcgcacgttcaacaagatgtttgaactgtatccggagcagcgcgcggaaggtgagatcctgctggatggcgacaacattctgactaacacccaggatatcgccctgctgcgcgctaaggttggcatggtgttccagaaaccaacgccgttcccgatgtccatatacgacaatatcgccttcggcgtgcgcctgtttgaaaagctgtcccgtgccgatatggacgagcgcgtgcagtgggcgctgaccaaagccgcattatggaacgaaaccaaagataaactgcaccagagcgggtattctctctccggtggtcagcagcagcgtctgtgcattgcccgcggtatcgcgatccgcccggaagtgctgctgcttgatgagccgtgctccgcgctggacccgatctccaccgggcgtatcgaagagctgatcaccgagctgaaacaggactacaccgtcgttatcgtgactcacaacatgcagcaggctgcgcgttgctccgaccatacggcatttatgtatcttggcgagctgattgagttcagcaacacggatgacctgttcactaagcccgcgaagaaacaaactgaagattatattactggccgctacggttga

SEQ ID NO: 3482 - DNA, 432 bp, Klebsiella pneumoniae
tcggagggtgatatggcaatgacttaccacctggacgtcgtcagcgcagagcaacaaatgttctctggtctggtcgaaaaaatccaggtaacgggtagcgaaggtgaactgggtatttacccgggccacgcgccgctgctcaccgccattaagcctggtatgattcgcatcgttaaacagcacggtcatgaagagtttatctatctgtccggcggcattcttgaagtgcagcctggcagcgtgaccgtcctggcggataccgcaattcgcggtcaggacctcgacgaagcgcgagcgctggaagcgaaacgcaaagcggaagagcacattaagagctctcacggcgatgtggattacgctcaggcgtctgcggaactggccaaagcgatcgctaaactgcgcgttatcgagttgaccaaaaaagcgatgtaa

SEQ ID NO: 3483 - DNA, 198 bp, Klebsiella pneumoniae
agccgaaccgatagagccactcagcgcgtcgagaaaggcgaggcgctatttacgattgacccggcgccctatcaggcgcgagtcgaccgcctgcaggccaacctggtaacgacgctgtactgtattaacgtccccaagccgcagctctctgaggccaggccaataccacccgcgtgtcgacggaacgcgatcgcttga

SEQ ID NO: 3484 - DNA, 1614 bp, Klebsiella pneumoniae
atacatcgcctttcccctcatggggaaggattattccacgatgaacagcggcttgccagtcatctcttgcgggatttccattcccatcagcgacagcatggtcggggcgatgtcggaaagtttgccgccgttgaccgctttgaccgctttattaccgacgtagatcagcggaaccggcagattggtatgggcggtgtgcgcctggccggtggccgggtcgcgcatctgctcggcgttgccgtggtcggcggtgatcagcagctggccgccaacggattccaccgcctgagccacctggtcgatgcagcgatccagcgcttcaaccgcttttacggctgcttccatcaccccggtatggccaaccatatcgccgttcgggtagttacagatgatggtatcgtattttccgcctttgatggcggcgaccagtttctcggtcagctcggcggagctcatttccggctgcagatcgtaggtcgccactttcggcgagttaatcaggatccgctcttcgcctttaaacggctcttctacgccgccgttgaagaagaaggtgacgtgagcgtatttttcagtttcggagatgcgcagctgggttttatcgtgcttcgccatccactcgccgaaggtattggccagcgaggcgggcggataggcgcaggcgactttgatgtcggcggcgtattcggtgagcatcacgaaatcgagattaaccactttcttacgcgcaaagccgtcgaagtcggcgttgacgaaggcgcgggtgatttcacgcgcgcggtcggcacggaagttcatgaagatcagcgcgtcgccgtcttccatcgcggcatcggcctggccggcggcgcggataacggtggctttcacgaattcgtcgttttcgtcacgggcgtaggcggcctgcagacccgcgacggcggtatcggcctggaattcgcctttggccagggtcagcagatcataagcttgttccacgcgatcccagcggttgtcgcggtccatggcgtaatagcggccgatgagcgacgcgatgcgacctttgcccagcgcggcaaatttggcttcgaatgtcgccagcgttttttccgcactgcgcggcggcgtatcacggccgtcgaggaaggcgtgcaggtagatcttctcagcgccgcgctctgccgccagctccaccatcgccatgatgtgatcttcgtggctgtggacgccgcctggcgacatcaggcccatgatatgtactgctttgccggcggcaaccgctttatcgaccgcggcggtcagtaccgggttggcgaagaaggtgcgttctttaatttccacatcgagacgggtcaggtcctgatagacgatacgaccggcgcccaggttgacgtggcctacttcggagttccccatctgacggtccggcaggccgacttcgaggccggatgcatcgatcagggtatgtggacgtttggcccacagcgcgtccattaccggcgttttagcgctataaatggcgttatcctgttggtcttcgcgatagccgtagccatccagaatcaccagtaccataggttttttagaaaccgacattgcgacaacctcatgctcaaagacagaaattttgcgtaa

SEQ ID NO: 3485 - DNA, 1197 bp, Klebsiella pneumoniae
aaaaatcgcctgggcgtcagcggcggcatcgcggcgtataaaaccccggaactggtgcgccggctgcgtgaacgcggcgcggaagtgcgtgtcgcgatgacggaggcggcaaaagcgttcatcaccccactcagcctgcaggcggtatccggctatccggtttccgacagcctgctcgatccggcggcggaagcggcaatgggccatattgagctcggtaaatgggccgacctggtgatcctcgccccagcgaccgccgatttaatcgctcgcgtggcggccggcatggccaacgatctggtgtcgacgatctgtcttgccaccccatccccggttgccgtggtgcccgccatgaaccagcagatgtatcgcgcgcaggccacccagcataatctgcagacgctcgctacccgcgggctgctgctatggggaccagacagcggtagccaggcctgcggcgacgtcggcccggggagaatgctcgatccgttaactatcgtagacatggccgcgcagcatttcgcctcccctgtcaaagatttgcaacatctcaacctcatgattaccgcgggcccgacccgtgagccattggatccggtgcgttatatcaccaaccacagctctggcaagatgggcttcgcgattgccgccgccgcagcgcagcggggcgcgaatgtgaccttgatcagcgggccggtatcgctaccgaccccgccgtttgtgcagcgcattgatgtcactaccgcgctggagatggaagcggccgtccaggctggcgcccagcagcagcacatttttattggctgcgccgcggtagcggattaccgcgccgccgtcatcgccgaagataaaataaaaaaacaaggtgatgaattaacaataaaaatggttaaaaacccggatatcgtggccggggtcgcggcgctaaaatcacatcgcccctacgtcgttgggtttgccgccgaaacgaataatgtggaagaatatgcgcggcaaaaacgtgcccgcaagaacctcgacctgatttgcgccaacgatgtttcccagcctaatcagggctttaacagcgacagcaacgcactacaccttttctggcaggatggggaaaagcgcttaccacttgagcgcaaggaactcctgggccaattattactcgacgagatcgtgacccgttatgatgaaaaaaatcgacgttaa

SEQ ID NO: 3486 - DNA, 480 bp, Klebsiella pneumoniae
tcaggctgcgattggatgagaggatgcatgatctggataggactggccaccctggtagtggtgtttgttgtgggatttcgggtgcttacctctgattcacgccgcgcgatccgccgcctgagcgaacgcctcggcatcacgcctgtcccgctggaatcgatgatcgatcagctgggaaaaaccgccggtaatgagtatttgcgttacctggagcggccgaatgaagcgcatctgcagaacgccgcccaggtgctgctgatctggcaggtcgcgattgtcgacgccagcgaaaaaaacctgcattactggtatcgcctgatgcaaaaagcacgtttagcggcgccgattaccgacgcgcagatccgcctggcgcaagggtttctgcgcgagctggacccggatgtgagcgatttacataacctacagcagcgctacaacgacctgtttctcccggaagacggcgtgcactggctgcactga

SEQ ID NO: 3487 - DNA, 633 bp, Klebsiella pneumoniae
tttgttggcgataaggagcaggctatgaaactgatcggcagctacaccagtccctttgtgcgcaaaatatcggtgatcctgctggaaaagcgcatcccatttgagtttgtcaacgaatccccctacagcgaaagcaacggtgtggcgcgctataacccgctgggcaaggtaccggcgctggtgacggacgacggtgagtgctggtttgactccccggtcatcgcccagtatctggagctgctgggcgtggcgccgccgatgatccccgccgaccccagagccgctctcaggatgcgccagctagaggcgctggcggatggcgtgatggaggccgcccaggcgctggtgcgtgaaaaggctcgcccgggcgcgcaacagtcagagcaagagctgctccgccagcgggagaaagtggctcgcggtctcgacaggctggaagcctgcgcggcagacggaacgctgcgcggcgacgaggttaatctggcgaccatttccacggcctgcgccattgcttatctgaactttcgccgggtcgcgcccggctggtgcgccacccggccgcagctggtgaagctggtggatgcgttgttccagcgcgccagctttgcgcgcactgaaccgccgcggacttga

SEQ ID NO: 3488 - DNA, 408 bp, Klebsiella pneumoniae
gtactgggcgacgtaaaagggccaaatggtttgtgtttctcgccggatgaaaagaccttatacgtggtggaaagccgggcgacaccgaaccgcttaattctggcgtgggatgtggaaggcaatacgctgaaaaataaacgggtatatctcgactgtgggaacggtaccgccgatgggatcgcctgcgacgcagacggcaatctgtggtgcggatggggaagcggaaacgaagaactcgacggcgtgcggatcttcaaccctcagggtaagcatatcggcaccattaaactgccagagcgctgcgcgaacttgtgctttggcggcgaacagcgcaatcgtctgtttatggcgtccagcacgtcaatctattcgctgtacgtcaatgcgcagggcgctaagctgatatag

SEQ ID NO: 3489 - DNA, 1125 bp, Klebsiella pneumoniae
cgagtaagcctgatgttgatgaaaaccaccgtcacttcttccccgtcgctggcggggacgtccgggatcaccctggactcgctgcgcgtttcataccacggcaacgtggtcttaaaaccgctgtcattgaccattgagcccggtgaggtgctggcgctgattggcccttccggttccgggaaaaccacggtgctgcgggcgattgccggttttgtgcaaccggctggcgggcggatcctgatcggcgatactgacgtcacccagttgccgccgtacaaacgcgggctggcgatggtggtgcagaactacgcgctgtttccgcatatgaaggtggaagataacgttgctttcggcctgcgggcgcaaaagcagcccagggggcttatcgccgagcgggtgactgaagccttaaaaatcgtcggcatggcggattacgccacccgctacccgcatcagctttccggcggccagcagcagcgcgtggcgatagcccgcgcgattgccgtgcgtcctcgggtgctattgcttgatgaaccgctgtcggcgctggatgcgcaaattcgtcataacatggtggaagagattgcccgtctgcatcgcgaactgccggaactgaccattctctacgtcacccacgatcagaccgaagcgctgaccctggcggacaaaatcggcattatgaaagacgggtcgctaatcgcccacggcgaaacgcacgagctctatcactatccgccgaaccgctttagcgccgaattcctcggccgcgccaatatcctgcaggcgacggcgctgaaagacagccccgagccggggctggttagcgtgagctgtggcggcggcctgattaacgccttcagccggggcggcctgcatggcaacaacaagctgttatgcattcgcccgcagcacatgagcctggcgccgcgatcggcaaccagtaatcgtctcaatgctaccctgacctcggtacattggcagggcgatctgacgcatctgctgtgcgatgttgccggcgaagcggtgcggattgtgatgacccacgtgaacccgctgccgcgcgcgggggacaagctggcgctctacttcgaacctggcgatgcggttctgatcgaggtgcaatga

SEQ ID NO: 3490 - DNA, 600 bp, Klebsiella pneumoniae
aacatggcagaaaagcaaactgcgaaacggaatcgtcgcgaagaaatacttcaatctctggcgctgatgctggaatccagcgatggtagtcagcgtattaccaccgcgaaactggcggcttccgtcggcgtctctgaagccgcgctgtatcgccattttcccagcaaaacccgcatgtttgacagcctgatcgagttcattgaagacagtctgattacgcgcatcaatttgattttgaaagatgaaaaggacaccaccgcgcgcctgcgcctgatcgttctgttgattcttggctttggcgagcgtaatcctgggctgacgcgtatcctcaccgggcacgcgctgatgttcgaacaggaccggcttcagggtcgcatcaaccagctttttgagcgcatcgaagcgcagctacgccaggtgatgcgcgagaaaaaaatgcgcgaaggcgaaggctacaccctcgacgaaaccctgctggccagccagctgctggctttctgcgagggcatgctgtcgcgctttgtgcgcagcgagttcaaatatcgtccgacggatgatttcgacgcccgctggccgctggtcgccgcacagctgcagtaa

SEQ ID NO: 3491 - DNA, 1323 bp, Klebsiella pneumoniae
aacgtaggcctgcagcgtggtgatcagccccaccatgcaggtgaagatcaggctatgtttgacggtaaagcggaacagatccgactctttgcccaccaggcctaccgcggcgcaggcgatggcgatcgactgcggggaaatcatcttgccggtaacgccgccggtggtattagccgcgaccagcagaatatcggagacgccaatctgctgcgccgccgttgcctgcagcgcggcgaacagggcgttagacgaggtgtccgaaccggtcaggaatacccccagccagccaaggaacggcgagaagaaggtaaacgcgtggccggtatgggccagcgccagggccagcgtcgacgacagcccggaatagttagagataaaggcgaacgccagcaccatgccgatagagtagatcggcagcgccagatccttcagcgtcccggcgaaggtggtcagcgcatctttcggcttcatgcgcagccagacgatggacagcagggcggcgaacagaatggcggtgccggttgccgacagccagtcgaatttatataccgcggcgtagggcgttgcggcgctaaccaccggcggcatacgggcaaccattttgtcgaggaatggtaccgaaatattgataacgaagtcatacatcgcgccgccaggagcgaacagcgctttgaatggcggcacgctccacagggtcacggtggcggtcaggaacaggaacggcgaccaggcgcggatcacttgtcccgccgtgtagcgtgtgcgggccagcgtcatatccacctgcgaggcgccgagatcgccgaagcggaagatgcgtaccggctgccagcgtttgaggaacagggtcagacagaccagggagaccagcgacgagatgatatccggcagctccgggccaaggaagttagagctgaggtactgggcaatagcgaacgaaccgcctgcgactatcaccgccggccaggtctctttaatgccgcgccagccgtccataatcgccatgatccagaacagcacgataatggtcaggaacggcagctggcggcccaccatctggccgatggcgaagctatcgataccggtcacctggccggcgaccagaatcgggatgcccatcgcgccgaaggccaccggcgcggtgttgacgatcaggcacaggccagccgcatacagcgggttaaacccgagaccaaccagcagcgcggcggtaatcgccaccggtgcgccgaaacccgccgccccttcgagaaaggcgccgaacgagaagccgacgatcagcatctgcaggcgctggtccggcgtaatcgacagaatcgatga

SEQ ID NO: 3492 - DNA, 258 bp, Klebsiella pneumoniae
aacaaactggagactgtcatggaaaacctgaatatggatctgctgtacatggctgccgctgtgatgatgggtctggcggcaatcggtgctgcgatcggtatcggcatcctcggaggtaaattcctggaaggcgcagcgcgtcagccggatctgatccctctgctgcgtactcagttctttatcgttatgggtctggtggatgctatcccgatgatcgctgtaggtctgggtctgtacgtgatgttcgccgtcgcgtag

SEQ ID NO: 3493 - DNA, 450 bp, Klebsiella pneumoniae
aaagtgatggaaaacaagcacgcgacgtattctcctgcgtttcatttgatctcctggattgccctgatcggcggcatcgtcacctatctggtggggctgtggaatgccgatatgcagttgaatgagaaaggctattattttgccgtcctggtactggggctgtttgccgcggcatcttatcaaaagacggtgcgcgataagtatgaagccattccgaccaccgcgctgtactacaccacctgtctggtggtcttcgttatcgctgtaggtctgctggttatcggactgtggaatgccactctgctgctcagcgagaaagggttctatgggctggcgtattttttgagcctgtttggcgctgttgcggtacagaaaaacgtgcgtgatgtctgggacccgacgcgcttacgggaacctctcagcgtgacggaagaggggcctgagacgtaa

SEQ ID NO: 3494 - DNA, 552 bp, Klebsiella pneumoniae
aacagttcggatgattcaggttcaagttgcaacttgaggggggcggtaaaccgcccccctgcaggcgcccgccgggcgtcccgggatgacttgatggaggaagctatgccacccctgttaattgccgccacgacgccggatgccccggggttcgcggcgctacgaattgaaagccttgaacagcatttcaatatgctgcgccgcctggcggaaaactggcagagcggcaaaaaccgctttaacgcgccgggcgaaacgctgctgggcgccttcgtcaaccaccagctggtaggggtatgcggcatcaatagcgatcccttcagtccgcagccgcgggccgggcgcattcgccacctctacatcagcgaacgctaccgccgccggggcatcggccagcagctgctggtctcggttatcacccactccagcgcctggttcgactttctcaacacccatgccccggcgcaggcctggcccttttatgaaaggcttggttttcgcccggtgtacgatgaaccgcgggtgacgcatcgcctgttttgttcgctttaa

SEQ ID NO: 3495 - DNA, 645 bp, Klebsiella pneumoniae
tgcccacgggagaagatgctgcagtacggcatcgaaacgctaacggatgttgagctgctggcgctttttctgcgcgtcggcacgcgtcgccaggatgtgctcagctatgcccaggcgttactgcagcgttttggctcactctacgctctgctttccgctgataaagcgcaactgattgctgtggacggactggggctggcgaaatatgcgcaactgaagggcattgccgagctggcgcgacgctattttagctcgcagctggtcgaggaggccgcgctggtcaccccctcgatgacgcgcgagtttttacaaagccagctgacggaagaggagcgcgagatctttatggtgatccttttagataatcagaaccgggtgttgaaacatagtcgtcttttttctggtactcttagccacgttgaggtgcatccgcgagaaattgtacgcgaagccatcaaagtgaacgccgccgccgtgatccttgcgcataatcatccctccggtagtccggagccaagtcaggccgacagactgattaccgaaagggtgataaaatgttgtagattcatggagatacgcgtgcttgatcatctggttatcggccgcggtgcgtatgtatcttttgccgaacgtggctggatttag

SEQ ID NO: 3496 - DNA, 942 bp, Klebsiella pneumoniae
ttccttatactgcgcgccactgagaataacgaggtttctatgagtatcgacctgagcaaactgctgaccgagcgacgtaacgccaacagcgccaacattgacaccctctccaccctcgagatgctgacggtgataaaccaggaagaccagcaggtagcccaggcgataacgccctatctgccgcagattgccgaggtggtggataaggtcgcggcggcgctgcaggccggtggccgcttgatttacattggcgcgggtacctcagggcgtctggggatcctcgatgccagtgaatgcccaccgaccttcggcacccgcccggagcaggtggtggggatcatcgccggcggacataaagcgattctcagcgccgtggaaaacgtggaagacaacaaagcgcagggggcgatggatctgcagaacctgaacttcagcaaccgcgatgtgctggtggggctggcggccagcggacgcacgccgtacgtcattggcgccatggaatacgcccatagtcagaatgcctttgtcgccatcgtcagctgtaacccgcatggcgaaatggcccagctggcggacgtggcgatcaccccggtagtcggcccggaagtggtcactggctctacccgcctgaaagccggcaccgcgcagaagctggtgctgaacatgatctccaccggggcgatgatccgcgtcggcaaggtgtacagcaacctgatggtcgacgttgaagcgaccaacgccaagctgattgagcgccaggtctctatcgtgatggaggccaccgactgcgatcgcgccaccgcccagaaggtgctggaggcctgcggccgccactgtaaaacggcgatcgtgatggtgctggcggacttaagcgccgcagaggcgcagtcgctgctggcgaaaaacaacggctatatccgcaaggcgctcagcaacacctga

SEQ ID NO: 3497 - DNA, 2142 bp, Klebsiella pneumoniae
gcggcgtcactcaccccttttcatcctcctggtaaaacgcgcgtcaggaggagttcacccgcgcggcgacaaggcacactagataaaaaccgctcacaggatctcgcaatgaaactcgctgcgcttgccacgttattcgtgcctgggatggcctttgccgcctggactaccaccgactttcctgcttttaccgaagaagggaccggccgattcatcagccagaaagtggttgagaagggtacacgtcccctgcagctaaattttgaccagcagtgctggcagccttccggcggcattaagctcaaccagatgctgtccatggagccctgtcgcggcacaccgccgcaatggcgcatcttccgccagggtctgtataccctggaggtggatacccgttccggcacgccaacgatgatgatttcgctggaggaaaaagagaccagcgccgcggcgccgcagatccgccagtgtccgaagtgggacggaaaacctctgaccatcgacgtcagcaaaaccttcgccgagggcagcaaggtccgcgatttctacagcggtaatgtcgcgaccgtcagcggcggcaaaatcaccctgcagcccgccttcggcagcaatggcctgctgctactcgagcgtgccgagacggccgccccggcgccgtttgactggcacaatgccaccgtctacttcgtcctgaccgatcgcttcgtaaacggtaacccggccaacgacaacagctatggtcgccataaagacggcatgcaggagatcggaaccttccacggcggcgacctgcagggattaaccagcaagctggattatctgcagcagatgggagttaacgccctgtggatcagctccccgctcgagcagatccacggctgggtcggcggcggcacgaagggcgatttccctcactacgcctaccacggctattacacccaggactggtcgaaactggacgccaacatggggaccgaagcggatctccgccgactggtggatgaagcgcataagcgcggaatacgtattctgttcgacgtggtgatgaaccatgccggctacgccaccctggccgacatgcaggagttccagttcggctccctgtatctgcaaggagatgagctgaaaaaaactctcggcgagcgctggacggactggaagccgggcgcgggacagacctggcacagctttaacgactatatcaacttcagcgacaaagccgggtgggagaaatggtggggtaagaagtggatccgcaccgatatcggcgattacgacaatccgggctatgacgatctcaccatgtcgctggccttcctgccggacctgaaaaccgaatcgaaggaggtctcaggcctgccgaacttctatagccataaaccagacaccgcagcgaaagcgatcccgggctatacgccgcgcgactatctgacacactggctgagccagtgggtacgtgactacggcatcgatggcttccgcgtcgataccgccaaacatgtggagatggacgcctggcagcagttaaaaacccaggccaccgccgcgctggcggagtggaagaaagccaatccggataaagcgctggatgcggcgccgttctggatgaccggcgaagcctggggacatggagtgatgcagagcgattattatcgccacggttttgatgcgatgatcaatttcgactaccaggaccaggcggcgaaagcggcgacctgtatggccaatattgacctcacctggcagcaaatggcggacaagctgcagagctttaacgtcctgagctacctctcctcgcacgatacgcggctgttccgcgaaggcggcaccaccgcggcggagctactgctgctggcccctggcgccgtgcagattttctatggcgacgaatcatcgcgcccgttcggccccaccggctcggacccgctgcagggtacccgctcggagatgaactggcaggatgtcaacggcaaggcggcccgcagcgttacccactggcagaagatcggccagttccgcgctcgccatccggcaatcggcatgggcaaacagacaacgctgtcgatgccacgtggttacgggttcgtgcgtgagagcggtgaagacaaagtgatggtcatctgggccgggcagcagcagtaa

SEQ ID NO: 3498 - DNA, 420 bp, Klebsiella pneumoniae
ttaatgacactaatcattacaaaaagcattaatcccgacgatcaacaagaattgtttgccggtctacggcagtataatcagcagtatctcgatgcggcgcagtttggcgatctggggatttactcgcgcgatgcgcaaggggtgatgcagggcgggctgattgccaaacgcaagggcaactggctgtgcattgagtatctgtgggttagcgaggcgacgcgcgggcgcgggctggggagcgagctgatgcaggaggcggaacagcaggcgcaggcgcaaggctgcagccatctgctggtggatacctttagcttccaggcgctgccgttttatcagaaattaggctatcagctgcagatgtcgctgcccgacttcccgcacgcaggcatgcagcgccactatttgtcgaaggcgctgtaa

SEQ ID NO: 3499 - DNA, 258 bp, Klebsiella pneumoniae
tttgatttttggagaatagacatgtcccgagtctgccaagttactggcaagcgtccggtgaccggtaacaaccgttcccacgcactgaacgcgactaaacgccgtttcctgccgaacctgcactctcaccgtttctgggttgagagcgagaagcgttttgtcaccctgcgcgtatctgctaaaggtatgcgtgtaatcgataagaaaggcatcgatacagttctggctgaactgcgtgcccgtggcgaaaagtactaa

SEQ ID NO: 3500 - DNA, 1008 bp, Klebsiella pneumoniae
gccttgttttgttactggtcgtcaccccgccgcgggttgcgcaatacgatgaagaagccgctgtcgagtcttgatcttaatttactcctctgcctgcagctcctgacccaggagctcagcgttacccgtacggcgaagcggatgaacgtttcgccgtcagcggtgagcaagtcgctggccaaactgcgcgcctggtttgacgacccgctgtttgtgaaaaccccgctgggcctggcgcccacgccgctggtcagcagcatggagcaggatctggcggactggatgcagatgggcaaccaaatcctcgataaaccgcaccataccatgcccagcggcctcaaattcgaactggcggcggaagcaccgctgctgatgatcctgtttaacaccctctctcagcgcatctatcagcgctatccgcaggcattgattcgtttgcgcaactgggactacgactccctggacgccatcatccgcggtgaggtggatatcggcttctgcggacgcgaaagccatccgcagtcgcgtgagctgctgagcctgctgccgtggtatatcgattttgatgtgctgttcaccgacctgccgcaggtctggctgcgcgccgatcatccggcgctcagggaagagtgggatctggcggcattcttacgctatccgcatatcactatctgctgggaacaacgcgatacctgggccctggacgacgtgctgcaggagctggggtataagcgtaacgtggcgctgaccgtgccggggtttgagcaatcactttttatggccgctcagccgcagcacaccatgctggccaccgcgccgcgctactgtcagcactataatcagcagcaccagctgccgctcgtctcccggccgctccccctggaggcgcagcatctggaaaagctgcgcgttcccttcaccctgctatggcataagcgcaacagctacaacccgaagcttgtctggcttagagatacgctgaaagcgctctattccggtacgctttaa

SEQ ID NO: 3501 - DNA, 1017 bp, Klebsiella pneumoniae
acgatgaaactctcccgacttgctctgctgtccctgttcgcgctgaccagctctccggtttgggcggacggcgtcgtcacggtttactccgccgacggcctgcatgacggcgataacagctggtatcagagccagttcgctgccttcaccaaagcgacgggcatcaaagtgcagtatgtggaaggcggctccggcgcgatcgtcgaacgtctggcgaaggagcgcaccaatccgcaggctgacgtgttggtcacggtgccgccgtttatccagcgcgccgcgaaagagcaattgctggcaacctttaccccgcaaggtagcgcgcagatccccggcgccaacgaccgctattcgccgctggtgaacaactatctgaccttcatctataacagccagttgctgaaaaccgcgccggccagctggcaggatctgctggatagccgctacaagaacaagttgcagtactccacgccgggtcaggcgggcgacggtaccgcggtgatgctgcaggcgttccacagcctcggcggcaaggatgccggcttcgagtatctgggcaagctgcaggccaataacgttggcccatcggcctcgaccggtaagctgacggcgctggtcaacaaaggcgagctgtacgtcgccaacggcgatctgcagatgaacctgtcgcagatggcgcgtaacccgaacgttaaaattttctggccggcggatgacaaaggcgagcgcagcgcgctggcgctgccctacaccatcgggctggtgcagaacggaccgaacagcgaaaacggcaaaaagctgatcaatttcctgctggataaaccggcgcaatccagcgtcagcgcgcgctcctggggcctgccggtacgcagcgatgtagcgccggatgatgctaactttaaggcggcgaaagcggcgctcgacggcgtgaagagctgggaacctaactgggacgatgtcgccgtatcgctgtcggctgacattgcccgctggcataaagtgaccgatagcgagtaa

SEQ ID NO: 3502 - DNA, 774 bp, Klebsiella pneumoniae
ggcatcgcttggcaacaggagaagacgatggcggactgggttagcggcaaagtgacaaaagtggagtactggacggacgccttgttcagtttatacgtgcgggcgcctgttcatccgtttaccgccgggcaatttaccaagctcgggctggaaatcgacggcgaacgcgtgcagcgcgcctactcctacgtcaacgcccccggcaatcccgacctcgagttctatttggtcaccgtcccggaaggcaagctgagcccgcgtctggcggcgctgaagccgggcgatgaagtcctggtggtgagtgaagcggcaggtttcttcgtcctcgaggaagtaccggattgcgataccctgtggatgctggcgaccggcactgcgctggggccgtacctgtcaattttgcaggaaggcaaggaccttgagcgctttaataacctggtgctggtccacgccgtccgctacgccgcggacctgagctatctgccgctaatgcgcgaactggagcagcgctacgccggtaaattacgcatccagacggtggtcagccgcgaaaccgtggaaggctcgctgaccggccgggtgccgtttctgattgaaaccggcgcgctggaagaggccgtcggcctgccgatgaccactgacaccagccatgtgatgctgtgcggcaacccgcaaatggtgcgcgatacccaacagctgttaaaagagacccggcagatgaccaaacatctgcgtcgccggccgggccatatgacggcggagcactactggtaa

SEQ ID NO: 3503 - DNA, 1062 bp, Klebsiella pneumoniae
aggagggattgccagatgttgatgcagcatatcggtgtcggctattttgggtattaccgagcaactgcttatgcgatgaaacactctcttatgcccgagattgcgaagttaagaatgaaggctctgaacttctgggataagcacgggatccgtgccgcagctgatgcttttgacgtatcaacgcgaacactctactggtggcgccggttactgcgcaccggtggtccagaagcactaattccaagaagcaaagcccctctggttcgccgttcaaggcactggcatcctgatgtactcaaggagatcaggcgtctgagaactgagttacccaatctcggcaaagagcagatttttgtcaggctgaaaccatggtgtgaagcgcggcattttacctgtcccagcacgtcaaccattggaagaatcattgctggtgctcacgataaaatgcggatgatccccgtacgcctcagcgccaggggcaaagcccggttgataaaaaaacgctcagtgaagcccagaagaccaaaacaataccgcccggtaaaaacaggcgaactcatagggatggacgcgattgaactcaggatgggggacctacgccgctatatcattaccatgatcgacgagcacagcgactatgcgctggccctggcggtcccttcactcaacagcgatattaccagccatttcttcagcaaggccacaaagctctttcctgtcgctatcagacaagttgtcactgacaacggtaaggagttcctcggtaactttgataaaacgctacaggaagcctcgattaaacacatctggacctatccgtacacaccgaaaatgaatgcgacctgtgagcgatttaaccggacacttagagaacaatttattgaattcaatgaattgttgctttttgaggacctgaatttgtttaatcaaagaatggctgaatatctggtgctgtataacagcaaaaggccacataaatcactcgaactgatgacgccagtggactatattttacgtgagagtaaaaattgcaatatgtggtggacccatacacagtgttga

SEQ ID NO: 3504 - DNA, 1197 bp, Klebsiella pneumoniae
attttttgttgcagcgccacatttcctttgaccctttcccggctttgtctccatgataactataaatctggtatagaccaaatggtgagacaaatgacttcacgaaattacctgctgctgacccccggcccgttaaccacctcccgtacggtgaaagaggcgatgttgttcgatagctgcacctgggatgatgattacaatctcggcgtggtacagaccattcgccagcagctggtgcagttggctaccccggccgacggttataccgcagtgctgctgcagggtagcggcagctacgcggtcgaagcggtgctcggcagcgtcatcggcgaacaaggcaaagtgctaatcgtcagcaatggcgcctatggcgcgcgtatgattgagatggcgcaactgatgggcatcgcctgccacccttacgactgtggcgaagtctcccgtccggacgcggccgcgatcgaacagatcctgcagaacgacccggcgatcacccatatcgcgatggtacacagcgaaaccaccaccggcatgctgaatccgatcgaagaggtggccgaactggcgaaacggtacgataaacgctatatcgtcgatgcgatgagcagcttcggcggcattccactggatatcgccgcgctgaatattgattacctgataagctccgccaataaatgcattcagggcgtgccgggctttgccttcgtgattgcccgtgaagcggagctggccgcctgcaaaggccgttcgcgctcgctgtcgctggatctgtacgcccagtggcgctgcatggaggacaaccacggcaagtggcgcttcacctcgccgacgcataccgtgctggccttcgcccaggcgctgaaagagctggcgcaggagggcggcgtcagcgctcgccatcagcgctaccgcaacaatcagcgccggctggtcgccgggatgcgcgcgctcggcttccggccgctgctcgacgatagcctgcactcgccgatcattaccgccttttattcaccggatgcgccgcagtaccgctttcacaccttttaccagaagctgaaagatcagggcttcgttatctatccgggcaaagtatcgcaaagcgattgcttccgcatcggcaacattggcgaagtctacgacgccgatatcaccgccctgctggcggctatcgacaacgccatgtactggaaacaataa

SEQ ID NO: 3505 - DNA, 1698 bp, Klebsiella pneumoniae
tgtattttctgcgggcggtggcgaaaaaaagccgctctcgctgacccggcgcggcccggccgctccctttctttgatctttcacggggatttaaacgattcagctgtagtaaaattacgcaaaatttctgtctttgagcatgaggttgtcgcaatgtcggtttctaaaaaacctatggtactggtgattctggatggctacggctatcgcgaagaccaacaggataacgccatttatagcgctaaaacgccggtaatggacgcgctgtgggccaaacgtccacataccctgatcgatgcatccggcctcgaagtcggcctgccggaccgtcagatggggaactccgaagtaggccacgtcaacctgggcgccggtcgtatcgtctatcaggacctgacccgtctcgatgtggaaattaaagaacgcaccttcttcgccaacccggtactgaccgccgcggtcgataaagcggttgccgccggcaaagcagtacatatcatgggcctgatgtcgccaggcggcgtccacagccacgaagatcacatcatggcgatggtggagctggcggcagagcgcggcgctgagaagatctacctgcacgccttcctcgacggccgtgatacgccgccgcgcagtgcggaaaaaacgctggcgacattcgaagccaaatttgccgcgctgggcaaaggtcgcatcgcgtcgctcatcggccgctattacgccatggaccgcgacaaccgctgggatcgcgtggaacaagcttatgatctgctgaccctggccaaaggcgaattccaggccgataccgccgtcgcgggtctgcaggccgcctacgcccgtgacgaaaacgacgaattcgtgaaagccaccgttatccgcgccgccggccaggccgatgccgcgatggaagacggcgacgcgctgatcttcatgaacttccgtgccgaccgcgcgcgtgaaatcacccgcgccttcgtcaacgccgacttcgacggctttgcgcgtaagaaagtggttaatctcgatttcgtgatgctcaccgaatacgccgccgacatcaaagtcgcctgcgcctatccgcccgcctcgctggccaataccttcggcgagtggatggcgaagcacgataaaacccagctgcgcatctccgaaactgaaaaatacgctcacgtcaccttcttcttcaacggcggcgtagaagagccgtttaaaggcgaagagcggatcctgattaactcgccgaaagtggcgacctacgatctgcagccggaaatgagctccgccgagctgaccgagaaactggtcgccgccatcaaaggcggaaaatacgataccatcatctgtaactacccgaacggcgatatggttggccataccggggtgatggaagcagccgtaaaagcggttgaagcgctggatcgctgcatcgaccaggtggctcaggcggtggaatccgttggcggccagctgctgatcaccgccgaccacggcaacgccgagcagatgcgcgacccggccaccggccaggcgcacaccgcccataccaatctgccggttccgctgatctacgtcggtaataaagcggtcaaagcggtcaacggcggcaaactttccgacatcgccccgaccatgctgtcgctgatgggaatggaaatcccgcaagagatgactggcaagccgctgttcatcgtggaataa

SEQ ID NO: 3506 - DNA, 201 bp, Klebsiella pneumoniae
tacgttatctggcaacactacagctgcccgaccaccagccctaagccccagataaatatgctgcaaaaaagcaagttgtttatttgtattaggaaatggaatatcgctgcgcaaaggacgctgtcccccggccttgttaccaaagggagggttggctacgattacgtcagctttatccaattccgctgcgtcatcagttag

SEQ ID NO: 3507 - DNA, 984 bp, Klebsiella pneumoniae
gagcattcatgtccggattgtctccgggctcccaacttcaaaggtacagttatgatcatcgttaccggcggcgcaggctttatcggcagcaacatcgttaaagcgctgaatgacaaaggcatcaccgacattctggttgtcgacaatctgaaagacggcaccaagtttgtaaacctggttgacctgaacatcgctgactacatggataaagaagactttctgatccagattatggcgggtgaagagttcggtgaaatcgaagcaatcttccacgaaggcgcgtgctcttccactaccgagtgggatggtaagtacatgatggacaacaactatcagtactccaaagagctgctgcactactgcctggagcgcgaaatcccgttcctgtacgcctcctccgcggccacctatggcggacgcaccagcgacttcatcgagtcccgcgagtacgaacagccgctgaacgtttacggctactccaaattcctgttcgacgaatacgtccgccagatcctgccggaagccaattcgcagatcgtcggcttccgctacttcaacgtctacgggccgcgcgaaggccacaaaggcagcatggcgagcgtcgctttccacctcaatacccagctgaataatggcgaaagcccgaaactgtttgaaggcagcgacggcttcaagcgcgacttcgtctacgtgggcgacgtggctgacgtcaacctgtggttctgggaaaacggcgtttccggcatcttcaacctcggcaccggccgtgcggaatccttccaggccgtcgccgatgcgaccctggcataccacaaaaaaggcagcatcgagtacatcccgttcccggacaaactgaaaggccgctaccaggcgttcactcaggcggatctgactaacctgcgcaaagcgggctatgacaaaccgttcaaaaccgttgccgaaggcgtaacggaatatatggcctggctaaaccgcgacgcgtaa

SEQ ID NO: 3508 - DNA, 1041 bp, Klebsiella pneumoniae
tcgtctcaatgctaccctgacctcggtacattggcagggcgatctgacgcatctgctgtgcgatgttgccggcgaagcggtgcggattgtgatgacccacgtgaacccgctgccgcgcgcgggggacaagctggcgctctacttcgaacctggcgatgcggttctgatcgaggtgcaatgatggcgcaaaccctcacgcttgcgcgtccggcgcgaaacttacggccttacctgtggctggcattgccgctgctggtgctggcgacgctgtttttctatccgctactgctgatcgccgaacaggcgctgcgcgacgccagcggcaacctgagcctcgagactttctggcaggtgattgactcaaaacgctttattggcgcgctgctcaataccttacagattgcagtgttcgccacccttggctgcctggtgctcggcagcgtgctggcgctgattctggtatttattccgttccccggcagccaactggtgagccgggtcattgatacttttattgcgctgccgacctttcttatcactcttgcgttcacctttatttacggctcggcggggctgctcaacggcaccctgatggcattgtttgcttttgaactgccgccggtagactttctctattcgatcaacggcgtgattctggcggagattaccgtctttacgccgctggtgatgcgcccgctgatggcgggactgcggcagatagataagagccaactggaagcggcgagtattctcggcgcccatccgctacgggtgattacccaggttatcttcccggcggcgctcccggcgctgatggcgggcggcagcctgtgcctgctgttgaccactaacgagttcggtatcgtgctgtttattggcgccaaaggggttaataccctgccgatgatggtctacagcaaggcgattctggagtcggattacagcgtggcctgcatgattgcgctgattaatattctgctgtcgctggggctgtttatgctctatcggctggcggcggcgcgcactggcgtaaggagttaa

SEQ ID NO: 3509 - DNA, 753 bp, Klebsiella pneumoniae
attgcccaatgcgcgtttccgctttcctttcctactatccagcttgctgaacatttcaccctcccccaacaccacccgacaaggagagatttgatggcgacgtcacggcgggatttactgaagataggcgggttggcaaccgcatcgctactggtcagtcaaaaaagcttcgcagcatgggccccctctgaacgctatccggacccacgcatcgtggccgtcgatgatagctttcgtcgctatatgcttgccagcgcaaaggtcgaacgcatcgccagcggcttccgctgggcggaaggcccggtctggttcggcgacatgcgaatgctgctgtggagcgacattccgaataacgccatcatgcgctgggatgaagtcagcggagaaaccagcgtctttcgctacccggccaattatagcaatggtcacgcccgcgacagacaggggcgcttaatcagttgcgagcacgacacccgccgcattacgcgtaccgaatacgatgggtctgttaccgtactggccgatagctaccagggtcatcgcctcaattctccaaacgatatcgttgtgaagtcagacggcaccatctggtttaccgatccgccatttggcatcagtggtttttacgaaggccacaaagcaacatcagaattgccgcaaaacgtctattgtctggagccggaaagccgcaaactgagcgtgagtactgggcgacgtaaaagggccaaatggtttgtgtttctcgccggatga

SEQ ID NO: 3510 - DNA, 378 bp, Klebsiella pneumoniae
tgctgctggtggtgtatggcggataaacgccgggcgcggcgggaaagcgatcccggtcttcagccagagcgcacctcgctggcctggtttcgcaccctgttgggctacggcgcgctgatggcgctggcgattaagcacagctggcaccgcgccggcctgccgttctggctgtcgatcggcgtgctggcgattgtggcggtgatcctctggggctatacccgccgtcgtcatctgatggatgtcgacgatagcgattttttacagccgcgggcggttcgtgacaaatttttgatcgcactcgcagtactttctctggcattcctgtttgctgttactcaccttcaaccgatcgttttattcattagggatatgtcatga

SEQ ID NO: 3511 - DNA, 861 bp, Klebsiella pneumoniae
aaaacaaggtgttggaatgcatatatccgaccaggagacctgatgatatcgaatcccatacgacgatatggggccgccatacttatgttactaacctgcatcttttcaggtagtgtgttggcgacaacgcacacagcgacaaagagtcataaagccccaacggtaaagaagataagtagtactaaggtaagcagtaaacaagagtattctcgcaatagtgtaaagagcagttcacttcctgacttgcgaaaatacccttccggaacaccaaggaaaaaagcgtttctccggacggtcatgccttatattaccaagcagaatcaggcgattactgcggatcgtaactggcttatttccaagcagtacgatgctcgctggtcaccgactgagaaggcgcgcctgaaggatatcgcttcccgttataaggtgaagtggtcaggtaatacgcgtcatgtgccctggaacgcgctgcttgagcgtgtcgacattattccgaacagcatggtggcgaccatggcggcggcggaaagtggctggggtacctccaggctggcgcgcgagaataacaacctgttcggcatgaagtgcggcgccggtcgctgccgcggcgcgatgaaaggttactcgcagtttgagtcggtagagcagtcggtgcaggcttacgtaacaaacctgaacacccacccggcctattcttctttccgcaagtcgcgcctgcagctgcgcaaggcggatcaggaagtaactgccagcaccatgatccataagctgaaggggtattcgaccaaagggtcgagctacaacaactatctcttcgcgatgtatcaggacaatcagcggctcatcgccgcccatctgtaa

SEQ ID NO: 3512 - DNA, 1368 bp, Klebsiella pneumoniae
ggtatgtttcgtttaagttttatgtttatcgcgctcctgaccgcgggctgcgtctcgcttgacccgcattatgatcgcccggccgcgccggtgccggccaccctgcccggggcgcacggcgaatcgacggcggtggtcggcgactggcagaaagtggtcaatgacgcgcggctgaaaaaagtggtcagcatcgcgctgaacagcaaccgcgatgtgcaaaaggcgctggccgatatcgaggccgcgcgcgcccagtatggcgaaacgcgggcatcgctgtttcccaccgttgatgccgaactgagccacacccgcagcaaaacggtggccagcggcctgagctccgcttcgcaggccgacggcgcggtctccagcttcgaactggacttgttcggcaagaaccagagcctgtcgcgcgcggcgcgcgaaacctggcttgccagcgaattcaccgcgcagaatacccggctgacgatgattgccgatttgaccaccgcctgggtgacgctggcgacggataacagcaatctggcgctggcgcagcagaccatggacagcgcggcaaactcgcgcaacatcgtcgcccgccagatggcggttggcaccgcctcagccggcgatgtaagctcggcggaaagcgtctatcagcaggcgcgcgccagcgtcgccagctatcgcacgctggtggcgcaggataaaaacgccattaacctgctggcgggggaaaccgtgccggagagcctgctgcccggcactctcgagagtctcggggataacagcatcgcgctggtgccggcgggcgtgtcgtcgtcggtgctgctgcgtcggccggacattcaggaagcggagcacaatctgaagagcgccaatgccgatatcggcgcggcgcgggcgaacttcttcccgtcgatttccctgaccgccagcgccggggtcggcagcgactcgctgtcgtcgctgttcagccacgggatgcaggtgtggtcgttcgccccctccatcagcctgccgctgttcaccggcggcagcaacctggcgcagctgcgctatgcggaagcggagaaaaaggggctgatcgccacctacgagaaatcgattcagagcgcgtttaaggacgttgccgatgcgctggcgcgccgggaaacgctgagcgaagagcttgatgctcagcggcagtatgtcgccgccgagcagacatcgctggatatcgccatgaagagctatcaggccggggtcggcgattatctgtcggtgctcaccgctcagcgcacgctgtggtcggcgaaaacgacgctgctgtccctgcagcagaccgacctcaataaccggatcaccctctggcagtcgctgggcggcggcgccagttaa

SEQ ID NO: 3513 - DNA, 1440 bp, Klebsiella pneumoniae
cattcgttgctccgcccctggttaccggggacttgcgctcctgccgccttcctgcaactcgaattatttagggtatctgattggttattcgccgcatctctgaatatggagttctctatgcagacctatttcgatcaactcgatcgcgttcgttacgaaggcccgaaatccactaacccgctggctttccgtcattacaacccggatgaactggtgctgggcaaacggatggaagatcatctgcgttttgcggcctgttactggcacaccttctgctggaatggcgccgatatgtttggcgtgggctcctttgatcgtccctggcagcagcctggcgacgccctggagatggccaaacgcaaagccgatgtggcgttcgaattcttccataaactcaacgtgccttactactgcttccacgacgttgacgtctcgccggaaggcgcttcgctcaaggagtacagcaataacttcgcccggatggtcgaggtgctggctgagaaacagcagcagagcggcgtgaagcttctgtgggggaccgcaaactgctttaccaacccgcgctacggcgccggcgcggccaccaacccggatccggaagtatttagctgggcggccacccaggtggtcaccgccatgaatgccacccatcaactgggcggtgaaaactatgtgctgtggggcggtcgcgagggctatgaaaccctgctgaataccgacctgcgccaggagcgtgagcagattggccgctttatgcagctggtggtggagcataagcataaaatcggctttaaaggcacgctgctgattgagcccaaaccgcaggagccgaccaagcatcagtatgactatgatgcctctaccgtttacggcttcctcaaacagtttggtctggaaaaagagattaaactgaatattgaagctaaccatgccacgctcgccggccattcgttccatcatgaaattgcgacggccatcgcgctggggctgttcggctccgtcgacgccaaccgcggcgatccgcagctgggctgggataccgaccagttcccgaacagcgtcgaagagaatgcgctggtgatgtatgaaattcttaaagcgggcggcttcactaccggcggcctcaactttgatgcgaaagtgcgccggcagagcaccgacaaatacgatctgttctatggtcatattggcgcgatggataccatggcgctatcgctgaaggtcgcggcgcggatgatcgaggacggcgaactggataagcgcgtggccagacgctacgccggctggaacggtgagctggggcagcagatccttaacgggcagatgaccctgagcgatattgcccagtatgccgctcagcatcagctggcgccgcagcatcgcagcggccagcaggaacaactggaaaacctggtcaaccattatctgtttgacaagtaa

SEQ ID NO: 3514 - DNA, 510 bp, Klebsiella pneumoniae
caacctgctcgccgtcagggagcagatgcgaatttacagaattcgcaggtattcactcgcttcttagaaggagaaaacagtatgcgtaactacgatttatcccccctgctgcgtcaatggatcggttttgacaaactggccagcgccctgcaaaccgccggtgaaagccaaagcttcccgccctataacatcgaaaaaagcgacgataaccactaccgcattacccttgcgctggccggtttccgtcaggaagatctggatattcaactggaaggcacccgtctggtggtgaaaggcacgccgcagcagccggaaaaagagaccacatggctgcaccaggggttggtgagccaggccttcagcctgagcttcaccctcgccgacaacatggaggtctctggcgcgaccttcaccaatggcctgctgcatatcgatctgacccgcaatgagcctgagcagatcgccccgcagcgtatcgccatcagcgaacgaccggcattaaatagttaa

SEQ ID NO: 3515 - DNA, 1050 bp, Klebsiella pneumoniae
tcattcaatcgctttctggcacgcttaacccatcacaacacacataaagagagcggtgcgatgaataagtggggcgtagggttaactctgttgctggcatccgccagcgttctggcaaaagacattcagctattaaacgtatcttatgatccaacgcgcgagctgtacgaacagtacaacaaagcgtttagcgcacactggaagcaggagaccggcgacaacgtggtgatccgccagtcgcatggtggctctggcaaacaggcgacctcggtgattaacggtattgaagcggatgtggtcacgctggcgctggcctacgatgtcgacgctattgccgaacgcggccgcatcgataaaaactggctgaaacgcctgccggataactctgcgccgtatacctccaccatcgtgttcctcgtccgcaagggcaatccgaaacagatccatgactggaacgatctgatcaaaccgggcgtgtcggtcattaccccgaacccgaaaagctccggcggcgcccgctggaactacctggcggcctggggctatgccctgcatcagaatcacggcgaccaggcgaaagcccaggaattcgtcaaggcgctgtataaaaacgtggaagtgctggactccggcgcgcgcggttcgaccaataccttcgtagaacgcggcatcggcgacgtactgatcgcctgggaaaacgaagcgctgctggcgaccaacgaactgggcaaagacaagtttgaaatcgtgaccccaagtgagtcgattctggctgagccgaccgtctcggtggtcgacaaagtggtggataagaaaggcacgcgtcaggtggcggaagcgtacctgaagtatctctactcgccggaaggccaggagattgcggcgaagaacttctaccgcccgcgcgatccgaatgtggcgaagaaatatgctaacgaattcccgaaactgaagctgtttaccatcgatcaggagttcggcggctggacgaaagcgcagaaagagcacttctccaacggcggcaccttcgaccagattagccagcgttaa

SEQ ID NO: 3516 - DNA, 513 bp, Klebsiella pneumoniae
cgattaaatcgggaagcgcggcgcttgtcaaaaagtcacgacgccagggtaaactacgcagacgatgatgataaggaaaaacgcatgaccctacagcagtggttattctcaattaaagggcgcattggccgccgcgatttctggatctggattgccatctggctggtgaccatgagcgccctgtttaccctggcaggcagcaatctgctcaacctgcagacggcggcgtttattatcgtctgcctgctgtggccgacggcggcggtggtggtcaagcggctgcacgatcgcggcaaatccgggctgtgggcgctgctgatggttctggcgtggatgctgctggcggggaactgggcgatgttgccgcaggtctggcagtggggcgtcgggcgctttgtgccgacgctgattatcgtcatgatgctgatcgacctgggggcgtttgtcggcacccagggcgagaataagttcggcaaggagacccaggacgtgcgctggaaagcggacgcctga

SEQ ID NO: 3517 - DNA, 231 bp, Klebsiella pneumoniae
cctgcgggtcgtgcatatcggcggcggtcagtttctttttcatcctgccactcctgtcaaaaattgagccttaagaacaacatagccggaggcggatggcaaccgccgcaggttggcccgatttcatcgatcattgcccaaacgcccctgttgagccaggcggggactcagtacgatgttcgtcagatgaccccagaggaacgccaacatgaacatcacccacatccgtaa

SEQ ID NO: 3518 - DNA, 1233 bp, Klebsiella pneumoniae
cgaacaatgctaaagagaaagcacgataaaattataaatatcatgcagctgcgctttttctgtcaggtcgcgctgcgcggtagcgtctcacgcgcggccgatgacttattccgcacgcagtcagcgataacccgggctattcgcgatcttgaagccgcgttgaacgtcacgctgttcgaacgccattacagcggcatggtgcccaccgagtatggcaagtgcatcctgccgcgcgccaggcgggcgattgacgacctgcaggccatcccggcgctgctgcagaagcaccatacccgcagcagcggcccgctggcggacgccggctggctgttcaatacccgccgcttagccatttttattcagctctatcacgtcaaccatacccaaaccgtcgcgcaacagttggggatcactcagccggcggtcagtgccgcgctgaaggtcctggaaaaaggagcggattcggcgctatttcgccggacgccagagggggtgcgtcccacgcctgccgcggagctactctatcccccggtgagcagagcgctcaacgagctggaaaacatctggagcgatctcgctgcccgtcgcggggtgctggagggcaccgtgcgcattggcgccctgccgctgagccggacccggctactgccctccgccatcgccgcctttctggcccagcacccgggcatcaccctcatgaccaatgaaagcccgtatgagtcgctggtcgccgatatgcgggcaggtaatatcgattttattatcggcgccctgcgccaggatgaagatctcccggacctctgtagcgaagcgttattcgaagaggatatgttgattttactgcgtaataaccacccgctgctgcgccatccggacccgcgcagccagctggcgacagcgcaatgggtgctgccgcgcgccaacgcgccggcgcgcaatttgctggataaggcgtttgtcaccctggggctgccgctgccccagccgacggtggagaccggggatgcggcgatggtgcgaggattgctgcagggctccgacatgctggcggcggtctccgccagccagatgcgttttgaaactgacaatgggctgctcagcgtgttgccggttcccctgcccgataccacccggcgtatcgggctgacgtttcgcgccggcagcctgccctccccggcgacgcaggcgctgttgcgttttatttatcagcaggttcaggacggggccgtttaa

SEQ ID NO: 3519 - DNA, 984 bp, Klebsiella pneumoniae
cggaagttccggcgttatttttttatcatccagactcccttttatcgccaggagcgcagaatggatgtgctaaaaaccttaggtacccggttgctgaacggctggcagctctccaggctgtcgacgtttgaggtggcggcgcggcacgagtcgttcgcccttgccgccgacgagctggcgctcaccccaagcgccgtcagtcaccggattaatcagctggaagaggagctggggatccagctctttgtccgctcgcaccgcaaagtggagctgacgcgtgaagggaagcgcgtttactgggcgctgaaggcgtcgctggatggtctcaatcaggagattctggacatcaaaaaccaggagctctccggcagtctgacggtctactcgcggccctctatcgcccagtgctggctggtgccggcgctgggggatttcagtcgccgctacccggccatctcgctgaccgtgctgaccggcaatgataacgtcaacctgcagcgggcgggtatcgatctggcaatctattttgatgacgcgccgtcgtcgcagctaagccaccattttctgatggatgaggcgatcgtgccggtatgtacgccgtattacgcccgccagctgcagttaacgtcaaatcctgccagtctgcgccactgtacgctgcttcacgatcgccaggcatggagcaatgattccggcaccgatgaatggttcagttgggcacagcaatttgggattgaattgccgcaatcgtcgggcattggcttcgatcgttctgatttagcggtgattgcggcgatgaatcatgtcggggtagcgatggggcgtaaacggctggtgcagaagcggctggacagtggggagttgatcgccccgttcggcgatatgacgctgaaatgccatcagcattattacgtgaccaccctgccgggccgtcagtggccgaaaatcgacgcctttatcgagtggctgcatagcctgacctga

SEQ ID NO: 3520 - DNA, 1956 bp, Klebsiella pneumoniae
atccccgtccgcaggcagtaccataacaataaccccactctctacaaggctcggggcgcccggaaaacgggcaaatacaggtcagcgacaacgcatggcatatcgccattatcaggaaatttaactatgtgtggaattgttggcgcagtcgcgcagcgtgatattgctgaaatccttctcgaaggtttacgtcgtctggaataccgtggctatgactctgccggtctggcagtggtcgacagcgaaggtcatatgacccgcgtgcgtcgcctgggtaaagttcagatgctggctcaggcggtagaagagcaaccgttacacggtggtaccgggatcgcccatactcgttgggcgacgcacggcgaaccgtctgagagcaatgcgcatccgcatgtttctgaacacattgtggtggtccataacgggatcatcgaaaaccatgagccgctgcgcgccctgctgcaatctcgcggctatgtcttcgtcaccgagaccgataccgaagttattgcccatctggtgcactgggagctggaacaaggcggtaccttgcgtgaagccgtcctgcgcgctatcccgcagctgcgcggcgcttacggtacggtgatcatggatacccgtgacccgggaactctgctggcggcccgctccggtagcccgctggtaattggcctggggatgggtgaaaactttatcgcctccgaccagctggcattgctgccggttacccgccgctttatcttcctcgaagagggcgatattgccgaagtcactcgccgctcggtggtgatttttgataagtccgctgcgcaagtgaagcgccaggagatcgaatccaatctgcagtatgacgctggcgataaaggtatctaccgccactatatgcagaaagagattttcgagcagccgaacgcgattaagaacaccctgaccgggcgcatcagccatggcgaagtggatctcagcgaactggggccgaacgccaatgaaatgctggctcaggttgaacatattcagatagttgcctgcgggacttcctataactccgggatggtttcccgctactggttcgaagcgttagccggcgtcccgtgcgatgtggaaatcgcctccgaattccgctatcgcaagtccgcggtgcgtcgcaatagcctgatgatcaccctctcccagtccggtgaaaccgccgataccctggcggcgctgcgtctgtcgaaagagctgggctatctcggctcgctggccatctgcaacgtgccgggctcgtcgctggtgcgcgagtccgatctggcgctgatgaccaaagccggaacggaaatcggcgtggcctcgaccaaagcctttaccactcagctaaccgtgctgttgatgctggtggcgaaactggcgcgactgaaagggcaggatgcgtctatcgagcatgatatcgtgcacggccttcaggctctgccgaaccgtatcgagcagatgctctcccaggacaagcgtattgagcagctggcagagcgcttctctgataagcaccatgcgctgttccttggccgtggcgatcagtatccgatcgctatggaaggggcgctgaagctgaaagagatctcctacattcacgcggaagcctatgcggcgggcgagcttaagcacggcccactggcgctgattgatgcggaaatgccggtgatcgtggtggcgccgaacaacgaactgctggaaaaactgaaatccaacatcgaagaggttcgtgcccgcggcggtgaactatacgtcttcgccgacggtgaagccggcttcaacggtagcgataacatgcacatcattgagatgccgcatgtggaagagaccatcgcccctatcttctatacggttccgctgcagctgttggcttatcacgtcgcgctgatcaaaggcactgacgttgaccagccgcgtaacctggcgaaatcggtaacggttgagtaa

SEQ ID NO: 3521 - DNA, 921 bp, Klebsiella pneumoniae
gtcaccgcccgcacggctataatccttgcattcattattacgaaaacaggaacgcctatgatccgcagtatgaccgcctatgcccgccgtgaaatcaagggtgactggggtagcgccgcatgggagctgcgctcggtaaaccagcgctatctggaaacgtacttccgcctgccggagcagttccgtagtctggagcccgtggtacgcgagcgcattcgcgcccgcttgactcgcggtaaagtcgaatgcaccttgcgttttgaacaagatcccagcgctcagggtgaactcatcctcaacgaaaagctggctaaacagctggtaaacgctgccaactgggtgaaaatgcagagcgatgaaggggaaatcaacccggttgatatcctgcgctggccgggtgtgatggccgccaaagagcaggatctcgacgccatcgccgccgacattctggccgctcttgacggcgcgctggacgacttcatcgtcgcccgcgaaacggaaggccaggccctgaaagcgcttatcgagcagcggcttgaaggcgtgagcggcgaagtggcgaaagttcgcgctcatatgccggaaattctccagtggcagcgcgagcgtctggtcgccaagctggaagatgcggaagtgcagctggaaaataaccgccttgagcaagagctggtgctgatggcgcagcgtatcgacgttgccgaagaactggaccgtctcgaagcgcacgttaaagagacctataacattctgaagaagaaagaagctgtgggtcgccgtctcgactttatgatgcaggagttcaaccgtgaatcgaacaccctggcgtcaaaatcgattaacgccgaggcgaccaactccgcgattgagctgaaggtactcatcgagcaaatgcgcgagcaaatccagaatatcgagtaa

SEQ ID NO: 3522 - DNA, 1302 bp, Klebsiella pneumoniae
ccaggcgcccgtcgcgcaaaagcgaacggacccctgagtggtctagttgccggggttgtcccagccctgccatttgaggcgatagtactggatcagcgcgctctggctgatgctatcgctgaggatagtgaagaagcggctggcgttcacaggctccagcgggcgcttcggtttgcaagacttcacgccatggaacggattacgcggcttctgctgcgtttgttgcgcaggcggctgggcgtagtttggcgtcgagttgtcgacctgcggctcgttcagcaggctgctcgggcgcaccagcgtgatatccggcggcaggttatagaccatctgctgcagcacccgcaccgtcgtcggatgcggatggccaatggctatcgccgaaccgttgcgccgcgccagggcgatggcgcgattgaactggttgcggatatcggcttcattctgcgtatcgtcgagaaacaccttgcgcttaatcaccttcacgccggtaccctgcgcggcgcgcatggcctgggtgttgccgatggtgacgctgtcgagaaaatagagattgtagcgctccagggcctgcatcaccttctgcatgccaaacaggttggaggtcatcgcgctgcccatatggttattcagcccgacggcgtaagggactttgccgtaagcctcgcgaataatgcgctcgatctcctcgctgctcatttcgggacgcagggtgtctttttccagcggctgtttgctgagcggcgccattggcagatggatgagcacttcatggccctgattatgcgctttagtggccatttcccgggcgtgcggcgcgttcggcagcacggcgacggagatagttgccggcagcgccagcacctgattctcggtctgcgggcggtagccaaaatcgtcaataacgatggagagtttgccagcgaacgctggcgccgccagagccagcgaaccggctacggcaagagcaattgcgcgaaattgaagcaaaacttatcttcccaaccacggctgtggattgaccgcctgaccctggcggcgaatttcgaaatagagcgacggacggccctgaccgccgctgctgcctacgagcgcgataggctggccggcacgcacctgggtaccaacgctgaccagcgcgctttggttatagccatacaggctcatgtcgcctttgccatgttcgaccaccaccaccagaccatagccctgcagccagtcggccagaatgacccgaccatcggcaatggctctgacttcggtgccttcagacgcggcgataaccatccctttccaacgtag

SEQ ID NO: 3523 - DNA, 366 bp, Klebsiella pneumoniae
cttctacaccgccaacctcggcaacggcgttgtcgctattggctacaaatcgcagccggtactggtgcagccaggccagaccgacaaactgcagagcacgctgtgggtcggcccggctattcaggacaaaatggctgccgttgcgccgcatctggatctgaccgtcgactacggctggctgtggttcatctcccaaccgctgttcaagctgctgaaattcatccacagcttcctcggcaactggggcttctcgatcatcgttatcacctttatcgttcgtggcatcatgtacccgctgaccaaagcgcagtacacctccatggcgaagatgcgcatgctgcagccgaagattcaggccatgcgtga

SEQ ID NO: 3524 - DNA, 630 bp, Klebsiella pneumoniae
ggagcatcgcttatgcagtggcaaactaaccttccacttatcgctatcctgcgcggtattacgccagacgaggcgctggctcacgttggcgccgttatcgacgccggtttcgacgcggttgaaatcccgctgaactcgccgcagtgggagaaaagtattccgcaggtcgtcgacgcttacggcgagcaggcgcttatcggcgcgggcacggtgctgcaaccggagcaggtcgacaggctggcggccatgggctgtcggctgattgtgacgccaaacattcaaccggaagtgatccggcgagcggtgggttacggtatgaccgtgtgtccaggctgcgccaccgccagcgaagccttcagcgccttggatgccggtgcgcaggcgctaaaaattttcccgtcatcggcttttggcccggattacatcaaagcgttgaaagccgtgctgccgcccgaggttccggtctttgccgttggcggcgtgacgccggaaaacctggcgcagtggattaatgccggctgtgttggggcaggattgggtatcgatctctatcgcgccggccagtcggttgaacgtaccgcgcagcaggcagccgcattcgtaaaagcgtatcgagaggcagtgaaatga

SEQ ID NO: 3525 - DNA, 228 bp, Klebsiella pneumoniae
cggttcgcacgtcaccccttttgtgcaggggcttttcggctaatgcagggtcttgtcgacgtgtgccaacaatcacgattgtttcagtttttctttgatatcgattttatgttcgagtggagtccgccgtgtcactttcgctttggcagcagtgtcttgcccgattgcaggatgagttaccagccacagaattcagcatgtggatccgcccattgcaggcggaactga

SEQ ID NO: 3526 - DNA, 1425 bp, Klebsiella pneumoniae
aaatttcaacgtgaaaggcttttacttttcgttctaactaccgtcaggatgagtatgtcaaatagtgcgatgagcgtggttatccttgctgcaggcaaagggacccgcatgtattccgatcttcctaaggtgctgcataccctggccgggaagccaatggtgcagcatgtcattgatgccgctaacgatttaggcgcatgtgcggtacacctggtatacggccacggcggcgatctgctgcgtcagactctgcatgaagacaacctgaactgggtgctgcaggccgagcagctcggaaccgggcacgctatgcagcaggcggcgccattcttcaatgatgatgaagacatcctgatgctctatggcgacgtgccgctgatctccgttgagacgctacagcgcctgcgcgccgcgaaaccacagggtgggattggtctgttaacggtgaagctggatgacccaaccggctatggccgcattacccgtgaaaatggccaggtgacgggtatcgttgagcacaaagatgccagcgaggcccagcgccagatccaggaaatcaacaccgggatcctgatcgccggtggagcggatctaaagcgctggctggcgaaactcaccaataacaacgctcagggcgaatactacatcaccgatatcatcgccatggcgcaccaggaaggacaccagatcgtcgcagtgcatccgcagcgcctgagcgaagtcgaaggcgtcaacaaccgcctgcagcttgcgcgcctggagcgcgtctaccaggcggagcaggcggaaaagctgctgctggcgggcgtgatgctgcgcgatccggcgcgtttcgatctgcgcggtacgctgcagcacgggcgcgatgtagagatcgatactaacgttattctggaaggcaacgtggtgctgggcgatcgagtgaaaatcggcgccggctgcgtgatcaaaaacagcaccatcggcgatgactgcgaaattagcccctacagcgtggtggaagatgcccagctgcaggcggcctgcaccatcggtccatttgcccgtctgcgcccgggcgccgaactgctggaaggcgcccacgttggtaacttcgtggaaatgaaaaaagcgcgtctcgggaaaggctccaaggcgggtcatctgacctatctgggcgatgcggagattggcgataacgtcaatatcggcgcgggcaccatcacctgcaactacgatggtgcgaacaagcataaaacgattattggcgatgatgtctttgtcggctcggatacccagctggtggccccggtcacggtaggcaacggcgtcacgatcgccgccggcaccaccgtcacgcgcaatatcgccgataacgaactggtgttgagccgcgtaccgcaggtccacaaacagggctggcagcgtccggtgaagaagaaataa

SEQ ID NO: 3527 - DNA, 618 bp, Klebsiella pneumoniae
cgactacaacgcggaaaaatgatgcacaacctggcgcggccgacgtcgcgcccattacgactcctgtcagatatgcaggcaatgatggaagaaacacaagcatttgaaaaccgtgtgcttgagcgtctgaatgctggcaaaaccgtacgaagcttcctgatcgccaccgtcgagctgttaacggaagcggtcaatattctggtgcttcaggtgttccgtaaagacgactacgcggtgaaatacgccgtcgagcccttgctggagggcagcgggccgctcggcgatctctctgtacgcctgaagctgatttatggccttggggtgataagtcgtgccgaatatgaagacgctgagctgctgatggccctgcgcgaagagcttaaccacgacggcaatgagtacagctttaccgacgacgaaattatcggtccgttcggcgagctgcactgcgtcgccgccctgccgccaacgccgcaatttgatgacagcgatgccgaactgctggcaatgcagaaactgcgttaccagcagatggtgcgctcaacgatggtgctgtccctgactgagctgatttcacgaatcagcttaaaaaaagcctttcagaaatcaacgctctga

SEQ ID NO: 3528 - DNA, 1086 bp, Klebsiella pneumoniae
atggcgcaacgcggaatcccctgtctatggatgcgcggcggcacctctaaagcggcctgttttctggccgacgatctgcctgccgatccggtgcgacgtgatgcggtgctgctggcggtgatgggctcgcctgatccccggcaaattgacgggatcggcggcgccgatccgctgaccagcaaagtggcgattatccgccgctccgcacggcctgacgccgatgtggactatctgtttgcccaggtgaacgtggcggcggctaccgtggattatggccaaaactgcggcaatattctcgccgccgttggccctttcgccatcgagcgcggtctggttcgtcacgatgcgccgctcactcgggtgcgtatttttatggagaacacggggcaactggcggtggcagagatcccctgtgacgccgacggggtcaactacgtcggcgagagccgtatcgatggcgtgccgggcagcgccagcccgatcctgctccattttcttgatgtcgccggctccagctgcggggcgctgctgccgaccggccgggttcgtgaccgttttgacggcgtcgaggtgacctgcatcgataacggaatgccggtgatcctgctgcgcgcttgcgacctcggttgcaccggctatgagacgcgcgaacagctggataatgacgacgcgcttaaacgtcgcctggagtcgattcgcctgcaggccgggccgctgatgcagcttggcgacgtcagccagcgcacggtgcccaagatgaccctgatcgccgagccgcgacacggcggcgccatcagcagccgcacctttatcccccaccgctgccacgcgtcgatcggcgtatttggcgcggtgagcgtggccagcgcttgtctgctccccggctctgtcgcgcagggcctggcgcaggtagcgccaggcgatacgccgctgctcagcgtcgagcatccgacaggcgaatttagcgtgacgcttcagcttgatgctgacggcgccctggctggctgcggcctgttacgcacggcgcgactgctgtttgctggcgaggtttttattccggcccgcgtctggccgcgtgaggagtga

SEQ ID NO: 3529 - DNA, 3123 bp, Klebsiella pneumoniae
cggaggcaacgcctgatgttctcccgtttcttcgtgcgtcgcccggtatttgcctgggtgatcgccattctgattatgctcgccggggtgctggcgatccgcacgctgccggtaggccagtacccggacgtcgccccgccggcggtgaaaatctccgccacctataccggggcgtccgccgaaaccctggagaacagcgtcacccaggtcatcgagcagcagctcaccggcctcgaccatctgctctacttcagctccaccagcagctccgacggctcggtcagcatcaccgtcacctttgagcaggggaccgacccggacaccgcccaggtgcaggtacaaaacaaagtgcagcaggcggaatcgcggctgccgagcgaagtccagcagtccggcgtaacggtggaaaaatcgcagagcagctttctgctgatcctcgcggtgtatgacaaaaccaaccgcgccaccagctccgatatctccgactggctggtcagcaatatgcaggacccgctggcgcgcgtggagggcgtcggcagcctgcaggtattcggcgccgaatacgcgatgcgcgtctggatggacccgaccaaactcgcctcctactcgctgatgccttccgacgtccagtcggcgattgaggcgcagaacgtgcaggtttccgccggtaaaatcggcgcgctaccgtcgtccaatgcccagcaattaaccgccaccgtgcgcgcgcagtcccggctgcaaacccctgaccagttcaaagcgatcatcgtgaaaagccaggccgacggctcggtagtacgcctgagcgatgtcgcgcgggtggagatgggtagcgaggattacaccgccaccgccaatctgaacggccacccggccgccgggatcgcggtgatgatggcccccggcgccaacgcgctggacaccgcgacgctggtgaaaagcaaaatcgccgaattccagcgtcagatgccgcagggttacgatattgcctatccgaaggacagcaccgagttcatcaaaatctcggtcgaggacgtgattcagaccctgttcgaagcgattatcctcgtcgtctgcgtgatgtatctgttcctgcagaacttccgcgcgacgctcattccggcggtagcggtgccggtggtgctgcttggcaccttcggcgtgctggcactgttcggctactcgattaacaccctgacgctgttcgccatggtgctagcgatcggcctgctggtggatgacgccatcgtggtggtggagaacgtggagcgcattatgcgcgacgaagggctccccgctcgcgaagccaccgaaaaatcgatgggcgaaatctccggcgcgctggtggcgattgccctggtgctgtcggcggtgttcctgccgatggccttcttcggcggttcgaccggggtcatctatcgccagttctcggtaaccattatctcggcgatgatgctgtcggtggtggtagcgctgaccctcaccccggcgctgtgcggcgcgctgctcagccactccaaaccgcacaccaaagggttcttcggcgcctttaaccgcctgtggggacgtacggaggcgggctaccagcgccgggtgctcggcggcctgcgccggggcgcagtgatgatgggcgcttacgcgctgatttgcggggcgatggcgctggcgatgtggaagctgccgggcagcttcctgccggtggaggaccagggggagatcatggtccagtacaccctgcccgccggggcgacggcggtgcgtaccgccgaggtgcgccgccaggtcaccgactggttcctcaccaaagagaaagccaataccgatgtcattttcaccgtcgacggcttcagctttagcggcagcgggcagaacgccgggatggccttcgtgtcgctgaaaaactggtcgcagcgcaaaggggacgacaacaccgcccaggccatcgccctgcgcgccaccaaagagctggggacgatccgcgacgccaccctcttcgccatgaccccgccgtcggtagacggtctcgggcagagcaacggcttcaccttcgaactgatggccagcggcggtaccgaccgtgacagcctgatgaagctgcgcagccagctgctggcggcggccaaccagagcagcgaactgcagtcggtgcgcgctaacgatctgccgcagatgccgcagctgcaggtggatatcgataacaacaaagccgtctcgctggggctgtcgctgagcgacgtgaccgatacgctctccagcgcctggggcggtacctacgtgaatgactttatcgatcgcggccgggtgaaaaaggtctatatccagggcgaaagcgacgcgcgcgcggtgccgtcggaccttggcaaatggttcgttcgcggcagcgataacagcatgacgccgttctccgccttcgccaccacccactggcaatacggcccggaaagcctggtgcgctacaacggctccgccgcctttgagatccagggcgaaaacgccgccggcttcagctccggcgcggcgatggacaagatggaaaagctggccgacagcctgccggcgggctccacctgggcgtggagcggcatttcgctgcaggaaaagctggccagcggccaggcgatgagcctctacgccatctcgattctggtggtgttcctgtgcctggcggcgctgtatgagagctggtcggtgccgttctcggtgatcatggtcatcccgctcggcctgcttggcgcggcgctggcggcgacgctgcgcggcttaagcaacgacgtctacttccaggtggcgctgctgaccaccatcggcctgtcgtcgaaaaacgccatcctgatcgtggagttcgctgaatccgccgtggatgaggggtattcgctctcccgggcggcgatccgcgccgcgcagactcgcctgcgcccgattgttatgacctcgctggcgtttatcgccggggtgctgccgctggccatcgccaccggcgccggagccaacagccgcgtggcgatcggcaccgggattatcggcggcaccctgacggccaccctgctggcggtgttcttcgtaccgctgttcttcgtgctggtgaagcgtctcttcacccgccaacgtccttctcaggagtaa

SEQ ID NO: 3530 - DNA, 903 bp, Klebsiella pneumoniae
gggggcacgctaatggcgaccattgaattgcaaactaccgccgaactggcggagtcccgtcgcaagatgcaggccaaacgccgcatgaagaaccgtatcgctctggcgctgtcgatggcgaccatggcgtttggtttgttctggcttatctggatcctgatggcgacgataacccgcggtttcgacggcatgagtctggcgctgttcaccgaaatgacgccgccgccgaatacggcgggcggtggactggctaacgccctcgccggcagcggtctgctgatcctgtgggcaaccgtatttggtacgccgctgggtatcctcgccggaatttatctggcggaatatggccgcaagtcggtgctggcggaaatcatccgctttatcaacgacattctgctttccgcgccgtctatcgtggtgggtctgttcgtctacaccattgtggtggcgcagatgcagcacttctcgggctgggcgggcgttatcgcgctggcgctgctgcaggtgcctatcgttattcgtaccaccgaaaacatgctgaagctggtgccggatagcctgcgtgaagcggcctatgcgctggggacgccgaagtggaagatgatctcggcgatcaccctgaaagcctccgtctcagggattatgaccgggatcctgctggctatcgcccgtatcgccggggaaacggcgccgctgctgttcaccgcgctgtccaaccagttctggagcaccgacatgatgcagccgattgctaacctgccggtgaccattttcaaatttgccatgagtccgtttgcggagtggcagcaactggcatgggccggggtgttgattatcaccctgtgcgtcttgctgctgaacatcctggcgcgcgttatcttcgccaagaagaaacacggttaa

SEQ ID NO: 3531 - DNA, 1839 bp, Klebsiella pneumoniae
tcgcgcctgcgggcagccggcgatgatggtatccaccatcttcttctctctagcatcggggccggaggtgagcaccaccgcgtatccttcggcggacagcgcgttgatcagggcgctcatccgatcttcgcgccagcatttaaagaaccagcgcgacgtcggctggatgacgatgtagtgttcccggaagtcctccggcagcagggcgcggctggcggcccagtctgcttcgctgtagcccatccgcgccggcgcatcgttcaactggagaccgagcggagcgagaatagagagattctgctgtaccgtatgcagctggttgtgctgttgggtggaggccagcgcggtgtggcaatagcgccagaccgggtggcggcgcttcggaaaatcaaaaccaatccgcgtcgcggcgccggtcagtttgctgataaccgcgctcggccactggtcggccaggttaagcaccatatcgtaccgctgctggcgcagcgtctgaatgagctgccattgcatcttcagctgatacctttttccctgctttttccagcggcgatcgagaccataaatatggtggatatcggggttggctgcgagcatatcccgggtctcttcatacaacaggacatccacgctggcggcggggtactgctgtttcagcgcgtgaataagcggcgtgatcagcagcatgtcgccatgatggcgcagcttaatgaccaggatccgcgccgggttcaacgggccgcgggagagggtttcaggcgtcatactctgttcttcatccaggataagggttccgattctaggggatcagacagattgagagaagcgttgtattgctctaccatgacccgatacgtatggcctgaggacgttttcgtgcacaatcccgcatttctcatcacgattgatacagagggcgataacctctggcaaaaacatgacagcatcaccaccgagaatgcgcgttatcttccgcgttttcagcagctttgcgaaaagtatggctttaaaccggtctatttgaccaactatgaaatggccatcgaccccttttatatcgaattcgccagagacgtgattgcccgcggcaccgcggaagtcggcatgcatctgcatgcgtggaacagcccgccgaccgagccgctgactgcagatgactggcgccataagccttatcttattgaatacagcgacgctatgatgcgtgagaaggtcgactatatgacgcgtctgctggaggataccttccagaccaaaatggttagccatcgcgccgggcgctgggcttttgacgagcgctatgcgcgtctgctggtggaatacgggtatcaggtggattgctcggtgaccccgcgggtgaactggaagaccgccaagggggcgccgcagggcgatggcgggaccgattatcgccgctttccgcagcatgcctatttcctcgatgaaaatgacatcagccgcgagggccactcgccgctgctggaagtgccgatgagcatccagtacaagcactcagcgtggatgaacagcgtgaagcagggttacgaccgcctgcgcggcaaagtgcgttccccctccgtacactggctgcgaccgatgggcggcaatgtggagacgatgaaaaaagtcgtcgaacaaacgttgacgcagggcaatgactacgtggaatatatgctccactcttcagagtatatgcccggcggcagccccacgttccagaatgaacgggatattgagcgtttatacgctgacctcgaagccttttttagctggctggcgccgcaggtgaagggcatgacgttggcagaatattaccagcggaaaattacacagcgctaa

SEQ ID NO: 3532 - DNA, 210 bp, Klebsiella pneumoniae
gtaaaaacgcgccggactggcgaaatccgttgtggcggtatgaggatggatctgtcgccgaatggtaaatgcgcgtcatacttcgcactggtgatgcgttggctgcattttcttaccctggtcacatactattgtatgctcccagggatgcgaaaatttgccgcctttccccagcgcgaattatttagcgcatcgcaacatagttattaa

SEQ ID NO: 3533 - DNA, 201 bp, Klebsiella pneumoniae
ccccgtcagcgcctcgcggccgctaccaaattcggcgacaacctgaaaatcagcttccagccccagcagctgagcaaagccggagcggacaatcaaatgatcgtcaataagggcgatggtggtcatggtgtgtcctggtgcctgaaaacgccggatggcggcgtaaacgccttattcggcctacggattcactgcttgtag

SEQ ID NO: 3534 - DNA, 873 bp, Klebsiella pneumoniae
ccctgccagcgcagaactggcaggtcattactatatcgcctggagtatgcaatgccgtgtgaagaactggatatcgtctggaataatattaaagccgaagcccgggctttggctgactgtgagccgatgctcgccagtttttaccacgcaacgctactcaagcatgaaaatctcggcagcgcgctgagctatatgctggccaacaagctggcttccccgattatgccggcgatcgccattcgcgaagtggtggaagaggcctacgccgccgatccggaaatgatcgcctccgccgcctgcgatattcaggcggtgcgcacgcgcgacccggcggtggataaatactccacgccgttgctctatctgaagggtttccatgccctgcaggcctatcgtatcggccactggctgtggactcaggggcgacgcgcgctggcgattttcctgcaaaatcaggtctccgtctctttccaggtggatatccacccggcggcgaaaatcggccgcgggatcatgctcgaccatgccaccggcattgtggtcggcgaaacggcggtgattgaagatgacgtctctattctgcagtcggtcaccctcggcgggaccggtaaaaccagcggcgaccgtcatccgaaaattcgcgaaggcgtaatgattggcgccggggcgaagatcctcggcaatattgaagtcgggcgtggcgcgaagattggcgccggttcggtggtattgcagccggttccgccgcacaccaccgcggcgggcgtaccggcgcgtatcgtcggcaagccggagagcgacaagccggcgatggatatggatcagcatttcaatggcatccaccacaccttcgagtacggcgatgggatttga

SEQ ID NO: 3535 - DNA, 378 bp, Klebsiella pneumoniae
agcctgcagcgcgatgaacaaggaactgtaatgaaaatctcccgcctcggcgaagcgccggattaccgcttttcgctggctaacgaacgcacctttctggcatggatccgcacggcgctcggttttctcgccgccggcgtcggccttgaccagttagcgccggactttgccacgccgctgatccgtgaaattctcgccctgctgctgtgtctctttgccggcggcatggccatctatggctatctgcgctggctgaataacgagaaggcgatgcgtctcaagcaggaccttccctatacccgcacgctgctgatgattagcattctgctgctggcggtggtggccgcggtgatgctgctggtggtgtatggcggataa

SEQ ID NO: 3536 - DNA, 1545 bp, Klebsiella pneumoniae
gccgcgcagcgtcgccgccagcgccgcgccaagcaggccgagcgggatgaccatgatcaccgagaacggcaccgaccagctctcatacagcgccgccaggcacaggaacaccaccagaatcgagatggcgtagaggctcatcgcctggccgctggccagcttttcctgcagcgaaatgccgctccacgcccaggtggagcccgccggcaggctgtcggccagcttttccatcttgtccatcgccgcgccggagctgaagccggcggcgttttcgccctggatctcaaaggcggcggagccgttgtagcgcaccaggctttccgggccgtattgccagtgggtggtggcgaaggcggagaacggcgtcatgctgttatcgctgccgcgaacgaaccatttgccaaggtccgacggcaccgcgcgcgcgtcgctttcgccctggatatagacctttttcacccggccgcgatcgataaagtcattcacgtaggtaccgccccaggcgctggagagcgtatcggtcacgtcgctcagcgacagccccagcgagacggctttgttgttatcgatatccacctgcagctgcggcatctgcggcagatcgttagcgcgcaccgactgcagttcgctgctctggttggccgccgccagcagctggctgcgcagcttcatcaggctgtcacggtcggtaccgccgctggccatcagttcgaaggtgaagccgttgctctgcccgagaccgtctaccgacggcggggtcatggcgaagagggtggcgtcgcggatcgtccccagctctttggtggcgcgcagggcgatggcctgggcggtgttgtcgtcccctttgcgctgcgaccagtttttcagcgacacgaaggccatcccggcgttctgcccgctgccgctaaagctgaagccgtcgacggtgaaaatgacatcggtattggctttctctttggtgaggaaccagtcggtgacctggcggcgcacctcggcggtacgcaccgccgtcgccccggcgggcagggtgtactggaccatgatctccccctggtcctccaccggcaggaagctgcccggcagcttccacatcgccagcgccatcgccccgcaaatcagcgcgtaagcgcccatcatcactgcgccccggcgcaggccgccgagcacccggcgctggtagcccgcctccgtacgtccccacaggcggttaaaggcgccgaagaaccctttggtgtgcggtttggagtggctgagcagcgcgccgcacagcgccggggtgagggtcagcgctaccaccaccgacagcatcatcgccgagataatggttaccgagaactggcgatagatgaccccggtcgaaccgccgaagaaggccatcggcaggaacaccgccgacagcaccagggcaatcgccaccagcgcgccggagatttcgcccatcgatttttcggtggcttcgcgagcggggagcccttcgtcgcgcataatgcgctccacgttctccaccaccacgatggcgtcatccaccagcaggccgatcgctag

SEQ ID NO: 3537 - DNA, 333 bp, Klebsiella pneumoniae
acgcgcaggcgccgcgtaccgccagcgaagcgtgatgtagctcaccctttcgccgcgaacggggcaaaactaagaaattttccccggttttacctggacgccgtctcaggccagacggcgcgcctggtttttacaatgcatggttattacgcaggcataaaaaatcagctcaggagatacccatgctgggcctttctgaatcaggtgcgcaagccgaccctggatctgccgctcgatgtgcggcgcaaaatgtggttcaaacctttcatgcagtccctatctggtggttttcatcggctacctgaccatgtacctgatccgcaagaactttaa

SEQ ID NO: 3538 - DNA, 1470 bp, Klebsiella pneumoniae
agcgctgggcgcccacggggtagtacgccgcggcaacgggattcaggtcatcgtcggcctgcacgttccccaggtgcgcgaccagctggaaaacctgatgaaagattctctttcgaccgaacataccaccatgacggaggcagtatcatgaaaaaattctcagttgttatcgcaggcggcggcagcaccttcaccccgggcattgtcctgatgctgctggcaaaccaggatcgttttccgctgcggtcgctgaaattttacgacaacgacggcgcgcgccaggagaccatcgccgaggcgtgcaaagtgatcctcaaagagcaggcgccggagattgagttcagctataccaccgatccgcaggcggcgtttaccgatgttgattttgtcatggcgcatatccgcgtcgggaaatatccgatgcgtgaacaagatgagaaaatcccgctacgccacggcgtgctgggccaggagacctgcggaccgggcgggatcgcctacggtatgcgctctatcggcggcgtgctggagctggtggattatatggaaaaatattcgccgaacgcctggatgcttaactactccaacccggcggcgattgtggcggaagccactcgtcgtctgcggccgaacgccaaaatcctcaacatctgcgatatgccgatcggcattgaagggcggatggcgcagattgtcggcctcaaagaccgtaaacagatgcgcgtgcgctactacggcctcaaccacttcggctggtggacgtcgattgaggacctcgacggcaatgatttgatgccgaaactgcgcgaatatgtggcgaaatacggctatgtgccgccctcgaacgatccgcacaccgaggccagctggaacgacacctttgccaaagcgaaagatgtgcaggcgctggatccgcagaccatgccgaacacctacctgaaatattatctgttcccggactatgtggtagcccactccaacccggaacgcacccgcgccaatgaggtgatggatcatcgggagaaaaacgtcttcagcgcctgccgggcgatcatcgccgccgggaaatccaccgccggcgatctggagattgacgagcatgcctcctatatcgtcgatctggcgacggctatcgcctttaacacgcaggaaaggatgctgctgattgtgccgaacaatggcgcgatccataactttgacgccgacgcgatggtggagatcccttgtctggtaggccacaacggaccggagccactgacggtaggcgacatcccgcatttccagaaagggctgatgagccagcaggtggcagtggaaaaactggtggtcgatgcctgggaacagcgctcttaccacaagctgtggcaggcgattaccctgtcgaaaaccgtgccgagcgcctcggtggcgaaagcgatcctcgacgacctcattgccgccaacaaagattactggcctgagctgcattaa

SEQ ID NO: 3539 - DNA, 2148 bp, Klebsiella pneumoniae
cgagcagggcgaagtagaagccgatgccgcgtggtgggctaccatgcaggctgcgaggtaaacccaatgtcaggccgcctgttagatgccgttccgctcagttcactcaccggtgtgggcgctgcgcagagcagcaaactggcgaagattggcctgcatacggtacaggacctgctgctgcacctgcctttacgctacgaagatcgcacccatctttacccgatagccgagctacttcccggagtttatgccaccgtggaaggtgaagtgctcaacagcaatatcaccttcggcggccggcggatgatgacctgccagatcagcgatggcaccggcatcctcaccatgcgctttttcaacttcaacgcggcgatgaaaaacagcctcgcgaccggtcgtcgggtgctggcctacggtgaagccaaacgcgggaagtacggcgccgagatgatccacccggaatatcgcgtccagggcgatatgagcaccccggagctgcaggaaacgttaaccccagtctatccgaccaccgaaggcatcaagcaggcgaccctgcgcaagctcaccgatcaggcgcttgagctcctggaaacctgcgcgattagcgaactcctgccgccggagctggcgcaggggatgatgagcctgccggaggcgctgcgtacgctgcaccgcccgcctccctccttgcaacttagcgagctggaaagcggcaagcacccggcgcagcagcgtctgattctggaagagctgctggcgcataacctcagcatgctggcgctgcgggcaggcgcccagcgctatcacgccctgccgctcggcgccaacgataccctgaaaaaccaactgctggcctccctgccctttaagcccaccggcgcgcaggcgcgggttaccgccgagattgaacacgatatggcgctggacgtgccgatgatgcgcctggtgcagggcgacgttggctccggtaaaacgctggtcgctgccctggccgccttgcgcgctatcgtccacggcaaacaggtggcgctgatggcgcccaccgaactgcttgccgagcagcatgccaataacttccgcaactggttcgaaccgctgggtattgaagtcggctggctggcgggcaaacagaaaggcaaagcccgccaggcgcagcaggaggctatcgccagcggcgaggtgcagatgattgtcggcacccacgccatcttccaggagcaggtgcagtttaacggcctggcgctggtgattattgacgaacagcaccgcttcggcgtgcatcagcggctggcgctgtgggagaaaggtcagcagcaggtattccacccgcatcagctgatcatgaccgccaccccgatcccccgcaccctggcgatgaccgcctacgccgatctggacacctcgattatcgacgagctgccgccaggccgaactccggtgaccactgtcgccatccccgacacccggcgcagcgatattatcgaccgcgtgcgcaacgcctgtacccatgaaggtcgccaggcctattgggtctgtacgctgattgaagagtccgatctgctggaagcccaggcggcggaagccacctgggaagagctcaaactggcgctgccggagctcaatatcggcctcgtccacgggcggatgaaaccggcggagaagcaggcggtgatgcaggccttcaagcagggcgagatgcatctgctggtagccaccacggtgattgaagtcggcgtcgacgtgcctaactcaagcctgatgattatcgaaaacccggaacgtctgggtctggcgcagctgcaccagctcagagggcgcgtcgggcgcggcgcagtcgcttcccactgcgtgctactctataaatcgccgctctccaaaacggcgcagaaacgtctgcaggtcctgcgcgacagcaacgatggtttcgtcattgcccagaaagacctcgaaattcgcggtcccggcgagctgctcggcacccgccagaccggcaacgccgaatttaaagtggcggacttactgcgcgatcaggcgatgatccccgatgtccagcgcattgctcgccacattcatgaacgctatccgctgcaggcccaggcgcttatcgagcgctggatgccggaaaccgaacgctattccaacgcgtag

SEQ ID NO: 3540 - DNA, 390 bp, Klebsiella pneumoniae
attaaggagctctatatgaaaattacatcatacatgtgtaaattagttttagtaatcattttgtctgtgtttagcctgcaaggcttggcctctgagtcaccaataaaagtagatgttggtggtgataaaatgaagattggccctaattatttgcctatttggagctacaatatcactagtattgaaaatgaggtcgttattacttcaatagttgttaatcgcggcaattgtctgccttcgattgcaggtcgcggaaataacatgaataaacgacttgggtatggtgaaacatttacatttaccattccaacaaataaagattatacacagtgcaaaccacttgagttgataataggcactcctaatggatcattgaaatatacgtggtaa

SEQ ID NO: 3541 - DNA, 762 bp, Klebsiella pneumoniae
ggggccttcagcccccgttttgtgcttgtgaaggacgacaagatgaaaatgattgtgaccgaagattatgaagagatgagcctggtcgccagccatcatgttctgggctatatcacggtgccgcggcgggtgaatctggcggtgacggcggggagcacgccaaagcggatgtatgagcatttgaccgccgccgtgaaaggcaaagcattctatgatcgggtgcactattacaacttcgatgagatcccttttcgcggccagtcgcgagaaggcgtcacgatatctaatttgcgccagctgttttttaccccggcgcagatcaaagaagagaacattcacaagctgacgctggacaacgccgctcagcacgatcgccagctggaagaggctggcggtctggatctgatggtgctggggctgggggccgacggccatttttgcggcaacctgccgaataccacccgctttcatgatcagacggtcgaagtgccgattcatggggaaatgattgctcttatcgctaacagcgagatgggcggggatatctcggcagtaccaaacagctatgtcaccatggggccgagaagcgtgatggcggcgaaaaatttattgctaattgtcagcggtgcggcaaaagcgcacgcgttaaagcaagtggtggaaggtccggtcagcgtgcaggtgccggcttcagtgctcaaattgcacccttcactggtgattattgccgataaagcggcggcggcggaattgcagcaataa

SEQ ID NO: 3542 - DNA, 1290 bp, Klebsiella pneumoniae
ccactttccagaaccaccgatagactattcgcgatgacattttcccttttcggcgacaaattcacccgtcattcaggcatcacccgcttgatggaagaccttaatgacggtctgcgcacgccgggcgctattatgctgggcggcggcaaccccgctcagatcccggaaatgaatgactacttccagcagctgctggccaacatgctggataatggcaaagcccttgatgcgctttgtaattatgatggtccacagggcaaaagcgagctgctggctctgctggcgaacatgctgcgcgacgagctgggctgggagatcgaaccacagaatattgcgctaacaaacggcagtcagagcgcatttttctacttatttaatctgtttgcaggccgtcgggcagatggcaccacccgtaaggtactgttcccactgacgccggaatacatcggctacgccgatgccggtctggaagaggatctgttcgttgccacccggccgaacatcgaactgctgccggaaggccagtttaagtaccatgttgattttgagcatctgcaggtgacggaagagaccgggatgatctgcgtctcgcgccccaccaacccgaccggcaacgtcatcactgatgaagagctgatcaaactggatgcgctggcgaatcagcacggggtcccgctggtgattgataacgcctacggcgtgccgttcccgggcattatctttagcgacgcccgaccgctgtggaatccgaacatcgtgctgtgtatgagcctgtccaagctgggcctgccgggcagccgctgcgggattatcatcgccaacgaaaaaatcatcaccgccatcagcaacatgaacggtattatcagcctcgcccctggcggcatcgggccggcaatgatgtgcgaaatgattaaacgacaggatctgctgcgcctgtcagagacggtgatcaagcccttctattaccagcgggtgcaggaaaccatcgccattattcgccgctatctgccggaggagcgctgccttattcacaaaccggagggggcaatcttcctctggctgtggtttaaggatctgccgatctccaccgagctgctgtatcagcggctgaaaaagcgcggcgtgctgatggtgccgggggattacttcttccctggtctggataaaccgtggccgcacacccaccagtgtatgcgcatgaactatgtaccggacccgcaaaaaatcgaagccggagtgaaaatcctcgccgaagaggttgaatttgcctggcgcgaacaggaagcatag

SEQ ID NO: 3543 - DNA, 267 bp, Klebsiella pneumoniae
ggatggcgcagcgatgatcctgaatttcttccgctgaagcccggttcagggtcagcaggttacgctccgtcgccagcagcaccagcgagccgtcgctctgttgcgccattgccagcgcgaagcgtcccatatgctggcgcgcctccggcacctcttccgccagcatcaggaacgggctacgctgggccagctccgcctccgtcacccggcgcgccaggtattcgtggccctgaagcccgcccggtagcggcagccagcggctgctga

SEQ ID NO: 3544 - DNA, 1344 bp, Klebsiella pneumoniae
atcacgctaagcctcgactcacagaggcagaacttgacgctttgtcatcccccctcgaacaccgataagtggagttatctgatggctaacattctcggcggtatcgccgtctctcataccccgactatcggcttcgcggtcgatcatcataaacagcaggatccggcgtgggcgccgatcttccagagcttcgaaccgctgcagcgctggctggaggagaaaaaaccggatgcgctggtgtacatctttaatgaccatgtgaccgcctttttcttcgatcactattcgacttttacgctgggaatcgacagtcaatatgacgttgccgatgaaggcggcggaccgcgctgtctgccgccggtccagggcaacgcggcgctctcaaggcacattggcgccagcctgatggccgacgagtttgatatgtcgttctttatggataaaaagctcgaccatggccttttctcgccgctttcggcgctgttgccctgggatgaagcgcaggggtggccgacggcggtgatcccgttacagatcggcgtgctgcaatttccggtaccaagcgcgcgccgttgttacaaactcggccaggcgctgcgccgggcgattgaaagcttcccggaagatatcaatgtggcgattgtcgcgaccggcgggctctcgcatcaggttcatggcgagcgctgcgggtttaataatcccgactgggatgcccagtttgttgatatgctggttaatgacccggaaaagcttaccgaaatgacccttggcgaatatgccgagctgggggggatggaggggtccgaagtgatcatgtggctggtgatgcgcggcgcgctatcagccaatgtcaccgaaacctggcgcgactattacctgccgtcgatgaccggtatcgccacgctgatccttgagaacaatgcgcgcctgccccccgtcgataccctgacgcgccatcgccagcatatggcgcagcagctggccggggtggagaaactgccgggaacctatccttttacccacgagcgcagcctgaatggcttgcggcttaaccgtttcctgcatcggctgattgagcctgcctggcgcgaacgttttctgcagtcgcctcagtcgctttatgccgaagccggactgagtgaggaggaacagcagttgctcaacgcgcgcgactggcggggattaattcagtatggcgccagcttcttcctgctggagaaaatgggcgcggtggtcggcgtatccaacctgcatatttacgccgcgatgcgcgggcagacgctggaggcgtttcagcaaacgcgcaaccagcaggtaacctattcggtggcgggtaaacgttaa

SEQ ID NO: 3545 - DNA, 483 bp, Klebsiella pneumoniae
aggagagtaagcatgaccgaacaacgtcccccgttaccgccgtttacccgcgacagcgctatccagaaggtccgcgccgcggaagatggctggaacagccgcgatgcggaaaaagtcgccctggcctacaccgtggatagcgaatggcgtaaccgcagcgaatttgtccacggtcgggggcaaattgttgagttcctgcagcgaaaatggcgcaaggagcagcaataccggctgattaaggagctgtgggcatggcaggagaatcgcattgccgtgcgcttcgcctatgagtggtgcgacgacagcggcaactggtttcgctcgtatggcaatgagaactgggagtttgataagcatggactgatgcagacgcgctacgcctgcatcaacgatctgccaattagcgaaagcgagcgcctgttccactggccgcaggggcgccgcccggacgatcatccggggctcagcgatctggggctgtaa

SEQ ID NO: 3546 - DNA, 1098 bp, Klebsiella pneumoniae
cacagctcaaggtaccgtatgcgtatccttaaacaattaacgcggaaaaagaatgcttttttccgcggcattaaatttaatttaattaactatcgatacagaaataagccggcgcgtaaagccttcgacccagcggctgtgcgccgcgtgctgctattgcgtctggatgataaagtcggtgatatggtggtcacgaccggctgcgccagaatactggccgaacggggatatcaggtttcggtgttaaccggaccaatatgcagcgaaatattagcaggctcagaattcattcagcaagtatatttatatcggccccgcatgtccttaaatacgttgcgggcggcgggttttgatgcggttatcgattttgatgacgtgaccagctatgaacgctttaaattactcgccgatttacgggcgaccagcgtgattggttttaataaagagccctataaactttacgatcactcaatcgctttttttgacggcaacagccatatttccctgcgctataagcaggtggtgaagctgtttggcatcgttgacgaccgcccgtatcactatcatctccccggctgccgccatgagcgggagaaagtggcccgcttgctttctcaggccggagaggtcgaactgcgtatcgccattaacccttttaccgcctccgaggataaagacttctgtcgtcaccaggtggcgaccctgatcgagcggctacatgctctgccttaccgggtctgtatcgtgatggtggggcgcagtgaaaaaatccgccagctggggctggatatggcgctgtacatcgccgacagcaccatcaactccgccgtagaagtgatccgcagctgtgatttagtcattacgccggacacctcgatcgtgcatattgcccgggctttcgataagccgatggtggcggtctataacaaacgcaaactcaagaataccgggctgcccggctatcacatctgggcgccgggctatgacaaggcgaagcagatagtctgtgaagaagcgaatgtcgccgatgtggcgattgagtcggtgtggcccgtgattaaagagcaggccgaccggctggtcgccgcccgcagttaa

SEQ ID NO: 3547 - DNA, 672 bp, Klebsiella pneumoniae
gtcgggtcaagagatcgccatatcatgacagcacaaaaggatcaggatgctccccgccgcccgggtcggccgcgcggtaaaaaaccgggtaccgccaaccgcgaacagctgatggacatcgccctgacgctgtttgcccgcgacggggcgggccgcgtatcgttgaacgccatcgccaaagaggccggggtgacaccggcgatgctgcattactacttcagctcgcgggatgcgctggtgactcagctgattgaggagcgctttatgccgctgcgcaatcacatcagccgcatctttgtcgatcatccacaggacccggtgctggcgctgacgatgatggtcgagacgctggcgcatatggcggagaaaaacgcctggttcgcgccgctgtggatgcaggagatcatcggcgaaatgccgattctgcgccagcatatggatgcccgcttcggcgaggagcgttttcaggtgatgctggggacggtgcgtcgctggcagcaggaaggcaagatcaatccggcgctggcgccggagctgctgtttaccacggtgattagcctggtgctggtgccattttcacgcatccacagcgatccgcgtttacaggcggtcaaccgtcagaccatcgtcagccacgcgctggcgttaatgggccacggcgttggaggttaa

SEQ ID NO: 3548 - DNA, 186 bp, Klebsiella pneumoniae
tgttttttgagtggaactttcgtactcaacttaaggcaggtcgcgcaggctgtccggttcgaaaatccggcgtcagatatgaattttatttataatgtgagggatacgacaaaaaccagccagcaaaaaacccgcagccaacggcggcgggtcagggcaagagcagcgtttagtgcttcggaataa

SEQ ID NO: 3549 - DNA, 1359 bp, Klebsiella pneumoniae
attctcctgagatttgttaaagcgatagcaagcatcgtttttttaaacatgcgagcagctacgcatcctcttatgaaaagcgagaatagttgcgaaaacgttaaatgcgtcacaaacaaaatgttacactgcgcagctttccgccactttcttcgcaggtcactcatgagtcattcaaatgaaaccaaaccccatgcacgcgagctggcgcgaccaaactggtcggcggtcttcgcggttgctttctgcgttgcctgcctgattaccgtcgaatttctaccggtcagtctgctgacgccgatggcgctggatttaggcatctccgaagggatggccgggcagtcggtgacgacgacggcattcgtcgcgatgttttccagcctgtttatcaccacggtgataggtaaaaccgatcgccgctacgtggttatcctgttttcactgctgctgaccctttcttgcctgctggtatctttcgctgatagcttcaccctgctactactggggcgcgcctgtctgggcctggcgctcggcggtttctgggcgatgtccgcatcgctgaccatgcggctggtgccgatgcgcgtggtgccgaaagcgctatcgattatcttcggcgcggtatcaatcgcgctggtgatcgctgccccgttgggcagtttccttggcgggcttatcggctggcgcaacgtctttaacggcgcggcggtaatgggcgtgctgtgtacgctctgggtgctgaaagcgctgccgtcgctgccgggtgaatcggcggctcagcagcaaaatatgtttggtctgctgaaacgtccgggggtgatggccgggatgtgcgccattttcatggcctttgccggacagtttgccttctttacctatattcgcccggtgtacatgaccctcgccgggtttgatgtcgacggcctgacgctggtgctgctgagctttggtatcgccagctttatcggcacctcgctctcctcggtgctgctcaagcgttcggtaaaagcggcgctggcgatcgcgccgctggtgctgaccgcctgcgcggtggcgctggtgctgtggggagagagcaaaatcatcgcctcgacggtggcgattatctggggcttcgcgtttgcgctgatcccggtggggtggtcaacgtggatcacccgttccctctccgatcaggcggaaaaagccgggtcgattcaggtggcggtgatccagctggccaacacctgcggcgccgcggtcggcggcattgcgcttgaccacttagggctgctgtcgccgctggtgttgtcagggatattgatgctgtttaccggcctgctggtggcggccaaagtgaaggtgaattcacccgcttaa

SEQ ID NO: 3550 - DNA, 450 bp, Klebsiella pneumoniae
agatcgtcgagccgtctgccgccggaacgtcacagcgtgcctcgcgtccattctcaaggtggaacagctggaaggcggtgccctcatgccaggcgtaatccggcttctggtcattgttgcccagcgccagcaggctgttgtcgcgaacgtagaccggcaggctcagcgcatcgtgatgctgcttatgccagcggctacccggcaattcatcgttatgccacagatgcgtccagtgcccttccggcagataaaactgcacttcgccggcctcggagaacaccggcgccaccaggaccgaatcgcccagcatatactggcggtcgagatagtcgcaggccggatcgtccggaaactcgagcatcatcgcgcgcagcatcggcgtgccgcactcgttggccagcgccgcctgacgatagagatacggcatcatgcggcatttcagctgcgtga

SEQ ID NO: 3551 - DNA, 1512 bp, Klebsiella pneumoniae
tttcaagcgagcgttgcaatgacttctcaagttgctaacccaccggtgcagtcgatacgcctgctgttcagcgcattgctgctggtgatgctgctttcagcgctggatcagaccattgtctccaccgcgctgccgacgattgtcggcgaactgggcgggctggacaagctttcctgggtggtcaccgcctatatcctcagctccaccatcgcggtgccgctgtacggtaaatttggcgatctgttcggccgcaaaattgtgctgcaggtggcgattgggctgtttctcgtcggctccgcgctctgcgggctggcgcagaatatgacccaactggtgctgatgcgcggcctgcaggggctcggcggcggcggcctgatggtgatcagcatggcggcggtcgccgacgtcatcccgcccgccaaccgcggccgctatcaggggctgttcggcggcgttttcggcctggcgacggtgatcggcccgctgatcggcggttttctggtgcagcacgcctcctggcgctggatcttctatatcaacctgccgctcggcctgttcgcgctgctggtgatcggcgcggtattccacagcagcaataaacgcagccagcatcagattgactggctgggggcgatttatctcagcatggcgctgctgtgcatcatcctgtttacctcggaaggaggcagcgttcatgcgtggaatgacccgcagctgtggtgcattctggccttcggcatcgtggggatcatcggctttatttacgaagaacggatggccgccgagccgattattccgctggcgctgttccgcaaccgcagcttcctgctgtgcagcctgatcggcttcgtcatcggcatgtcgctgttcgggtcagtcaccttcctgccgctctatctgcaggtggtgaaggaggcgacgcccaccgaagccgggctgcagctgatccctctgatgggcggcctgctgctgacctcgattatcagcgggcggattatcagccgtaccggtaaatatcgcctgtttccgatcctcggcaccctgctcggcgtgaccggcatggtactgctgacccgcatcaccattcactcgccgctgtggcagctgtacctgtttaccggcgtgctgggagcgggtctggggctggtgatgcaggtgctggtcctggcggtgcagaatgcgatgccggcgcagatgtacggcgtcgccacctccggcgtgaccctgttccgctcgattggcggctccatcggcgtggcgctgtttggcgcggtgttcacgcacgtgctgcagagcaacctgcaacaactgctgccggaaggcgcggtgctgccgccgggaatgaatccggtggcggtccagcacctgcccgcggatatccgcctcgactacctcgacgccttcggcgcggcgatccacgcggcgtttctgatggcggccggcattatggcggtggcgtttgtcctctcatggctgttaaaggaggcgccgctgaagaccgcgacgcattaa

SEQ ID NO: 3552 - DNA, 222 bp, Klebsiella pneumoniae
cccggaaagagaccagttagccagcttacccgcaggacatataatcaatacgcctccttttcgcaggtgatcgttcatctcgcggaattttttatggctcatcttaccggccatattctcaattccaatggtaagttccgatacctgggggaatataattggcaaaacgtgattggctattatttttatatcgctcctgactcgggagaccgtatgtattaa

SEQ ID NO: 3553 - DNA, 1554 bp, Klebsiella pneumoniae
ggggactggagcatgcaactgaattccaccgaaatcagcgaactgatcaagcagcgcattgctcagttcaatgttgtgagcgaagctcataacgaaggtactattgtttctgtaagtgacggtgttatccgcatccacggccttgccgaatgtatgcagggcgagatgatctccctgccgggtaaccgttacgctatcgcactgaacctggagcgcgactccgtaggtgcggtggtaatgggtccgtacgctgacctcgccgaaggcatgaaggtgaaatgtactggccgtatcctggaagttccggtaggccgtggcctgctgggccgcgtggttaacaccctgggcgcgccaattgatggtaaaggtccgctggaaaatgacggtttctccgccgttgaagcgatcgcaccgggcgtaatcgaacgtcagtccgtcgatcagccggtacagaccggttacaaatccgttgacgccatgatcccaatcggtcgtggtcagcgtgaactgatcatcggcgaccgtcagaccggtaaaactgcgctggctatcgatgccatcatcaaccagcgtgattccggcatcaagtgcgtctatgtcgctatcggtcagaaagcgtccaccatctctaacgtggtgcgtaaactggaagagcacggcgcgctggctaacaccatcgtagtggtagcgactgcatctgaatctgctgcactgcaatacctggcgccatacgctggttgcgcaatgggcgaatacttccgcgaccgcggtgaagatgcgctgatcgtttacgatgatctgtctaaacaggctgttgcttatcgccagatctccctgctgctccgtcgtccgcctggacgtgaagcgttcccgggcgacgtattctacctccactctcgtctgctggagcgtgctgcgcgtgttaacgccgaatacgttgaagccttcaccaaaggtgaagtgaaagggaaaaccggttctctgaccgcgctgccgattatcgaaacgcaggcgggtgacgtttccgcattcgttccgaccaacgtaatctctattaccgatggtcagatcttcctggaaaccaacctgtttaacgccggtattcgtcctgcggttaacccgggtatctccgtatcccgtgttggtggtgcagcgcagaccaagatcatgaagaaactgtccggtggtatccgtaccgcgctggcgcagtatcgtgaactggcggcgttctcccagtttgcatccgaccttgacgatgcaacccgcaaacagctggaccacggtcagaaagtgaccgagctgctgaaacagaaacagtatgcgccgatgtccgtcgcgcagcagtctctggttctgttcgcagcagaacgtggttacctggctgatgtagaactggcgaaaatcggtagcttcgaagccgctctgctggcttacgtcgaccgtgatcacgctccgctgatgcaagagattaaccagtccggtggctataacgacgaaatcgaaggcaagctgaaaggcatcctcgattccttcaaagcaacccagtcctggtaa

SEQ ID NO: 3554 - DNA, 786 bp, Klebsiella pneumoniae
gtagcgtggagaattaaaatgcgacatcctttagtgatgggtaactggaaactgaacggcagccgccacatggtaaacgaactggttgcgaacctgcgtaccgagctggctggcgtaagcggctgtgcagttgccatcgccccgccggaaatgtatctggacctggctaagcgcgcggcagaaggcagccacattcacctgggcgcgcagaacgttgacgtgaatctgtccggcgcattcaccggtgaaacctccgccgaaatgctgaaagatatcggcacgcagtacatcatcatcggccactccgagcgtcgtacctaccacaaagaatccgacgagctgatcgcgaagaaattcgccgtgctgaaagagcagggtctgaccccggttctgtgcatcggtgaaaccgaagccgaaaacgaagcgggcaaaacggaagaagtttgcgcacgtcagatcgacgccgtgctgaaaacccagggcgctgccgctttcgaaggcgtggttatcgcttacgaaccagtatgggctatcggtaccggcaaatcagcgaccccggctcaggcgcaggcggtgcacaaattcatccgtgaccacattgctaaagctgacgccaaaatcgctgagcaagtgatcatccagtacggcggttccgttaacgctggcaacgccgcagagctgttcacccagccggacatcgacggcgcgctggttggcggcgcctccctgaaagctgacgctttcgcggtgatcgttaaagcagcagaagcagcgaaaaaagcgtaa

SEQ ID NO: 3555 - DNA, 555 bp, Klebsiella pneumoniae
actgtaaggagggaggggctgatgtctgaatttgtaacggtagctcgcccctacgccaaagcagcttttgactttgccgtcgaacacaacagtgttgaacgctggcaggatatgctggcgtttgccgccgaagtgaccaaaaacgaccaaatggcagagcttctctccggtgctttggcgccggaaacgctctcagaagcgtttatcgctatctgcggcgagcaactcgacgaaaatggccagaacctgattaaggtgatggcggaaaataatcgtctgaaggtgctcccggacgttcttgagcaattcattcacctgcgcgcggccagtgaggccatcgcagaggtagaagtaatatctgccaaccaactgagtgatgaacagcttgccaggatcgtcagcgcgatggaaaaacgtctgtcacgcaaagttaagctgaattgcaaaatcgataagtctgttatggcaggtattatcatccgtgcgggtgatatggtcattgatggcagcgtacgcggccgtcttgagcgccttgcagacgtcttgcagtcttaa

SEQ ID NO: 3556 - DNA, 846 bp, Klebsiella pneumoniae
catgaggggagactcatcttacccggggaccctatggctattaaactgattgcaatcgatatggacggcacgctgctgctgcccgaccataccatctctccagcggtgaaagccgccatcgccgcggcgcgcgagcgcggtgttaacgtggtgctgaccaccggtcgcccttacgctggcgtccacagctatttgaaagagctgcatatggagcagccgggtgattactgcattacctacaatggcgcgctggtgcagaaggctggtgacggaagcaccgtcgcgcaaaccgcgctgagctatgacgactatcgcttccttgagcagctctcccgcgaggtcggctcccacttccatgcgctggatcgcaatacgctgtataccgcgaaccgcgatatcagctactacaccgtccacgaatcctatgtggcaaccattccgctggtgttctgcgaagcggagaaaatggatcctgagatccagctgctgaaagtgatgatgattgatgagccggcaatcctcgaccaggccatcgcccgtattccggcggaagtgaaagagaagtacaccgtgctgaaaagtgcgccttacttcctcgaaatactggataaacgcgtcaataaaggcactggcgtgaagtcgctggccgatgcgctgggcatcaagccggaagagattatggcgattggcgatcaggaaaatgatatcgcgatgattgaatttgccggcgtcggcgtggcaatggataacgccattcctgcggtcaaagaagcggcgaacttcatcaccaaatcgaaccttgaagatggcgttgccttcgccattgaaaaatacgttttagcgtaa

SEQ ID NO: 3557 - DNA, 321 bp, Klebsiella pneumoniae
ttactatctggtggggcttttctctgtctgtctcccgctgaatacctgagacacacagtctcaaccacccgccgccattctagcgtaaatacctctcggaattatgtttatatattcctaaaacgtttctcatcgatgaatgcaaataatgaagatatcaatggcagaattattaacggttcacctatttatatttcacgtataaaaaaacctgccctgaggcaggtctttattattaccgatacgcttactgcagcagagaaatatccgccacctgcaggaacagttcacgcagtttggacagcagcgtcagacggttga

SEQ ID NO: 3558 - DNA, 441 bp, Klebsiella pneumoniae
tatgcgtatggatgcgttttaatgcgaaagccaataaatgtatttattatattgatatcggtgctgatactcaccgggtgtgataacaaaccagataacatgttatccggttattcacatggagaatttgtatacctttcatattctggtaatgaaaaaatagaacggatcttgatcaataaaggagataacgtcgccgcaggacaggagttagtgaagattgagtccttcgatgcgcaaaatattttcctgcgcgctgaggaaaagctatcagcagagagcgctctattacgaaatctggaatctggcgaacggcctgaagagttggatattatacgttcgcagataaaaaaagcacaatcggcagaatcccaggtaaagcggcagcttgggcgatatcgtaatctttacgccaatcatgccatatcgcttgcggggtaa

SEQ ID NO: 3559 - DNA, 396 bp, Klebsiella pneumoniae
cggcgtgatgggggtgatcgtcagcgacgagcagttccaggtggtgctcggccccggcaaggcgcaaaccgccgccgaaatgatgaacggcctgctggagccggcgcccgccgccgcgccgacgctggccgacgtcgcggcggagaaaaagcaggcgctgaagggcaagcagaccagcgcggtgcagaagtttctcgccaaattcgccaccatctttacgccgctgatccccggctttatcgccgtcgggctgctgctgggcttcgccaccctggcggaacaggttttcgtgctggagaacgcccatccgaacgccagcctggtggcgctgattggctatatgaaggtcttcagcaaagggatgttcacctttctgagtatcctgatcggctataa

SEQ ID NO: 3560 - DNA, 1581 bp, Klebsiella pneumoniae
aaaaagcccggcagcgatgccgggctttttcatcatgcgtgcggattaatgtgcatcgataaagacaattttcagcacgaacagcagcgaaacaataatcacacacgggctaagctcgcgcagccggccggtaccgatcttcatcacgcagtaagagataaagcccagggcgataccttcggtgatcgagaagctaaacggcatcatcactgcggtgatgaacgcaggcaccgcctcggtcaggtcgctccacttcacgcgcgcgaggctggaggtcatcagcacgccgacgtatatcagcgcgcccgcggcggcatagccaggaaccatccccgccagcggagagaggaaaataaccagcaggaacaggataccaacgacaacggcggtcaggccggtacgcccgcccacggaaacgccggaagaagattcgatataggccgtcaccgacgaggtaccgatgaaggagcccgccaccgacgagacgctatcgacaaacagcgcttgcttcatgcgcgggaatttaccgttggcatccgcgagacccgctttatccgtcacgccaatcagcgtcccggaggagtcaaacaggttgaccagcataaaggagaagatcacgccggccaggcccaggttcagggagcccgccagatcgacctgaccaatcaccgaagccacgctcggcggcgccgagacgatcccggtgtaatgcacgtcgcccagcatccagcccagcagggtggtcacaacgatagagaccagtaccgcggcgtgaatgttgcgcgacgccagaatcgcgatgataaagaagcccagcacgcccagcagtacgctgtgggaagtcaaatgaccaatgctgaccagcgtttccggattggcgacaatcaccccggcgtttttcaggcccatcatgccgataaacaggccgataccgctggtaatacctacacgcaggctaagcggaatattggcgatcatccagtaacgtacgcggaagatggtcagcagcagcaggcccacggcgccccagaagatggcgcccatgcccacctgccacggcagccccatcgcctgcaccaccacaaaggcgaaaaaggcgttcaggcccatcgccggcgccagggcgaccggcaggttcgcgaacagacccatcaggatactgccgaaagcggcaatcagacaggtggtcacaaacacggcgctggtatccatgcccgctacgccaagaatttgtgggttaacaaaaacgatatacaccatcgtcaggaacgtggtgaaaccggcgatggcttcggtgcgcaccgtggtgccgtgctcgcgcagcttaaatacgcgctccagcagaccctggccagaagactggctggtttgttgttgactcattatcggtttccgaacgtaaggagggaaaattcgaggctatcctataccaaattacggcaccaggcgcggttgtatggtaatttttttcatttattttgcttatacggcaacgattgcgtcgcggcattgagcattacgaaaacgttaaacttgttaatatggaaaggctatgactcaaccagaagcagtattttttga

SEQ ID NO: 3561 - DNA, 243 bp, Klebsiella pneumoniae
tgcgccgccggcgccgataatcagcaggatgttggcgatggaaccaaagccgttttcggtatgagtcagcagaacgcccatccccatttgccgacggatgccgagcatgtaataggcgacaaagacggcgataaacatcgcggtgatggggttgccgataaattccagcactgtatacagcgtgccgcctttcgccatattcagttcagcgacggttttcaccagcatcaggccaatcggtaa

SEQ ID NO: 3562 - DNA, 1533 bp, Klebsiella pneumoniae
tctgactacgggacaccgactatgaccgacaaaaaatatatcgttgcgcttgaccagggcactaccagctcccgggccgttgtgatggatcatgatgccaatatcgtcagcgtctcccagcgagaatttgaacaaatttatcctaagccaggctgggtcgaacacgacccgatggaaatctgggcttcccaaagctcgacgctggtcgaagcgctggccaaagcggatatcaactccgatcagatcgcggccatcggcatcaccaatcagcgtgagaccgtggtggtgtgggagcgagagaccggtaaacccatctacaacgctatcgtctggcagtgccgccgtaccgcggagatctgcgagcagctcaagcgtgacgggatggaagagtatatccgcaaggccacaggcctggtggtggacccgtacttctccggcaccaaggtgaaatggatcctcgaccatgtcgaaggttcccgtgagcgtgcgaagcgcggcgagctgctgttcggcaccgttgacacctggcttatctggaagatgacccagggccgcgtgcacgtcaccgactacaccaacgcctcgcgtaccatgctgttcaacatccacgacctcgactgggacgacaagatgctcgacgcgctggacattccgcgcgccatgctgccggaagtgcgcaagtcttccgaagtgtacggccagaccaacatcggtggtaaaggcgggacccgtattcctatcgccgggatcgccggtgaccagcaggcggccctgttcggccagctgtgcgtcaaagaagggatggcgaaaaacacctacggcaccggctgctttatgctgatgaataccggcgaaaaagcggtcacctccacccacggtctgctgaccaccatcgcctgcggcccgcgcggcgaggtgaactacgctctggaaggggcggtgtttatggccggcgcgtctattcagtggctgcgcgacgagatgaagctcatcagcgatgccttcgactccgagtacttcgccaccaaagtgaaggataccaacggcgtatacgtggtacccgcgttcaccggtcttggcgcaccgtactgggacccgtatgcccgcggcgcgattttcggcctcacccgcggcgtgaactccaaccacattatccgtgcgacgctggagtccatcgcctttcagacccgcgacgtgctggaagcgatgcaggctgactccggcattcgtctgcacgccctgcgcgtagacggcggcgcggtggctaacaacttcctgatgcagttccagtccgatatcctcggcacccgtgtcgagcgtccggaagtacgcgaagtgacggcgctgggcgcggcctatctggccggtctggcggtcggtttctggcagaatctggatgaactgcaggagaaagcggtgattgagcgcgaattccgcccgggtattgaaactactgagcgtaactatcgttacagcggctggaagaaagcggtgaaacgcgcgttagcgtgggaagagcacgacgaagcgtaa

SEQ ID NO: 3563 - DNA, 207 bp, Klebsiella pneumoniae
agccgcaacggcaggcgtttatcagcacccacagcgggaagaaccaggataaatattcgccagtcgctggcgggggagggcggtaaagtgatggatgctatccataaaaaacgaaaggccacctatcaggtgaccttcttttcccggtttcacatcgccagtgttgtcgttttgatgggcgatacgtcgtgtcagcgggcgagatag

SEQ ID NO: 3564 - DNA, 792 bp, Klebsiella pneumoniae
gcccaacgcggcacagtcaggaaaacactaccgcgagagaaaagaatggactttaatgcgcttcaccagcaaaaccaacctttgttgcttgccaatgtctgggatgccagcagcgctcaggctgctcagcaggctggttatcaggcgctgggatcctccagcgctgctatcgccgcaatgttagggtatgaagatggcgaagagatgagttttgacgagctgttttatgtcgtctcacgcatcaaaaccgttagcgaactgccgttaagcgtcgatttagaggcgggctacggcgcgacaaccagccacatcattgacaatatccggcgtctggcgcatctcggcgtgagtggaataaatctcgaggatagtcatgtggtggatggtacgcgtcgtcttgacgatgcggagcgctttgccgtcaaactgcaggaaataacccgcgcctgtcccggtctgtttgttaatgtccgcaccgatacctttcttctcaacgtacaagatgcgctggttcagacgctctatcgcggtcaactctacgccaaacacggcgcatgcggtttttttgtgccttgcgtcacccgcgcggaggatattaccgccatcgttcaccacgtgcctttacccttaaacgtaatgtgtatgcctgagctggctgacttcagcaccttatcgacactgggcgtaaaacgaatttcgatgggcaattttatttatgctgcgacgcaggccagactgaaagacttattatgtcaggtgcaaacccaacactctttctcaggtgttttttga

SEQ ID NO: 3565 - DNA, 2139 bp, Klebsiella pneumoniae
tcacacagcgggtcgcccttgtatctgtttgaaagcctgaatcagctgattcaaaactacctgccggaagaccagattaagcgtctgcggcaggcgtatctcgttgcacgtgacgctcacgagggtcagacacgttcaagcggtgaaccctatatcacgcacccggtcgcggtagcctgcattctggccgagatgaagctcgactatgaaacgctgatggccgcgctgctgcatgatgtgattgaagatacccccgccacctaccaggacatggaacagctttttggtaaaagcgtcgccgagctggtagagggggtgtcgaaacttgataagctcaagttccgcgataagaaagaggcgcaggccgaaaactttcgcaaaatgatcatggcgatggtgcaggacatccgcgtcatcctcatcaagcttgccgaccgcacccacaacatgcgtactctgggctcgctgcgcccggataaacgccgacgcatcgcccgcgaaacgctggaaatttacagcccgctggcgcaccgtttaggtatccatcacatcaaaaccgagctcgaagagctgggctttgaagcactgtaccctaatcgctaccgcgtcattaaagaggtggtcaaagcggcgcgcggcaaccgtaaggagatgattcaaaagatcctctccgaaatcgaagggcgtttgcaggaagcggggatcccctgccgcgtcagcggtcgcgagaagcatctatactccatctactgtaaaatggtgctcaaagagcaacgttttcactcgatcatggatatctacgccttccgcgttatcgtccatgatgccgacatctgctatcgcgtgctcggccagatgcacagcctctacaaaccgcgtccgggtcgttttaaagactacatcgccattccgaaagctaacggctatcagtctttgcacacctcgatgatcggcccccacggcgtcccggtcgaggtacaaattcgtaccgaagacatggaccagatggcggagatgggggtagcggcgcactgggcttataaagagcacggcggcgaaagcagcaccaccgcgcaaatccgcgctcagcgctggatgcaaagcctgctggagctgcagcagagcgccggtagctcgtttgaatttatcgagagcgtaaaatccgatctgttccccgatgagatttacgttttcaccccggaagggcgcattgtcgaactgcctgccggcgccacgccggtggacttcgcctacgcggtgcataccgatatcggtcatgcctgcgtcggcgcgcgcgtcgaccgtcagccctatccgctgtcgcagccgctctccagcggtcagactgtcgaaattatcaccgcgccgggcgctcgcccgaacgccgcctggctgaactttgtcgtcagctcgaaagcgcgcgccaagatccgtcagctgctgaaaaaccttaagcgcgacgattcggtcagccttggccgtcgtctgctcaatcacgcgctgggcggaagccgcaaactcgccgagatcccaccggagaatatccagcgcgaactcgatcgcatgaagctggcctcgcttgacgatctgctggcggaaatcggtctgggcaacgccatgagcgtcgtggtggcaaaaaacctgcagcagggcgaagccgctgcggcgccggtaccggctaacgcgtcgaaccacggtcatctgccaatcaaaggcgccgatggcgtgttgatcaccttcgccaagtgctgtcgtccaattccaggtgacccgattatcgcccacgtcagcccgggtaaagggttggttatccaccatgaatcctgtcgtaacattcgcggctaccagaaagagccggagaaatttatggcggttgagtgggataaagagaccgctcaggagttcatcaccgaaatcaaggtggacatgtttaaccaccagggcgcgctggctaacctgacggcggcgatcaacaccgcgtcttccaatatccagagcctgaatacggaagagaaagatggccgcgtatacagcgcctttatccgcctgaccgcgcgcgaccgcgtgcatctggcgaatatcatgcgcaaaatccgcgtcatgccggacgtgattaaagtcacccgtaaccgaaactag

SEQ ID NO: 3566 - DNA, 1284 bp, Klebsiella pneumoniae
tggcgcagcggcgaagcggctcgcttacggcttaagcatccgccagcggaaccacagctgggccacgaggatcagcacgccgccgataatcttctgcagcggcagctgttcgccgtaccacagcgcggcggcaatgaccgtcagcagcggttcgagcaccatgatgatcgccgcgctggccaccgccgcgtacttctgccccttcatctgcagaccgaagcgcaggctggtagcgatgacaatgctggccaccaaccagccgagagtcggcagggtcatcggctggtcccagcgttcaacggcagcggagatggtcaacccgacgataccggtgatcgccagctgcacggtggtcagggggatcagcggtacttcacgcgcgcagcggctggtgtaacagaaccagatcgactgcaccagcgccgtcagcaaaaaccagccctggctggggtggaaggctatcggcatatgcagactgagcagccccaggccaaccaccgcgatcggcaggcactcccaccaggcgcgcggcgggcgcaccttcatcatcacccatgcggtcagcgggacgaacatcatcgacaggctcatgataaacgccccttcgccgagcgacgccgtcgtggagaccgaatagatccacaggcagaggttgagcgcaaaccagagtccgctgatgatgagttttggccagtgctgcttttgcgggcgaaaaccgcggcagaacggcagcagaagcagcgcggcgaagaaaaaacgcagcccaagaaacgcgaacaccggcatgccggcgatcgcctcgcgggaaaatatccagccgcaggcggcaatcaccgtcgcggcaatcagcagcaggtcagcctgccgttggcgtaccatacgcgcctctccctgtgtgttggcttaccagccaggcaccgcgccgccgttgaagatagtctctgccgccttcgccacctccggcgactggtacgactgcataaactccttcacgttttccgcgtctttattgtcttctcgggtcacgatgatgttcacgtagggcgagtttttatcttcgataaagatgccgtcacgaaccggcgacagcccggtttgctgcaggtaggtggtgctgatgatagccacgtcgactttgggatcgtcgagtacgcgcggcagttgcgccccttccagctccatgatcttcaggttatgcgggttgtcggtgatatccaccgccgtcggcagcaggccggtcccggctttgagggtaatcagcttctctttttgcagcagcagtag

SEQ ID NO: 3567 - DNA, 390 bp, Klebsiella pneumoniae
tcgccgggcggcccaaatgccggtaaatcaagcctgctgaacgccctggcggggccgcgaagcggcgatcgtcaccgatatcgccggtaccacccgcgacgtgctacgcgagcatatccatatcgacggcatgccgctgcatatcatcgataccgcagggcctgcgcgatgctaatgacgaagtggaacgtatcggcatcgagcgcgcctggcaggagattgcccagcccgatcgggtgctgtttatggtcgacggcaccaccaccagcgccgttgacccggcggagatctggccagactttatcgagcgcctgcccgctaaactgccgattaccgtggtgcgcaataaagccgatgtcaccggcgaagcgctcggtatcagcgaagtaa

SEQ ID NO: 3568 - DNA, 1317 bp, Klebsiella pneumoniae
agagtatcaggatttcttcttctcgcggctatgcaggccacgtttctccagaccacggtaaatcagctgctgctgaataatggtgaccaggttgctgacgatgtagtacaccaccaggccagacgggaaccacaggaagaacaccgtgaagatgaccggcataaaggtcatgatcttctgctgcatcgggtcggtcacggtggtcggcgacatcttctggatgaagaacatggtcgcgcccatgatgatcggcaggatgtagtacgggtcctgagcagacaggtcgtggatccacaggataaacggcgcatgacgcagttcaaccgaggcgctcagcatgtaatacagcgcaaggaagatcggcatctgaataatcagcgggaagcagccgcccagcgggtttactttttccgctttatacagcgccatcatctcctggctttgacgttgtttatcgtcgcccagacgctcacgcatggcctgaatcttcggctgcagcatgcgcatcttcgccatggaggtgtactgcgctttggtcagcgggtacatgatgccacgaacgataaaggtgataacgatgatcgagaagccccagttgccgaggaagctgtggatgaatttcagcagcttgaacagcggttgggagatgaaccacagccagccgtagtcgacggtcagatccagatgcggcgcaacggcagccattttgtcctgaatagccgggccgacccacagcgtgctctgcagtttgtcggtctggcctggctgcaccagtaccggctgcgatttgtagccaatagcgacaacgccgttgccgaggttggcggtgtagaagttattcgtcccgttattccgcggcacccatgcggtggtgaagtactgctgcagcatggcaacccaaccgtttttggtgctgacgttcaggttttcgttatccagaatggtatcgaatttatatttctcgtatttcgaatccgcagtggagaacgcggcgccacggaaagtatgcatcgtggacaggccaccggtctgcgtatcgcgactggtcggcagcgcagcggtctgcttcagctgaccgaaggtcgagacttccagaggcttctcgctggcattctgcacgctgtaacccacgttcaccgcatagccaccgcgcttcagggtgaaggttttggtgaagacgttgccggctttgtcagtgtaggtcagcgggataacgagctcatcctggccatcggccaacacaaacgcctctttatcgacgttgtacagcggacgcgggccgtttgccgggttatccggaccgtcacggccggttaa

SEQ ID NO: 3569 - DNA, 1038 bp, Klebsiella pneumoniae
acaacatcaggatgcctgatgaacgcacttaatgctgcaatgactgtgatcggtgccggctcttacggcaccgctcttgccatcaccctggcaagaaatggccaccacgttgtgctgtggggccatgacccgaaacatatcgcgacgctgcaacacgatcgctgcaacgccgcgttccttcccgatgtgcctttcccggatacgctgcatcttgagagcgacctggccaccgcgctggccgccagccgcgacatccttgtcgtggtgccgagccatgtattcggtcaggtgttacgccagattaaaccgctgatgcgttccgacgcgcggctggtgtgggccaccaaaggccttgaggccgaaaccggccgtctgctgcaggacgtggcgcgtgaagcgctgggcgatgatattccgctggcggtgatctcggggccaaccttcgccaaagagctggccgccggcctgccgacggcgatttcgctggcggccacggatccgcagtttgcggaggaccttcagcgcctactgcactgcggcaaaagcttccgcgtctacatcaacccggactttatcggcgtgcagctcggcggcgcggtgaaaaacgtcattgccatcggggcaggtatgtcggatggcatcggcttcggcgccaatgcgcgtacggcgctgattacccgtgggctggtggaaatgtcccgcctcggcgcggcgctgggcgccgatccggaaacctttatgggcatggccggcctcggtgacctggtgctcacctgcaccgacaaccagtcccgtaaccgtcgcttcggcatgatgctcggccagggtatggacgtgcagagcgcccaggacaagattggccaggtggttgaaggctaccgcaataccaaggaagttcgcgttctggcacagcgtttaggtgtcgaaatgccaataaccgaggaaatttatcaggtattgtattgcggaaaaattgcgcgcgaggcagcattgaccttattgggtcgcgcccgcaaggacgagcgcagcagcaattag

SEQ ID NO: 3570 - DNA, 249 bp, Klebsiella pneumoniae
cacgaaacaggttggccgcgagctcagtcgatcccatatagtcgagtattttttggcttttctttaggccttacgctcatggattgctttttggtcaagaccaccatagagacctttataaccatggttttgaaagacagcaaaatcaagagtcgtctcaacaccagcacgttgggccgtttcaaccagatgtttattatgctctttgagctcattgcgcaggaacagtcgcttttcatcctctcgtag

SEQ ID NO: 3571 - DNA, 378 bp, Klebsiella pneumoniae
ccgctgaaaggttatctcaacgcccgaaacgacaatggaagaacaatgaaaagcagacgactgttaaagctggtcctgttcagcgggataataagcctgagcggttgctccagcgtaatgtcacataccggtggcaaagagggaacctatccgggcacgcgatccagtgcgcaaacgctgggggacagcgataccaactggggtgtgaaatcgctggtggcgctggacatgccgttcaccgccgtcatggataccctgctgctgccgtgggatatgttccgcaccgacagctcaatcaaatctcgggtcgaaaagagcgagaaggctacgctggcgaccaactcggtgatcccgccagcgccgatgcctgcccagtaa

SEQ ID NO: 3572 - DNA, 1773 bp, Klebsiella pneumoniae
atcctggaaggcgcttcgcaaggcgaaaaagcttccgtcgcggctcgcggcattctgccgcagactctccgcgaggtgatggaggaggggactgcaatgcgtaaaggagggtggtggctggcgttagggatgttctctgccagcgcgctggcgacgtgtccggactggccgccggccagaggaaggcaggagacatcacgccttcatcagcaaattgtcgcctggaaagaggcttactggcggcagggcgctagcggagtgagcgatgacgtttacgaccagctcaccctgcgcctggcgcagtggcgacaatgctttccgggcgcgacgcctgaggatgacgatctgcctccgcccaccggcgatgcgcgtcatccggtggcccataccggcgtgcgcaagctggcggatgaggacagcgttgcccgctggatgaaaaataaatccgacctgtggatacagcctaaagtggacggcgtggcggtgactctcgtttatcgccaggggcgtctggttcaggccattagccgcggcgatggtttacgcggtgaggcatggaccgcccgagcgcggcagatcccggcgctggcgaaagtgatgaccggtgaactggccgacagcgtactgcagggggaactgtttctgcgccgggacggccatgtccagcagcaggccggggggatgaatgcgcgggcgaaagtcgccgggttgatgatgcgagccgacgcggcggcggcgctcagtcaactggacgtttttatctgggcctggccagacggcccgtcggatatgcgccgtcgtcagaagctgctggcgcaggcggggtttaagtacagcggacaatatacccatccggtgtcgagcatcgagcaggtggcgcagtggcgccagcgctggtatcgctcgccgctgcccttcgtcagcgacggtgtgattgtgcgcgaaggacgcgagccgccgggacgagtctggtcgcccggaaagggcgagtggctggcagcctggaaatatcctccggcatcgcgggtgatgcaggtacgggcgatccgtttcagtaccggccgcagcggcagactcaacgtggtggccgagcttgagccccagcggctggatgataaacgcgtgcagcgggttaacgttggctctgtgtcccgctggcagatgctggatattggggttggcgatcagctgcaaatcagtctggcagggcagggtattcctcgggtcgacgccgtcgtctggcggacggccgagcgccataaaccgacgccgccgccggcgaaattcaatgcgctaacctgctatttcgccacccctgagtgcagcgaacagtttctttccaggctgatctggttgtcatcaaagtccgccctgaatgtcgatggcgtgggggaaaatttatggcgcgtcattcagcagcaaaacccgatgacgcatatcttttcctggctggcgcttaccgttgagcagctgcaggcggtgccagggatttccgccgcccgcgggcagcacctctggcatcagtttgatctcgttcgcaaacgaccttttatccgctgggtgctggcgatggggatcccggtgccgcagggggcgctggcgcagctcgaaagcgagaactggcatctgctggcggcaaaaagtgaagcgcaatggcgcacgctgccgggcgtgggggagatcagagcccgccagctggtggctttcctgcaccatccggacgtggtggcgctggcgcaatggcttagcgggcagcgcatccccggattttaa

SEQ ID NO: 3573 - DNA, 222 bp, Klebsiella pneumoniae
tgctcgacgggaacgtcggccagcagtattccactggctggtttggtgacaatgccggcggcgaaaactacattcaattctcggatatgtatgttaacaccaaagggttcctgccgtttgcgccggaagccgatttctgggtcggcaaacacggggcgccaaaaattgaaatccagatgctggactggaaaacgcagagaaccgatgcggcggccggcgtag

SEQ ID NO: 3574 - DNA, 282 bp, Klebsiella pneumoniae
aaccctcagggtaacaacaggagtgaagtcatggccaatattgagatctacaccaaagcgacctgcccgttctgcatccgcgcgaaagcgctgctgaacagtaaaggcgtaacgttccatgagttgccgatcgatggcgatgccgcgaagcgtgaggagatgatccagcgcagcggacggacgacggttccgcagatttttattgatgcgcagcacattggcggctgtgacgacttgtatgcgcttgattcacgtggtggacttgatcccctcttgcgctaa

SEQ ID NO: 3575 - DNA, 1206 bp, Klebsiella pneumoniae
aaattccagggagaactcgtgatgattatttccgccgccagcgactatcgcgccgccgcacagcgtatcctgccgccgtttctgttccactatattgacggcggcgcctacgccgaacataccctgcgccgcaacgtcgaggacctttccgatgtagccttgcgccagcgtattttgcgcaatatgtcggacctgagtctggaaacgacattattcaacgagaagctggcgatgccgacggcgttggcgccggtcgggctgtgcgggatgtacgcccgccgcggcgaagtgcaggccgccggcgcggcggacgacaaaggcattccgttcaccctctctaccgtttccgtctgcccgatcgaagaggtcgccccgaccatcaagcgcccgatgtggttccagctgtatgtcctgcgcgaccgcggctttatgcgcaatgcgctggagcgcgccaaagccgcgggctgctcgacgctggtctttaccgtcgatatgccgactcccggcgcccgctaccgcgacgcccattctggcatgagcggcccgaacgccgccctgcgccgctactggcaggccgtcacccatccgcagtgggcgtgggacgtcggccttaacggtcgcccgcacgatctgggcaatatctccgcctatctcggcaaaccgaccgggcttgaggattacattggctggctggcgaataacttcgatccgtcgatttcatggaaagacctggagtggatccgcgatttctgggacggtccgatggtgatcaaagggatcctcgatccggaggacgcccgcgatgcggtgcgcttcggcgctgacggcattgtcgtctccaaccacggcggccgccagctcgatggcgtgctctcctcggcccgcgccctgccggcaattgccgacgcggtgaaaggcgacatcactattctcgcagacagcggcatccgtaacgggctcgacgtggtgcggatgatcgctctgggcgccgacagcgtgctactgggccgcgcttacctgtacgccctggcgacccacggtaagcagggcgtggcgaatctgctgaacctcatcgagaaagagatgaaagtggcgatgaccctcaccggggcgaaaagtatccgtgaaatcagccgtgattcgctggtgcagaacgccgaagcgctgcagaccttcgatgcgctgaagcagaataacgccgcgtaa

SEQ ID NO: 3576 - DNA, 588 bp, Klebsiella pneumoniae
ggctcaatttttgacaggagtggcaggatgaaaaagaaactgaccgccgccgatatgcacgacccgcaggtcatcgccgagacgccgtggttcagcatgcgtaaggtgggtattgatgttgcccccggcgaacgccgcgacttttattccattcattacccgcgcccggcggtggggattgtggccatccaggatgagaaggtgctgctgattcgccactaccgctacctgatcgataaggtggtgtgggcgatcccctctggcggcgtcgatgaaggggaagacccggcagtcgccgcgctgcgcgagctgcgggaagagaccggctggcaggcgcaacgcgttgaggagatcattcgctttaacccctcctacggcagcagcgatcagctgtttatcacctggctggccaccggtttacactgggtggggatggatgcagatcagaatgaggtgatggagaccggctggtttaccttcgacgagataaaccaactgatcgcccgcggcgagatgccggacgggctgtcgctggtgccgctgctgcagctgatggcgcagcggcgaagcggctcgcttacggcttaa

SEQ ID NO: 3577 - DNA, 1389 bp, Klebsiella pneumoniae
ggagtatttatgaaattaaccgtattaggcgggggcggcgttcgctctgcatttttagcgaaatctctggcctataacgctcaccgcattggtttaacagaagtcgtttttctcgataactctgctgataatctggcgatatttggcgaaattgcccgctatgtatttaataccattcgcccggatattcagtttagtaccaccaccgacccggtcgcagcgctgcaggacgccaactatatcattaccaccctgcgggttggcggcgatgaaagccgcattcgcgacgaacgtattgcgcttgagcataacactctcggccaggagaccaccggcgccggcggtttcgcgatggccatgcgctcgatcccggcgatccttcgctattgccggctgatcgaagaacatgccgccgaagacgccattctgtttaactttaccaacccgtcaggtctggtgacggaagcgattattaagtccggctttaagcgccgggtctatgggatctgcgatgccccctccgagctgattcgtgaactgccggcgatccttggctgtgaggagcgcgacctcagcgtggaatgctatgggctgaaccatttctcctggtttacccacttcaccgtccgtggggaagaggtgaccgaacggctgatcgccagcccggaactgtaccagaagacggcgatgcagtacttctccccggagctggtacggctttgtgataatcaactcctcaatgaatatctctattattactactatcgcgacgaggcgctgaaggcgattcagggggccggcgagacgcgcggagagcagatcgcccgcatcaatcaggagatgcgcgaggcactgcgcaccgtggatgccagaacgcaaccggaggccgccttcaccatctggatgcagcattacctacgccgggaaaacagctatatgcagaacgaatcccggcaggagaaattccacacccgcgaaccgctgacgctgcgccagtttatcgaagagccggacaccggcggctatgccggagtggcgctggatatcctggaagcggtgaacagcaccaccaccaagcggatcgtggtgtcgatccagaatcacgacacgctcgactttttgcgccctgacgacgtgatcgagatcagctgcgacctgagccgggatggcctcaagccggtgacgccggtgaaggtaccgacggcgcagaagaatatgattgcctgcgtgaaagagtatgagcggctggcggtggcggcgatcctgcagcaggataaatcgctggcggtgcgggcgctgatggcgcacccgctgatcggttcctattcgctggcgaaaaccctggtcgaagcctatctcgacgatgagcagttcgccgcctggcggtaa

SEQ ID NO: 3578 - DNA, 1644 bp, Klebsiella pneumoniae
gggaatattatgatgagaaaaaacaggatcgcttcggcgatagtcttgctggcgccactttgttattcaactaatctgctagcgagccagttgacggtggaacaacggcttgagctgctggaaaaagcgctcaaagacacgcaaaaagagctcaaaaaatatcaggaccaggaaagaaaaagagaccagatttgggcctcatggtctcctcctgcggaaggtcagaagcgcaagaccgggggggcgaccgccgggccgaaaacggcggttaaaccggatgcggtgctggttaaaaatcaacaacctgtcaccgatggcgcgccagcctacagcgcgatgacgctgaaagactttagcaagttcgtgaaagatgaaattggctttagctataacggctacttccgttccggctgggggaccgcctcgcacggctcgccaaaatcatgggcgatcggttcgcttggccgcctgggcaatgaatattccggctggttcgatctgcagctgaagcagcgggtgtttcaggaaggcgataaacgcgtcgacgccatcgtgatgctcgacgggaacgtcggccagcagtattccactggctggtttggtgacaatgccggcggcgaaaactacattcaattctcggatatgtatgttaacaccaaagggttcctgccgtttgcgccggaagccgatttctgggtcggcaaacacggggcgccaaaaattgaaatccagatgctggactggaaaacgcagagaaccgatgcggcggccggcgtagggctggaaaactggcaggtgggcgccgggaaattcgatatcgcgttgattcgcgaagatgtcgatgattatgaccgttctttaagcaataagcagcaaattaacaccaacaccctggacgttcgctacaaagagattccgctgtgggataaagccagcctgatggttagcggacgctatgtcgccgccaaccaaagttcctctgagaaatataaagagggcaatgaaggttattatccgtggaaagatacctggatggctggtacctcgttaacgcagaaatttgctaacggcggctttaacgaattctctttcttactggccaataattctattgccagcagcttctcacgctatgccgggtccagcccctataccacctttaatggccgctattatggcgatcataccaatggcaccgccgtgcgcttaacctcgcagggggaaacctatttacgcgatgacgttattatggcgaatgccatcgtctactcttttggtaacgacgtctatagctacgaaaccggagcccactccgattttgaatctatccgtacggttctgcgaccggcttatatctgggatgaatataaccagaccggcgtcgagctggggtacttcaaacagcaaaacaaagatgttaccggcaagaaatataacgagtccggctacaagaccacgctgttccataccttcaaagtcaataccagtatgctgacctcgcgcccggaaattcgtttctatgccacctatattaaagcgaaggatattgacctggataaggccgcgaataataccaccagcatttttgaagacgggaagaacgatcagtttgccgtgggggcgcaggcggaaatctggtggtga

SEQ ID NO: 3579 - DNA, 1374 bp, Klebsiella pneumoniae
cctcgaattttccctccttacgttcggaaaccgataatgagtcaacaacaaaccagccagtcttctggccagggtctgctggagcgcgtatttaagctgcgcgagcacggcaccacggtgcgcaccgaagccatcgccggtttcaccacgttcctgacgatggtgtatatcgtttttgttaacccacaaattcttggcgtagcgggcatggataccagcgccgtgtttgtgaccacctgtctgattgccgctttcggcagtatcctgatgggtctgttcgcgaacctgccggtcgccctggcgccggcgatgggcctgaacgcctttttcgcctttgtggtggtgcaggcgatggggctgccgtggcaggtgggcatgggcgccatcttctggggcgccgtgggcctgctgctgctgaccatcttccgcgtacgttactggatgatcgccaatattccgcttagcctgcgtgtaggtattaccagcggtatcggcctgtttatcggcatgatgggcctgaaaaacgccggggtgattgtcgccaatccggaaacgctggtcagcattggtcatttgacttcccacagcgtactgctgggcgtgctgggcttctttatcatcgcgattctggcgtcgcgcaacattcacgccgcggtactggtctctatcgttgtgaccaccctgctgggctggatgctgggcgacgtgcattacaccgggatcgtctcggcgccgccgagcgtggcttcggtgattggtcaggtcgatctggcgggctccctgaacctgggcctggccggcgtgatcttctcctttatgctggtcaacctgtttgactcctccgggacgctgattggcgtgacggataaagcgggtctcgcggatgccaacggtaaattcccgcgcatgaagcaagcgctgtttgtcgatagcgtctcgtcggtggcgggctccttcatcggtacctcgtcggtgacggcctatatcgaatcttcttccggcgtttccgtgggcgggcgtaccggcctgaccgccgttgtcgttggtatcctgttcctgctggttattttcctctctccgctggcggggatggttcctggctatgccgccgcgggcgcgctgatatacgtcggcgtgctgatgacctccagcctcgcgcgcgtgaagtggagcgacctgaccgaggcggtgcctgcgttcatcaccgcagtgatgatgccgtttagcttctcgatcaccgaaggtatcgccctgggctttatctcttactgcgtgatgaagatcggtaccggccggctgcgcgagcttagcccgtgtgtgattattgtttcgctgctgttcgtgctgaaaattgtctttatcgatgcacattaa

SEQ ID NO: 3580 - DNA, 1149 bp, Klebsiella pneumoniae
caagttgttatcctaaagattcagtattacaggtattttgcgaatatcatgaaactgcgacaagtctgtgaccgaaaactcagactaatctattgcgacaccgggaaaccgggcaggtcatatcttatttcgccagcagacattgagggactgatgcaagaaaagatacactggatcaccaacctgcgcggcatcgcctgcatgatggtggtgatgatccacagcaccagctggtatatcactcacccccatgcgattaccctgctgcaatgggatatcgccaatctgctcaattccgcctcccgcgtcagcgtgccgctgttttttatgatctcgggctacctcttttttggggaacgcagcgcccagccgcgccatttctggcggattggcctgtgcattgcgttctatagcgcactatctctgctgtatatcacgctgtttacccatatcaacgtcgagctgtcgttaaagaatttgctgcagaagcccgtcttctaccacctgtggtttttctttgctatcaccgtcatctacctgctctcgccgctgattcaggttaagtccaccagtagcacaatgctgctggcgctgatggcgatcctcggcattctggccaaccccaatatggtcagcgttaaagccgccgggattgagtggctgccagtcaacctctatatcaacggcgacaccttctactacgtgctctacggcgtgctgggcagagccattggcaccctggacaccgataaaaaatggctaacaccgctctgcgccgcgctgttcatcgccgccgtgtgggtcatttcccgcggcacgctgcatgagctgcgctggcgcggagacttcggcgacacctggtatctctactgcggaccggcggtgtttgtttgcgcggtcaccctgctgacgctggccaaaaactggcttaacgcgcgtcccctgcccggtatcgcctgcattgcgcgacattcgctggggatctacggctttcatgccctgatagtgcatgcgctgcgcgccagccatctggagctatcccgctggccgctgctggatattgtgtggatatttagcgccgccctgctcggcagcctgctgctgtcaggcctggtgcagcggattgatagccgccggctggtcagctaa

SEQ ID NO: 3581 - DNA, 1668 bp, Klebsiella pneumoniae
ggacagcctatgaaagtcgacaaactatatatccgctcacgctttaaaaatctagaaaacgtgaaagtggattttgacgaaaatcatctgatgaccgttgtggtaggtcgtaatggttccggtaaatccaacgttctagaagccttagtatctatattccgcaatcttgacttaggtgaggcgccagcgttttcatacgaactgacttatcgattgggtgaacctcacaaacccaatcgacccagtaatcgatggctggaaatcactattgatgccgatccaaatcgcggaacgctggcaaagcaatacgaagtacgtatgcgcaatcttttgaatgacagcttacctgaagacatatttgatgaaaagactttaggtatagttattccattttcaaaggttaagcgcaataaagaaggtaaagcgccgtacctgcccaactatgtgtttgcctactattcaggtcctagtgatcgattagaaagctacttcaagaaacatcggacagatttttatcgtcatttattaaatgataagccggataaaaagctaaatcttaagggcgacattcgtccgcttttttatgcaaaaccctaccacagccagtttgtactcttggcatttttcttatctgacgaaaatagccctcagcgcacttttattaaggaacatttaggcatagaagatttagatagcattcactttgtgatgcgacaacctggctgggcaaaacaaaaaggcgagctattctggggtgcacgtggcgtagtccgccgtttcctagatgagctaataaaatatacgctagcacctataaaagtgacacgacaagaagatacatctttaactggtagtcatgttcgaaacgaattttttcatttatttttacctaatgtcgaagtactacacacatttgcaaaaggattaagtgatgacgagctttttaaaatgctcgaaagtacactgctatcagaaattatctctgaagtaagtattcgggtgaaagtatccagtagcaaagtacctcttactttccgagaactcagcgaaggagaacaacaactactaaccgtgttgggactactcaaattcaccggcggcaaagactccttgtttttactcgacgaacctgacacccaccttaatccgtcatgggccattaagtatctgaaattcctgcgtgaattcgtacccaaccatgaaactagccatttactgatggttacacaccatcctttggctattgctgagctaaagaaacagcaagtccaagtcatgtggcgtgatgatgagtataatgttcactcacaagaaccttacatagatccacgtggtgctggttttatggccacacttactgaagtttttggtctaaatacaacattggatcttgagacccaaaagttactggatgataggaacgaactggcccacatcgaaagccgaacagaagctcagagcaaccaactagatctccttaatgatgagttaaacagacttgggttttcatttgaaaacagagatccattatacagtgagttccttttagcatggcaagatctaaaatacagtgaaaggccacccttaacgccagataaagcagctcagagacgagttgccatgaagaaggtaattgaggtacttcaagctaagaaggctagcgaatga

SEQ ID NO: 3582 - DNA, 402 bp, Klebsiella pneumoniae
tgtagcactatgtgctatacttttaacgacaggatgtcagcaatgcgtatctttaaaaccaaatggttcgccagagaggctagctctcatggcatttccgacgacgagctctatcaggcaattcaatctgcgcttcagggcaaggtggttgatttaggaggaggggtttataaaaagcgactcaacaagaatcgcgatcgcgcaatcatacttaccaaaagcgcagggtattggttttatacctttctatatgccaaacaggatatggccaatatcaaccatcgcgagttaatgggttttcgtgagttagcaaaacactatgccaatctctctgaagagaaaacgacggtcttagttaaaagtaaagaactggtggagatttgcgatgacagcaaaaaataa

SEQ ID NO: 3583 - DNA, 681 bp, Klebsiella pneumoniae
cgaatgattttcatcaaacgagacgctgcgcttattcctgaaaaggtacttaatgttgctcagcgggcacaaaatgctctggaacaattacccgccgagcagaggaaagatttcatcaagaaaaagtctcatatatggagaggcttttcaaagtatcttgccaaaatgtcttatggtaagtgctggtattctgaggctaaagatgcgggtgcaaatttcgatgtagatcatttcagacctaaagcagaagcaaaaagggctgaaaatttagtcgatgtcgaaggttatgcatggttagcatttgattggaaaaacttccgactttccgctcaaaattgtaaccgtttgaacacggatgaatcaggtaacaccgtaggtaaaggtagctggttccccctgctaaatggtagccctaaagcaagctgggataatcgttgtattaatgatgaaagagtcactcttctggaccctgtagttcaagctgacctcacctatatagactatgacgacaacggtagatttacttcgagtagacactgtattggacaagcagcattaaggatacaacagtctgctgttatttatggtcttaattttgagaaaatgcgtgaagcacgatttcaggtcatgagagaagcaaaagaacttctcgaaactattcaacaaagtgttgaggactaa

SEQ ID NO: 3584 - DNA, 1206 bp, Klebsiella pneumoniae
aaaggtgatatctcccgtaccggcatggcagcaggcaatccgatcctccagcgcaaaacccagccactctcccgacggatgccagttaaacgccgactggatacccgacgcgtgatgcgtcaactgccgcggctcgcccccctgcggggaaataagccacagctgcactacgccggcgtcgtcgcgcatcagaaaggctatcgccgtcgcctggggattggcgcgcacccagtggcgcgggacgttcaccagtcccgggtagcggcgatggtgggtgaaggtcaaacgacgctggctgacgcccgccggcggcgccggcattgtggttgcggtaccggccagcggcgccccgccaggctgcttccagccggcttcatcctgcggcagatcgacaataaacagctcaggcactttatcgccattttccgccagcgtatcgccaataaacgccagagtatggttcccgacccagccctcctcataggcgcgattaatctcatcgctgcccggcgcgggtgccggcgtcgtgcggcttaccagcacgcaccagtggctgccgccatattcgcgcggatgctgtccctgcggcgtcaccggtccatagggcgccgccacgccgacgttgcgcagatccagcgccggatcgcgctcgtgcagcacgtgatcgttgtaggtaaaactgacaaactgaccgttggggctatagacatggacgtggctgccgccgcgcagcgcgccgggcgtgtaggggggggtaatgtccatggcgtccagattctcgacagccccctgaaaggccaccaccccgcggcgatgatgaaaatcatactgccactgcgcatccggccgctcggggccatgaataaacacatagcgctcctgggttggatgcacggttaccacgcccacgtgcgcgccctgcgtggcacgataaatggtctccacagtaccgctgtttacgttcactcgctcaatggtttcgccggtaaacgatgcgccggacggacgaacgtcgaataccagccactggctgtcgggagtccaggtattaatattggtaagctggtgatgacggggagcaaaagtgacttgtttcatgacgataccctgatgcgagacttacgcatcagggtagcgtatcgcaaaaaattagcctacacgtttcacatcgccgaccagcaggatataagacagcgcgcctattaa

SEQ ID NO: 3585 - DNA, 477 bp, Klebsiella pneumoniae
agtatggatatgaaaatgaagactttgatgaactttattgtgctgataattcctacatttttttcaatgaaatcttttgcagaaaataaactttgtgaagcgaatacaacgttcttttttgctaacaataaagcacatacaaagtctgttgaactttgctatgaaaaaaagggggttaaatatatctttggtccagaaggtaaaccagaaatcacattagaagtttccagagaaaaaattatctatgaatatgagaatggttgtgaaaacaataccattcctaatgggaaaacggattactatatttatcagtgcgggagtgcacctcaaacagatcccactttacaagttaatcaatatggtaatcctgttgctacaattgaattagatggcaaggatgggaaatacttaaatgccatttctgatgctggttatgagcaactgagtaaaatccgccttcacagaaggcggtattaa

SEQ ID NO: 3586 - DNA, 939 bp, Klebsiella pneumoniae
cctccttgtataaaaaccccgcttcggcggggttttttgtttttaaaactcccccatattgctttcacatactcccttttcagtcacctgtccgtgaagcacaatacgtcgggtaaacggaggaaaatcatgcctgaattaccagaggttgaaaccagccgtcgcggcatcgagccgcacctggttggcgcaaccattctgcacgccgtcgtgcgcaacggacggctgcgctggccggtttccgaagagatttatcgcttgagcgacgttccggttctcagcgtgcgtcgccgcgccaaatacctgcttctggagctgccggacggctggatcatcgtccatcttgggatgtcggggagcctgcgcatcctgagcgaagagctgcctgctgaaaaacacgatcacgttgacctggtcatgagtaacggcaaggtgttgcgctacaccgatccacgccgctttggcgcctggttgtggaccagaacgctggaaggccatccggtactggcccatcttggcccggagccgctcagcgacgcgttcaacgccgactatctccagcaaaaatgcgcgaagaagaaaaccgcgatcaaaccctggctgatggataacaagctggtggtgggcgtggggaatatctacgccagtgaatcgctgttctccgccgggatccatcctgaccggctagcgtcctcgctgtcgcgggaagagtgtgagcagctggtgaaggtgattaagctggtcctgctgcgttcgatagagcagggcggcaccacgttaaaggatttcctgcaaagcgatggcaagccgggctatttcgcccaggagctacaggtctatggccgcaagggcgaaccctgccggatctgcggcacgccggtcgtcgggaccaaacatgcccagcgggcgaccttttattgccgccagtgtcagaaatag

SEQ ID NO: 3587 - DNA, 483 bp, Klebsiella pneumoniae
gggggcagtatgctgaacatcgtgttattcgaaccagagatcccgccgaacaccgggaatattatccgcctgtgcgccaacacgggcttcagtctgcatatcattgagccgatgggcttcacctgggacgataaacgcctgagacgcgccggactggactatcacgagttcactgccgtgcagcgccatgcggattacgcggcgtttgtcgccagcgcgcagccgcagcgtctgttcgccctgaccaccaaaggcacgcctgcgcacagcgcagtgagctatcaggacggcgatttcttgatgtttggcccggaaacccgcggtctgccggccagcatcctcgatgccctgccgccggagcagaaaatccgtattccgatgatgccggacagccgcagtatgaacctgtcaaacgcggtgtcggtggtggtgtatgaagcctggcgccagctggggtatcctggcgcggtcttgcgcagctaa

SEQ ID NO: 3588 - DNA, 603 bp, Klebsiella pneumoniae
aaaacaatcatactttgggactcactcaaacaaggatacgttatgaacgaacagcagccatttgaagcgattagaaagagcgatgaggcggggcgggagtattggtctgcccgcaaccttggtcccctgcttgactataaagagtggcggaatttttataaggtcattgcaaaagcgataatttcatgtgaggcgagtggtcatccctcggcagaccattttgttgaaaccaacaaaatggtcgaattaggttctggcgccagcaggaatcttgaagatttccacctctcacgctacgcctgctatctggtagtgcaaaatggcgatccgtcgaaaccggtgattgctgcggggcaaacgtactttgtcttgcaaacccggcgccaggaattgcaagatgatcaaatatttaagtctctacgagaggatgaaaagcgactgttcctgcgcaatgagctcaaagagcataataaacatctggttgaaacggcccaacgtgctggtgttgagacgactcttgattttgctgtctttcaaaaccatggttataaaggtctctatggtggtcttgaccaaaaagcaatccatgagcgtaaggcctaa

SEQ ID NO: 3589 - DNA, 510 bp, Klebsiella pneumoniae
ggatatgtcatgacaggatgtccggcgaatttgcctctcactcatgcccccggccagcaacatgacactccctttcaggctgtcgtggtggaggcgcatcattgccatcaaccgcaggcgttctatgcgcagcttcgtcaacaggggctcaccgctatccattttattccgcagctggcggccggcgacgccgcgctttggggagagtttctctgcgcagtctttcaccgctgggtgcgggaagatattgggcgcatcaatattttactgtttagcgagacgctgagcgcctggtgcggggagacgctgacccagccaggcgcgccggcggccaacagcacctgctacggctgcccgtggctgcgcctgtgccgctgtagcgaacaggaagacccgctgtgcgcgggttaccggcagttctacgattttagcgggccctatatgcgagtgatgcgggacctgcggcgacagcagcggccgccagaggcgctgatgccgctgctgcgctaa

SEQ ID NO: 3590 - DNA, 1281 bp, Klebsiella pneumoniae
tccttccccatgaggggaaaggcgatgtattcaactacatggatcgcagcggcagttcgatccgtcctttacgccagcgcgctcagcgctggcgtattgctgtgcgcgtcatctgcgcatgccgacgatcgcgatcagctaaagtccatccaggccgacatcgccgccaggcagcgggcgattaagcaacagcagcagcagcgcgcaagcctgctcgcccagctcaaagcgcaggaagaggcgatcgccgccgcggcccgcaaactgcgcgaaacccaggatagcctgaaccagctcaataagcagattgacgagatgaacgccgctctcgcgaagctggagcgccagcgcgcgtctcaggagcggaacctcgccgcgcagctcgatgccgctttccgccaggggccgcataccggcatccagatggtgctcagcggtgaagagggccagcgcaatcagcggatgcaggtctatttcagctatttcaaccaggcccgccaggagactatcgcggagttgaagaaaacgcgcgaagagatggcggtgcaaaagtcgatgctcgaagaaaaacagagccagcagcaaacgctggtctacgagcaaaaggcccagcaggcgaagctggagcaggcgcgtaacgaacggaaaaagaccctttccggcctggagtcttccattcagcagggtcagcaacaattaagtgaattacgggctaacgaatcgcgcctacgcggtcgtatcgcccaggcggaggctgccgccaaagcccgcgccgatcgggaagcacgcgacgcgcaggcggtgcgcgaccgccagcaggaagcatcgcgcaaaggcaccacctataaaccaacggaaagtgagcgttcgctgatgtcacgcaccggcgggctgggctcgccgcgcggtcaggcgttctggccggttcgcggtccgctccttcatcgatatggcgaacagctgcaaggtgaactacgttggaaagggatggttatcgccgcgtctgaaggcaccgaagtcagagccattgccgatggtcgggtcattctggccgactggctgcagggctatggtctggtggtggtggtcgaacatggcaaaggcgacatgagcctgtatggctataaccaaagcgcgctggtcagcgttggtacccaggtgcgtgccggccagcctatcgcgctcgtaggcagcagcggcggtcagggccgtccgtcgctctatttcgaaattcgccgccagggtcaggcggtcaatccacagccgtggttgggaagataa

SEQ ID NO: 3591 - DNA, 696 bp, Klebsiella pneumoniae
agagtcaccatgagccataacgacactatcgtcgcccaggcaacccctccgggacgcgggggtgtgggcatcctgcgtatctccggccttaaggcgcgcgacgtcgcgcaggcggtgctgggcaagctgccgaagccgcgctatgccgactacctgccgttcaacgacgttgacggtaccccgctggatcaggggattgcgctgtggttccccgggccgaactcctttaccggggaagatgtgcttgagctgcagggccacggcggcccggtcattctcgacctgctgcttaaacgtattctgaccctgccgggcctgcgcatcgccaggccgggtgagttttccgagcgcgcgttcctcaacgacaagctcgatctggcgcaggcagaggccatcgccgaccttatcgacgccagttcagagcaggcggcgcgctcggcgctgaattcgctgcagggggcgttctccgcgcgggtaaatcatcttgtggaagcgctcactcacctgcgcatctacgtggaagcggccattgacttcccggatgaagaaatcgatttcctctccgacggcaaaattgaagcccagctgaacgaggtgatggccgatctcgacgccgtccgcgcggaagctcgtcagggcagcctgctgcgcgaagggatgaaagtggtgatcgccgggcggcccaaatgccggtaa

SEQ ID NO: 3592 - DNA, 819 bp, Klebsiella pneumoniae
ggaaccgccatgaaccgtattagcgcactgatccttgactgggcaggcaccaccgtagacttcggctctttcgccccgacgcaaatcttcgtcgaggccttccgccaggccttcgatattgagataacccttgaagaggcccgcgtgccgatggggcttggcaagtggcagcacattgaggcgctgggcaaactccctgctgtcgatagccgctggcaggccaaattcggccgcgcgatgacggccgccgatatcgatgcgatctacgccgcgtttatgccgctgcaaatcgctaaggttgtcgatttttccgtaccgattgccggcgttgtcgacactatcgccgcgctgcgcgccgagggcctgaagatcggctcctgctcgggctatccgcgtccggtgatggaaaagctggtaccggccgccgccgcccagggctacgccccggactactgggtcgccaccgatgaccttgccgccggcggtcgtccgggcccgtggatggcgctgcagaacgtgattaccctgggcatagacgatgtggcccactgcgtgaaggtcgacgacgccgcgccgggcatcagcgaagggttacatgccgggatgtggagcgtcgggctggcggtgtccggtaacgaattcggcgctacctgggaggagtaccaggggatgtcgaaagaggaaatcgccacccgccgcgagcgggcggcagacaaactgtatgccgccggggcgcattatgtggttgataccctggcggacctgccggacgtgattgccgacatcaatgcccggctggcaaaaggcgagcggccttaa

SEQ ID NO: 3593 - DNA, 2079 bp, Klebsiella pneumoniae
gaggcggccatgtctgagaatacttttctggtggaaatcggcactgaagagctgccaccaaaagcgctgcgcagcctggcggaatcttttgctgcgaatgtgaccgcggagctggataacgctggccttgcgcacggtaaagtggaatggtttgccgccccgcgtcgtctggcgctgaaggtggccaacctggcggcggcgcaagccgatcgcgaagtggaaaaacgcggcccggctattgcccaggcgttcgatgccgaaggcaagccaagcaaagcggccgaaggctgggcgcgcggctgcggtatcaccgtcgatcaggccgaacgtctgaccacggacaaaggcgagtggttgctgtatcgcgcccatgtgaagggcgaaagcaccgaagcgctgctgccgaacatgattgccagctcgctggcgaagctaccgatcccgaaactgatgcgctggggcgcgtctgacgtccacttcgtgcgtccggtacacacggtgactttgctgctgggtgacaaagtgatcccggccactatcctcggtattccgtccgatcgcgtgattcgcgggcatcgctttatgggcgagccggagttcaccatcgaccatgccgaccagtacccgcagatcctgctggagcgcggtaaagtcattgccgattacgaacagcgtaaagccaaaatcaaagctgatgcgcaagaggcggcgcgtaagattggcggtcaagccgatctgagcgaaagcctgctggaagaggtcacctcgctggtggaatggccggtggtgctgacggcgaagttcgaagaaaaattcctcgcggtgccgtctgaagcgctggtttacaccatgaagggcgaccagaagtacttcccggtctacgacaacgccggcaaactgctgccgaactttatcttcgtggccaacatcgagtccaaagatccgcagcagatcatctccggtaacgagaaggtggtccgtccgcgtctggccgatgccgagttcttcttcaataccgaccgtaaaaaacgtctggaaaataacctgccgcgtctggaaaccgtgctgttccagcagcaacttgggactctgcgcgacaagaccgatcgcatccaggcgctggcgggttggattgccgaacagattggcgctgacgtgaaccacgcaacccgcgcgggcctgctgtccaagtgcgacctgatgaccaacatggtcttcgagttcaccgacacccagggcgtgatggggatgcactacgcgcgccatgacggcgaagcggaagacgtggccgtggcgctgaacgagcagtatcagccgcgatttgctggcgacacgctgccgtctaatccggtggcctgcgcggtagcgattgccgataagatggacaccctggcgggtatctttggtatcggtcagcatccgaaaggcgataaagacccgtttgcgctgcgtcgcgccgcgctgggcgtgctgcgtatcatcgttgagaagaacctggatctcgatctgcagacgctgaccgaagaagcggttcgtctgtacggtgagaagctgaccaacgccaacgtggttgatgatgtgatcgactttatgctgggccgcttccgtgcctggtatcaggacgaaggctacggcgtcgacacgatccaggcggtactggcgcgtcgtccaacccgcccggcggatttcgatgcgcgtatgaaggcggtatcgcacttccgtactctggaagagtcctccgcgttggcggcggcaaacaaacgtgtctccaacatcctcgcgaaatccgatgagacgctgaacgacatcgttcacgcttcggtgctgaaagaagcggcggaaattaagctggcgggtaatctggtggtgctgcgcgacaagctgcagccgtatttcgccgcaggccgttatcaggatgcgctgattgagctggccgcgctgcgcgagccggtggatgagttcttcgagaacgtgatggttaacgctgaagacaaagatgtccgcatcaaccgtctgacgctgctgtccaaactgcgtgaactgttcctgcaggtggcggatatttctctgctgcagtaa

SEQ ID NO: 3594 - DNA, 888 bp, Klebsiella pneumoniae
ggaaatcacatgacggctcgctacatcgcaatagattggggatcgacgaatttacgcgcctggctttatcagggcgaagaatgcctggaaagcaggcaatctgaagcaggcgtaacgcgcctgaatggtcgctctcccgctgcggtgttagcggaaatcacacagcactggcgcgatggcgccacaccggtggtgatggcagggatggtcggcagcaacgtgggctggaaaatcgccccttatttgccacttcctgccgctttctcggatattggccagcagttaactgctgttggcgacaatatctggataattcccggcctttgcgtttcccgtgacgataaccataacgtcatgcgtggggaagaaacgcagctgctgggcgctcgcgccttagccccttcgtctgtctacgtgatgccgggaacccactgcaagtgggtactggccgatcgccggcaaattcacgattttcgtaccgttttgaccggtgaattgcatcatctgttgcttcagcactcgctggtgggcgccggcttaccgccgcaggaaacgtccgctgccgcattcgcggcaggtctgcagcgcggtatcaacaaccccgccgtcctgccgcagctgtttgaagttcgcgcttcgcacgtgctgggcgcgctgcctcgcgagcaggttagcgaatttctttccggcctgctgattggcgccgaagttgccaccctcagcgacacatttgccggacagcaggcgatcagtctcgtcgctgggttatcgttaacatcccgctatcagcaggcattcgccgccattggccgcgaagtcagcgcggttgcgggcgatacggcatttcagacaggaataaggagcatcgcttatgcagtggcaaactaa

SEQ ID NO: 3595 - DNA, 840 bp, Klebsiella pneumoniae
gacgacaacataaataaaaatcatagccttcgcaagttaacgaattacctccccacgacgggacatgacaagctgaaaaaaacaacagaggaagccatcatgtctcatccggttagcgaaaaaagtgcccttgtcgtcagcgcccactcggccgatttcgtctggcgcgcgggcggtgcgatagcgctgcatgccctgcagggctatcaggtccatgtggtctgtttatcctttggcgagcgcggcgagtccgccaaactgtggcgtaaaggcaacatgaccgaggaggcggtgaagcaggtgcgtcgcgaagaggcgcaggccgccgccgcgatcctgggcgccagcgtcgaattctttgatatcggcgattatccgctgcgcgccgataaagagacgctatttcgtctggcggatgtgtatcgccgtatccagccccactttgtcctgacgcactccctgcacgatccctataactacgatcatccgctggcctcccatctggcgcaggaagcacggattatcgcccaggcagaaggctatcgccctggcgagaaaattgtcgctgctcccccggtttactgtttcgaaccgcaccagccggagcagtgcaactggaaacccgatgtgttgctggacatcaccgccgtctgggagaaaaagtatcaggccattcagtgcatgcagggtcaggagcatctgtgggaatactacacccgcgtggcgctgcagcgcggggtgcaggccaagcgcaatatcggcatcacggccgcgcgcgatatcgttcacggcgaagccttccagagcatcttcccccgcgtaacggagaacctggcatga

SEQ ID NO: 3596 - DNA, 1068 bp, Klebsiella pneumoniae
gaaacaagcatgaaaatattggtggtaggcccgtcttgggtgggcgacatgatgatgtcgcaaagtctttatcgtacgctcagggcgcgctatccccaggcgattatcgacgtgatggcgccagcctggtgccgtccgttgctttcgcgcatgccggaagtgaacgaagcgatcccgatgccgctgggtcacggcgcgctggctatcggcgaacgccgcaagctcggccacagcctgcgcgagcgtcgctacgatcgcgcttacgtgctgccgaactcgtttaaatcggcattagtccctttctttgccaatatcccgctgcgcaccggctggcgcggcgagatgcgctacggactgctcaacgacgcccgggtgctggacaaagacgcctggccgctgatggtggaacgctacgtggcgctggcctacgacaacggcgtgatgcgctgcgccaaagatctgccgcagccgctgctgtggccgcagctgcaggtcaacgaaggggaaaagtcgcaggcctgcagcgcttttaacctgtcctacgatcggccgatcgtcggcttctgccccggcgcggagttcggcccggccaaacgctggccgcactatcactatgctgcgctggcgaaaaagcttatcgacgatggctatcagattgcgcttttcggctcggcgaaagataacgagcccggcaaagagatcatcgccgccctcagcagcgagcagcaggcctggtgccgtaatctggcgggtgaaacccagctggagcaggcggtcattctgatcgccgcctgtaaagctgtagtgactaacgattcggggctaatgcacgtcgccgcggcgctggaccgcccgctggtggcgctgtatggcccgagcagtccggactttaccccgccgctgtcgcataaagcgcgggttatccgtctgattaccggctaccacaaggtgcgcaaaggcgatgccgccgaaggctatcatcagagcctgatcgacatcaccccagaacgcgtcctgcaagagctaaacgaactgttagcggaaaaaaccgagcacgaggaagcgtaa

SEQ ID NO: 3597 - DNA, 717 bp, Klebsiella pneumoniae
cctgatggcataaaaaccatgtcgatccctgcagccagcctctctactgaccaggcgttaccgtctttttattacggaagacagacaaagccgttattcgcggtggaatccctgttatctgcgttcctgcccgccagctcaccctttgcgctgccgcgatcgacctattatcgttttccgccgacccaggctgaatccggattaattctgctcgaagaggggattgcctcgctatgccatgcggaaaacaacatggtgatatcaacgatatttgccccttcgctattgggattaatcgatggttacggcgtctttaacggtattccggaaaaacaccactgctctctgtttgctgagacagatttgcgcggacgctggataggacaccaggccgcggtcgagatcctcaatgcgcaaaacctgtggcaggagatggcccatgttctggcgcagcggctgatggtgttgagcatgcgttcgcaggagatgatgggggtggattcttatctgatggtgcgaaccctgctaacagagctggcggactatccggaggcatatcgtcgccaaatcaacgtcctgagctttattcagcgccgtaccaacctgtcgcgtagccgcattatgtcgattctgtcggagctgcgtaaaggtgactatattacgatccatcgcggtgtgctgaggaccatcgcccacccgcttcccgcccacttttaa

SEQ ID NO: 3598 - DNA, 507 bp, Klebsiella pneumoniae
  unsure (473): Identity of nucleotide at the above locations are unknown.
cggcttgtttttctctttgataaaattgattcgcaaatgattaaaacatcaactggtgaaaatatgagtaagtactcagaccttttacaggtaatcaagtcccgggtttgtcaaaataacaacttcccccaaacattactggcagactcacacagttacagagccaggcaggtttggtatcgaataggacaaatattcactcttgaatgtattctcgatgagtacaggaaacatttttcatcggattattattatcttgataacgataaggctcttcatcaccttatcttcgaaatgaccaagtggaaacctgaagagattagaagactctcgctaaacgactgtctctttatcattgccagtcaactaaagcccagttatatgtcagaagatgctgccgctgtcctggcgtcactcaatctgccgactggccactatcctgttgaggattttccaacaacgaggatctttanccacgggggtcgggcatgcccgctacgcatttaa

SEQ ID NO: 3599 - DNA, 1134 bp, Klebsiella pneumoniae
gaaaatataatgaaatacatcatagctcccatcgcgacagcattatttctccttagcggatgcgataatgcgcagacatctgctccgcagcaacccacgccggaagtgggcgtggtcaccctgcaaagccagccggtgccggtagtcagccagctcaccggccgcaccaccgcctcgctcagcgccgaagttcgcccgcaggtgggcggcatcatccagaaacgcctgtttaccgaaggcgatatggtgaaggccgggcaggccctttaccagatcgatccctccagctatcgcgcgacctggaacgaagcggcggcggcgctgaaacaggcccaggcgctggtggtctccgattgccagaaggcccagcgctacgcgtcgctggtcagggataacggcgtttcccgccaggatgctgacgacgccgcctccacctgcgcccaggacaaggccagcgtggaatcgaagaaagcggcgctggagagcgcccgcattaacctgaactggaccaccgtcaccgcgccgattgccgggcgcatcggcatctcgtcggttacgccgggggcgctggtctccgccgatcaggataccgcgctggcgacgatccgcgggctcgacaccatgtatgtcgatctgacgcgatccagcgtcgatctcctgcgtttacgcaaacaaagcctggccagcaacagcgacaccctcagcgtgacgttaaccctggaagatggcagtacctatcccgaaaaagggcgtctggcgctcaccgaagtcgccgtcgatgaatctaccggctcggtaaccctgcgcgctatcttccccaacccgcagcacgtcctgctaccggggatgttcgtccgcgcgcgcatcgatgaaggcatcatgaacgacgcgatcctcgccccgcagcaggggatcacccgcgatgccaaaggcgacgccacggcgctggtggtcgatgccgccaacaaagttgagcagcgtaccgtggaaaccggcgacacctacggcgataaatggctggtgctgagcggcctgaaagcgggcgacaagctgattgtcgaaggcaccggtaaagtggcccccggacagacagtgaaggccgtcgccgtcaacaataacggaggcaacgcctga

SEQ ID NO: 3600 - DNA, 1239 bp, Klebsiella pneumoniae
ctttgggtaatatgtgccaaattttgccgaatctggagagttgcaatgcgtggtgatttctacaaacagttaactagcaatctggagaccgctcgggccgaagggttgttcaaagaagagcgcatcatcacctcggcgcagcaggcggacattaccgtcggcgacagccacgtgattaacttctgcgccaataactatctgggtctggcgaaccacccggaactgattgccgcggcgaaatccggcatggacagccacggtttcgggatggcctcggtacgcttcatctgcggcacccaggatacgcataagcagctggagaagaagctggccgatttcctcggtatggaagacgcgatcctctactcctcctgtttcgacgccaacggcggcctgtttgaaacgctgctcggcccggaagacgccattatctccgacgccctgaaccatgcctcgatcatcgacggcgtgcgtctgtgtaaagcgaagcgcttccgctatgccaacaacgatatgcaagagctggaggcgcgtctgaaagaagctcgcgaggccggcgcgcgtcacgtgctgatcgccaccgacggcgtgttctcgatggatggcgtgatcgccaacctgcaaggcgtttgcgacctggcggataaatacgatgcgctggtgatggtcgatgactcccacgccgtcggcttcgtcggcgaaaacggccgcggctcccacgaatactgcgatgtgatggggcgcgtcgatatcatcaccggcacgttgggtaaagcgctgggcggcgcctccggcggctacaccgccgcgcgcaaagaggtggttgagtggctgcgccagcgctcccgtccgtatctgttctccaactctctggcgccggccatcgtggccgcctccatcaaagtgctggagatggttgaagagggggcagacctgcgcgatcgcctgtgggctaacgcgcgtctgttccgcgaaaaaatgaccgcggcaggcttcacgctggccggcgccgaccacgccatcattccggtgatgctgggtgaggcggtggtggcgcagaactttgcccgcgagctgcagaaagaagggatctatgtcaccggcttcttctatccggtggtaccgaaaggccaggcgcgtattcgcacccagatgtcggcggcgcatacccctgaacaaattgagcgtgcggtggaagcctttacccgcatcggcaaacaactgggcgtcatcgcctaa

SEQ ID NO: 3601 - DNA, 243 bp, Klebsiella pneumoniae
gcaccagcaatgattcttccaatggttgacgtgctgggacaggtaaaatgccgcgcttcacaccatggtttcagcctgacaaaaatctgctctttgccgagattgggtaactcagttctcagacgcctgatctccttgagtacatcaggatgccagtgccttgaacggcgaaccagaggggctttgcttcttggaattagtgcttctggaccaccggtgcgcagtaaccggcgccaccagtag

SEQ ID NO: 3602 - DNA, 318 bp, Klebsiella pneumoniae
caaactgaaattaaggagaattatagaatgactacgatatgcccgcaatgctgttctgaccgcgtaagtgagcgtcatattggcaggaagacgggaggtattgtcggcggagctgctggcgctctcagtggcgcaggaacgggggctgcgattggttcagtcgtgcctgtagtgggaacggcgacaggggcggtcattggcgcactgttaggacggtttgtcgctggggcaacggctggagctgttacgggttcagctatggatggtgtgctgtttgacaggtatgaatgtcgtaactgcaagcatacatttgactga

SEQ ID NO: 3603 - DNA, 1119 bp, Klebsiella pneumoniae
tcccctagaatcggaacccttatcctggatgaagaacagagtatgacgcctgaaaccctctcccgcggcccgttgaacccggcgcggatcctggtcattaagctgcgccatcatggcgacatgctgctgatcacgccgcttattcacgcgctgaaacagcagtaccccgccgccagcgtggatgtcctgttgtatgaagagacccgggatatgctcgcagccaaccccgatatccaccatatttatggtctcgatcgccgctggaaaaagcagggaaaaaggtatcagctgaagatgcaatggcagctcattcagacgctgcgccagcagcggtacgatatggtgcttaacctggccgaccagtggccgagcgcggttatcagcaaactgaccggcgccgcgacgcggattggttttgattttccgaagcgccgccacccggtctggcgctattgccacaccgcgctggcctccacccaacagcacaaccagctgcatacggtacagcagaatctctctattctcgctccgctcggtctccagttgaacgatgcgccggcgcggatgggctacagcgaagcagactgggccgccagccgcgccctgctgccggaggacttccgggaacactacatcgtcatccagccgacgtcgcgctggttctttaaatgctggcgcgaagatcggatgagcgccctgatcaacgcgctgtccgccgaaggatacgcggtggtgctcacctccggccccgatgctagagagaagaagatggtggataccatcatcgccggctgcccgcaggcgcgactacactctttagccggccagttaacgctgcgccagctggcggcggtgatcgatcatgcccggttgtttatcggcgtcgactcggtgccgatgcatatggctgcagcccttggcactccgctggtcgccctgttcggcccctcgaagctgagcttctggcgtccgtggcaggcgaaaggcgaggtgatctgggccggcgacttcggtccgctgcccgatccggacgctatcgacaccaacaccgacgaacgttatcttgatttaattcctaccgacgccgtgatcgcggcggcgaaaaaggtactggcatga

SEQ ID NO: 3604 - DNA, 267 bp, Klebsiella pneumoniae
aagggcttgatcaccgtctctgacaggcgcagcagatcctgtcgtttaatcatttcgcacatcattgccggcccgatgccgccaggggcgaggctgataataccgttcatgttgctgatggcggtgatgattttttcgttggcgatgataatcccgcagcggctgcccggcaggcccagcttggacaggctcatacacagcacgatgttcggattccacagcggtcgggcgtcgctaaagataatgcccgggaacggcacgccgtag

SEQ ID NO: 3605 - DNA, 465 bp, Klebsiella pneumoniae
cccgttatgatgaaaaaaatcgacgttaagattctggacccgcgtgtcggccagcaatttccgctgccgacctatgccacctccggctccgccggacttgacctgcgagcctgtctcgacgacgccgtagagctggcgccgggcgcaaccacgctgttgccgaccggccttgcgattcatatcgccgatccctctctggcggcggtgatcctgccgcgctccggcctgggtcataagcatggcgtagtcctgggcaacctggtgggccttatcgactccgattaccaggggcagctgatggtgtccgtctggaaccgcggtcagcagagctttattatcgagccgggcgaacgtatcgcacagatggtctttgtgccggtcgttcaggcggaatttaacctggtggaatccttcgatgccaccgaccgcggcgaaggcggcttcggtcactcagggcgtaaataa

SEQ ID NO: 3606 - DNA, 873 bp, Klebsiella pneumoniae
ggagtgatgatgacaatcgcgtttattggttttggcgaggcgggtggcattctggcggcggatctggcccgtgagcatgcggtgaccatttgggattgcaagctcaatggcccggagcgagaggcaatgctcagtaaagcccgtgattcgcgcgttcaggtgggaaattcgctggcgcaggcgctggagggggccacgctggttttttctactgtgaccgccggtgaggcgctaaaggtggcgcagcaggcggccgcgctgctgcagccgggacaatatttcctcgatctcaactccgtggcgccggagacgaaacggcaggcggctgaacattttctgccgggcgcctacattgatgtcgcggtgatggcgccggtaccgccggcccgattgcagacaccgttattgatcggcgggccgcaggcggaggcgatcgcgccgcgtctgcagaggctggggctgaatgcccgctatggcgccagtacggtgggccaggtgtcggcgataaaaatgtgccgtagcgtgatgatcaaaggtcttgaagcgcttaccacagaatgcctgttcgcggctcgtgaatacggcgttgaggaggaggtgcttagctccttgcatcatagtttcccctctctgggctggacaggcgcgttccccgactatctgatcagccgggtggcggaacatggcattcggcgcagcgaagagatggaggaggtggtgaaaaccctgcgtgacgtggggagcgccgggataatgagcgaggcgatcgcgaaaagccagcgccagctgccggagcagatggccgcccgtagcctgagctacaggcagcttacgccgtttgactggaaaacgctggtcgcgaggctgaaataa

SEQ ID NO: 3607 - DNA, 2331 bp, Klebsiella pneumoniae
gaggacgttttaatgaaaatcagtgatggaaactggctcattcaaccagggctcaacctgatccaacccgtacaggtttacgaggtggagcagcaggggaatgaaatggtggtctatgccgcgccgcgcgatgtccgcgaacgcgcctggcagctggatacgccattgttcaccctgcgctttttctcgcctcaggaagggataatcggcgtgcgtatggagcacttccagggcgcgctggataacggtccgcactatccgctgaacgtgcagaaagacgtccatgtcgaaatagaaaatacggccgggttcgctgagctgaaaagcggcagcctcagcgtgcgggtgactaaaggcgaattctgggcgctggattttctgcgcgacggcgtgcgtatcaccggtagccagctaaaaaacaacggctacgtgcaggatagtaagacccagcgcaactacatgtttgagcgcctcgacctcggcgtcggcgaaaccgtctacggcctcggcgagcgctttaccgccctggtgcgcaacggccagacggtagaaacctggaacgaggacggcggcaccagcaccgagcaatcctacaaaaatatcccgttctatctgaccaaccgcggctacggcgtgctggtcaaccatccgcagcgcgtctccttcgaggtgggctcggagaaagtctctaaagtccagttcagcgttgaaggcgaatacctcgagtacttcgtcatcgagggcccgacgccgaaagcggtgcttaaccgctatacgcagttcaccggccgcccggcgctgccgccggcatggtcgtttggtctgtggctgacgacctcgttcaccactaactatgacgaagcgacggtgaatagctttatcgacggcatggctgagcgccatctgccgctgcacgtcttccacttcgactgcttctggatgaaggccttccagtggtgcgattttgaatgggatccgctaactttcccggacccggaagggatgatcaagcgcctgaaggcgaaagggctgaaggtctgcgtgtggatcaacccgtacatcggtcagcgctcgccggtgttcaaagagctgaaagagaagggttatctgctgaagcgtccggacggttcgctgtggcagtgggataagtggcagccggggctggcgatttatgacttcaccaatccggaagcccgccagtggtacgctgacaaactaaaaggcctggtggcgatgggggtcgattgcttcaagaccgactttggcgagcgtatcccgaccgacgtccagtggtttgacggttccgatccgcagaaaatgcacaaccactacgccttcatctataacgagctggtgtggaaggtgctgaaagagaccgtcggcgagcaggaggcggtgctgttcgcccgctccgcctcggtgggcgcgcagcagttcccggtgcactggggcggcgactgctacgccaactacgaatcgatggcggaaagcctgcgcggcgggctgtcgatcggcatgtccggcttcggtttctggagtcacgatatcggcggtttcgaaaacaccgcgccggcccacgtctacaagcgctggtgcgccttcggcctgctctccagccacagccgcctgcacggcagcaaatcctatcgggtgccatgggcctacgatgacgagtcctgcgacgtggtgcgccacttcacgcagctgaaatgccgcatgatgccgtatctctatcgtcaggcggcgctggccaacgagtgcggcacgccgatgctgcgcgcgatgatgctcgagtttccggacgatccggcctgcgactatctcgaccgccagtatatgctgggcgattcggtcctggtggcgccggtgttctccgaggccggcgaagtgcagttttatctgccggaagggcactggacgcatctgtggcataacgatgaattgccgggtagccgctggcataagcagcatcacgatgcgctgagcctgccggtctacgttcgcgacaacagcctgctggcgctgggcaacaatgaccagaagccggattacgcctggcatgagggcaccgccttccagctgttccaccttgagaatggacgcgaggcacgctgtgacgttccggcggcagacggctcgacgatcttcaccctgaaggccaggcgccagggcaacgccatcgccgtgagcggcgaatgcgaagcccgcggctggacgctgtgcctgcgcaatatcccgcatgtcgcgggcgtgcacggcggtacgcagaccggtatcgaatggggagtggtggtgagcgccgaaggcaatacgctgacgattacgttgtaa

SEQ ID NO: 3608 - DNA, 786 bp, Klebsiella pneumoniae
taccaggcgataatagcgcccgcagttttatccagaccattactcacggagcgacgtatggcaacgcattttgcaagagggatactcagtaccggggagccgctatcgacacgtttgtcagcggcctgtcatcaatccgcacgtcttctcccgacatatcgccaggctcgcttttgcgcgtcgcgctcgctgcttgccgagctgctgtttatgctttacggcatcagcgagctgcctgaaatcatcaacgaagccaatggccgaccggtttttagcgatcgccaactcccccgcttttcgatcgcttatactggcaatatcgttggtgttgccctcaccaccgagggggattgtggcctcgacatggaactgcagcgcactgtccgcagccacgacgccgaccggcacaatttcagcaacaatgagaatctgtggattaacatacagcatgatccggacgaagcgcgcagccagctggtagcgctgcgtcgcagcgtgctaaagctgaccggcgaagcatcaacgcagctgcagctgctgcccggctctggccgcctgcgcaccgccggaagtcagccaatcgaagcggtatgtgacgccgaatcgctgctggtatggtccattgccgctaccccgaacatcggctcgctgaaggtctgggaatatgatgctaagggaggtgactggcgcagcctggcggatgcgcagcagcgcgcacgcgaaccgtcagcccgcctgatgcgctttaccagcttacccatggaaaaaaccttatccctcaattga

SEQ ID NO: 3609 - DNA, 678 bp, Klebsiella pneumoniae
gggtatgagatgaaagcgttatccaaactgaaagcggaagaaggcatctggatgaccgacgtaccggaaccggaagtcggccataacgatctgctgattaaaatccgcaagaccgccatttgcgggaccgacgtgcacatctacaactgggatgagtggtcgcagaagaccattccggtgccgatggtggtcggtcacgaatatgtcggcgaagtggtggggattggtcaggaagtgcgcggctttaagattggcgaccgcgtctccggcgaagggcatatcacctgcggccactgccgtaactgccgcgcgggccgcacccatctgtgccgcaacaccatcggcgtgggcgtcaaccgcccgggctgctttgctgagtatctggtgatcccggcctttaacgcctttaaaatccccgacaatatctctgatgacctggcgtctatcttcgacccgttcggcaacgcggtgcacaccgcgctctccttcgatctggtcggggaagacgtgctggtttccggcgccggtccgatcggcgtgatggcggcggcggtagcgaaacacgtcggcgcgcgtaacgtggtgatcaccgacgtcaacgagtaccgtcttgagctggcacgcaaaatgggcgttacccgcgcggtgaacgtggccaaagagaacttaatgacgtga

SEQ ID NO: 3610 - DNA, 1779 bp, Klebsiella pneumoniae
gtagacaactttggccaaattaaaaccatgaatgggatcacgaatcgcaacggcgcggcatgttgtcggacgggcaaatttttattctccagtcaggccggtaatcaagaaaaagaaggccactcaccctacgagttgttacatgaggatttcccaatgctcagtcaaatacaacgctttggcggcgccatgtttaccccggttttattgttcccttttgccgggattgtggttggtatcgccatcatgctgcgcaacccgatgttcgtcggcgaagcgctgaccgcacccgacagcctgtttgcccagatcgttcacatcattgaggagggcggctggaccgtctttcgtaatatgccgctgattttcgccgtcggtctgccgatcggcctggcgaaacaggcccagggccgggcctgcctggcggtgctggtgagctttctcacctggaactattttatcaacgccatggggatgacctggggccacttcttcggcgtcgatttttccgctgaacccacggccggcagcggcctgacgatgattgccgggattaaaaccctcgacaccagcattatcggcgccatcgtcatctccggtctggtgacggccctgcacaatcgctatttcgataaacccctgccggtattcctcggcatctttcagggttcatcgtttgtggtcattgtcgccttcctcgcgatgatcccttgcgcctggctgaccctgctcggctggccaaaggtccagctgggcattgaatcactgcaggcctttctgcgctcagccggggcgcttggggtgtgggtttacatcttccttgagcgcatcctgatccccaccggcctgcaccacttcgtctatggcccgttcatctttggccctgcggtggtggagggcggactgcaggtctactgggcagagcatctgcaggcgttcagtcagagtacggaaccgctgaagacgctgttcccggagggcggctttgccctgcacggtaactcgaaagtgtttggttcggtggggattgcgctggcgctctacttcactgccgcgccggaaaaccgcgtcaaggtcgccggactgctcatccccgccaccctgaccgcgatgctggtcgggatcactgagccgctggagttcaccttcctcttcatctcgccgctgctgttcgccgttcacgcggtgctggcggcgactatggcgacggtgatgtacatctgcggggtggtaggcaacttcggcggcggcctgctcgatcaattcttgccgcaaaactggatcccaatgttccatcaccacgcttcgatgatgttcattcagataggcatcggcctctgtttcactgccctctacttcgtagtcttccgtaccctgatcctgcgtctgaacctgaagacgcctggccgggaagagagcgaaatcaagctctacagcaaggccgattaccaggcggcacgaggtaaaaccacggccgccgccgcgccagagacccggctgggtcaggccgctggcttcctgcaggccctcggcggcgccgacaacattgaaagcatcaacaactgcgccacccgactgcgcatcgcgctggtcgatatggcgaaaacgcaaagtgacgacgtctttaaagcgctgggcgcccacggggtagtacgccgcggcaacgggattcaggtcatcgtcggcctgcacgttccccaggtgcgcgaccagctggaaaacctgatgaaagattctctttcgaccgaacataccaccatgacggaggcagtatcatga

SEQ ID NO: 3611 - DNA, 1323 bp, Klebsiella pneumoniae
caaagggttttaaagacatctttgttatacaaggggtgcattgggggtatcaggttagctactggcggaaatcccccaggaggatggattcatcaaaagccggaggatgtcatggcgctaaccgatgttaaagtgaaaaccgcgaagccaaaagaaaagccctataagctggctgatagcggcggtatgtatctgctgattaacgctaatggttccaaatactggcgaatgaagtaccgcttcgccggtaaagaaaagatgctttctattggcgtataccccgatgtttcactggccgacgcacgagagaaacgtaacgaggccagaaaaatcctcgccactggaggcgatccgggtgaggcaaagaaagaggaaaaaatcgcccagcaaatgagtctgaaaaataccttcgaggccgttgcccgcgaatggcaccagacaaaagccgatcgctggtcactacgctatcgtgatgaaatcatcgatacctttgagaaagatatcttcccctatattggcaaacgccctattgctgaaatcaaaccaatggagttattggaagccctacgtaagatggagaaacgcggggcgctggagaaaatgcgcaaggtccgccagcgctgtggtgaggtgttccgctatgcaatagtcactggaagggccgactataaccccgctccagaccttgccagcgcattagctacgccgaaaaaagtacatttccccttccttactgccaatgaacttccccacttccttaacgatctggcgggctataccggcagtattatcacgaagacagccacccaaatcattatgttaaccggtgtacgcacgcaagaactgcgcttcgcacgctgggaagatatcgattttgaggcaaaattgtgggagattccggcagaggtaatgaagatgaaacggcctcacattgtgccgctctcagagcaggtcattgccctgtttaagcaacttgaaccgatctcaaaacatcatccactggtttttatcggcaggaacgatcctcgcaagcctatcagtaaggaaagcatcaatcaggttattgagttgttgggatataaaggcagactgacggggcatggcttccgccacacaatgagtactattctgcatgaagagggctttaactcggcatggattgaaacacagcttgcacatgtcgataagaacgcgattcgcggaacgtataaccatgctcagtatctggacggaaggcgagagatgatgcagtggtatgcggattacattgacgctttggcgaaagggacagttatacagggaacatttggtaagacagcgtga

SEQ ID NO: 3612 - DNA, 1149 bp, Klebsiella pneumoniae
aaaataattgtgaaaaaaattaattttagcttctccgttacgcggtggattggcgtggttattaaggaaattcacgagctacgccgtgataaagtcagcatcagtatggtgctcctgacacctctttttcagctgatcattcttggctatgccatcaatatggatccgcataatcttccgaccgccttactaaattatgataccgaacgcatgagtcaaatctttgtgacggaagcgcaaaataccgggtatttttcgatgattcctgtcgattcagaagaggcggcgcagaaagcctttgtgcggggggatgtcacttttatcgtgacgatccctgaggggtttacgcgcaagttactgcgtggagaaaagccacaaatattaattcagggggatgccatcgatccgatcaccacggaaaatgcgctcagaacccttgtgcaggtggcgaagtcgatgtttcagcacgatttgccgggcgatatgcgtgtggtgcaaaaagaggatgatttcgagcttatcattcatcgcatgtttaaccctgaggggataacccagtttaatactattcccggtattatggggtctatactcagtacaacgttaatcctgatgaccgccctgtctattacccgcgagcgagaaaacggggcgttagaaaatttactggtctctccgttgtccgggcttgaggtcattattgggaaaataacgccttttgttatcattggtctgtttcaggcgacgttaatcctgattgccgccgttttgttgttcgatatcccccttcacggtagcgtcttcctactattttttgtgctgttaatttatgtctttctttgtctgtcaattggtatcggtatttctggcttagcacaaaaccagctgcaggcgctgcaaatgtcgtcattttatttcatcccttcacttatgctgtccggatttgtcagcccctttattagtatgccagactgggcgaaagccattggctcctgtttaccgttgacctacttcatccgcctggttaagggcattatgctgaaaggctattcagcaatggcattgttgcctgacctcttgccgctgataggcctggcggtgattgtcattggtgtggggttgaaatcttatcgtaaaacgctggactga

SEQ ID NO: 3613 - DNA, 399 bp, Klebsiella pneumoniae
tcagcccctgtcgaccagggaggtgagatgatcacaaaacgcaatattgccagggggatgatggcgacaggatcgctggtttatctgctcggtatctggcggacctgcccgctgttcagcggcaaagggtattttctcggcgtgctggtgatggggatgtttgctgttctcgcccatcagcgcgccagtcagtggcaggaacaggacgacggttttattgccttatgccggctggtgctgctgctatcggtcggcctgctgctggtcggcgcctggtatgtaccggcagactggcatgaaaaagccgtctatatcgcggcatggtttgtctgcttatatggcgcatcggcaacccccgaacggacccgcatcgcccgcgcgatgcaaaaaacggaataa

SEQ ID NO: 3614 - DNA, 870 bp, Klebsiella pneumoniae
tattctgctgtcgctggggctgtttatgctctatcggctggcggcggcgcgcactggcgtaaggagttaacgatgttgatttggtcgcgtaaaggccgcgcggcggcgggcgcgctggcggtgacgctttttgccggcgttttcctgctgccgctggcggtgattttactctccagcctgagtaaacaatggaacggcctgctgcccaccggctttacctttacccactttgttaacgcctttcgcggcgcggcgtgggattcgctgttttcgagcctgatggtgggcttctgcgccagccttctggcgctgctgtgcgggatgtgggcggcgctggtgctgcgccagtatggcgcgacgctacagaaatatcttggcctggcattttatctgcccagcgctatcccctcggtttccgtcggactgggcattctggtggcgtttagccaggggccgctgcagatgaacggtactttttggatcgtcctggcggcgcactttgtcctgatttccgcctttaccttcagcaacgtaacgaccgggctggcgcggatttccgccgatattgaaaacgtcgcctccagtcttggcgcctcgccgtggtatcgcctgcgtcatgtgacgctgccgctgatgacgccgtggatgatttcagcgctggcgttgagcttatcgctgtcgatgggagagttaggggcgacggtgatgatctatccgccgggctggacgacgctgccggtgaccattttcagcctcaccgatcgcggcaatatcgccgatggctcggcgctgaccattgtgctggtgggcgtcacgctgctgttgatgatgaagcttgagcgcatcgcccgccgattaagccagagataa

SEQ ID NO: 3615 - DNA, 1749 bp, Klebsiella pneumoniae
cacggtgatgtgcatctcacagaatggaagaccatgaaatttcttggaaagctgattctctggctgctagtcgctctgctgctcgtcattattggcgcgtggttcctgctgcaaacccactggggcgcccgccaggccagcgcctggctcagcaatggcaccggctggcaggtctccttcgatgagatggagcacgatttctcctccccccttcatgtgcagttgcgaaacgtcacctttggtcgggaaggcaagcctgccactttggtggcaaaaacggtcgatattggcttcagcacccgccagtttagcgatccgctgcatgcggatgagatagtccttaacgacggcactctgaatctgtcaccccactctgcagacctgccgttcgctgccgaccggctgatgttgcgcaatatggctttcaacagcccggaaaccggctgggcgctcagcgcgcagcgcgtcaccggcggcgtcagcccatggacgccggaggcgggcaatgtgctggggaaaacggcgcagatccagatgagcgcgggctcgatgacgctcaatggcgtcgaagccagcaacgttctgattcagggtaagattgatcagggcgaggtcaccctctccaccctcggcgccgatgtcgcccgcggcaccttaaccggcaatgccaaacgcagcgccgatggcagctggcgggtggataacctccagctcaacgagattcgactgcagagccccgcctcgctgaccgagtttttcgcgccgttaaccacggtcccctctctgcagattggccgcctggacatcaccgacgcccgcctgcagggaccggactgggcggtaaccgacctcgacctgagcctgcgcaacctgacccttagccacggcggctggcagagcgaggacggcacgctgtcgatgaacgccagcgaatttatctacggttcgctgcacttcttcgacccgatcctcaatgctgaattctctccccagggcattgcgctgcgccagttcacttcgcgctgggagggcggcatggtgcgcacctccggcaactggctgcgcgccgggaacgccctggtgctcgacgacaccgccttcgccggactggagtacacgctgccggcgaactggaaacagctgtggatgacgccgctgccaacctggctgcaaagcctgacgctgaaaaaattcagcgccagccgcaatctgatcatcgatgtggaccctgctttcccgtggcaaattaccgccctcgatggctatggcggcgagctacagctggtgaaaaacggcagctggggagtatggaacggcagcgcgacgctgaacgccgcggcggcgactttcaaccggatcgacgtgcgccgcccatcactcaaactgaacgccacagcctcgacggtcaatatcactgagcttagcgccttcaccgagcgcggcattttgcaggccaccgccgcggtatcccagctgccgcagcgccaggtcaatctgagcttcagcggccgcggcgtgccgctgaatattctgcaggcctggggctggccgtcgctacctataagcggggatggcaatctccagctgaccgccagcggcagcgtgcaggccgatgccccgctcaaaccgacggtcaacgggcagctcagcgccgtgaatatggagaaacagctggtggcgcaaatcatgcgcaacggcgaggtcagccccgcccccgccgcgccagcgcccgctcccgtcaccccatag

SEQ ID NO: 3616 - DNA, 726 bp, Klebsiella pneumoniae
cgccgacccgtttttttgaggaaaaagaagggttgggccccgcgtcgcgaatcaggctttcctacggcgtgttgggagataacctttgcaccctgggtaccaaagaccggtccgggattgttacttcccggcgttaaatatcgtctgatgctgcgcgaagacaacaccaatttgcgtctgaccgaacaggggcgcaagctgggtctggtgaatgacgaacgctgggcgcgctacaacgagaagctggaaagcatcgaacgtgaacgccagcgtctgaaatccacctgggtgaatccgcaggcagagagcgccaacgaagtgaacgctcacctgaccgcgccgttgtcgcgtgaagccagcggcgaagatctgctgcgtcgtccggaaatgacctacgaacagctggttcaactctcgccattcaccccgggactggaagatcgtcaggcggctgagcaggtagagatccaggtgaagtatgagggctatatcgcgcgccagcaggatgagattgagaaacaacagcgcaatgagaataccttgctgccagcgaccctcgactaccgccaggtcactgggctgtctaacgaggtgattgccaaactgaacgaccataaaccgtcgtcgatagggcaggcgtcacgtatctcccggatcaccccggcggcgatctctattttgctggtttggctgaaaaagcaggggatgctgcgccgcagcgcctga

SEQ ID NO: 3617 - DNA, 459 bp, Klebsiella pneumoniae
acgataaccgtcccgatatcagcccccagtttattcgccacgaacagcgcggccggatgcggcggtaccacgcagtgcaccgccatcagcgcggtacacagcggaatagccagcttcagcagcgaagtattggtttttttggcgatggagaatgccagcgggatcagcagcaccaccccgacttcgacaaacagggtaatgccgcagatcaggccgaccagcaccataatcacgtccgccgacagccagcggcagcgctggagcgtcaggccgatgcgctccgccgcgccggagacctccatcatcttgccgagaatggtgccgagaccgatcaccgccgccaggaagcccagcgtaccgccgatcccgctctcaatggcgttgaccatctccagcggacccattcccatcatcgccccgacgaaaaagctcgccagcagcagcgccagaaacggatga

SEQ ID NO: 3618 - DNA, 423 bp, Klebsiella pneumoniae
aacatgaccgttgaatataccgtgatcgagaaggtgccctccgccgaagcgttttgccacctgcgggtagccgccggcatgtcgccgcgccccctggaaggcgccagagccggactgccgcatagctgttatggcgtacatatcctctggcaggagacgccgatcgcgatgggacgcatcgtcggcgacggcgcgattaatttcgatattgtcgacgtcgccgtcgatccggctcaccagggaaaaggccttggccggctggtgatggagaagctggtcgcctggctggacgctaacgcctttgatggcgcctacgttacgctggtggcggatgtgccggaactgtacgcgaagttcggcttcgaaagcgttcgcccggagagcgaggggatggcccgcgtctggcgaacccgcagtcgttag

SEQ ID NO: 3619 - DNA, 1242 bp, Klebsiella pneumoniae
gttaggcacgtcgacgccgacttcaatcaccgtggtggctaccagcagatgcatctcgccctgcttgaaggcctgcatcaccgcctgcttctccgccggtttcatccgcccgtggacgaggccgatattgagctccggcagcgccagtttgagctcttcccaggtggcttccgccgcctgggcttccagcagatcggactcttcaatcagcgtacagacccaataggcctggcgaccttcatgggtacaggcgttgcgcacgcggtcgataatatcgctgcgccgggtgtcggggatggcgacagtggtcaccggagttcggcctggcggcagctcgtcgataatcgaggtgtccagatcggcgtaggcggtcatcgccagggtgcgggggatcggggtggcggtcatgatcagctgatgcgggtggaatacctgctgctgacctttctcccacagcgccagccgctgatgcacgccgaagcggtgctgttcgtcaataatcaccagcgccaggccgttaaactgcacctgctcctggaagatggcgtgggtgccgacaatcatctgcacctcgccgctggcgatagcctcctgctgcgcctggcgggctttgcctttctgtttgcccgccagccagccgacttcaatacccagcggttcgaaccagttgcggaagttattggcatgctgctcggcaagcagttcggtgggcgccatcagcgccacctgtttgccgtggacgatagcgcgcaaggcggccagggcagcgaccagcgttttaccggagccaacgtcgccctgcaccaggcgcatcatcggcacgtccagcgccatatcgtgttcaatctcggcggtaacccgcgcctgcgcgccggtgggcttaaagggcagggaggccagcagttggtttttcagggtatcgttggcgccgagcggcagggcgtgatagcgctgggcgcctgcccgcagcgccagcatgctgaggttatgcgccagcagctcttccagaatcagacgctgctgcgccgggtgcttgccgctttccagctcgctaagttgcaaggagggaggcgggcggtgcagcgtacgcagcgcctccggcaggctcatcatcccctgcgccagctccggcggcaggagttcgctaatcgcgcaggtttccaggagctcaagcgcctgatcggtgagcttgcgcagggtcgcctgcttgatgccttcggtggtcggatagactggggttaa

SEQ ID NO: 3620 - DNA, 1425 bp, Klebsiella pneumoniae
aattcccgctttgccaccttgggattgcttgtgatgtccgttaacaccgcagagtcagaaaatgcgcaaccggttgcgcataaaccagccagcgaattaatctaccgcctcgaagatcgcccgccgctaccgcaaaccctgttcgccgccttccagcacctgctggcgatgtttgtcgcggtgatcaccccggcgctgttaatctgccaggctctcggtctcccggcgcaagatacccaacatatcatcagcatgtcgctgttcgcctccggcgtcgcctctattattcagatcaaagcctggggcccggtcggctccggactgctctccatccagggcaccagcttcaactttgtcgccccgctgatcatgggcggtaccgccttgaaaaccggcggcgccgacgtccccaccatgatggccgccctcttcggcaccctgatgctggccagctgcaccgaaatggtcctctcccggatcctgcacctggcgcgccgtatcattaccccgctggtttccggcgtggtggtgatgattatcggcctgtcgctgattcaggtcggactgacctccatcggcggcggctacgcggcgatggctgaccacacctttggtgcgccgaaaaatctgctgctggcgggtatcgtgctggcgctgattattatcctcaaccgccagcgcaacccgtacctgcgcatcgcctcgctagtgattgccatggctgccggttatctggcggcgtggttcctggatatgctgccagccaacaccgccccgaccaacagcagcctcatcaccgtcccgacaccgctctattatggcctcggcatcgactggagtctgctgctgcccctgatgctggtgtttatgatcacctccctggaaaccatcggcgatatcaccgccacctccgacgtctccgaacagccggtctcgggtccgctgtatatgaagcgcctgaaaggcggcgtgctggctaacggcctgaactccttcgtttccgcggtcttcaacaccttcccgaactcctgcttcggccagaacaacggcgtgatccagctgaccggggtcgccagccgctacgtcggctttgtggtcgccctgatgctgatcgtcctcggcctgttcccggcggtgagcggctttgtccagcatatccctgagccagtgctcggcggcgccacgctggtgatgttcggcaccatcgccgcgtccggcgtgcgcatcgtctcccgtgaaccgctgaaccgtcgggcgatcctgattatcgctctgtcgctggcggtaggcctcggcgtgtcgcagcaaccgctgatcctgcagttcgccccggactggctgaaaaacctgctttcctccgggattgccgccggcggtatcacggcgattgttctgaatttaattttcccgccagaaaaggcgtga

SEQ ID NO: 3621 - DNA, 285 bp, Klebsiella pneumoniae
ggtgctccagtggcttctgtttctatcagctgtccctcctgttcagctactgacggggtggtgcgtaaccgcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaaccgcccgcattatgggcgttggcctcaacacgattttccgccatttaaaaaactcaggccgcagtcggtaa

SEQ ID NO: 3622 - DNA, 1497 bp, Klebsiella pneumoniae
agagctgcagttggtatacaacaaagctcgtcaggccagcattactcaggaactcaccgagatcgtctcgggggccgccgcggtttaaccaggttatttcgtagaggatttaagatggctactggaaagattgtccaggtaatcggcgccgtggtcgacgtcgagttccctcaggatgccgtaccacgcgtgtacgaagcccttgaggtacagaatggtaatgaagttctggtgctggaagttcagcagcagctgggcggcggtatcgtacgtaccatcgccatgggttcttctgatggtctgcgccgcggtctggatgtaaaagacctcgagcacccgatcgaagtcccggtaggtaaagcaacgctgggtcgtatcatgaacgtactgggtcaaccggttgacatgaaaggcgacatcggcgaagaagagcgttgggctatccaccgcgcggcaccgtcctatgaagagctgtccagctctcaggaactgctggaaaccggcatcaaagttatcgacctgatgtgtccgttcgcgaagggcggtaaagttggtctgttcggcggtgcgggtgtaggtaaaactgtaaacatgatggagctgatccgtaacatcgcgatcgagcactccggttactctgtgtttgcgggcgtaggtgagcgtactcgtgagggtaacgacttctaccacgaaatgaccgactccaacgttatcgataaagtatccctggtgtacggccagatgaacgagccgccgggaaaccgtctgcgcgttgcgctgaccggcctgaccatggctgagaaattccgtgacgaaggtcgtgacgtactgctgttcgtcgataacatctatcgttacaccctggccggtactgaagtatccgcgctgctgggtcgtatgccttcagcggtaggttatcagccgaccctggcggaagagatgggcgttctgcaggaacgtatcacctccaccaaaaccggttctatcacctccgtacaggcggtatacgtaccggcggatgacttaactgacccatccccagccactacctttgctcacttagatgcaaccgtagtactgagccgtcagatcgcatccctgggtatctacccggccgttgacccgctggattccaccagccgtcagctggatccgctggttgttggtcaggaacactacgacaccgcgcgtggcgttcagtccatcctgcagcgttatcaggaactgaaagacattatcgccatcctcggtatggacgaactgtctgaagaagacaaactggtggtagctcgcgcgcgtaagatccagcgcttcctgtcccagccgttcttcgtggcagaagtctttaccggttctccgggcaaatacgtggcgctgaaagacaccatccgtggctttaaaggcatcatggaaggcgaatacgatcacctgccagagcaggcgttctacatggtcggttccatcgacgaagccgtggaaaaagccaaaaaactttaa

SEQ ID NO: 3623 - DNA, 1449 bp, Klebsiella pneumoniae
caaagcggcttccctgaacattcccgttcagcccatcgatacgatggactacggtatgcagcggggagacaacgtcctgaattatgctctgtcgctgatcccagcggcgcactgagaggtgttgaaatgagttctctgtatcagtccatgattgccgtgatcgagcaatctattactccgctggcaggacgccttgggcagcagaaatacgttatcgctatccgcgatggcttcactgccgccttgccgtttatgatcatcggctctttcatgctggtatttatctttccgccgttttcacccgataccaccaacggctttgcccgcggctggcttgatttctcccagcactaccgcgaacagctgatgctgccgtttaacctcagcatgggcgtgatgaccttctttatctcggtcggcattggcgccagcctcggtcgtcagtttcagctcgatccggtgatgtccggtctgctggcgtttatggctttcctgctggtcgccgcgccctatgccgatggcaaaatttccactcagtatctgtccggtcagggcattttcaccgcgctgatcaccgccatctactccacccgcgtttacgcgtggctgaagcaaaacaacattacgattcgtctgccgaaagaggtccccaccggcgtcgcccgttcgtttgaaatcttgatcccggtgctggtggttattgcgactctgcatccgctgaatctgtttatcgaagcgcagaccgggatgatcctgccgcaggcgatcatgcatctgctggagccgctggtttccgcctccgactcgctgccggcgattttgctctctgttctgatgtgccagattttctggttcgccggtatccacggctcgctgattgttaccggcattatgaacccgttctggatggccaacctgtcggcaaaccaggcggcgctggcggctggcacggtactgccgcacgtctacctgcagggcttctgggatcactatctgctgattggcggcgtcggttctaccctgccgctggccttcctgctgctgcgtagccgggccacccatctgcgcaccatcggcaagatgggcatcgtgccgagcttctttaatatcaacgagccgattctgttcggggcgccgatcatcatgaacccgatgatgtttatccccttcgtctgcgtaccgatggtcaacgcggtgctggcttacggcgcgacgcgtcttggctggctgagccaggtggtgtcgctgacgccgtggactacgccggccccaattggcgcgtcgtgggcggctaactggaccctgagcccggtggtgatgtgtctcatctgcatggtgatgtcggcggtcatttatctgccgttcctgcgcgcttatgaacgttccttaatgaaaaccgaagttgagaaagccaaaaatagcgttccggtagcagaaaccgttagctaa

SEQ ID NO: 3624 - DNA, 1431 bp, Klebsiella pneumoniae
aacgttcaagtactacacgacagcgacatttatcgcatcgctacttgcactggccgccaccttcctgctttctttcattatctgagcgcaaagagacgtatgatgaaacacgctgacctgaccaccttaaccgcgaccttcccgcttgtgcaggatctgatcgccctgaaagaaaccacctggtttaacccggcaaccaccaccctggcggaggggttgccttacgtcggtctgaccgccgacgatgtgcaagacgcccatgcccgccttcagcgcttcgcgtcctatctggcggcagccttcccggaaaccgccgcgagcggcgggattatcgaatcagaagtggttgccattccggcaatgaaacgcagccttgagcaaaaattcggccagccaattagcggcgaactgctgctgaaaaaagacagccatctgccgatctccggctcaatcaaagcgcgcggtgggatttatgaagtgctgacccatgcggaaaagctggcgctggaagccgggctgctgacgaccgcagacgattatcgcaaattgctgacgccggagtttaaacagttctttagccagttcagcatcgccgtcggctccaccggcaaccttgggatgtcgatcggcatcatgagcgcgcgcattggttttaaagtcacggtgcatatgtccgccgatgccagggcgtggaaaaaagccaaactgcgcagccacggcgtaacggtggttgagtatgaagaggactatggcgtggcggtcgaacaggggcgccaggcagcggaatccgatccgaactgctttttcattgatgatgaaaactcacgcacgctgttcctcggctatgccgtagccggcgagcgcctgaaggcgcagttcgcgcaagcagggcgcgtagtcgatgccgatcacccgctgttcgtctatctgccgtgcggcgtcggcggcggccccggcggcgtggcatttggcctgaagctggccttcggcgaccacgttcactgcctgttcgccgaaccgacccattcgccatgcatgctgctcggcgtctataccgggctccacgaccagatagcggtgcaggatttaggcattgataacctgaccgcggccgacggtctggcggtcggcagggcgtccgggttcgttggccgggcaatggagcgcctgctcgacgggttctatacccttgacgaccagacgatgtatgacatgctgggctggctggcggcagcggaaaatatccgtcttgaaccctccgcgctggccgggatggccggaccgcagcgcgtctgcgccagcaaagcgtaccatcagctgcaggggctgagtgagcaacagctgcagcaggccacccacctggtgtgggccaccggcggcggcatggtgccggaagaggagatggcgcagtacctggcgaaggggcgctaa

SEQ ID NO: 3625 - DNA, 213 bp, Klebsiella pneumoniae
tgtatgatggtgttttatgaggtgctccagtggcttctgtttctatcagctgtccctcctgttcagctactgacggggtggtgcgtaaccgcaaaagcaccgccggacatcagcgctatctctgctctcactgccgtaaaacatggcaactgcagttcacttacaccgcttctcaacccggtacgcaccagaaaatcattgatatggccatga

SEQ ID NO: 3626 - DNA, 189 bp, Klebsiella pneumoniae
tttaccgtggtctggagaaacgtggcctgcatagccgcgagaagaagaaatcctgatactcttcattcttcaagccgcagatgcgttggcttcattagttcgccccagtcacttactacagtaagctcctggggcctcactaacttgccgcctttctgcaacttgaattatttcgagtatctacggtag

SEQ ID NO: 3627 - DNA, 345 bp, Klebsiella pneumoniae
aggcacgtggtgaacgatggcggtaatatcctccgcgcgggtgacgcaaggcacaaaaaaaccgcatgcgccgtgtttggcgtagagttgaccgcgatagagcgtctgaaccagcgcatcttgtacgttgagaagaaaggtatcggtgcggacattaacaaacagaccgggacaggcgcgggttatttcctgcagtttgacggcaaagcgctccgcatcgtcaagacgacgcgtaccatccaccacatgactatcctcgagatttattccactcacgccgagatgcgccagacgccggatattgtcaatgatgtggctggttgtcgcgccgtagcccgcctctaa

SEQ ID NO: 3628 - DNA, 366 bp, Klebsiella pneumoniae
ccctgcgtggttaagctcgcatttcccagggagttacgcttgttaactcccagtcatttcactttcgtcttccagcagccacaacgggctggcacgccgcaaatcaccatcctcggccgcctgaattcgctggggcatccccgcatcggtctcaccgtcgccaagaaaaacgtgaaacgcgcacatgaacgcaatcggattaaacgtctgacgcgtgaaagttttcgtttgcgtcaacatgaactcccgccaatggatttcgtggtggtggcgaaaagaggggttgccgacctcgataaccgtgctctctcggaagcgttggaaaaattatggcgccgccattgtcgcctggctcgcgggtcctga

SEQ ID NO: 3629 - DNA, 696 bp, Klebsiella pneumoniae
tgtccggcggtgcttttgcggttacgcaccaccccgtcagtagctgaacaggagggacagctgatagaaacagaagccactggagcacctcataaaacaccatcatacactaaatcagtaagttggcagcatcacccgcttgcggaatgggaggatatccgggatgaattaactcaaaaaggcgcacaggttgaagagttaattaatcaactcaaagcacggcaactccctgcccggcaggatgagcttagcaagcagcgctcaatggtggccgcggcaaaactcgaacgggataaggcgctgtgggatgtccagcaaacgacgattgtttctccggtcaatgctaaggtcttcgatattatttatcgtgccggggagcgcccttctgctggtaaaccaataatcagtctgttacctcctgagaatataaaagtacgcttctttatacccgaagcgaagctcggtaaatttaaaatcggatctaaggtaaaacttatatgcgatggttgcgctgagcccattgctggcattattaactatatcagccctgaggccgagtttacgcctccagttatttatagtacgaaacgtcgtgagaagctcatttttatggcggaggctatccctgcgctgcagcaggcagggcggatgaaaatcggccaaccgtttgatgtggagattattggcgatgaataa

SEQ ID NO: 3630 - DNA, 975 bp, Klebsiella pneumoniae
cggatgcgggtattgatcgttaaaacctcctccatgggcgacgtgctgcacacgctgcccgcgctaaccgacgccgcgcaggctatccccggcatccgcttcgactgggtggttgaagagggtttcgcgcagatcccctcctggcatgaaagcgtcgagcgggtgatcccggtggcgatccgccgctggcgcaaagcctggttctccgcgccgatcaaagccgagcgtcaagcctttcgcgaggccgttcaggcggtaaagtatgacgccatcatcgacgcccaggggctggtaaaaagcgccgcgctggttactcgcctggcgcacggcgtcaagcacggtatggactggcaaacggcccgcgagccgctggcgagcctgttttacaaccgccgccaccatatcgcgaaacagcagcacgcggtggagcgtacccgtgagctgttcgccaaaagccttggctacgcgaaaccccagacccagggggattacgccattgcgcgccatttcctgcagcacgaggctagcgctgccgcgccctatctggtgtttctgcacgccaccacccgcgacgataagcactggccggaaacccgctggcaggagcttctcgatctgctggccgacagcggcgtccacattaagctgccgtggggggccccgcacgaagaggcgcgggcgaagcggctggcggaaggccgggagtatgtcgaagtgctgccgcgtatgagccttgagcaggtggcgcaggttctggccggcgcccgggccgtcgtctcggtcgataccgggctgagccatctgaccgccgcgctggataaaccgaactttacgctctacggcccgaccgacccggggctgattggcggatacggtaaaaaccagcatatcgtgcggccggaaaacagcgccagcaccggcgatattgcggccagccggattcatcttctcctgcaaaatcaggggctgctctga

SEQ ID NO: 3631 - DNA, 225 bp, Klebsiella pneumoniae
aatctttctttattatttttgcgtttcattaagcaagcgataaaatttagaaaagagaaagagtgtcaaatccatgagggaatatataaaggattgcggagctatttttacgtagacattagtcttatgtatactccgccgtgccagatattaaacttggtcacatacctcaagctgcatccaaacttctatcaattaagtaatcctctgcaccaagttttataa

SEQ ID NO: 3632 - DNA, 225 bp, Klebsiella pneumoniae
ttagtgtcattaactatctccagtatcgcgctgccgaatggttattttccctctccactttcacaaaatattcttattttctccatgattatttgccttaattttttgcgttctaaaagtaagcaaaaaaacctttccattatcccgacggatcgtataatggggaaaaatgagaatgatcattctcaccacaaaaccagaggagatgcgcttttcacctcctga

SEQ ID NO: 3633 - DNA, 1674 bp, Klebsiella pneumoniae
ggcaggtctttattattaccgatacgcttactgcagcagagaaatatccgccacctgcaggaacagttcacgcagtttggacagcagcgtcagacggttgatgcggacatctttgtcttcagcgttaaccatcacgttctcgaagaactcatccaccggctcgcgcagcgcggccagctcaatcagcgcatcctgataacggcctgcggcgaaatacggctgcagcttgtcgcgcagcaccaccagattacccgccagcttaatttccgccgcttctttcagcaccgaagcgtgaacgatgtcgttcagcgtctcatcggatttcgcgaggatgttggagacacgtttgtttgccgccgccaacgcggaggactcttccagagtacggaagtgcgataccgccttcatacgcgcatcgaaatccgccgggcgggttggacgacgcgccagtaccgcctggatcgtgtcgacgccgtagccttcgtcctgataccaggcacggaagcggcccagcataaagtcgatcacatcatcaaccacgttggcgttggtcagcttctcaccgtacagacgaaccgcttcttcggtcagcgtctgcagatcgagatccaggttcttctcaacgatgatacgcagcacgcccagcgcggcgcgacgcagcgcaaacgggtctttatcgcctttcggatgctgaccgataccaaagatacccgccagggtgtccatcttatcggcaatcgctaccgcgcaggccaccggattagacggcagcgtgtcgccagcaaatcgcggctgatactgctcgttcagcgccacggccacgtcttccgcttcgccgtcatggcgcgcgtagtgcatccccatcacgccctgggtgtcggtgaactcgaagaccatgttggtcatcaggtcgcacttggacagcaggcccgcgcgggttgcgtggttcacgtcagcgccaatctgttcggcaatccaacccgccagcgcctggatgcgatcggtcttgtcgcgcagagtcccaagttgctgctggaacagcacggtttccagacgcggcaggttattttccagacgttttttacggtcggtattgaagaagaactcggcatcggccagacgcggacggaccaccttctcgttaccggagatgatctgctgcggatctttggactcgatgttggccacgaagataaagttcggcagcagtttgccggcgttgtcgtagaccgggaagtacttctggtcgcccttcatggtgtaaaccagcgcttcagacggcaccgcgaggaatttttcttcgaacttcgccgtcagcaccaccggccattccaccagcgaggtgacctcttccagcaggctttcgctcagatcggcttgaccgccaatcttacgcgccgcctcttgcgcatcagctttgattttggctttacgctgttcgtaatcggcaatgactttaccgcgctccagcaggatctgcgggtactggtcggcatggtcgatggtgaactccggctcgcccataaagcgatgcccgcgaatcacgcgatcggacggaataccgaggatagtggccgggatcactttgtcacccagcagcaaagtcaccgtgtgtaccggacgcacgaagtggacgtcagacgcgccccagcgcatcagtttcgggatcggtag

SEQ ID NO: 3634 - DNA, 1716 bp, Klebsiella pneumoniae
ttaatgatttcaaccaattcatgcaattggatagatctaaaaattggggacattgcagacgttgttgctggagggaccccaaagtctggtaatcaagaaaactttaaagaatctggtacggggattccttggttaaccccagcggatcttagtggttatactggcaaatatataagcttcggtgctcgagatttgagtcagcaagggtacgattcgagttccgcaaaaatattgcctaaaggaagtttgctgtttagcagtcgtgcaccgattggatatgtagccattgcacaaaatgagatttcaacaaatcaagggtttaagagctttgtttttacctatggtgtcgattcagtttatgcctaccactaccttagaagcattaaggatgtagctgaaagtatgggcacgggcacaacctttaaggaaatttcgggcgctactgcaaaaacgttgcctttcatacttccccctttagctgaacaaaaagttattgccgataaacttgatacactgttggcgcaggtggaagctactaaggcccgtctcgaacgcatccctgaaatcctaaagaccttccgccaatctatcctcactgccgcagttagtgggaagttgacagagatatggcgaatgaagaataaattcaacaacgtagcagtgaaacacaatgtcaatctgccaacgttaacccaagatgaatattaccttgaccctatcgaaggatggcaatgggtgagactagggtctgttgttaatctcataaatggagatagagggaaaaattatccgaataaaagtgaatatgtggaaaaaggaattccatttatcaatacagggcatattaatgcagacggaacacttgctgatgaacgcatgaattttatttctgaagctaagtatggctcattaagtggagggaaaacgaaatcaacagacctagtttattgtctccgtggagcaacaatgggaaaaaccgcccgtgttcactacaaaataggggcgattgcatcctcccttgtaattgtcagaccaagtgattacatagacagagatttcgcatattattttcttattagtcctcctgctaaaaatttaattaataagtttgataatggttctgctcagccgaatctatcagcaaagagtttggctacataccctttacaactcccttcgtgtaaagaacaaatcgaaattgtccgccgcgtcgaagaacttttcaccttcgcagatcatgccgaaataaaagttgcaattgcattagagcgaatcaataaaatcagtcaatctatactagttaaagctttccggggtgagctaactgctgattggcgcgtggccaacccggatttaatcagcggagaaaacagtgtcgaagtcttgctacaaaaaattaagaccgcacgtgaggctgtcaaaaaacaacctaaaccaacacgttctgccgtaaaaaaaaatgcaggtagccgtatgagcaaacagattatcaaagtagttgaagcgttaaaacaagctggagaaccgcttagtggtcagcaattgttagcggcggctggctatcccaacgacagcagcactgagcaacttgaacagttctttctagatattcgtgacgctcttgccattgaaaaatccattgtaaaacttgagcgtggtgatgacggccaagattggttcaccttagctgagaaagtcgagataagcaaagcatag

SEQ ID NO: 3635 - DNA, 255 bp, Klebsiella pneumoniae
gtgtccacttcctggaaggcgtcggtaccgatcatcgaggccggtacctggccggtgatgcagaccagcggaatcgaatccaggcgggcatcggcgatcgccgtcaccaggttcgtcgcccccgggccgctgcaggccatacagaccgccggcttgccttcggtacgcgccatcccctgggcgataaagcccgcgccctgctcatggcgcgccaggatgtggcggatctgcgtgctctggcttaaggcatcgtag

SEQ ID NO: 3636 - DNA, 1146 bp, Klebsiella pneumoniae
tgctcgacttctatcaggtgggctgattttcactttctgcatataactgttattgccgttagcccgtttttcccctcccggcagcggtctacgatggctccatcttttcattcacccgaatcacagaccggagcagttatgaaagctatcgccattactcaagccgccgctgacggcaacaacatcccttctttaaccgagatcgacctgccgatccccaccgcccacgggcgtgatctgctggtcgctgtgaaggctatctcggtcaatccggtagacaccaaagtgcgcgccggctttcagggcgacacgccgcgggtgctgggctgggacgccgttggcgtggtgcagtccgtcggtgaggaagtgacgctgttcgcgcccggggacgaggtctggtacgccggcgcgctgggccgggccggcagcaacagtgaatatcagctggtggatgagcgcctggtggcgcacaaaccgcgcaccctcgataatgcctccgccgccgcgctgccgctgacggcgatcaccgcctgggagctgctgtttcaccgtctcggcgttgaggaaggcggcaatgcgggcgacacgctgctaatcgtcggcgcggcgggcggcgtggggtctatcctgacccagctggccagtaaactgaccgccatgacggtgatcggcaccgcctcgcgtcccgagagccagcagtgggtccgcgaggcgggcgcgcaccatgtgatcgatcacagcaagccgctcgccgacgagctggcgcgcattggtatcacgtcggtaacccatgtcgccagcctgaccaataccgagcagcacttcaacgcgctgatcgacgccctcgccccgcagggcaagctggcgctgattgatgacccggagaccctggacgtggtgccgctgaaagcgaaaagcctgtccctgcactgggaatttatgttcacccgttcaatgtttgagacggatgatatgatcgcccagcatcagctgctcacccgcgtggcggcgctgatcgacaaccacactatcaaaaccacccttggcgaacactacggcgccatcaccgccgccaatctgcagaaagcgcatcgccagctggaaaccggacgcgccgtcggcaagatcgtgctggaggggttttaa

SEQ ID NO: 3637 - DNA, 252 bp, Klebsiella pneumoniae
tcagattattcccaaaaggaggacgtgatggcaaagatcggcgacggcgtaccacgtttaatcgacaaagcggttgattttatggcttccagtcaggcgtttatggagtatttgaaaaagtctccgcgtctgcagcatgtaccgcgagacattcctcaggataaggaagcgttgttcctgcagcgtctggaatattatcgtcagctttaccggccgacctgcgaccagacggaaccggaatcagagcgttga

SEQ ID NO: 3638 - DNA, 600 bp, Klebsiella pneumoniae
tcgggctgttcccggcggctttctcctgctatgttcggaggattcgccctgcccggaacgacgcttatgcctgaacttctgacgccgcgcctgcgctgctcaccgctgcagctggacgactggtcgttttttctttccctgcagcaggatccgcaggtcatgctctacgttgccgatccccggccgcaggcggccatccgcgaggcgttcgattcgcggctgccgccgtggacgcccggggatgaacactggctgtgcctggtggtgcgcgacaggctgacccataccccgctcggcctgaccggttaccagcatcatcagcgcgacattgccgaggttggctttctcttcgccccggcggcgcagggccggggctacggctacgaatcgctgcgcgcgctgtgcgactacgcctttaccaccggcggcgtgcgccgcctgaccgccagcgtcaccgccggcaacgaggcgtctaagcagttactgctcaaagccggcttccggctggagggagagctgcgggaaaactactggctcaacggacgctggcacaacgactggctgttcggtcggctgcgtggggagggcgatgcgccgtag

SEQ ID NO: 3639 - DNA, 1770 bp, Klebsiella pneumoniae
aacctacctttcaggagtaagacaatgataaaaacaacaatatggcgtcaggtggtcatcgctgcgttgctggcggggggcagctttaccgtcgccgccaatccgccaccgccgccgccggtctcttatggcgtagaggaagatgtgttccacccggtacgcgcccggcaggggatggtggcctcggtggacgcgctggcgacccgcgtcggcgtggatatcctgcgccagggcggtaacgctgtcgatgcggcggtagcggtaggctacgcgctggcggtcacccatccgcaggccgggaatattggcggcggcggttttatgatgctgcggactaaagacggcaagaccacggcgatcgatttccgcgaaatggcgccagagcaggccacccgcgacatgttccttgacgaccagggcaacccggacagtaaaaaatcactgacttcgcatctggcctccggcacgccaggcagcgtcgccggtttctccctcgcgctggaaaagtatggcaccatgccgttgaacaaagtgatccgtccggcgatcaagctggcggaagaggggtttatcgttaacgatgcgctggcggacgatctgaagacctacggcagcgaagtgatcccgcagcatgaaaatagtaaagcgatcttctggaagaacggcgagccgctgaagaagggcgatcggctggtgcagaagaacctcggtaagagcctggagctgattgccgagcacggcccggacgccttctataaaggggccatcgccgaccagatcgctaacgagatgaaaaagcacggcgggctaatcaccaaagccgatctcgccggctataaggctgtggagcgtacgccggttagcggcgagtatcgcgggtatgaggtttactctatgccgccgccgtcctccggcgggatccatatcgtgcagatcctcaatatcctcgaaaacttcgatatgcagaaatatggttttggcagcgccgacgccatgcaggtgatggcggaggcggagaaacacgcctacgccgaccgctctgaatatctcggcgaccctgacttcgtcaacgtgccgtggcaggcgctgaccagcaaggcttacgccaaagcgatcgccgccgagattgatgtcaacaaggcgaagccttccagccagatccgtccgggcaagctggcgccctatgaaagcaaccagaccacccacttctcggtggtcgataaagacggcaatgcggtggcggtgacctatacgctgaataccaccttcggtaccggcattgtggccggtgattccggcattctgctcaataaccagatggatgatttctcggcgaagcccggcgtgcctaacgtctatggtctggtgggcggcgacgccaatgcggtggagccgaaaaaacgcccgctgtcgtcgatgtcgccgaccattgtggtgaaagatggcaaaacctggctggtgaccggcagcccgggcggcagtcggatcatcaccaccgtactgcagatggtggtcaataccatcgatttcgggatgaacgtcgcggaagccaccaacgcgccgcgtttccaccatcaatggctgccggatgagctgcgggtggagaaaggctttagcccggataccctcaagctgctggaggcgaaggggcagaaagtggcgctgaaagaggcgatgggcagtacccagagcatcatggtgggaccggacggcatgctgtatggcgcctccgatccgcgttcgccggatgatttaacggcggggtattga

SEQ ID NO: 3640 - DNA, 297 bp, Klebsiella pneumoniae
cggcaacgttctatagtacgttttttgctttttacgataaccctggggcgagaggccccggccctggagaaatggatgaaatcactgtttaaagtaacgctgctggcggccacaatggccgtcgccctgaatgcaccgctgaccttcgctgcagatacggcaacgaaggcagccccggcggctgagagtaaatcggcatttaaaaatgacgatcagaaatcggcctatggcgctgggcgcgtccatggggcgttacatggaaaactccctgaaagaacaagagaagctgggcattaa

SEQ ID NO: 3641 - DNA, 603 bp, Klebsiella pneumoniae
ggtttcagttcatgccctgcggcgctgggtgtctgcgaagcgggtttatcattaacgaatagtcttagtagtaccgaaaaaatggcagagaaacgcaatatctttctggttgggcctatgggtgccggcaaaagcactattgggcgccagttagcccaacagctcaacatggaattttacgattctgatcaagagattgagaaacgcactggcgctgatgtgggctgggtcttcgatgttgaaggcgaagaaggcttccgtgaccgtgaagagaaaattatcaatgagttgacggaaaaacaggggattgtgctggcgactggcggcggctctgtaaaatcccgtgaaacgcgtaaccgtctctccgcccgcggcgtggtggtctacctggaaactacgatcgagaagcagttggcccgtacgcagcgcgataaaaagcgtcctttgctacaagtcgatgcgccgcctcgtgaagtgctggaagcgctggctgacgagcgtaacccgctgtatgaagagatcgccgatgtgactatccgcacagacgatcagagtgcgaaagtcgtcgcgaaccagattattcatatgctggaaagcaactga

SEQ ID NO: 3642 - DNA, 1332 bp, Klebsiella pneumoniae
agcccgggttcgccgggcatttttatttttgcgcttatgaaaaagaatataaatttacgcagcctggccgcccaggctatcgagcaagttgttgaaaaagggcagtctttaagcaacgtactgccccctctacagcagaaagtcagcgataaagataaagcgctactgcaggagttgtgctttggtgtactacgtactctaagccagctggagtggcttatcagcaagctaatggcgcgtccgatgaccggcaaacagcgcaccgtgcactttctgatcatggttggtctctatcagttactctacacccgcattccaccacacgccgcgctggcggaaacggtagaaggcgcggtggccattaaacgcccgcagcttaaagggctaatcaacggcgtgctacgccagttccagcgccagcaggaagcgttgttagccgaatttgctgagcatgaaaaccgctatcttcatcccaaatggctgctgaaacgcctgcagcaggcctggccggagcagtggcaggagatcgtcgaggcgaacaaccagcgcccgccgatgtggctgcgcgttaaccgcaaccatcattcccgggatgagtggcttgccctgcttaacgagaccggtttagagggctttacccaccctgattatccggacgccgtacgcctggccacccctgctccggtccacgcgttaccaggctttgccgaaggctgggtgaccgtccaggatgcctcggctcagggctgtatgcgctacctgcaaccggaaaatggcgaacgcattctcgatctctgcgcggcgccgggcgggaagacgacgcatattctggaagtcgctccccaggctcaggttatggcggtggatattgatgaacagcgtttgtcccgcgtctatgacaacctgaaacggctgggcatgaaagccgaagtcaagcagggcgatggccgcttccctgagcagtggtgtggcaatgagcagttcgatcgtattctgctggatgccccctgctccgcaaccggcgttattcgccgccatccggatatcaaatggctgcgccgggatcgggatatcgccgagttagcccaactgcaggccgagatcctcaatgccacctggacgcacctgaagccaggcggcacgctggtttacgcaacctgttctattctgccggaagagaacagtcagcaaattgccgctttcctcgcgcgaactccggatgcagaacttcacgccaccggcacgccggcgagccccgggcagcaaaatctgccgggcgtggaagaaggtgatggcttcttttacgctaagctaatcaaacgtcggaactaa

SEQ ID NO: 3643 - DNA, 303 bp, Klebsiella pneumoniae
aaggagttctcaatggaatataaagatcccgtgtttgaactgctgagcagcctggaacacatcgtttttaaggatgataatcagaaacttacctcaaaccgtaagtccactgtgtttagtgaatttgagcaactgcgtaaaggcactggacttaagattgacgactttgccaacgtcatgggcgtgagcgtcgccatggtaagagagtgggagtcgagacgggtcagaccgtctcccactgagctgaaattgatgcgcctgattcaggccaatccacagctttcacgacaattactcgattaa

SEQ ID NO: 3644 - DNA, 540 bp, Klebsiella pneumoniae
aggctaccctcccgcgaatgtagcacgcaggacgcgggcgaaacggcagcgccagctgtcaggtccaatggtcatcgacaaacttatggaaggagtaacactatggcttacaaacatattctgattgcagtagacctgtccccggagagtaaagtactggttgaaaaagccgtttctatggcccgcccgtataacgcgaaagtctccctgatccatgtggatgtgaattactccgacctctacaccgggctgattgacgttaacctcggcgacatgcaaaaacgcatctccgaagagacccatcacgcgctgaccgagctctcgaccaacgcaggctatcccatcaccgagaccctgagcggcagcggcgaccttggccaggtgctggtcgatgcgattaaaaaatacgatatggacctggtggtctgcggccatcatcaggacttctggagcaagctgatgtcctctgcccgccagctgattaacaccgttcatgtcgacatgctgatcgtcccgctgcgcgacgaagaagacgaataa

SEQ ID NO: 3645 - DNA, 699 bp, Klebsiella pneumoniae
ttgccgagctcagcgagcgcggcctcgacctggtcccccgtcgtcgataaaggcgagctggtcggctgcctgatggagaaggagatcgcccatctgctggaggatgacgtcaccgaagatgctcagctgcagggggcaacgctgccgctggaaaaaccgtacctcgagatcagcccctggacgctgtggaaaaaacgctcggtgtggctgctgctgctgttcgtggccgaagcctacaccagcagcgtactgcagcatttcgaagaagccctggaatcggccatcgcgctggccttctttattccgctgctcatcggcaccggcggcaacagcggaacgcagatcacctcgacgctggtgcgctcgatggcgctgggggaagtgcgactgcgcgatatggggcgggtgatccgcaaagaggtatcgacctcgtttctgattgccctgaccctgggcctggcgggctgcctgcgcgcctggatgatggggataggcatggaaatcacgctcatcgtcagcctgacgctggtctgcattaccctgtggagcgcgattgtctcctcggtcattccgatggtgcttaagcggatcggcatcgacccggcggtagtttccgcgccgtttatcgccacgctgattgatggcaccgggctaattatctatttcaaaatcgcccagtattttcttgggttgaactga

SEQ ID NO: 3646 - DNA, 1914 bp, Klebsiella pneumoniae
gccccattatcgtctactgggcccggaggcagcagccagaggagctgcgcagccgcgccctggcctaccgggactggttggccaaccccatcgccgccggaggtgtccatggcgggatctgatttgctgctggcgggggtgttgtttttgttcgcggccgtcatcgccgtccctctggcttcaagactggggattggcgcggtgctgggctatctgctggccgggatcgccattggtccgtgggggctcgggtttatcagcgatgtggatgaaattctccatttctctgagctcggcgtagtgtttctgatgtttatcatcggcctggagctcaatcccgccaagctatggcgactgcggagctccatcttcggcgttggcgcggcgcaggtgatgctcagcgcggcgatcctcggtgggttgctgatgacgaccgggttttcatggcaggcggcggtggtcggcgggatcggcctggcgatgtcttccaccgccatggcgctgcagctgatgcgtgagaagggaatgagccgcagcgaagcgggacagctaggcttttcggtgctgctgtttcaggatctggcggtgatcccggcgctggcgctggtgcccctgctggccggttcagcggatgagcatgtgaactggttgacggtcggcatgaaggtcctggcctttgccgggatgctgattggcggacgctatctgctgcggccggtgttccgttttatcgccagctcgggggtcagggaggtgttcactgccgccacgctgctgttggtcctcggatctgccctgtttatggaggcgctggggctgtcgatggcgctgggcacctttattgccggcgtgctgctggcggaaagtgagtatcgccacgaactggagatcgctatcgatccgttcaaggggctgctgctcgggttgttctttatttccgtcggcatggcgctgaaccttggcgtactgtatacccatctgctgtgggtggcggtgagcgtggcggtgctggtggcggtaaaaatgctggtgctctatctgctggcccgtctctatggcctgcgaagttccgagcggatgcagttcgcgggcgtattaagccagggcggcgagttcgcgtttgtcctcttttcgctgcccgcctctcagcggttgtttcagcacgaccagatggcgctgctgctggtggcggtaacgttgtcgatgatgacgacgccgctgctgatgaaggggatagataagctattgtcgcgacggctgaacccggcggacgataccggtgaggcgccgtgggtggaggatgacaagccgcaggtgattattgtcgggtttggtcgctttggtcaggtcattggtcgcctgctgatggccaataagatgcgtattacggtactggagcgggacatcagcgcggtaaatctgatgcgcaactatggctataaagtctattttggcgatgccacccagctggagctgctgcgctcggcgggagcggaagaggcgcagtcaatcgtcatcacctgtaatgagccagaagataccatgcggctggtggaaatgtgtcaacaacactttccacatctgcatattctggcccgcgctcgcgggcgcgttgaggcgcatgagctgctgcaggccggcgtgacgcagttttctcgtgaaactttctccagtgcgttggaactggggcgcaaagcgctcatcaccctcgggatgcatcctcaccaggcccagcgcgcgcagctgcacttccgacgcctcgatatgcgaatgctgcgcgagctaatgccagtgcatactgatacggtacagatatcacgcgtgcgggaggcccggcgcgaactggaagagattttccagcgcgaaatgcagaaagagagccggcagctggacggctgggacgagtttgaataa

SEQ ID NO: 3647 - DNA, 1320 bp, Klebsiella pneumoniae
ccgatgatatcgttacgacatacagctttaggactggcgctgagcctggcttttgccggtcaggccctggcggttaccaccatcccattctggcactcaatggaaggcgagctgggtaaagaagtggattctctggcgcaacgctttaacgcggccaatcctgattacaaaatcgttccggtatacaaaggcaactacgagcagagcctgagcgccggtatcgccgccttccgtaccggcaacgcgccggctatcctgcaggtgtatgaagtcggcaccgccaccatgatggcgtcaaaagccattaagccggtctaccaggtgtttagcgaggcgggcatcaagtttgatgaatcgcagttcgtaccgacggtggccgggtattacaccgattcgaaaaccggccatctgctctcccagccgtttaacagctctaccccggtgctctactacaacaaagacgccttcaaaaaagccggcttagatccggatcagccgccgaagacctggcaggatctggcggcctataccgcgaagctgaaagccgccgggatgaagtgcggctacgccagcggctggcagggctggatccagattgaaaacttcagcgcctggcacggtctgccggtggccacgaagaataacggcttcgacggtaccgacgcggttcttgagttcaacaagccggagcaggtgaagcatatcgcgctgctcgaagagatgaacaagaagggcgatttcagctacttcgggcgtaaagacgagtctaccgaaaagttctataacggcgactgcgccattaccactgcctcgtccggctcgctggccgatatccgccagtacgccaaatttaactacggcgtcggcatgatgccttacgatgccgacgtgaaaggcgcgccgcagaacgccatcatcggcggggccagcctgtgggtgatgcagggcaaagacaaagagacctacaccggcgtggcgaagttcctcgacttcctgaccaaaccggaaaacgccgccgagtggcaccagaaaaccggctacctgccgatcactaccgcggcctacgatctgacgcgtcagcagggcttctatgataagaacccgggcgctgatatcgctacccgccagatgctgaacaagccgccgttgccgttcaccaaaggtctgcgcctgggcaacatgccgcaaatccgcaccatcgtcgatgaagagctggagagcgtgtggaccggcaagaaaaccccgcagcaggcgctggattccgccgtgcagcgcgggaaccagctgctgcgtcgcttcgagcaagcgaccaaatcgtaa

SEQ ID NO: 3648 - DNA, 1254 bp, Klebsiella pneumoniae
tccacaggattaaaacctaagtcccgtgctctctccgaaggggagagcactatagtaaggaatatagccgtgtctaaagaaaaatttgaacgtacaaaaccgcacgtcaacgttggtactatcggccacgttgaccatggtaaaactaccctgactgctgccatcactaccgttctggctaaaacctacggtggttccgctcgcgcattcgaccagatcgataacgcgccggaagaaaaagctcgtggtatcaccatcaacacctctcacgttgaatatgacaccccgactcgccactacgcgcacgtagactgcccgggccacgccgactatgttaaaaacatgatcaccggtgctgcgcagatggacggcgcgatcctggttgttgctgcgactgacggcccgatgccgcagactcgtgagcacatcctgctgggtcgtcaggtaggcgttccgtacatcatcgtgttcctgaacaaatgcgatatggttgatgacgaagagctgctggaactggttgagatggaagttcgtgaactgctgtctcagtacgatttcccgggcgacgacaccccgatcgttcgtggttctgctctgaaagcgctggaaggcgacgcagagtgggaagcgaaaatcatcgaactggctggccacctggatacctatatcccggaaccagagcgtgcgattgacaagccgttcctgctgccgatcgaagacgtattctccatctccggtcgtggtaccgttgttaccggtcgtgtagagcgcggtatcatcaaagtaggtgaagaagttgaaatcgttggtatcaaagaaaccgcgaaaaccacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaacccgcacaccaagttcgaatctgaagtgtacatcctgtccaaagacgaaggcggccgtcatactccgttcttcaaaggctaccgtccgcagttctacttccgtactactgacgtgactggcaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgtagctaaagttctgggctaa

SEQ ID NO: 3649 - DNA, 2112 bp, Klebsiella pneumoniae
atgaaaaaatctcttttttggttgctggcgctggtgctgtcacccgtcgccgtgctggtggtgatcacgccgatggacagccaaaagcagtatatttttggtctgttaagtatcggtattctctttctgatgggcttcagcaagcgccgcagcgtatcggtcattatggtcgtcacgtcgctgctgatgtccacccgttacatgtattttcgcctcacgcagaccctgcacttcaactcgtccattgaagctattctcggcatgggactctttctggcggaagtctatatctgggtgatgctactgcttaactatctgcagacggtctggccgctgaagcgcggcattgttccgctgccggatgatatgagtaagtggccgacggtcgatatctatattccgagctataacgaaccgctggaggtggtgcgcgataccgtcctggcggcacaatgcattgattatccaaaagataaaatgaaaatctatcttctggatgacggtaagcgcagcgagtttgccgtcttcgccgccgacgttggggtgggctatatcacccgcaatgacaacaagcacgccaaagcggggaaccttaaccatgcgctgaccctgactcagggggagcttatctgcgttttcgactgcgaccacgtcgccacgcgcgtcttcctgcaggccaccgtcggcggtttcctgaaagacccgatgctggctctggtgcagacgccgcactacttctattccccggacccgtttgaacgtaacctctccgtcggacgcaacattcccaacgaagggatgttgttctatggcccgattcagcaggggaacgacaactggaacgccacctttttctgcggctcctgcgcggtgatccgtcgcgaggcgctggcgcagatcggcggtttcgccgtcgaaacggtgaccgaagatgctcatacggcgctgaagtttcagcgtctggggtggaagtcggcctttctcgatatcccactggccgcaggcctcgctactgaacgcctggtggtgcacgtcatccagcgtacccgctgggcgcgcgggatgacgcagattttccgcgtcgataatccgctgtttggccgcgggctgacttttcagcagcgcttgtgctatctcagcgccatgctctactaccagttcgcgctgcccagggtggtgtttgtcaccgccccgctggcttacctgctgtttaacctcaatattatttactcgtcggcgagcctgatcgtctcctatgccctgccgcacctgttcctcgctatttacgtcggttcgcgaatgaacggccgctatcgctacagcttctggggggaaatttacgatattgtgctggccttccacctggtgctgccgaccctggtgacgatgattttccctaaacgcggcaagttcaacgtcaccgataagggcggcctgctggacgtcggctacttcgatttcaccgtggtgcgcccgcacctggtggtggcctgcctgctggcgctgggggtggtggtcggcatcgtccgggcgattggccatgactattttggctcggatcccaacgttatcgccctcaacgtcgggtgggggatctacagtctgatcttcctgctggcggcgattgccgtggcgcgcgaaacgcggcaggtgcgaaaaaccattcgtatcgatgtcgatattccggtggtgatccattacgccagcggcatcgtctcgcgcagccataccgcggacctgtcgatgggcggctgccgcgtggtcgcgcctgataatcgccatctggaggatgacatcgaagagattgagctgatcctgcagtccggggctatctcgattccggcccagcttgtcacctctgacgagcgcttcctgcgcctcaagtttgatgaagatattccgctttcgcgccgccgtgaactggtgcgcgtggtgctggcccgcgcggatgcgtggattaatccgccgcgcccgcaggataacccgttccgctccttcttcaccattttacgctgcgtgttcgaactgttctggctgacgtggaaaacccgtcgcagccagcgcaatcgggcaacagtggcgaaaacggcgcaggaggatgggacgttatga

SEQ ID NO: 3650 - DNA, 2001 bp, Klebsiella pneumoniae
agaggaagatcgttcatgaaagccgtagtcttcgcttatcacgatatgggctgcaccggtatccagtccctgctggacgccgggtatgatatcgctgctattttcacccacccggataaccctggcgaaaaccatttctttggctccgtggcgcgccttgccgccgagcagggtattccggtgtgggccccggaagacgtgaaccatccgctgtggattgagcgtatccgcgagatgaaaccggacgtgctgttctccttctactatcgcaacctgctgggcgatgagatcctcaatctggcgccgaaaggggcgttcaacctgcacggttcgctgctgccaaaatatcgcggccgcgcgccgctgaactgggtgctggtcaatggcgaaagcgaaaccggcgtcaccctgcaccggatggtgaaccgcgcagacgctggcgatatcgtcgcccagcaggccgtggcgattggcgcggatgacgccgccctgacgctgcatcgtaagctgtgcgctgccgccactgagctgctgagccgggcgctgccagcgatcctcgccggcaccaccgatgagcgtccgcaggatcacagccaggcaacctatgtggggcgtcgtaccccggaagatggccggctggactgggagctgccggcgcagaccctgcacaatctggtgcgtgcggtctcggatccgtggccgggcgccttcggctacgccggagcgaacaagtttatcgtctggaaatcccgcgttcgccacgatttgccagcagctaaaccgggcaccgtgctctccattgctccgctgatcgtcgcgtgccaggacggggcgctggagattgtcaccggccagaccgaacgcggcgtgtacatgcagggcgctcagctggcgcaggcgctgggcctggtgtccggggcggtgatcagcagcaaaccggtggtggcgattaagcgtcgcacccgggtgctgatcctcggcgtcaacggctttatcggtaaccacctgaccgagcgcctgctgcaggacgacaactatgagatttacggtctggatatcggctccgacgccatcagccgttttctcgactgtccgcgtttccactttgtggaaggcgatatcagcattcactctgagtggatcgagtatcacattaagaaatgcgacgtggtgctgccgctggtggccatcgccacgcctatcgaatacacccgcaacccgctgcgcgtgttcgagctggatttcgaagagaacctgaaaatcatccgcgactgcgtgaaatacaataagcgcattatcttcccgtcgacctcggaagtgtacggcatgtgcaccgacaaaaacttcgacgaagatagctccaacctggtggtggggccgatcaacaaacagcgctggatctactcggtctccaagcagctgctcgatcgcgtgatctgggcctatggcgataagaatggcctcaagttcacccttttccgtccgttcaactggatggggccgcggctggataacctcaacgccgcgcgtatcggcagctcccgcgctatcacccagctgatcctcaacctggtggaagggtcgccgatcaagcttatcgaaggcggcaagcagaagcgctgtttcaccgacatcagcgacggtatcgaagcgctgttccgcatcatcgagaacaaagacggccgctgcgacgggcagatcattaacatcggcaacccggataacgaagcgagcatcaaagagctggccgaaatgctgctcgcctgcttcgaacgtcatccgctgcgcgatcgcttcccgccgttcgccggcttccgtgaagtggaaagcagcgattactacggaaagggctaccaggacgttgagcatcgtaagccgagcatccgcaacgccaaacgctgcctgaactgggagccgaaggtggagatggaagaaacggtcgaacacacgctggacttcttcctgcgcacggttgaactggtggacgataaaaatccatga

SEQ ID NO: 3651 - DNA, 270 bp, Klebsiella pneumoniae
ttggcgggatcgattttaaacagtttggccgtcacgctacgtgatgcccagggcgatgtcccggctgtggtgatgcattatggggtattcattcagaacgttttcgatttcatcatcgtcgcgtttgccatcttcatggcgattaaattgatgaataagttaaatcgtaagaaagaagaggctccggcggcaccgccagccccctctaaagaagaagttctgctgagcgaaattcgcgatctgctgaaagaacaaaacaaccgttcttaa

SEQ ID NO: 3652 - DNA, 219 bp, Klebsiella pneumoniae
ttcactatgtccggtaaaatgactggtatcgtaaaatggttcaacgctgacaaaggcttcggcttcatcactcctgacgatggctctaaagacgtgttcgtacacttctctgctatccagaacgatggctacaaatccctggacgaaggtcagaaagtatccttcaccatcgaaagcggcgctaaaggcccggcagctggcaacgtaacttctctgtaa

SEQ ID NO: 3653 - DNA, 681 bp, Klebsiella pneumoniae
cgttatccgtcggctttttttaagctaaagggtacacggcagcagaattccgctacaatctgcgccactattcttcccatctcaggagatatcatgaaagtagcaaaagacctggtggtcagcctggcctatcaggtacgtacagaagacggtgtgttggttgatgaatctccggtaagcgcgccgctggattacctgcacggtcacggctccctgatttccggcctggaaaacgcgctggatggccacgaagtgggcgacaaatttgacgttgccgtcggcgctaacgacgcttacggtcagtatgacgaaaacctggtgcagcgtgtaccgaaagacgtcttcatgggcgttgatgaactgcaggttggcatgcgcttcctggcggaaaccgatcagggtccggtaccagtagaaatcactgaagttgaagacgaccacgttgtggttgatggcaaccacatgctggctggccagaacctgaagtttaatgtggaagtcgtcgccatccgcgaagcgactgcggaagagctggagcacggtcacgtgcacggcgcgcatggccacgatcacgatcatgaccatggtcatgacggttgctgcggcggccacggccacgatcatggtcacgaccatggtaaaggcggctgcggcggccacggtggctgcggctgccactaa

SEQ ID NO: 3654 - DNA, 210 bp, Klebsiella pneumoniae
tgggctacgtctggctgcggggtgagcgcgaatcgcaaagcggtatttatctgcagcgcggggttgatactcttctctttagtgtgggtaaatgctggctggtttgaccttttcggcatggcgatcgccaacggcgcgcacgtggctggtctggcgaccggcctggcgatggcgtttgttgataccttacatgggcgaaaacgcgcataa

SEQ ID NO: 3655 - DNA, 534 bp, Klebsiella pneumoniae
tcagtgatgtttaaagggacttttcacctgaatgaggaacaaggaatgagtgacatcgtgatacgccatgctgaaccgaaagatattgacgcgattcgtcaaattcacgcccagccggaggtgtatcacaacacgctacaggtccctcatccatccgaacatatgtggcgggagcggctaaccgatacgcccggcgtgaagcaactggtggcctgtatcgatgagcaagtcgtcggccacttaagcattgccgtcgtccaacgtccccgccgtagccacgtcgccgattttggtgtcagcgtggattcgcgctggcacaaccgcggcgtcgccagcgcgctgatgcgtaccatgattgatatgtgcgacaactggctgcgcgtcgagcgtattgagctgacggtgttcgccgataatgccccggcgattgcggtgtataagaagtacggctttgagatcgaaggcaccggcaggcgttacgcgctgcgcaacggtgagtatgtggatgcgtattatatggcgagaatgaagtag

SEQ ID NO: 3656 - DNA, 1392 bp, Klebsiella pneumoniae
acctctgtccctcgctcagtctgccaggaaagccgtatgactaagacaaccatcgacattcaggcctttatcaacgagcaccccttcacccgctaccagtggatgatccttgcgctctgctttatcaccgtcgcgatggacgggttcgataccgcaattatcgggttcatcgcctccgacctggtgcaagagtggggcgtggaaaaatcggccctcggcccggtgatgagcgccgcgctggtgggcctggcggtcggcgccttaaccgcagggccgctggctgaccgcatcggccgcaaaaaagtgctgatcatgtcgatcgtggtgttcggcggattcagcctgctcaccgccttcgccaccagccttaatcagctgacgctgctgcgcttcctgaccggtctgggccttggcgcggcgatgccgaatgccgcgacgctaatgagtgaatatgcgccggagcgccgtcgggcgctgctggtgaacctgatgtttgtcggctttccgatgggatcttcgctgggcggctttttatccgcctggatgatcccgcactatggctggcagagcgtgctggtgctgggcggcgtgatgcccctcctgctggcggtggcattaatattcctgctgccagagtccgtccgctatctggtggtgaagcagcacccggcgcagcgcattgctgctatcctgcgccgtatcgcgccgctgccgaaggcggtggaatttgtactacgcgaagcaggccaggtgaaagagaaatccgctatcggcgtcattttctcccctcgctacgcggtgggtaccgtgatgctgtgcctgacctactttatgggcctgctgattttctatctgctgaccagctggctgccgctgctcatccgtgaaaccggcgcctcgatgagtcaggcctcaattatcaccgccctgttcccgctcggcggcgggattggcgtgctgatcctcggcgccctgatggacaagatcaaccccaataaagtggtggccgtcggctggctgctgaccggcgtttttgtctgcctggtgggcttctccaccagcagcctggcgctaatgggagtgatggtctttatcgccggcagcattatgaacggcgcgcagtcgtcgatgccggcgctggcggctggcttctatccgacgcaggggcgcgccaccggcgtcgcctggatgctgggtatcggccgcttcggcggcatcctcggcgcgttcagcggcgccttcctgatgcaggctcagctctcctttgagaccattttcaccctgctggccatcccggcgttcctgtcagccattgcgctgctgatcaagtaccgggtcagtaaatccgtgccggcgacgacagatgaggcgagaagcctgcagaaagcctaa

SEQ ID NO: 3657 - DNA, 276 bp, Klebsiella pneumoniae
tcgaccgcccccgtttcatgcaggatcttcccgaacatcgcgccgagcgcgacgacgatcgccaggaagcccagcgtaccgcccatccctttctccatcgtcgccgcgattttatccagcggcatgccggagaagagaccggcgccaatagaaaccaccatcaaagccacgaaggcgtgcattcgcgccttcatgactaaaaacagcagcagcaataccgagccgactgctgttaaaacaagcgttaaagtactcactagtgactgcctttgttga

SEQ ID NO: 3658 - DNA, 1095 bp, Klebsiella pneumoniae
tgtgctgacccgtctgcatcaggacgcggtgtatctgcccatcagctatgtctcgctgatgtcggtcgcgcgccaggaggtcggggagatcccgttcgccccggtgaccagcgagatccctttcgaccagattaccccggtaacgccataatgctacgctatattttacgccgcctgctgctgctgatcccgctgctgctcgccgcctccgccatcatctttctgctgctgcggctcggcaccggcgacccggcgctggattatttacgcctgtcgaacctgccgcccactgaagagatggttgcctcgacacgcgagctgctggggctcaaccagccgctggcaatgcagtatctgcactggctatggcgggcgctgcacctggatttcggtctctcctatgccacccagcgcccggtgctggacgacctgctgcacttcctgccggccaccctgctgctcaccggcgcggcgctggcgctgatcctcgtcacctccctgccgttgggcatctgggcggcgcgccatcgcgatcgcctgccggactatatcgtacggctgattgccttcctcggcgtctcaatgcccaacttctggctggcctttctgctggtgatgctcttttccgtgcatctgcagtggctcccggcgatggggtatggcgactggcagcacctgatattgcccgccgtctccatcgcctttatgtcgctggcgatcaacgcccgcctgctgcgcgccagcatgctggacgccgccagccagcgtcacgtgatatgggcgcggctacgcggattgagcgcgcgccaggtggagcgccgacatatcctgcgcaatgccaccctgccggtggtgaccgccatgggcatgcacattggcgagctgatcggcggcaccatgattatcgaaaatatctttgcctggcccggggtcggccgctacgcggtttccgccattttcaatcgcgattacccggtgatccagtgctttaccctgatgatggtgacggtgttcgtgctggctaatctggcggtggatgtgcttaacgcggcgctcgacccgcgcctgcgccgccacgaggaggtgagcgcatga

SEQ ID NO: 3659 - DNA, 456 bp, Klebsiella pneumoniae
gccggtcgcccgtcgccactggcttggcgtcgggttgatcgtcgtgggcattgtcattctggggaccagcgtctgatgggctttttctgggcattactcagcgtcggcctcgtcagcgccgcgcagttgctgctgcgcagcgccatggtggccttgccgccgctgaccgatattgtggcatttctccagcatctgctgcatttccagcccgggactttcggcctgtttttcggcctgctgggctacctgctgtcgatggtctgctggtactttgccctccatcgcctgccgctgtcgaaagcgtatgcgctactgagcctgagctatatcctcgtgtgggccgccgccatctggctgcccggctggcatgagccgttctactggcaatcgctgctgggcgtggcgatcatcgtcgccggcgtattgaccatcttctggccggtgaaacgccgctag

SEQ ID NO: 3660 - DNA, 264 bp, Klebsiella pneumoniae
cgcacttcgttcgggacgaaggggtcggaggttcgaatcctctatcaccgaccaaattcgaaaagcctgctcaatgagcaggcttttttgcatctgaggcctgcgaggatgagaacctccgggggcaggaggttcgactcgagcgaagcgagagaacgttgcgtcagcaacggcccgcagggcgagccacgaagtggtgagtcatcctctatcaccgaccaaattcgaaaagcctgctcaatgagcaggcttttttgcatctga

SEQ ID NO: 3661 - DNA, 858 bp, Klebsiella pneumoniae
ggtgcgttaccaatgattgagaaccgtcgcgggctgacgattttcagccacaccatgctgatcctgggtatcgccgtcattttattcccgctgtacgtcgccttcgtggcggcgacgctggataacaaatcggtatttgaaacgccgatgacgctgcttcccggcggacatctgctggagaacatgaagaccatctgggtgaacggcgtcggcgtcaacagcgcgccgttctggctgatgatgctcaacagtttcatcatggcgttcgccattacggtcggcaaaatcgtggtgtcgatgctttcggcgttcgccatcgtctggttccgctttccgctgcgtaacctgttcttctggatgatctttatcaccctgatgctgccggtcgaggtgcgtattttcccgacggtggaggtgatcgccaacctcaacatgctcgacagctatgccgggttaacgctgccgttgatggcttcggccaccgctaccttcctgttccgacagttctttatgaccctgccggacgagctgattgaagcggcgcgtatcgatggcgcttcgccgatgcgcttctttcgcgacatcgtgctgccgctgtcgaaaaccaacctcgccgcgctgttcgtcatcacctttatctacggctggaaccagtatctgtggccgttgctgattattcaggatgtgaatcttggcaccgccgtcgccggtattaaaggcatgatcgccaccggcgaaggtactacccagtggaatcaggtgatggcggcgatgctgctgaccctgatcccgccggtcgtcatcgttttagccatgcagcgcgcgtttgtgcgcggcctggtcgatagtgagaaataa

SEQ ID NO: 3662 - DNA, 1323 bp, Klebsiella pneumoniae
acgacatcgtttctaatttgttgcgataacgtgacatacacgacaggagattcgcaggtgaaaagctcagaactgaatcaacgtcgccagcaggcgacgccgcgcggtgtaggcgtaatgtgtaactactttgtcgagaaggcggaaaacgccacgctgtgggatatcgaaggcaatgaggtgatcgatttcgccgccgggatcgccgtgttaaataccggtcaccgccatccgaaagtggtcgccgcggtagccgagcagctgcaggcgttcacccacaccgcctatcagattgtgccgtacgaaagctatgtttcgctggcggagcgtatcaacgatctggcgccaattgacgggccggcaaaaacggctttcttcaccaccggcgcggaagcggtcgagaacgcggtgaaaatcgcccgcgcttacaccggtcgtccggggctgattaccttcggcggcggtttccacggccgtacctttatgaccatggccctcaccggtaaggtcgcaccctacaaaatcggtttcgggccattccctggctcggtgtatcacggtgtctacccgaatgcggcgcatggcgtgaccaccgcggatgcgctgaaaagcctggagcgcattttcaaagcggatattgcgccggatcaggtcgcggccatcatcctcgagccgatccagggggaaggcggctttaacgtcgcgccggccgatttcatgcaggcgctgcgcgacctgtgcgatacccacggcattctgctgatcgccgatgaagtgcagaccggtttcgcccgtaccggcaagctgttcgccatgcagcactatgaggtgaaaccggatctgatgacgatggcgaaaagcctcgccggcggtttcccgctgtcgggcgtcgttggtcgcgccgaagtgatggatgcgccagcgcctggcgggctgggcggaacctatgccggtaacccgctggcggtggccgcggcgcacgcggtgctggatgtgattgccgaagagcagctgtgtcagcgcgctgagcagctgggtagccatctgcaggaagtgctcaaccaggcgcgcgccacctgtccggcgatcgtggatgtccgcggccgggggtcgatggtggcggtggagtttaacgatccgcaaacaggcgaaccgtcgccggaattcacccgccaggtgcaacagaaagcgcaggagaacggcctgctgctgctgagctgtggcgtctacggcaacgtgatccgcttcctgtatccgttgactatcccggatgcccagttctcgaaagcgctggatattctggcgcgcgtactgaagagctaa

SEQ ID NO: 3663 - DNA, 1095 bp, Klebsiella pneumoniae
agtgagggaccggcttgcgctatggttgaaggtagctcattaactaaggacagcgttatgactctgcactgcgcatttattggctttggtaaaagcaccacccgctatcaccttccttacgttttgcaccgcaaagaccgctggcaggtagcgcacatttaccgccgccgggcgaagcccgaggagcaggcgccgcagtattcccatattcatttcaccagcgaccttgatgaagtattaaacgatccactggtcaagctggtggtggtctgcactcacgccgacagccattttgaatatgcgaaaaaggcgctggaggcaggaaaaaacgtgctggtggaaaagccgttcaccccgacgctggaggaagcaaaaactctgtttgccctggcgaacagcaaaggcctgacggtgacgccctatcagaaccgccgtttcgactcctgcttcctgaccaccaaaaaggtgattgagagcgggaaactcggcgaactggtggagatcgaaagccatttcgataattatcgcccgctggcggagaccaaccccggcggtccgcaaaacggcgagttctatggccttggcgtgcataccctggatcagatcatttcgctgttcggccgcccggaccatgtctcttacgatctgcgctcgctgcgcaataaagccaacccggatgacacctttgaagcccagctgttctacggcgatatgaaggccatcgttaagaccagccatctggtgcagatcgattacccgaaatttatcgttcacgggcacaaaggttcgtttgtgaagtacggcattgaccagcaggagaccagcctgaaggccaatgtcatgccgggcgagccgggatttggcgcggacgacagcgttggcgagctggtgtatgtcaacgaggcaggggagatggtgcgcgaagcggtgccgctggagagcggcgattatggtcgggtgtacgacgcgctgtacgacaccctcgtcaacggccagccgaattacgtcaaggaaactgacgttctcaccaatatggaaatcctgcagcgcggctttgagcagccttcaccggccaccattacccttacccgataa

SEQ ID NO: 3664 - DNA, 294 bp, Klebsiella pneumoniae
ttgtccgctttatcaactggagcatggttggcgccttctttgttttgctggtgctatggttgtttatcagccagtggctgcgcgtcaccgtgtttgtctcggcaatggtcgtctggctggcggtcagcccgctgctgccggcctttaccctatggccctccggtcagcccaccacggccgccgccacgaccgcacaggccaataccggggccaacgccgccgctggcgccgcgtccagccccgccaacagcgatattccgccgcagaccgagccgccgacctcagccaacctga

SEQ ID NO: 3665 - DNA, 1749 bp, Klebsiella pneumoniae
agacggctgccgtttgatgagggcgatcgcctgcgcttcgtcgccgctatcgcgcagctggttggcctggcgcagcacccggtcgctttgcaggcgcgcttcgagttcacgaatgttatccgtccacgcgctgcgcggcagagcggcgatttgcgccagagccagatcgtcctggtcgttccccgacaggtagagtcccgaggcgtagacccgttcggcgtcctgcggctggcggttgaccatcgtccgcatcagcgcgtcggcctcctggcgttcgccggcgctgaccagatcccgcgccagacggtaggttatccagacgctgtccggatccagcgccaggcgccgacgctgaacttccgccgcctgcgcccagttgccctggctctccagagcctgcgcctgtttctccagccggtcgttagtcaggctgcgctcaatatcatcgatactgcgccgctgagcgggagggaggccggcgatccaggcgctggctttctccggcgattcggcgcgatagaggttggccaggccgcgcaccgccaggttattgccgcgatccaggcgcaacgcctgctggtaatagcgctccgccgccgccgcctctttgcgcgccgccgcgacgtcccccagccccagcacggcatagctgtcggtgcgatcgacccgctgcgcctgggcataatagttctgcgcctgcgaaagctggccggctttcagggcgttatccccctgctttatcagcagccagtagcggttagtttgcagcaggctgtcccacttgccgcggttcgggctgtcagggtccatggcaatcgctttactgagctgcgccactgcccgcgcgcggtcgccgcgctgggaataggcctggccgagagcgcccaccgcgtcgctgtcgcggctgtcggcctgaacggctttctgcagatccgcgaccgcctgcgtggtattcccggacttgaccgccgccagcccttccgagcgggcgcggaaagtcggatcctgcagctgcgcctgctgttggtcgagcagaacgcgggcgttcgccgccaccgagccggtgggaaactgcagaagaaattgctgcaacgcctgcacgctggccttactcaccggcatgcttttcacctcactgaaccacatatcggcggcgataccgcgtcccgaggccgatcgggccatctccgccagataggcgaacccctcctgcggtttgttatcggcgaacatctgcttcgccagcgaagtcagcaggctgacgttgcccggcgcgctggcgttcagttttttcaactggctgacgccttcgctatggcgggccggcaggcgcgccaccagcgtccagtattcaatggcgacgtcaacgtcatccggcaccccgccgtacagtttttcataggcggcgatggcttcatcgaccttcccggccacgcccagcagtcgcgcctgctgcagcgcctggcggccctcgccggtgttgcttttcatctcattgcgcgacgccttcagctccggggagtccggcgccagcttcgtcagtcgttccagctctttttgcgccccggcggcatccccctgacgcagcagatagcgcatccgcgcggcaatcagctccgggttgttgggatcaatcagctccagacggtacagcgactggcgcaccaggtcttcacgattgctggcctcgccgaggcgcacctgctccagcagatgctcctgggcaggcgtcgtcgtcgcctgcgctaa

SEQ ID NO: 3666 - DNA, 771 bp, Klebsiella pneumoniae
ccactgatgccgcagaagatccaactggaacagatctcgcttgccgctgaccgaccactggtcagggacgtctccttcaccctgcgccgcggccaggtgctggcgctgctcggcagcagtggttgcggaaaatcgctgacctgcgccgccgcgctgggcctgctgccgcccggcgtcaggcaaaccgccggccgggtgcttctcgacggcattccggtgcacggcgaacagctgcgcggggcgaccatcgccaccatcatgcagaacccgcgcagcgcctttaacccgctgcagaccatggccgcgcacgcccgggaaacctgccgggcagcgggtcgtgaagcgaatgacgccgtgctgctggcagcgatggaggaggtcggtctggacaatccgcgggcgctgctgaagcgctacccttttgaaatgagcgggggcatgctgcaacggatgatggtcgctctcgccctgctcagccgcgcgccctttatcatcgccgacgagccgacgaccgatctcgatgccatcgcccaggcgcgcatcctcgacctgctggcggatattgtcgccaggcgcggtctgggactgctgctggtgacgcatgacatgggcgtcgtggcgcggctggcgcatcacgtaacggtgatggagaacggtcgcctcgttgaacactgcgatgtgaatacgctatttagcgccccgcggcacccgctcagccagcgcctgctggccgcgcatctggcgttatacggtctggagaaaacaccatga

SEQ ID NO: 3667 - DNA, 462 bp, Klebsiella pneumoniae
aaaaacccgccctggcgggtttttttatatctaccccatccccatttcactacactatctgtactctttttgttcatcccctggagccgtagaatgtggttgctggatcagtgggcggaacgtcatatcctcgatgcccaaaccaaaggtgagttcgataatttacccggcagcggagaaccgctgactctcgatgacgattcacatgtgccggcggagttgcgggcaggctatcgccttctgaaaaatgcaggatgtcttcctccggaactggagcaacgcaaagaagcgttggctctggcagacttactgaacggcgtccgtcaggacgatccgcgtcatgccgaacttagcaaatgccttgccctgctcgagctgaagttacgtcaggcaggtctgaacaccgactttttacgcggtgagtacgccgatgcgttgctgcaaaaaataaatcaggagtaa

SEQ ID NO: 3668 - DNA, 348 bp, Klebsiella pneumoniae
atccatgcgccgcagcatccgctccggattgatatgcagattaaggaaggggagatactcctggagctggaggatcttgcgcgtcagggcgcggttgaaatcgggcagcatggcgacaaagtcattgagcgacgccgccagcacgccgagcagcgcggtgagcatcaccagcatcgccgtcaccaccagggtaatggcgaacggacgccgcaccctgcggcgaatgaaccaggtgaccagcgggttgagaacaatagcgaaaaacagcgccagcagcagctgcaccaggatatcggcggcggcgtggatcccggcgaggataatcaccagcgccgccagcttaagtaa

SEQ ID NO: 3669 - DNA, 1704 bp, Klebsiella pneumoniae
atctatgagcctggtcgcggtcaatacccggcaattaaccctacaatttacagcagtacatcttggctaaggagcagtgacatgcgcgttaatcatggtttaaccccgcaggatctcaaggcttatggtatcaatgacgtccaggatatcgtccacaaccccagctacgacatgttgtttcaggaagagctcgacccgaacctggaaggctacgaacgtggcgtattaaccactctgggagctatcgccgtcgacacgggcatttttaccggtcgttctccgaaagataagtatctcgtgcgcgacgacaccacccgcgacaccgtctggtggtccgataaaggcaaaggtaaaaacgacaacaagccgctttcgcaggaaacctggcagcatctgaaagggctggtgacccagcaactgtccggtaaacgcctgtttatcgtcgacgctttctgcggcgccaacgccgatacccgtctcagcgtacgtttcattaccgaagtggcctggcaggcgcacttcgttaaaaacatgttcatccgtccgagcgatgaagagctggctgaattcgagcccgacttcatcgtgatgaacggcgcgaaatgcaccaatccgcagtggaaagagcagggcctcaattcggaaaacttcgtcgccttcaacctcaccgagcgcattcagctgatcggcggcacctggtacggcggcgagatgaagaaagggatgttctcgatcatgaactacctgctgccgctgaagggcatcgcctccatgcactgctcagccaacgtcggcgagaaaggcgatgtcgccattttcttcggcctctcaggcaccggcaaaaccaccctctccaccgacccgaaacgccgcctgattggcgatgacgaacatggctgggatgacgacggcgtgtttaacttcgaagggggctgctacgccaagaccatcaagctctctgaagcggccgagccagatatctatcacgccatccgccgcaacgccctgctggaaaacgtggtggtacgcgccgacggcacggtcgatttcgatgacggttcaaagaccgaaaatacccgcgtctcctaccccatcgaccacatcgacaacattgttaagccggtgtctaaagcgggtcacgccaccaaagtgatcttcctgacggccgatgcgttcggcgtcctgccgccggtctcccgcctgaccgccgaccagacgcagtaccatttcctgtccgggtttaccgccaaactggccggcaccgagcgcggcgtaaccgaacccacgccaaccttctccgcctgcttcggcgccgccttcctgtcgctgcacccgacgcagtacgccgaagtgctggtcaaacgcatgcaggcggctggcgcgcaggcttatctggtcaataccggctggaacggcaccggcaagcgcatctcgattaaagatacccgcgcgatcatcgacgccatcctcaatggctcgctggacaacgcggagacctttaccctaccgatgtttaacctgcagatcccgacggcgctcccgggcgtggatacccacatcctcgatccgcgcagcacctatggttccccggagcagtggcaggaaaaagccgaccagctggcgaagctgtttattgagaattttgagaagtataccgatacgccagcgggcgccgcgctggtggcggcaggaccgcagcgctaa

SEQ ID NO: 3670 - DNA, 2151 bp, Klebsiella pneumoniae
ccagccgggccgctggcgcgaggcgctaaataccgactccatgcactatcacggcagcaatcagggcaatggcggcgtggtggaaagcgacgctatcgccagtcatggccgcgaacattcgctgtcgctgaccctgcccccgctggcgacgatctggctggtccgggaggcgcaatgacctcactcgcggcaggcaaacctgcgccattgggcgccagctatgacggcaaagggggtgatttcgccctcttctccgcccatgcggagcgggtggagctgtgcgtattcgacgagcagggcaacgagcaacgcttcgatctcccggcgcgcagcggcgacatctggcacggctggctggccgccgccgggccgggcctgcgctacggctatcgggtacatggtccctgggacccggcgcaggggcaccgctttaacccggccaagctgttgatcgatcccagcgcccaccgggtcgagggcgatctgcctgacgatgagcgcctgcacggcggcatgtggcagcccgatcgccgcgacagcgccgcggtcgcgccaaaatcgcaggtggtggatctgcgctatgactggcgtggcgataaaccgccgcgtaccccatggggggaaacggtgatttatgaagcgcacgtgaaagggcttaccttgcttaatccgcagctaccggaagccattcgcggaacctataaagcgctgggccacccggcgatgatcgcttacttcaaatcgctgggcatcagcgcccttgagctgttgccggtggcgcagttcgccagcgagccgcgactgcagcggatggggttaagcaactactggggctacaacccgttggcgtggttcgcgctggatccgcgctacgccagcgacccggatcgcgccctggatgagtttcgcgatgcggttaaggcgctgcacgccgccggtatcgaagtgattctggatatcgtgctcaaccatagtgcggaaatcgatctcgacgggcccaccgtctccctgcgcggaatcgacaaccgtagctattattgggtaagggaggatggcgattatcacaactggaccgggtgcggtaatacgctcaatcttagccaccccggcgtggtggagtgggcgcgccagtgtttgcgcttttgggtggatgagtgccatgtcgacggctttcgcttcgacctcgcctcagtgatggggcggacgccggaattccgccaggatgcgccgctgttcgaggctatccgccgcgacagcgtgctgtcgcaggtgaaactgattgcggaaccctgggatatcggcccgggcggctatcaggtgggtaatttcccaccgctgttcgctgaatggaatgaccattttcgcgatagcgcccgacgcttctggctacagcaaaatgtctccctgggggattttgcccaacgtttcgcggcctccagcgatctctttgcccgcgatggcaaaccgccatcggcgacggtcaacctggtgacggcccacgatggcttcacgctgcgcgactgcgtttgtttcaatcagaaacacaatgaggcaaacggggaggagaatcgcgatgggactaacaataactacagcaacaatcatggtatagaaggattagaagcgaattttgcggtgattgaacggcggcgcgccagcgcgcatgcgctgttgacgacgctgctgctggctcaggggacgccaatgctgctggcgggcgatgaacagggccacagccagcacggtaacaataatgcttactgccaggacaacgccctgacgtggctggactggcgccaggcgaacccgggattaaccgcctttaccgcggcgctgatccacctgcggcgccgtattccggcgctcacccgcaaccgctggtggcaggagggggatggcaacgtccgctggcttaatcgcaacgcccagcccctgactgccgcggagtggcagcagggggccgcgtgtatgcagatccagttgtcggatcgctggctgctcacgctgaacgccaccgcagaggtggtggatatggttttacccgagggggaatggcgcgccgttcctccattcgccggagaggataatccggtcatcatggctgtctggcatgggcccgcgcacggagtgtgcgtatttcaaaggtcgtaa

SEQ ID NO: 3671 - DNA, 1269 bp, Klebsiella pneumoniae
ctggcaaagttaaagataacgacagagacaatccgcagattgaggcgcagtccattaagcgccggttcggcgacgggttcgggcatcaggttccaccagatttcgacaaccagctttcactattaccacgctgtcggcggaaaagcagccctcctttcggaatattggcagtcggcgaaccgctacacttatctggcgcgactcataaaaggaatacctatgtcccctccgcaggctgataaagccgggcttcatattttacttaagctggcggcgctggtgattatcctcgccgggatccacgccgccgccgatatcctggtgcagctgctgctggcgctgtttttcgctattgttctcaacccgctggtcacctggttcattcgccgcagggtgcggcgtccgttcgccattaccctggtggtgacggcgatgctggtgatgctcaccgcgctgctcggcgtgctggcggcgtcgctcaatgactttgtcgccatgctgcccgatttcaaccgcgccctgacgcgcaagatcctccagctccaggagtatctccccttccttaatctgcatatcaatccggagcggatgctgcggcgcatggattcagaacggctgatgacctgggccacgacgctgatgacccagctttccggggcgatggccagcatcgtgctgctggtgatgacggtgatctttatgctgtttgaggttcgccacctgccctacaaactgcgttttgccctcaataacccgcgcctgcatatcgccggattgcaccgggcgctgaaaggcgtcacccattatctggcgctgaagacgctgattagcctgtggaccgggctgattgtctggctggggctgctggcgatgggggtacagttcgccctgatgtggggggtgctggcgtttttgctgaactatgtgccgaacattggctccgccatctccgctatcccccccatgctgcaggcgctgctgttcagcggcatctatgagtgcctgttggtaggggcgctgtttctggtggtgcatatggtgctgggcaacatggtggagccgcgcatgatgggccaccggctggggatgtcgaccctggtagtgttcctgtcgttgttggtctggggctggctgctggggccggtgggaatgctgctctcggtgccgttaaccagcgtctgtaaaatctggatggaaaccaccgtcggaggcagcaagctggcgatcctgctcggcccgggccgtcccaaaagccggctccccggctag

SEQ ID NO: 3672 - DNA, 996 bp, Klebsiella pneumoniae
acgactcatactacggagattcgcatgaagccgtctgtcattctctataaaacgcttcccgacgacctgctacagcgtctggaggagcacttttccgtcactcaggtgaaaaacctgcggccggagaccgtttcgcagcacgctgaggccttcgcccaggctgaaggcctgctgggctccagcgaaaaggttgacgccgcgctgctggagaagatgccgaagctgcgtgcgacctccaccgtttccgttggctatgacaacttcgacgtcgaggcgctgaacgcccgccgggtgctgctgatgcataccccgaccgtgctgaccgagaccgtcgccgatacggtcatggcgctggtgctgagtaccgcgcgccgggtggtggaagtggcggagcgcgtcaaagcgggtgaatggacgaagagcattggtccggactggttcggcacggatgttcaccataaaaccttgggcatcgtcggcatgggccgcatcggtatggcgctggcgcagcgcgcccacttcgggttcggcatgccgatcctgtataacgcgcgtcgccaccatccgcaggcggaagaacgcttcaatgcccgctattgcgatctcgataccctgctgcaggaggctgactttgtctgcctgatcctgcccctgagcgaagagactcaccatctgttcggtcaggcgcagtttgccaaaatgaaatcttccgccatcttcattaacgccgggcgtggcccggtagtggacgagcaggcgctgatcgccgctctgcagaacggtgagatccacgctgccggtctcgatgtgttcgaacacgaaccgctggccaaggactcaccgctgctgagcctgccgaacgtcgtcgcgctgccgcatatcggctccgccacccatgagacgcgctacaatatggcggcctgtgcggtggacaacctgatcgacgccctgaacggcaacgtagagaaaaactgcgtcaatccgcaggtaaaataa

SEQ ID NO: 3673 - DNA, 741 bp, Klebsiella pneumoniae
tccgcgcataccttggtgaggcataagatggaaaacgcgatgttaacttttgacaacgtcagcgcccactacggcaagattcaggcgctgcacaacgtcagcctgcatatcaaacagggcgagatcgtcacgcttatcggcgccaacggcgcggggaaaaccaccctgctcggcacgctgtgcggcgacccgcgcgcctccagcgggcgcattgtctttgacggtaaggatattaccgactggcaaaccgcgaagatcatgcgcgaggcggtggcgatcgttccggaagggcggcgcgtcttttcgcgtatgacggtggaagagaacctggcgatgggcggtttttttgccgaccgcgatcagttccagacccgcatcaaatgggtgtatgagctgttcccgcgtctgcatgaacgccgtattcagcgcgccggcaccatgtccggcggcgagcagcagatgctggcgatcggtcgcgccctgatgagccaaccgcgcctgctgctgctggatgaaccgtcgctggggctggcgccgattatcattcagcagattttcgacaccatcgagcagctgcgcgagcaagggatgacgatcttcctggttgagcagaacgccaaccaggcgctgaagctggccgaccgcggctatgtgctggagaacggccacgtggtgctggaggacactggcgacgcgctgttggccaacgaggcggtgcgcagcgcctatctcggcggttaa

SEQ ID NO: 3674 - DNA, 1038 bp, Klebsiella pneumoniae
ctatctgtcaccactcaaacaacagcgcattcgtcagaaggtagagaaactggatcgtttacgttcccgtgcctgataacaaggaataccgtgtcacaatcactacgtatcattttcgccggcacccctgattttgcagcgcgtcatcttgatgcgctgctgtcgtctgaacatcaggttgttggcgtattcactcagcctgatcgccctgctggtcgcggcaaaaaattgatgccaagcccggtaaaagtgctggcagaagcccataacttacctgtgttccagccatcctccctgcgtccgcaggataaccagcggttagtcgccgatctcggcgccgatattatggtggtagtggcgtacggtctgattctgcctaaagcggtgctggagatgccccgtctgggctgtatcaacgttcacggctcgctgctaccgcgctggcgtggcgcagcgcctattcagcgttcactgtgggcgggggatagcgaaactggcgtaaccatcatgcagatggacgtcggccttgatacgggggatatgctgtataagctttcctgtcccattaccgcagaagataccagcggcagcctgtacgataagctggccgagctcggccctcaggggctgctggcaacgttagcccagctggccaacggcaccgcacggcctgaagtacaagatgaatcgctggtgtgccatgccgaaaagctgagtaaagaagaggctcgtatcgattggtcgctttccgctgcgcagttggaacgctgcatccgcgcgtttaatccgtggccaatgagctggctggaaattgacggacaaccggtaaaagtgtggcgagcatcggtcatcgccgaagccgctcacgccgaaccgggtactatcgtggcagcaaccaaacagggtattcaggtcgccacgggggatgggatcctcagcctggagtcgctacagcctgcgggtaaaaaagcgatgagcgcccaggacttactcaattcccgccgggagtggtttatccctggcacccgtctcgcctga

SEQ ID NO: 3675 - DNA, 906 bp, Klebsiella pneumoniae
ggcgacgccactacatcgtttaaccagggagttgttatgtctgccaaacatccggtgatcgccgtcacgggctccagcggcgcgggcactaccaccaccagccttgcctttcgcaaaatcttcgcgcagctaaacctgcacgccgcggaggtggaaggcgatagctttcatcgctacacccgcccggaaatggacatggcgatccgtaaggcgcgggatcagggcaaacatatcagctactttggcccggaggcgaacgacttcggcctgctggagcagacctttgtcgactatggtcgccacggtaaaggtcagtcgcggaaatacctccacacctatgacgaagccgtgccgtggaatcaggtgccggggacctttaccccctggcagccgctgccggagccgacagacgtgctgttctatgaggggctgcacggcggggttgtcacgccgcagcatgatgtcgccagccatgtcgacctgctggtcggggtggtgcctatcgttaacctcgagtggatccaaaagcttattcgcgacaccagcgaacgcggccactcccgggaggcggtgatggactcggtcgtccgctcgatggaagattacatcaacttcattaccccgcaattttcccgcacccatatcaactttcagcgcgtgccgacggtggacacctccaacccgtttgccgccaaagcgatcccctcgctggacgagagctttgtggtgatccatttccgcaatctgcagaatatcgatttcccctggctgttggcgatgctgcagggctcgtttatctcgcacatgaacaccctggtggtgccgggcggtaaaatggggctggcgatggagcttatcatgacgccgctggtcgagcgcctgatggaaggccgtaagataggctaa

SEQ ID NO: 3676 - DNA, 507 bp, Klebsiella pneumoniae
atgatgagcactttcgacaaacatgacctcagcggctttatcggtaaacatctggtctatacctacgacaacggctggaactacgagatttacgtcaaaaatggccacaccctcgactaccgtattcacagcggcatcgtcggcaatcgctgggtgaaagatcaggaagcgtacattgtgcgggtgggggaaagtatctacaaaatctcctggaccgaaccgaccggcaccgacgtcagcctgatcgtcaacctgggcgacaaactattccacggcactattttcttcccgcgctggatcatgaataacccggaaaaaaccatctgcttccagaacgaccatattccgctgatgaattcgtatcgcgatgccggcccggcctacccgacggaagtgattgacgagttcgccactatcaccttcattcgcgactgtggcgcggataatgacgaggtcattaattgcccggcgagcgaattgcctgcggattttcctgcaaatttgtaa

SEQ ID NO: 3677 - DNA, 186 bp, Klebsiella pneumoniae
gcgtacggcactgtttatcaccctgctttttttaaagcgaaatggaattatattgccggcgaatccagacttcgtcggcatgaccgtcgaggcagcagcagggcaacttaccctggaacagattgtcgcgcgtttgcgtggatgacggttaactcgttgcaacccggcggcttcgccggtttgtag

SEQ ID NO: 3678 - DNA, 303 bp, Klebsiella pneumoniae
cctacaataacaaccttatggagagtagaggctatgaaacttgttacaggaatggttgcatctctggtgataggcaccctctctttcggcgcattcgccgcgaaagagatccaaaaagaagacgtggcgaagatgaatctgaccaaggtcggtagcattacgacctccaggacgacgtcgccgatggatgcccgacgcgatctgtcgaaaaaagccgatgagctgggtgggaaatactttgtggtgattgccgggcagaaaaacgaaaaaaccgtacacgcgaacgctgacgtttataaataa

SEQ ID NO: 3679 - DNA, 756 bp, Klebsiella pneumoniae
aacaggacaacgcgcatgagtaactggccttatccccgcatcgtcgcccatcgcggcggcggtaaactggcgccggagaacaccctggcggctatcgacgtcggcgcccgctacgggcacacgatgattgaatttgacgccaagctgtcgaaggacgggcagatctttctgctgcatgacgataatctcgaacgcaccagcaatggctggggcgtggcgggcgagctggcatgggacgatctgctgaaggtcgatgccggtagctggttcagccgtgaatttaagggcgagccgctgccgttgctctcccaggtggcggagcgctgccgttgtcacggcatgatggcgaatatcgaaattaagccgaccaccgggctggggccgcagaccggcagagtggtggcgctggccgcgcgcgatctatggcaaggcatgaccgcgccgctgctctcctcttttgaaatcgacgccctggaggcggcgcaggaagccgcgcccgagctgccgcgcgggctgctgctggatgagtggcgcgatgactggcgcgaattgaccacccggttgggctgcgtgtcgattcacctcaatcacaaactgctggatgcggcgcgggtggcgagcctgaaacaggccggcctgcacattctggtgtacacggtcaataaaccccagcgcgccgccgaactgctgtgctggggcgtagactgcatctgcaccgatgccattgatgtcatcgggccgaatttccagccttaa

SEQ ID NO: 3680 - DNA, 642 bp, Klebsiella pneumoniae
gaggttgaaacaatgattggtttagtcggtaaaaaagtgggcatgacccgcatcttcactgaagatggcgtttctatcccagtaaccgtaatcgaagttgaagcaaaccgtgttactcaggttaaagacctggctaacgatggctaccgcgcaatccaggttaccaccggtgctaaaaaagctaaccgtgtaaccaagccggaagcgggtcacttcgctaaagctggcgttgaagctggccgtggtctgtgggaattccgtctggctgacggcgaagaattcaccgtaggtcagaacattagcgttgaactgtttgctgacgttaaaaaagttgacgtaaccggtacctctaaaggtaaaggttttgctggtaccgttaagcgctggaacttccgtacccaggacgctactcacggtaactccttgtcccaccgcgttccgggttctatcggtcagaaccagactccgggcaaagtgttcaaaggcaagaaaatggcaggtcagctgggtaatgagcgtgtaaccgttcagagcctggacgtagtacgtgttgacgctgagcgcaacctgctgctggttaaaggtgctgtcccgggtgcgaccggtagcgacctgatcgttaaaccagctgtgaaggcgtga

SEQ ID NO: 3681 - DNA, 366 bp, Klebsiella pneumoniae
ggtttaccgacgttcgcttcaacgttgaattcacgcttcatacggtcaacgatgatgtcgaggtgcagctcacccataccggcgataattgtctggttagactcttcgtcagtccatacgcggaaagacgggtcttctttagccagacgacccagagccagacccattttttcctggtcagctttggttttcggctcaacggcgatggagattaccggctcagggaattccatacgctccagaatgatcggcgcatccgggtcacacagggtgtcaccagtagttacgtctttcagaccgatagcagcagcgatgtcgcccgcgcgaacttctttgatctcttcacgtttgttagcgtgcatctga

SEQ ID NO: 3682 - DNA, 444 bp, Klebsiella pneumoniae
ttaccgacgactgatcccttcgcttaccccgaaggagaggcgatgaaagagaagcccaccgaaaccgtcagactggacaaatggctttgggccgcccgcttttacaaaacccgcgcgctggcgcgggaaatgattgaaggcggcaaggtgcattacaacggacaacgtagcaaacccggaaaaattgtcgaactcgacgccatgctgacgctgcgccagggcaacgacgagcggacggtgcgcattatcggtattaccgaacagcgccgcccggcaagcgaagccgtcaacctgtatgaagagacagcggagagtatcgagaagcgtgaaaaaatggccctggcgcgcaaaatgaacgccctgaccatgccgcaccctgacagacgtccggacaagaaagagcgccgcgacctgatgagatttaaacacggcgagagtgaataa

SEQ ID NO: 3683 - DNA, 1092 bp, Klebsiella pneumoniae
cgcttagcgacggccatctgcatggaggcattcggggtgaataagcgcgacgcaatgaaccagattcgccagttcggcagcaagttcgatcgcctgcgcaacgccgcgggcggcggcggtggcgggcgcaatgcgccaaaacggccgaaagcggcgcctaacccggcctcgcgtaagagcaacgtattcaacgagcaggtgcgctatgcctggcacggcgcgctgcaggatctaaaaagcacgccgctggcgaccttcctgacggtcatggtcatcgccatttcgttgaccctgccaagcgtctgctacatggtctacaaaaacgtcagcagcgcggcgtcccagtattatccctcgccgcagatcaccgtttatctggaaaaaacgctggatgacgatgccgcggcgcgggtggtgggccagctgcaggcggagcagggcgtcgacaaggtgaattatttatcccgcgatgaggcgctgggggaattccgtaactggtctggctttggcggcgccctggatatgctggaggagaacccgctgccggcggtcgccatcgtggtgccgaagctggatttccagagcaccgaggcgctgaataccctgcgcgatcgggtaacgcggatccagggcgtcgatgaagtgcggatggacgacagctggtttgcccgtctctcctcgctcaccgggctggtaggacgcgtgtcggcgatgatcggcgtgctgatggtggcggcggtgttcctggtgatcggcaacagcgtgcgcctgagcatcttcgcccgccgcgataccattaacgttcagaagcttatcggcgccaccgacggctttatcctgcgtccgttcctctacggcggagcgatgctgggcttttccggcgcgtttttatcgctgatcctgtcggagattctggtaatgcgcctctcgtcggcggtgaccgaagtggcgaaagtcttcggcacccagtttgagctgagcggcttaggcttcgacgagtgtctgttgatgttgatcgtctgctcgatgatcgggtgggtagccgcctggctggcgacagtgcaacatttacgtcactttactcccgattaa

SEQ ID NO: 3684 - DNA, 1224 bp, Klebsiella pneumoniae
tttatcaggacaactgctatgaacgctgcaaaccgtcaatcgacccgctggctgacactgatcggcaccatcatcacccaattcgctctcggttcggtttatacctggagcctgtttaacagttcgctgtctgacaaactgggcgagccggtcagtcaggtggctttttcctttggtctgctgagcctcgggctggcgctctcttcgtcggtcgccggcaagctgcaggagcgctttggcgtgaagcgcgtcaccatggcctccgggatcctgctcggcctgggcttcttcctgaccgcgcactccagcagcctgatgatgctgtggctgagcgcgggcgtgctggtggggctggcggacggcgccggttacctgctgaccctgtcgaactgcgtgaaatggttcccggagcgtaaagggttgatctccgccttctccattggctcctatggtctcggcagcctggggttcaaattcattgattcccacctgctggccaccgttggcctggaaaaaaccttcgttatctggggcgctatcgtgctggtgatgatcgtctttggcgcgaccctgatgaaagatgcgccaaatcacccggcagccaccgcggccaacggcgtcgtggaaaacgacttcaccctcgccgaatcgatgcgtaaaccgcagtactggatgctggcggtgatgttcctgacggcctgcatgagcggtctgtacgtaattggcgtagcgaaagatattgcccagggaatggtccacctggatgtcgccacggcggccaacgcggtaacggttatctcgattgcgaacctcagcggtcgcctggtgttaggtatcctgtctgataaaatctcccgcattcgcgtgattaccatcggtcaggtcgtgtcgctggtggggatggccgcgctgctgttcgccccgctgaatgccttgaccttcttcgccgccatcgcctgcgtcgcctttaacttcggcggcaccattaccgtcttcccgtcgctggtgagtgagttctttggtctgaacaatctggcgaaaaactatggcgtgatttatctgggcttcggtatcggcagcatctgcggctctctcatcgcttcgctgttcggcggtttctacgtgaccttctgcgtgatcttcgccctgctgatcctctcgctggcgttatccaccaccattcgtcagccgaaaagcacggtatataacgaggcgcacgcctga

SEQ ID NO: 3685 - DNA, 225 bp, Klebsiella pneumoniae
cgcctttttgcaacgcgaaatgctgggttaaatggggggcgcctttcacgctgccgatgcgttgtttgcggccctcaatcccggtcactcactgatgtaagctcccggggatttcgggtcttgacgcctttttgcaacgcgaaatgctgggttaaatgggtgggggcctttcactctgcaaatgcgttgtctgcggccctcaaccccggtcacttactgatgtaa

SEQ ID NO: 3686 - DNA, 465 bp, Klebsiella pneumoniae
tttgtttttgctgtaagctggcgtcactggccgcaagaccacatattggctaaccccctgcatgccctgcgcggtatagtcatcatcacgtttattaattgttctggtgctatggttgaaatcatccccacagacatgacgccccccgaaaacgattcgcgtgagttccatccgatgcgcggcgtgggcaatcgtcatctgcaaaccatgctgccgcggctgattcgccgtaaattgcgctttaccccgcactggcagcgccttgagctgccggacggcgattttgtcgatctggcctggagcgaagacccgcaccaggcgcgccataagccgcgcctcgtcgtttttcacggccttggaaggcactctgcacagcccgtacgcccatggtctgatccacgcggcgatgcagcgcggctggctgggcgtggtgatgcatttccgcggctgcagcggcgaacctaa

SEQ ID NO: 3687 - DNA, 1248 bp, Klebsiella pneumoniae
cagcgcattgctgtcctcaaagacaaaccctgtcgccagaccatcggccagattctccagcgaactgtcagcgacggtgtccgccagaccgccggtgcggcgcaccagcggcagcgtcccgtacttcagaccatacagctgggtcaggccgcagggttcaaagcggctcgggaccagaatgacgtcggcgccgcccataatgcggtgggagaaggcctcatggtagccaatctgcacacccactttgcccgggtgttcggcggcggcggcgaagaaaacttcctgcagcaccggatcgccggcgcccagcagcgccagctgggcgccctgctcaagcagacccggcagcgcttcaagcaccaggtccagccctttctggctggtaagacggctgacgacggcaaacaacggcgctttatcatcgaccttcaggcccatggcaatctgcagctgacgcttgttctccgccttctcctccagcgtgtcgcgatcgtagcgcatcggcagcagcagatcgttttgcgggctccagataccgtcgtcaacgccgttgagaattcccgacagccgaccttcatgatggcgctggcgcagcagcccctccatgccgtaggcgtactgcggctcggtgatctcgcgcgcgtaggtcgggctcaccgccgtaatatggtcggcgtagtagaggccggccttgagaaacgagatctgcccgttaaactcgaggccatgcatgttatagaacgaccaaggcagctcaatgtcattcatatgccaggagtaaaacatcccctggtacgccaggttgtgcacggtaaacaccgatttagccgggcgtccgcgcgccgccaggtaggccggcgtcaggccggcgtgccagtcatgggcatgcaccacatccgggcgccagaacggatccagtccgctggccatttcacttcccatccagcccagcagcgcaaagcgcaggacgttgtcgggataagcgtgctggttggtatcgtggtaagggctccccggacggtcatagagatgcggggcgtctatcaggtagatccccacgccgttaaagtggccgtacagcagcgtgatccgcccggcgaaggtatcccggcgggtcaccacctgggcatccaccacgccgcgacggatatcgggaaacgccggcaacagcacgcgcgtatcgataccctccgcgatttgcgccgccggcagtgcgccgatgacgtccgccagaccgcccgtctttaa

SEQ ID NO: 3688 - DNA, 222 bp, Klebsiella pneumoniae
cctgaaattgctgcttatacttgtggcacacaggggacgataaggggggcgacgatgcgtccactcaccgataagcaaaaatcccgactctgggaacagacacgcaataccaattttcaggccagccgtcgccttgaaggcgtgacggtgccgctggttacgctgactgccgaagaggcgctggcgcgtctggcgacgttgcggagggagtatgagcgataa

SEQ ID NO: 3689 - DNA, 366 bp, Klebsiella pneumoniae
tcaatgattgctgaacaatcagaaaagcaacttatcctgcacattgtccaccgtcgctggtcgtcgtcaaaagcgcaacgattatcggggaaatcccccggggaatggaatattttccgtcgctattttattgatcctgattatggattaagcgtgaaatctggtgcttttccgcttgccaaaaaaaagcgacaaacccagtcacagcaagggctgacgagggatacgagcatcatcgtagcgctaataagggccaatagctggcaaggaaaagagggaaaaagggcggcttattgcaaagaagccagggtaagcagcgttaccctggctttttatttcccgcgagcgggagatgagcgggcttag

SEQ ID NO: 3690 - DNA, 585 bp, Klebsiella pneumoniae
aggtatgctgcattaatctttttgcagcaacatcgagttgttatgaccaaatcagcactgttttcggtgcgtaaaaatgagccctgcccgcagtgcggggccgaactggtgatccgttccgggaaacatggcccgtttctcggctgttcgcattatccggactgtgactatattcgtcccctgaaaagccaggcggacgggcatatcgttaaggtgctggaggggcaagagtgcccatcgtgcggtgcggttatggtgttacgccaggggcgttttgggatgttcattggctgtagccgctatccggaatgtgaacataccgagctgattgataaacccgatgagacggctatcgcttgcccgcagtgcggacaaggccatctggtccagcgtcgttcccgtttcggtaaaacctttcactcctgcgatcgctatcctgattgccagttcgttatcaattttaaaccagtggcgggcgaatgccctgaatgccattacccgctgttaatagaaaagaagacggcgcaggggctcagacgcttctgtgccagtaaacaatgtggaaagccgatcccggcggaataa

SEQ ID NO: 3691 - DNA, 666 bp, Klebsiella pneumoniae
ccagccgctgctgatggacaaacagtatctcgccataaacggcgccctttttttctggcttctcgcgctgatcgcctggtctgtcgatgcaagcgcgctggcgcgcctggcggcgcctgcgcgcttatcgctttcctcctccatagccaacggaacaagattaacgcgatgtttattaagaaaaataaaacggaacctcagatatcagaagcagccacgcctccggcaattaacccagaacccgaagcggtcgccagcaaaaaacacgagactacggtcatcgccagcggggtgcatttcgtcggcaatatagtcgccagcggccatgtctatatccacggtcaggtcaccggcaacattgaggccaaagagcatttgattaaggtaatgcgtgaaggccaggtggagggcaacgtcagctgccgggagctaataattgacggcaaggtgcaggggcagtgtcatggcgacagcatcaccatcgaggagcacggccatctggagggtaccctcgcctatcgcgcgctggcgatcaagaaaggcagcgtttttagcggtcgcgctgaaatgctggccgccgcggagaacaaaagtcatattctcggtctggtagcagacgcaccctccaaaaccgacgcggagcccgtcaggccgcagagcgcctga

SEQ ID NO: 3692 - DNA, 312 bp, Klebsiella pneumoniae
aaaacagctgctgaacgagtttccggagctgaaaggggttcgcgatctgaccgagcatcagcgcggcgagcactcctactactaagcccttcctccggcggcaccctgccgccggtcctccctggccctttctgtgttaccgcgcaacatctcccgctaaatgaccggcaaaaaccggggaaagagtatgacttaagtctcatatttaacattttcccccgtcaggtgattctcaaccctcacatgttacccgtatcatccatttcaggcgccaccggtaaaaaaatagccagctatcctttctctgggtaa

SEQ ID NO: 3693 - DNA, 411 bp, Klebsiella pneumoniae
cgaggccatgccatgcagcgcgtaaccctgacccttgatgatgacctgctggccgccctcgatgcgctaagcgcccgccgcggctaccacaaccgttcggaggcggtacgcgatattctgcgcgacgccctcaaccaggatcctccgtcgccggaatcacggcgcgggtatgccgtcctgtcgtacgtgtatgaacatgagaaacgcgaactggcgagccggctggtggccacccagcatcatcatcacgatctctccgtcgccacgctgcatgtacatatcagtcatgacgactgcctggagattgcggtgctgaaaggtgatatggccgaggtacagcattttgccgacgacgtgattgcccagcgcggcgtgcgccatgggcatttgcagtgtttagcggatgattaa

SEQ ID NO: 3694 - DNA, 288 bp, Klebsiella pneumoniae
ggccagcgtgcaggcgttgcagcaatttcttctgcagtttcccaccggctcggtggcggcgaacgcccgcgttctgctcgaccaacagcaggcgcagctgcaggatccgactttccgcgcccgctcggaagggctggcggcggtcaagtccgggaataccacgcaggcggtcgcggatctgcagaaagccgttcaggccgacagccgcgacagcgacgcggtgggcgctctcggccaggcctattcccagcgcggcgaccgcgcgcgggcagtggcgcagctcagtaa

SEQ ID NO: 3695 - DNA, 1458 bp, Klebsiella pneumoniae
aatcggttcgctggcgattcaggtccagggcgacagcgaggggctgcccactcgcgacgcgctgggcgagtaacttttctacgcaacgataacagccgtcctgtaccctacctgcagcgcggcacagcagcgtccgtttcgacggacgtatgtctcctcattgacagaggcaagcctatgaatagctcaacaaatgcaacgaaacgctggtggtacatcatgcctatcgtgtttatcacgtatagcctggcgtacctcgaccgcgccaacttcagcttcgcctccgcggcaggcattaccgaagacctgggcatcaccaaggggatctcctccctgctgggggcgctgttcttcctcggctacttcttcttccagatccccggcgctatctatgcggagcgccgcagcgttcgcaaactgatctttatctgcctgatcctgtggggcggttgcgcctccctgaccggtattgtgcataatatcccggcgctggcggcgatccgctttatcctcggtgtcgtcgaagccgcggtgatgccggcgatgcttatctatatcagcaactggttcaccaaatcagagcgctctcgcgccaacaccttcctgatcctcggtaacccggtgacggtcctgtggatgtcggtagtctccggctacctgattcaggccttcggctggcgggaaatgttcatcatcgaaggggtgccggcggtgatctgggccttctgctggtgggtgctggtgaaagataagccgtcgcaggtgtcctggctggcggagagtgaaaaagcggcgctgcaggagcaactggatcgtgaacagcaaggtatcaaagcggtgcgtaactatggcgaagccttccgctcccgcaacgtgatcctgctctgcgcgcagtattttgcctggagtatcggcgtatacggctttgtactgtggctgccgtcgattatccgcagcggcggtgaaaatatggggatggtggaagtgggctggctctcttctgtcccgtacctggcggccaccatcgccatgatcgtcgtctcctgggcctcggataaactgcaaaaccgtaagctgttcgtctggccgctgctgctgattggcggactggccttcatcggttcctgggcggtcggcgccaaccacttctgggtctcctacaccctgctggtggtagccggggcggcaatgtatgcgccatacggccccttcttcgccattattccggaaatgctgccgcgcaacgtcgccgggggcgccatggcgctgatcaacagcatgggcgccctgggctccttctgcggctcgtggtttgtcggctacctgaacggcgccaccggcagccccgcagcgtcctatatttttatgggggtagcgcttttcgcctcagtatggctgactttgattgttaagcctgctaataatcaaaaccttccacttggcgctcatcacgcctga

SEQ ID NO: 3696 - DNA, 219 bp, Klebsiella pneumoniae
actgtttccgccaggggtgaacccatggaaacctattgccgttttggtaatccgatcgcgcacagcaagtcgcctgctattcatcagctgtttggcccgccagttaggaattactcatccttatggacgtgtactggcgccgctggacgattttgtctcttctctgaatcagttctttgcagaaggaggaaagggggccaacgtcaccgttccttttaa

SEQ ID NO: 3697 - DNA, 258 bp, Klebsiella pneumoniae
gtagaatccgcccgcaggatcagactaaagaggttacccatgcacgatagcacattagaaacgcgccttgcggagctggaaagccggctggcgtttcaggaaatcaccatcgaagacctcaacaaaaccgtgaccgcccacgagatcgagatggcgaagatgcgggagcatatgcgtctgatgatcgagaagctgaaggcgacccaaccctcccatatcgcctcccaggcggaagagacgccaccgccgcactattga

SEQ ID NO: 3698 - DNA, 1245 bp, Klebsiella pneumoniae
aatctgtccgcccggcgcagcgtcaacgcgctttacctttctattcacaggccagtcatgactaacagcaaccgtattaagctcacatggatcagcttcttctcctacgccctgaccggcgcgttggtgatcgtcaccgggatggtgatgggtaacattgcggattatttccatctgcccgtttccagtatgagcaacacctttacctttctgaacgccggtattcttatctccatcttcctcaatgcctggctgatggaaatcgtgccgctgaaaactcagctgcgctttggctttattttgatggtgctggcggtggccggcctgatgctcagccacagcctggcgctgttctccgcgtcaatgttcgttcttggcctggtgagcgggatcaccatgtcgatcgggaccttcctgatcacccatatgtatgaaggccgtcagcgcggggcgcgtctgctgtttaccgactccttctttagcatggcgggcatgattttcccgatggtcgccgccgtcctgctggcgcgcagcatcgagtggtactgggtctacgcctgtattggtctggtgtatgtcgctattttcgtcctgactttcggctgtgatttcccggtgctgggcaaaaaagcccagagtgaaaacagccagccggtggtgaaagagaagtggggcattggcgtactgttcctctccgttgcggcgctgtgctacatcctcggtcagctgggctttatctcctgggtaccggaatatgcaaagagcctgggcatgagcctcggcgacgccggtaaactggtgagcgatttctggatgtcctacatgatcggcatgtggtcattcagcttcatcctgcgcttcttcgacctgcagcgtatcttaaccgtcctcgccgggctcgcgacggtgctgatgtacctgtttatcaatggttcgccggagcatatgccgtggtttattctgaccctgggcttcttctccagcgccatttacacctcgatcattacgctcggttcgcagcagacgcgggtcgcttcgccgaagctggtgaactttatcctcacctgcggcaccatcggcaccatgctcactttcgtggtcaccggcccgattgtggcggccagcggtcccctggccgcgctgcacaccgctaacggcctctatgccgtggtattcgtaatgtgctttatcctcggcttcgtctcccgtcatcgccagaacaacgctcaggcggcgtctcactaa

SEQ ID NO: 3699 - DNA, 1362 bp, Klebsiella pneumoniae
caccgacccgccgagctcccaggaccagttctcggtgcgctgacgccaggtcaccggcacggcgaacgagagatactcctgtgggctgtaatagccgccctggccgagggtgtagccgctgagatctttgtcgtagtgccagatcatattgttgaggccgacggtgacgcgacgattattctcgttgatgaccttgtagtagtacccggtcatccagcgcacgcgccagttatccgccacgtttttaccggtcagcgagtcggcgcccagcgaggaccagatgccgtgagcctccccgcgatcgtagctcaggctcaggccgccgccgtcggcgcggacgccgccccaggtggcgccggtatggctgctgctgtccttctgcccgccaaaggagagcagcgagctggagataggccgccggtggacgttgaccgtgtaccccaccggcccgacgtcgctgctgtagctcagcccccccaccacatcgacaacattgaagcccatcggcgtagtgccgatatccccgctccaggtgtcattcttccagccgaccgccacgctggtcccgctgtcggtctgatttttactgccgctggtacaggcgatctccccgcaggtgccccagctgggcgagtagctcccgtcgctgtgggtggaaaagctgccggcatccatattgaccagatcggtgcgaaagaacatccggccatccgccagcggagcatccacctgcagcatggtggtatgcgccttcaggtcggaatagccgccggtgccgctggaaccccagaagtcgtgttccagggtgacgttcagatcctgctgacgataaaggtcggcggcatcgctgcggatcccacgcttcagccagtcatcatggctgtcgttgcgcgtcagccgcgtaaaagtatcgttatcctgcggctgcgcgggggtaatgccggaggccaccatcgcttcccggtagtgcgtcagcgcctgctgcggcgccccgctctgggtggcaaagcgcgcggcatcgcgcagcaccagcgcgctctccatcgagggcggctgcgccttcgcctgcggcacaatctgattaaaaatccgttgcgcgtcagcggtatcgccaaggccagctcgcgccagcgccacccgccgctgcatgttcatggattcggtctctgcgcctttcagctgcatgacctgcgcccgggcggccggtttatcgccctcggccaggtagacttccgcaaggccgaggcgcgcatcgccgttgtcggcctcctgacgcagcacccgctgatagtcggcaatcgccgtctggctgtctccgcgctgctgcgcccagtcggccagcgtcaggtcatagcgcactga

SEQ ID NO: 3700 - DNA, 1224 bp, Klebsiella pneumoniae
cgggaatacgccccccgcctctcccacgcggggagagggggtcaggcatcgtgcttattattcgacagagacgttatcgaagtggtgtttgcccagcgggtccaccacatagcctttgacttctttacgcaccggctcatagacggtggagtgagcaatgatcagcgccggagcctggtcatgcatcactacctgagcctgtttgtacagttcaatacgcttgttgtggtcgtcggtagcgcgggccggctgaatgagatcttcaaacggcttatagcaccagcgcgagtagttggagccgtctttcgccgcggcgcagctgaacagggtcgcgaagaagttatccggatccccgttgtcgccggtccagcccatcatcacgctctggtgctcgcccgctttcgcccgcttcagatactcgccccactcgtaggtgacgatcttggcctggacgccaatcttggcccagtcagcctgaatcatctccgccatgcggcgggcgttcgggttgtacggacgctgtaccggcatcgcccacagatcgatggtgaagcctttttccaggcccgcttctttcagcagctgcttcgccttctccggatcgtaggtgtagtccttaacgtcgtcgttatagccccacatggtcggcgggatcaggttcttcgccgcctggcctgcgccctggtaaaccgctttgatgatcgcttctttgttgaccgcgtaggtcagcgcctgacgtactttgacgtcgtccagcggtttcttctcggtgttaaaggagagataaccaacgttcagacccggctgttccagcagggtaatgttcttatcttccttcatgcgcgcgatgtccgccgggttcgggtacggcatcacctggcactcatttttctgcagcttggcatagcgcacggaagcgtccggggtgatggagaagaccagacgatcgatcttcggcttggtaccccagtagcccgggaaggctttatacagaatgcgggaatctttctggtattgcagcagctggaatgggccggtaccgataggattgagatccactttttccggcgtgccggctttcagcatgttgtcagcatactctttcgaaagaatggaggcgaagtccatggccagatcagcgaggaacggcgcttccggacgggtcaggacgaactggacggtattatcgtccactttcttcacttcgctaatcaggtccggtaa

SEQ ID NO: 3701 - DNA, 777 bp, Klebsiella pneumoniae
gcaacaaacgccgggagtaagagcgcgatggccagaaaaattattgtcgttaccgctgcgtatggtaatgaccatgttaaatccttaggcgggcaggccgccgtcctgccgtttatcgccaacgccggcgcggacggcgtcgaaatccgccgcgagctgtgcagcgcggaagagctcaacgctctgccctcgctggcggccaccattgagcgccacggcctgctggcctgctactccgcgccgcaggcgctgttcaccgacaacggcgagcttaacccggatctcccgacgctgctcgcggaagcgcaaaccctgaacgctctgtggctgaagctctcccttggccatttcctccacaatcagcagttggatgagctgcgcgatatcctcagcgacagcggcatggcgttggtggtagagaatgaccagaccgactgcggccagctggcgccgatgcagcgcttcaaagccgcctgccgggtccatcagctgccgatcaccttaacgtttgatatgggcaactggctgtgggttggcgattcgccggaagaggcggcacgtcatcttgcgccggcggtcagctatattcatgttaaagcggcggagcctcatcatgagaaattccgcgctgtaccgccggatcaggccgccgaacgctggctggccctgctcgataatcttcccgccgacgcgccgcgtggaatcgagtttccgctgactggccatgacctgacggccgtgacccgccgctacgtcaacctgttacgcgaggattaa

SEQ ID NO: 3702 - DNA, 321 bp, Klebsiella pneumoniae
cgccgctgcgcttcacggacgatagcctgcgccagcgggtggctggagccttgctccaccgccgccgccagcgccagcagcgcgttgtcgtcaacttcggccgtggcaataaccgaagtcacctgcggctggccgacggtcagggtgccggttttatcgaacgccacctggcgcacctggcccagctgctccagcgccgcgccgcctttgattagcgccccgcggcgggcggcgaccgccaggccggaggtgatggccgccggcgtggagatgaccagcgcgcacggacagccgatcagcagcagcgtcagccctttataa

SEQ ID NO: 3703 - DNA, 444 bp, Klebsiella pneumoniae
cgggagcgcgcgctgatgcggattaaccttcggggcgcctggacggggctgccgatcctgctcgcaatggggctgtcgggaggcggcgtggcgctctggcgcgatctgcgccctccgcaggcggcggtaacccgtgatgcggcgttgcaaacgcagtggcggcggatcatggcgctgcgcatccccggcgaggaaaatcccggggcgcgcatcgacacgcagtcattttcgcccatagccattccgctctccggagcgaagcttatcgcctggcgtccgcagggaagcggcggcgagatggagctgaccctgtcctggtcaacggtacccgcgcttttttcctggctggcgcgctgcgggatgaatccgcgttcgttttcgctgggccgtgaggcgcagacgctccgcctgcgactgctgctggaggcggaagatgagcggtaa

SEQ ID NO: 3704 - DNA, 1119 bp, Klebsiella pneumoniae
ccatgcagcgcgcgtttgtgcgcggcctggtcgatagtgagaaataaaatggctggtttaaaactacaggcagtaagcaaaagctgggatggcaaaacccaggtaattcaaccgctgacgctggacgtggcggacggggaatttatcgttatggtcggcccgtcgggctgcgggaaatcaacgctgctgcggatggtcgcgggacttgaacgggtgaccagcggcgatatctggatcgatcgtaaacgggtgaccgagatggagccgaaagatcgcggcatcgcgatggtgttccagaattatgccctttatccgcatatgagcgtggaagagaacatggcgtgggggctgaagattcgcggcatgggtaagggattgatcgccgagcgggtgcaggaggcggcgcgcattcttgagctggatggtctgctcaagcgccgcccgcgggaactgtccggcggccagcgccagcgcgtggcgatgggccgcgccatcgtgcgtgacccggcggtattcctcttcgacgaaccgttgtcaaacctcgacgccaagctgcgcgtgcagatgcgtctggaactgcagcagctgcatcgccgcctgaaaaccacctcgctgtacgtcacccatgaccaggtggaggcgatgaccctcgcccagcgggtgatggtgatgaacaaaggcgttgccgagcagatcggcaccccggtggaagtgtatgagaagccagccagccgctttgtggcgagctttatcggcagcccggccatgaacctgctggaagggcgcatcagcgatgacggcggtcgctttgagctggcgggcggcatgcagctgccgacgaatcatgagcaccggcgccacgctgggcgtaaaatgacgctcggtatccgtccggagcattttatcttaagctcgcaggcgcaaggtggtattccgctgctgatggacaccctggaaattttaggtgccgataacctcgctcacgggcgctggggcgaacagaagctggtggtcagactgccgcaccagcagcgcccggcggcaggcagcacgctatggctgcatctgcctttagaacatctgcacctctttgatggtgaaacaggacaacgcgcatga

SEQ ID NO: 3705 - DNA, 243 bp, Klebsiella pneumoniae
aacgatggcgctagtgtgccgacctcccgattcatcgtcctcatcctgacggggattagacagggaggagtggcggggatgagcgaaaagtgtgatcctgaacactatagtgtgggtgagaaggcaaaaatatgctgtaaaaatcaccgcgatatgacaatcgagaggttacctccggtagctaaaaatttgttacaggccaatacgcgtaaaaaatcttccagttcctcgccacgttattaa

SEQ ID NO: 3706 - DNA, 762 bp, Klebsiella pneumoniae
gcgggcttagctcagcagctggaaggcgatcataccgacaatcgccccggtggtgccaaggatggtttccatcatggtccaggtcttcagcgtctgggcttcactggcgccggtaaatttaccgaacagccagaagccggcgtcgttcacgtggcttaccacaatcgagccgccggcgatacagatagacaatgccgccatctgcgcgccgctgtagttcagctgctcaatcaccggcatcaccaggccgaccgccgtcaggcacgccacggtggcagagccctgaatgatacgcaccgccgccgccagtacgaagcaggtaatagcgatcggcagccccattccggtcagcgcttcaccaagcgccgggccaacgccggagtcaaccagcacctgcttgaagacgccgccagccccgatcaccagcagaataatcccggccggctgcagcgcgtggccgcaaatctccatcacccggtctttcgccattccctgacgtaccgccagaccgtaaatcgccaccaggcaggccaccaggatcgcggtgaacgggtggccgataaactcgaaccattcgtaggcagtggaacccaccggcacaaagcgcgcggcgatggttttcaggccaaccagcaccagcggcagcaggatcagcgccaggctgaagccgaaggagggcattttgccttcgccgagatgcggttccgtgacgtcgtcaggaatatgcaattcgacgtagcggctgatgaagttgccccatag

SEQ ID NO: 3707 - DNA, 453 bp, Klebsiella pneumoniae
cgtaattcagcctattctgctaccagtcggcgtagggcaccagcggctggggcggcatatccagatccccctgccagccggccgccgagtagcggacgtaaagcagcgcatggctcggggtgtaatccttcgcctgctgaatatcgaccgcggcgccgacgaaccagttgctggtcacccgccgctccaccagcgctctggcggtgtaaccgaatccatggctgctgctcccctcctccgtcagctcgctggcgcgctgccggtagtcggacgggatcaggttcagcagcggatagcgggcttgcgtctgggtgcgcgaatgggaccatgacaccgacccgccgagctcccaggaccagttctcggtgcgctgacgccaggtcaccggcacggcgaacgagagatactcctgtgggctgtaatagccgccctggccgagggtgtagccgctga

SEQ ID NO: 3708 - DNA, 402 bp, Klebsiella pneumoniae
gctcgtccagctctttggtctctttcgggttcagccccgccgccggttcatcgagcatcagaatttccggctgggtcaccatgcagcgggcaatctccagccgacgctggtcgccgtaggccaggttgctggcctgacggttggcatgctccagcaggccgatacgctccagccaggtggcggccctgtccagcgcttcgctctgcgcccgacggaaggccggcgttttcagcaggccggagaagagcccggttttcagctgctgatgctgcgccaccagcaggttttcaatcaccgtcatttcgcggaacaggcgcacgtgctggaaggtccgcaccacgcccatccgcgcaatctgctgacccggcagcccttccaggtgctggtcgcgcagcagaatag

SEQ ID NO: 3709 - DNA, 246 bp, Klebsiella pneumoniae
aagagtacagctttggaggtttttatgagaacggttaactatagcgaagcccggcaaaatctggccgatgtgctggaaagcgcagtgacaggtgtacctgtgaccattacccgtcgtgggcataaatctgcagtcatcattagtgcagaagagtttgaacgctaccaggcggccagaatggatgatgagttcgcggctatcatggcggttcatggtgatgagatcagggagcttgcggataaatga

SEQ ID NO: 3710 - DNA, 282 bp, Klebsiella pneumoniae
aacgctgcagcaggaactgaatgcatgaatcaggcgattcagtttcctgaccgggaatcatgggatgccgaacggcagggcgtggtttttcccgcgctggtgaatgggatgcaattaacctgcgcaatttcagggcaaatcttgcagcagcgtttcggcgcagaggggccagcgcagtggctggccgccttccaggaacatcgttgggatctagaggaagaggcagaagcattgatccgcgatggtcaggaagatgctcagggctggatctggttatcctga

SEQ ID NO: 3711 - DNA, 486 bp, Klebsiella pneumoniae
ggagggcaagccatgttcgacgtactcatgtatttgtttgaaacttacatccatagcgaagcagaaatgcgcgtggatcaggacaaactgacgcgggatcttaccgatgcgggttttgagcgggaagacatctataacgcgttaatgtggctcgagaaactggctgattatcaggaaggtctcgttgaacccatgcagctcgcttccgacccgctctctcttcgggtatataccgaagaggagtgccagcgtctggatgccagttgccgggggtttttactcttcctcgagcagattcaggtgttgaacctcgaaacgcgagaaatggtgatagagcgcgtactggcgctggatacggcggaatttgagctggaagacctgaaatgggtcatcctgatggtactgttcaatatcccgggctgtgaaaacgcctatcagcaaatggaagaattactcttcgaagtaaatgaaggtatgctgcattaa

SEQ ID NO: 3712 - DNA, 1584 bp, Klebsiella pneumoniae
ccgacgtatttcactctcacttttttcggcagcccgtcagtggggtgctgttgtaaccaggaatgttcatcaggggttcacatgcagggcacaacaattaaactcttaacgggcggtttgctgatggtagcggcggccggttatgtgcaggcagaagcgctccagcctgatccggcctggcaacaagggaccttagcgaatggtttgtcgtggcaggtattggccacgccgcaacgtcccagcgaccgtatcgaagtccgtttgtccgtcaatattggctcgctgagcgaaagcactcagcagagcggtttcagccgctttattccccgcctggcgttgacgcaaagcggcagcctgccgacgatgcaggcgcgctctttatggcagcagagtattgacccgaagcgtcctctgccgccggccatcgtctcctacgattacacgatgtttaatctcagcctgcccaataaccgcaacgatctgttgaaagaggcgctgagctggctggcggacgccagcggtaaactggccattacgcctgaatcgatcaatcatgcgctgcagggcagcgacatggtggcgacctggccactggataccaaagagggttggtggcgctatcgcctgaaagggtccaccatgctgggccatgaccccgccgcgccgctgaagcagccgatcgacgtggcgcagctgaaagacttttatcaaaaatggtacacccccgacgccatgacgctgatcgtggtggggaatgtcgacagccgcagcgttgccgagcaaatcaataagacctttggcgatctgaagggcaagcgggaaacccccgcagcggtgccgaccttatcgccgttgcctaccgtgccggtcagcatcatgaccaacgcggtgcgtcaggacaaactgtccatcatgtgggatgcgccatggcagccgatccgcgactccgcggcgctgcagcgctactggcgtgacgatctcgcccgtgaagcgctgttctggcacgtgcagcagagcctgagcaaaaataacgtgaaggatattggccttggctttgactgccgggtgctatatcagcgcgcgcagtgcgccatcaacatcgattcaccgggcgagcgcctgaacaacaacctgagcgtggtttcgcgcgagctggcgaaagtgcgggacaacggcctgccgcaggaggagtttgacgcgcttatcgcccagaaaagcctcgagctgcagaagctgtttgccacctatgcgcgcactgacaccgacattctgatgagccagcgcatgcgctccctgcagaatcaggtggtggacatcgcgccggagcagtaccagaagctgcgtcaggagttcctcaactccctgacggtggacatgctgaaccagtatctgcgccagcagctctcgcaggacatggcgctggtgctgcaacagccgaagggcgaaccggaatacaatatgaaggaactgcaggccacctgggaaaaactgatggcgccgaatccggcggccacggcggctagcggcagcgccgatacggttgacgcccacagcgaggccagcgacatcccgccggggcagtaa

SEQ ID NO: 3713 - DNA, 384 bp, Klebsiella pneumoniae
cgcctacgagctgggccgggtcgttttccttcagtacctgccgcaatgagcgtctggatctgtctggtgtgcgccagcctgctgagctgcgccggacagctctgccagaaacaggcgacccgcccgtcccgtcgcggacggcggagtcgccatatactcttctggttggggatggcgctgttatgtctgggctgcggcatgctgctgtggctgagcgtcctgcagtctattccggtcagcatcgcctatccgatgctgagtctgaatttcgtctgggttaccctcgcgggctggggcatctggcatgagccggtcgcccgtcgccactggcttggcgtcgggttgatcgtcgtgggcattgtcattctggggaccagcgtctga

SEQ ID NO: 3714 - DNA, 645 bp, Klebsiella pneumoniae
cgatcaggagcagtgtgcgagcaaatgagctgcgcggcgaaaagcgcacgcgtttcatgccttagaaccgtccgggacgaagacgtagcccagaccccagacggtctggatgtagcgcggatgcgccggatcctcttccaccatgcgccgcaggcgggagatctgtacgtcgatggagcgctccatcgcagagtattcgcggccgcgggcgaggttcatcagcttatcgcgcgacagcggctcacggggatggctcaccagcgccttcaggaccgcgaattcgccgctggtcaacggcatcggctcgtcttcacggaacatctcgcgggtacccaggttcagtttgaatttaccaaaggcgataaccgcctcttcctgcgacggcgcgcccggcagctcgttcgcctggcggcgcagcaccgcccggatgcgggccagcagttcacgcgggttaaacggcttcggaatgtagtcgtcagccccgatctccagacccacgatccgatcgacctcttcgcctttcgccgtcaccataatgatcggcatcgggttactctggctgcgcagacgacggcagatagagagaccatcttcgcccggcagcatcagatccagcaccatcaggtggaaggattcacgggttaa

SEQ ID NO: 3715 - DNA, 387 bp, Klebsiella pneumoniae
tcacctgcggcttgtcatcctccacccacggcgcctcaccggtatcgtccgccgggttcagccgtcgcgacaatagcttatctatccccttcatcagcagcggcgtcgtcatcatcgacaacgttaccgccaccagcagcagcgccatctggtcgtgctgaaacaaccgctgagaggcgggcagcgaaaagaggacaaacgcgaactcgccgccctggcttaatacgcccgcgaactgcatccgctcggaacttcgcaggccatagagacgggccagcagatagagcaccagcatttttaccgccaccagcaccgccacgctcaccgccacccacagcagatgggtatacagtacgccaaggttcagcgccatgccgacggaaataa

SEQ ID NO: 3716 - DNA, 864 bp, Klebsiella pneumoniae
cgccccgcggcacccgctcagccagcgcctgctggccgcgcatctggcgttatacggtctggagaaaacaccatgaatttactcagcgctaccggggtgagtcacgattatcctcaccacggcagggtcctgcacgagatacaactcgccatcgcccccggcgaaacggtggccctgctcggacgcagcggctgtgggaaaagcaccctggcgcggatgctggtgggtctggaaacgccgcagcacggtgatattgcctggcgcggcacgccgctgactgccctgaagggcgaggccatcggcgccttccgccgcgatattcagctggtatttcaggatgccttcagcgcggtgaatccgcgcaaaacggtgcgcgagatcgtcagcgagccgctgcgccatctgttgtgcttgtcgcgtgaggcgcgtgcgcggcgggtggaagagatgctgctggccgtcgacctcgcgtcgtcgctgctcgataagcgcccggcgcagctcagcggcggacagctgcagcgcgtctgcctggcacgcgccctggcggtacggccgcagctgttgatccttgatgaagcggtttcaaatctcgatctgctgctgcaggcggagattatcgccctgctgaagcgtctgcaggcgcagtttgacaccgcctgcctgttcatcacccatgacctgcggctggtggagcgcttttgccagcgagtgctggtgatggagcacgggcgcatcgtcgaaaccgcaacggttagtctaccgctacgcctgcgttcccctgccggacaggcgctccagcaggcggtgctccccccttttcctgccactctgcttaacgaggccatgccatgcagcgcgtaa

SEQ ID NO: 3717 - DNA, 552 bp, Klebsiella pneumoniae
aaaaacgcggctttaagtttgtcggctcgacaatctgttattcctttatgcaggcctgtgggctggtcaacgaccatgtcaccggctgcttctgtcaccctggaggtcaggatgatccgcaagtgggacactgaagataccgcgccgctgctggcgctgtggctggacagcacgattcatgcccatccttttatcagcgaaagctactggcgcgacagcgtcgcggtagtacgggatgtctatcttcccgccgccagcacctgggtctgggagcaggatggcgagttaaaaggctttgtcagcgtactggactcccgtttcgtcggcgcgctgtttgttgcgccgggcgccacccgccagggtattggtcgggcgctgctggatgaagtcaaacggcactacgcctggctgagccttgaggtttatcagaagaacgaatcggcggtcagtttctaccatgcgcagggcttccggattgaagactgcgcatggcaggacgatactcagcacccgacgtggattatgcgttggccggcggatcaaatgccgtaa

SEQ ID NO: 3718 - DNA, 321 bp, Klebsiella pneumoniae
ttctcggcggcgggcgcgggtcggggggccattctcggcggcggcgccatggccggttccgacgccggaattgaaggcgcaggggtcggcgcaggctcctgcctgaccggctccggtgcggctgcggcggtctccacgaccggctgggaagtagcaggcgcggccgaagcggcagacacaacaggatcagaggttggcgccgctgctacggccgcctctacctggcggaacagatccgcaggcaccgactgcggcaacggcgcggagaccgagcctcccagcgccagagaagaggatttctcggtcccgggatttagctga

SEQ ID NO: 3719 - DNA, 819 bp, Klebsiella pneumoniae
tatttccaggcgcgaacagctgaacgcggcgctgaagcgctggccgctgctggcagagtttgcagagaaaaaataaggaagccggagatggctattctgggattacagggcgtgcgcgggggaactggcgtcacgtccattacggctgcactcgcctgggccctgcaattgctcggtgaaagcgtgctggcgatcgacgccagcccggataatatgctgcgctttttctttaataccgatatccatcatcaggacggctgggcgcgggcgctgctcgacggccgggactggcgtgacgcgggcttgcgctatacgcagcatatcgatctactgccgtttggccagctcagcgccggcgaaagagaaaatgtcgaccagctgcagcccaccctgggggcgatagcggaggcagtacagcagctacagggccagtaccgctggctgctgctggatctgccggcgggttattcgccgttgactcgcgagctgctgacgctctgcgatcgctcgctggtggtggttcatcccgacgccaatagccatatccgtctacaccagcagcccctcccggccaacggcgatattctgattaacgatctgcgggtcggcagccagctgcaggaagatctctaccagctgtggctggagagccagccgcgcatcctgccggtgacgattcaccgcgacgaggcgatggccgagtgcctggcggcgaaacagcctctcggggagtatcgtcaggattcgctggcggcggaagaggtgctgaccctggcgaactggtgcctgatccactattccgccgggagagcggcatga

SEQ ID NO: 3720 - DNA, 1290 bp, Klebsiella pneumoniae
gcagcgcaggcgcggcgtcagaagttcaggcataagcgtcgttccgggcagggcgaatcctccgaacatagcaggagaaagccgccgggaacagcccgactaggttggctcaccgtacaggccaatcagtcggcgcaccacgccgttggtccagccaaagccatcctgcaggggatactccccgccgccaccctcatgggggacgccggtggcaatatggtatttttcaatcagcttgtgatgctgcttgtaaaagtggttgaccgtctgcagccagctccaggcaatctcatctcccagcggatcctggccgtaacgtttaaatccctggatcgccatccactgcagcggcgcccagccgttgggtttatcccactgctcaccgctttcgtattcggtggccatgatccccccgggggtgagcaggcgggcccgcaccgcatcggcaaggcgttctgcctgttcgtgggtcgccaggccgacgtaaagggtgacgatactggctgcggaaaacagcgccagctgttcacggcgccagtcataatcgcggaaacagccgttctcatcatcccacagatagcggttgaccgccgcccgccgatcctgggccttctggcggaaggccgtctccgtctcgcgatcgcccttcaggccggagaggttggcaatggtcgtctccagcttgaacaggaaggcgttcaggtcgatggggataaactgcgtcgtgcggatgctggccagccgcgtgatatcccgcagccagcggctggagtagtcccagccggacgcggcgcccgcccgcaggtcgcggtatacttcattggcgggccgcccggagtgtcgggcggtctccacgtcttcgcgccacgactcatcccgcggcgtgtcacggtcgtcccagtagcgattgagcagggagccatccggcatacgcaccacgtggcgatacgcctggtgcgggatcaacgactcggcgccgtccatccagaaggcgtgctccatcttcagatggtccagatagcgcttcgcgccgcgcacgccatcctcttcaaagagttcgaccatcagggcgaacaccggcggctgcgagcggctgaggtagtaggtgcggttgccgttcggaatgtggccgtaggtttcaatcagccaggcaaagttatcggccatgcatttcagcaaatcttcccggccgctctccgccagccccagcatggtgaaataagagtcccagtaataggtttcgctaaagcgaccgccgggcacgatgtaggcctgcggcagcgccagtag

SEQ ID NO: 3721 - DNA, 1032 bp, Klebsiella pneumoniae
tgccgggaggcctggattatgagtacgcaaaaggccgccacgccacaaccgctgttgcaggccattgatctgaaaaaacactatccggtgaagaaggggttattcgccccggaacggctggtgaaggcgctggacggcgtctcctttacccttgagcgcggtaaaacgctggcggtagtgggggagtcgggctgcggcaaatcgaccctcggtcgtctgctgacgatgattgagatccccaccggcggcgagctctattatcaggggcaggatctgcttaagcacgacccgcaggcgcagaagctgcggcggcaaaaaatccagattgtgttccagaacccgtatggttcgctgaacccgcgtaaaaaagtggggcagattctggaggagccgctgctgattaacagcagcctgagcaaagagcagcggcgtgaaaaagcgctggcgatgatggcgaaagtgggcctgaaaaccgagcattacgatcgctacccgcatatgttctccggcggtcagcgtcagcgtatcgctattgctcgcgggctaatgctggatccagatgtggtgattgccgatgagccggtctccgcgctggacgtttcggtacgcgcccaggtgctgaacctgatgatggatctgcagcaggatttagggctgtcctacgtgtttatctcccacgacctgtcggtcgtcgagcacatcgccgatgaagtgatggtgatgtatctcggccgctgcgtggagaagggcaccaaagaccagatcttcaacaatccgcgtcatccgtacacccaggcgctgctgtcggcgacgccgcgtctgaacccagacgaccggcgcgagcggatcaagctgaccggcgaactgccgagcccgctaaatccgccaccgggctgcgcctttaacgcgcgctgtcgccgtcgctttggcccctgcactcagctccagccgcagctgaaggattacggcggccagctggtggcctgctttgccgtcgaccaggatgagaatccgcaaaagtcccacgcctga

SEQ ID NO: 3722 - DNA, 783 bp, Klebsiella pneumoniae
gcgcgccgggcttttttgagaatacgcactgactattgcagtgaacctttgggagtacaaacaatgcaagagaattataagattctggttgtggatgacgacatgcgcctgcgtgcgctgctcgagcgttatctgaccgagcagggcttccaggttcgtagcgtggcgaacgccgaacagatggatcgtctgttaacccgtgaatccttccacctgatggtgctggatctgatgctgccgggcgaagatggtctctctatctgccgtcgtctgcgcagccagagtaacccgatgccgatcattatggtgacggcgaaaggcgaagaggtcgatcggatcgtgggtctggagatcggggctgacgactacattccgaagccgtttaacccgcgtgaactgctggcccgcatccgggcggtgctgcgccgccaggcgaacgagctgccgggcgcgccgtcgcaggaagaggcggttatcgcctttggtaaattcaaactgaacctgggtacccgcgagatgttccgtgaagacgagccgatgccgttgaccagcggcgaattcgcggtcctgaaggcgctggtgagccatccccgtgagccgctgtcgcgcgataagctgatgaacctcgcccgcggccgcgaatactctgcgatggagcgctccatcgacgtacagatctcccgcctgcggcgcatggtggaagaggatccggcgcatccgcgctacatccagaccgtctggggtctgggctacgtcttcgtcccggacggttctaaggcatga

SEQ ID NO: 3723 - DNA, 840 bp, Klebsiella pneumoniae
tatagccgggcagttttgccggataaggagatcgtaagcatggctttcagaaactggcggcttggaatgcatatccaacaggatagcattgccattgtcgcgctattgcatgaacgttcacactgggcgctgcgccgctggtggcgtatcccattgccgccggggctggtgcgtcagggaatggtggcggacgtcagcgcactcggttcgcggctggccgcctggcggcgggagctaccggcgcagcatcaggttagtatcgcctttcccgcggtgcgcacactgcaaaagcgtcttccgtatccccagttcgccctgcgggagcgggaacaggcgacgtgggtagccagcgccatgagccagcagctggcaatgcctgcctccgcgctatgtattgattatgcgcccacctcgcgggatgacggctggcaggttacggcggcgcagcggctggatatcaatgttctgcgggagctggcagggcggctgcggctgcgggtggcggccatcgtaccggatgccagtgcgctcggcgcctttttcccctggatgactgcggcagaccagggcctggcgtggcgggatgaaaagcgctggctgtgggcgacccgtgaggcctggggcagtgacgcctgcgctgatgtcgggtccttaagccagctggcggggcagcttcaggttccgctgcgcctgtgtattgacgcgggcgatgaggccagtcgctttgatgtctggcaagtgattcaccgtcggcagcccccgctgccagccgatggcgatcgttacgccattgcccttgggctggcactgggaggcgggcggcatgacgcatgtcgttaa

SEQ ID NO: 3724 - DNA, 207 bp, Klebsiella pneumoniae
taccgatgttacggtagcgtgcgatgggtgttgtacgagccatttgattcctcgtttatttctttaggcgttcagttaagttatccagagcgggcgactcatctgaagcgcccgcctggtgactatgactccgaagggattaccaacggtagtgagcgaacgccttgttggcttcggccatacggtgaacgtcttcacgtttcttaa

SEQ ID NO: 3725 - DNA, 264 bp, Klebsiella pneumoniae
gtcatcctctatcaccgaccaaattcgaaaagcctgctcaatgagcaggcttttttgcatctgaggccactgaggatgagaacctccgggggcaggaggttcgactcgcgtttcgtaggcccgcgcaagcgcagcgccgccgggcatcatcagtgcacaactggccaaaaataccaccaaaatcacaataaacgtctttactcacgttttcagccggctattcgctattttgtgacatcttccattgcatttttttatcgatga

SEQ ID NO: 3726 - DNA, 573 bp, Klebsiella pneumoniae
cagcgaaactatcaagtaatttggagtagtacgatggcgaaactgcatgattactacaaagacgaagtagttaagaaactcatgactgagtttaactacaattctgtcatgcaagtccctcgggtcgagaagatcaccctgaacatgggtgttggtgaagcgatcgctgacaagaaactgctggataacgcagcagctgacctggcagcaatctccggtcaaaaaccgctgatcaccaaagcacgcaaatcagttgcaggcttcaaaatccgtcagggctatccgatcggctgtaaagtaactctgcgtggcgaacgcatgtgggagttctttgagcgcctgatcactattgctgtaccgcgtattcgtgacttccgcggcctgtccgctaagtctttcgacggtcgtggcaactacagcatgggtgtccgtgagcagatcatcttcccagaaatcgactacgataaagtcgaccgcgttcgtggtttggatattaccattaccactactgcgaaatctgacgaagaaggccgtgctctgctggctgcctttgacttcccgttccgcaagtaa

SEQ ID NO: 3727 - DNA, 477 bp, Klebsiella pneumoniae
cgccttcgctatggcgggccggcaggcgcgccaccagcgtccagtattcaatggcgacgtcaacgtcatccggcaccccgccgtacagtttttcataggcggcgatggcttcatcgaccttcccggccacgcccagcagtcgcgcctgctgcagcgcctggcggccctcgccggtgttgcttttcatctcattgcgcgacgccttcagctccggggagtccggcgccagcttcgtcagtcgttccagctctttttgcgccccggcggcatccccctgacgcagcagatagcgcatccgcgcggcaatcagctccgggttgttgggatcaatcagctccagacggtacagcgactggcgcaccaggtcttcacgattgctggcctcgccgaggcgcacctgctccagcagatgctcctgggcaggcgtcgtcgtcgcctgcgctaacggtagcagcgcaacgccgagggacagcgtga

SEQ ID NO: 3728 - DNA, 270 bp, Klebsiella pneumoniae
gcgggtagctatcctgtcgccggttatcttcctcaccgcgatgctggtgtatgcgattggcacctatgcggtgctggacccgatgatcaccctgtggctggcgctggcgatgtgcagcttctggggcgcggcgcaggcgcagagccgcagcggcaaaatactgggctacgtgctgctgggcgtcgcctgcgggatgggggtgatgaccaagggcttcctggcgctggcggtgccggtggtgggcgttctgccgtgggtgatcgcccgtaa

SEQ ID NO: 3729 - DNA, 357 bp, Klebsiella pneumoniae
aaattatctctctggcaccagaagtactctaaggagcgaatcatggcagcgaaaatccgtcgtgatgacgaagttatcgtgttaaccggtaaagataaaggtaagcgcggtaaagttaagaatgtcctgtcttccggcaaggtcattgttgaaggtatcaacctggttaagaaacaccagaagccggttccggctctgaaccaaccaggcggcatcgttgaaaaagaagctgcaattcaggtttctaacgttgcaatcttcaatgcggcaaccggcaaggctgaccgtgtaggctttagattcgaagacggtaaaaaagtccgtttcttcaagtctaacagcgaaactatcaagtaa

SEQ ID NO: 3730 - DNA, 1287 bp, Klebsiella pneumoniae
atggatgatttcaaaccagaagacgatatgaaagccgatcgcaacgatcgtcgtgctggtcgttcccgtcagtcttccgagcgtgatgccgatccgcagatcaattttgacgatgttgatcttgatgccgatgaaggccgtccgacgcgcgctggtaaggcccgtcgcgagcgtgaagaggaagagttcgaagaagaactggatgcgcaagacgaggagatgctcgaagagcagcctgtagagcgtcgtccgcgcaagcgtaaaaaagcgccggccaaaccggcctcccgccagtacatcatgatgggtgtggggattctggtgctgctgctgttgatcgtgggtatcggttccgcactgaaatcgccatcatcttccagccagcagaccgcttccggcgagaagagcattaatctgtctgacgaccagtccgccagcatgcctgctgccggccaggaccagactgccgccgctaacagcacctcacagcaggacgtaacggtaccgcctattgccgcgaacccgacgcagggccaggcagcggttgcgccgcagggccagcagcgtatcgaagttcagggcgatctgaacaatgcgttgacccagcagcagggccaactggacggcgccgtggctaactcgacgctgccgactgaaccggctaccgtcgcgccaatccggaatggcgccaatggcaccgcggcgccgcgccaggcgaccgagcgtcagacagcagcgaccccgcgtccggctgaacgtaagcataccgttatcgaagcgaagccgcagtcgaagccacaggccgtggcgaaaacgccggtagaatcgaagccggtccagcagaagcatgttgaaagcacggcgaccaccgctccggcgaaaacgtccgtcagcgaaagcaaaccggtggccaccgctcagagcaaaccgaccacgacgactgcagcgccagcggcaacggcagctgcggcagcgccggcagcgaagagcgggaagacggcaggtgacgtcagctcaatgaaaactgcgccgtcgggtcactatactctgcagctcagcagctcctctaactacgacaacctcaacaactgggcgaagaaagagaagctggataaatatgttgtctatgaaacgtcgcgtaacggccaaccatggtacgtgctggtgagcggtatctatgcatcgaaagatgaagcgaaacgtgctgtcacctcgctgccggcggacgtgcaggcgaaaaatccatgggcaaaaccactgcatcaggttcaggctgacctgaaataa

SEQ ID NO: 3731 - DNA, 684 bp, Klebsiella pneumoniae
aagagtgattttcaacaccttttcaccgtggtattggcacattttgctcaattttcaccgttttcaggggatgcacagggagataaaagccaccaaacccttcttacgttcccgtattttgagggctatatggctgctcaggtgcgcccctacaaagcatttttcccacaaatcggtcttcgcgtcatgattgacgcatccagcgttgtcatcggcgatgtcagaattgccgatgacgtcagcgtctggcctctggtggccattcgcggcgacgtcaactatgtatcgataggtcaacgcagcaatattcaggacggtagcgttctccatgtgacccataagtcctcttataagccggagggaaatccgctgatcattggtgaggatgtaactgttggtcataaagtgatgctccacggctgcactatcggcaaccgcgtactggttggtatgggttcgatcttattagatggtgtcgtcgttggcgatgacgtcatgattggtgcgggcagtctggttccgcagaacaaacagctggaaagcggctacctttactttggcaatccggtcaaacagatccgccccctgacagaggcggaacgggaaggactcaagtattcagcaaataactatgtgaaatggaaaaatgagtacatggatcaggataaccagatccagccctga

SEQ ID NO: 3732 - DNA, 2430 bp, Klebsiella pneumoniae
cgtcgtttgtaccccgacgccctgaacgcgccgcgccgacgctctccgcagacccggcaatggctcaacaatgatgataatgcgatgaaaagaaaactttcctggatgtgtgcagtagcggtgggcatgtgcagctggtatccactggcctcttacgcggcgccggccgcggtggcgaacgctgcccctggcgttcagccgcaggccgcgaccccggctgcgccgatcgtggtgggcgagccgacggcgaccctcgccgaaccgaccgctccggcggcggtggccgagaacgtgccgcagcgggaggtgaagctgagctttgccaccatcgcgccgccgcccggcagcatcgtgctgcgcggctcacggcctgacgcgtcggtcgaattcggcatgcgcagcgatgagctggtcgccaacgcgctgctcaatctggaatacaccccatcgccctcgctgctgcccgtgcagtcgcagttgaaggtctatcttaacgatgagctgatgggcgtcctgcccgtcaccaaagagcagctggggaaaaagatccgcgcgcagctgccgattgacccgctgtacatcaccgacttcaaccgcgtacggctggagtttgtcggccactaccgcgacgtctgcgaaaacccggccagcagcacgctgtggctggacgtcggacgcgaaagctatctggatctcacctaccagtcgctgaaggtaaataacgatctgtcacacttcccggtgccgttctacgatccgcgcgataaccgcccgctgaagctgccgatgattttcccgggctcgccagcggtcacccagcagcaggcggcggcgatagtcgcctcctggttcggcagcaaggccggctggcgcggccagcagttcccggtctatttcaatgaactgccggatcgtaacgccattgtcttcgccaccaacgacaagcgtccggacttcctgcgcgatcatccgccggtcaaggcgccgaccatcgaaatgatcgacaacccgaacgatccctacgtcaagctgctggtgattttcggccgcgatgataacgacctgctgctggcggcgaaggggattgctcagggcaatattctgttccgcggcagcagcgtcaccgtggacggcatcaaaaccctgcagccgcgtcagccttacgacgcgccgaactgggtgcgcaccgaccgctcggtcaccttcgctgagctgaaaacctatgagcaacagctgcagtccagcgggctggtgccggatgccatcaccgtggcgcttaacctgccgccggatctctatctgctgcgggccaacggcatcgatatggatctgaaataccgctacaccatgccgccggtgaaggacagctcgcggatggatatcagcctcaacgaccagttcctgcagtcgttcagccttaacagctcccaggacatgaacaaactgatcctgcgcctgccggtgctgcaggggctgctggacggcaaatcggaggtcaccatccccgcgctgcgtcttggggcggtcaaccagctgcgctttgacttccagtatatgaacccgatgcccggcggctccatcgacaactgtattaccttccagccggtgcagaaccacgtggtgatcggcgacgattcgaccatcgacttctcgaagtattatcactttatcgccttgccggacctgcgcgtcttcgccaatgcgggcttcccttacagccgtatggccgacctttccgacacgctggtggtggtgccgaaggcgccgacccagggccaggtggcgacgctgctgcaggcgctggggggcatcggctcgcagaccggtctggcggcgattaatctgcaaatgaccgacgatggcaaccagatcaagaacaaagatgcggatctgctgctgatcggcgcgatcccgtcgtccctcaaggacgacaccaaaatcaacctgctggtcgaggcgaccaaaagctgggtgaaaatgccgatgcgccactatgacctggcgagcatttatcccgacgatgaggcccgcacgcccaatacccgcaccgacattacctcttccgggccgatggcggcggtgattggcttccagtcgccgtataacgatcagcgcagcgtggtggccctgctggccgacagcccgcgcggtaatgaactgctgaccaacgccctcaacgacagcggtaagcgggcagcgatgtttggctcggtggcggtgatccgcgaatccggcgtcaacagtctgcgggtgggggatatttactacgtgggtcatctgccctggttcgagcgcatctggttcgcgctgtctaaccacccgatactgctggcgatcttcgccgccatcagcattgtgctgctggcatgggtgctgtggcgcatgctgcgcatcatcagccgccgccgtcttagcctggatgatgagtaa

SEQ ID NO: 3733 - DNA, 2238 bp, Klebsiella pneumoniae
gaaaattatcatttcccggagggtgccatgtcgactccagacgcgcaggataaaaaagttccacaattctcgtctttcaccatgcggccagcaaccgccccggcggagagctgctgtacagatcacgcctgcgccacagagtccgcccctgccgccgaagcgcttagcggcgcccgctatagctggcaagttgatggcatggactgcgccgcctgcgcccgcaaggtggaaaccgcggtccgtcaggtgcccggggtcagtcaggtccaggtgctgttcgccacagaaaagctgctggttaacgccgagggcgatgtccgcgctcaggttgagaacgcggtccgccaggcggggtatacgctgcgcgatgccgatgctcccgcagcagagcaaacccgagggtcgctgctgcgcgacaatctgccgttactgacgctggttatcatgatggccttgagctgggggctggagcaggccaaccaccctgccggtcagttggcctttattgccaccaccctggttggcctgtggccggttgcccgccaggcgctgcgcctgatcaagagcgggagctggttcgccattgaaacgctgatgagcgtcgccgccatcggggcgctgtttatcggcgccaccgcggaggcggcgatggtcctgctgctgttcctgatcggcgagcgtctcgaaggctgggccgccagccgcgcacggcagggggtgagcgcgctgatggcgctgaagcccgacaccgccatccgtctgcgcaacggcgtgcgggaaaccgtcgcccagcgcgacctgcgtcccggagatgtgattgaagtggctgccggcgggcgtctgccggcggatggccagctgctgtcgccgtttgccagctttgatgaaagcgccctgaccggcgagtcggtgccggtggagcgtcaggccggggaacgggtagcggcgggcgccaccagcgtcgaccgcctggtgcagcttaccgtgatatccgaaccgggcgacagcgccatcgaccgcatcctgaagctgattgaagaggctgaggagcgtcgggcgccgatcgagcgcttcatcgaccgtttcagccggatctacaccccggccattatggtggtggccttgttggtcgccattgtcccgccgctgttcttcgccagcgcctggctgccgtggatttataaagggctgacgctgctgctgatcggctgtccgtgcgcgctggtcatctccacgccggcggccatcacctccggcctggcggtcgccgcccgccgcggggcgctaatcaaaggcggcgcggcgctggagcagctgggccaggtgcgccaggtggcgttcgataaaaccggcaccctgaccgtcggccagccgcaggtgacttcggttattgccacggccgaagttgacgacaacgcgctgctggcgctggcggcggcggtggagcaaggctccagccacccgctggcgcaggctatcgtccgtgaagcgcagcggcgtcagctgagcattccgcttgccagcggccagcgggcgctggcgggctctggtatcgaagccgaagtcaacggcaaccgcatcctgatctgcgccgccagcaaagccgccccggcagagcatgaggcgcagatccagcagctggaaagcgccgggcaaacggtagtgctggtgatgcgcggcgagacgctgctcggcattctggcgctgcgcgataccctgcgcgacgacgcgcgtcaggcggtggatgctttacatcagttgggcgttcagggggtgatccttaccggggataacccgcgcgctgcggcggccatcgccagcgaactggggctggaattccgcgccggtctgctaccggcggacaaggtcaacgcggtgatagcgctgaatgccgacgcgccgctggcgatggtcggggacggtatcaacgacgcgccggcgatgaaagcggccaccatcggcatcgccatgggcagcggaaccgacgtggcgctggagacggccgacgccgcgctgacccataaccgtctgaccggcctggcgcagatgatttccctggcgcgcgccacccacgccaatatccgccagaacatcgcgattgccttagggctgaaggggattttcctcgtcaccaccctgctcggcctgaccggtctgtggctggcggtgctggcggataccggcgccaccgtgctggtaacggctaacgcgctgcggttattgcgtaagaagttgtag

SEQ ID NO: 3734 - DNA, 1269 bp, Klebsiella pneumoniae
ttagattatcataatcgcatctgcgtaacgaagagggatgggcaagacatggcaactgaacaaccggcaatcacccgcgccacattcgatgaagttattttgccaatttatgcaccggcagaattcatcccggtgaaggggaaaggcagccgcgtctgggatcagcaggggaaagagtatatcgatttcgccggcggtatcgcggtgacggcgcttggccattgccatccggcgctggtggcggcgctgcatcagcagggcgaaacgctgtggcacaccagcaacgtctttaccaatgagccggcgctgcgtctgggacgtaaacttgtcgaggctaccttcgccgagcgcgtggtgtttatgaactccggcaccgaagccaatgaaacggcctttaagctggcgcgtcactatgcggtgacccgccatagcccgtataaaaccaaaatcatcgccttccataatgcctttcatggccgctccctgtttaccgtttccgtcggcggtcagccgaagtattccgatggtttcggcccaaaaccggcggatattgtccatgttcccttcaacgatctgcaggcggtaaaagcggtgatggatgaccacacctgcgcggtggtggtggagccgattcagggcgaaggcggcgtgacggcggccacgccggctttcctgcagggactgcgcgagctgtgcgatcagcaccaggcgctgctcgtctttgatgaagtacagtgtggtatggggcgtaccggatcgctgttcgcctatatgcactacggcgtgaccccggatattctgaccagcgccaaagcgctgggcggcggcttccctgtcagcgccatgctgaccacccacgagatcgccagcgccttccatgcgggctcccatggctcaacctacggcggcaacccgctggcctgcgcggtcgccaacgccgccttcgatctgatcaataccccggcggtgctggatggcgtgagcgcgaagcgcgaactgttcgtcaaacacctgcagcggctggatgccgagtttgatctgttcagtgatatacgcgggatgggcctgctgatcggcgcggaactcaagccgcagcacaaaggccgcgcgcgtgatttcctctatgccgcggccgacgccggcgtcatggtgctcaacgccgggccggacgtgatgcgttttgttccctcgctgatcatcgacgagcaggatattactgaagggatggcgcgctttgcccaggcggtggcaaaggtgattaacggttga

SEQ ID NO: 3735 - DNA, 1293 bp, Klebsiella pneumoniae
ctccaccatcagtcgggaatgcagctcggacaccccgttgaccttgtggctgaccactaccgccagccaggccatccgcacacggcggccgttagactcgtcgataatcgaggtgcggctgagaaggtcggtatcgttcggatactgctcctgcaaggtcttgaggaaatagtcgttaatctcgaagataatctgcagatggcgcggcagaattttacccagcatatccaccggccaggtctcgagcgcttcgctcatcagggtgtggttggtataggagaagacctgacaggtcacctcgaacgcctcgtcccagctgaacttatgttcgtcgataagcagacgcatcagctccggtatcgacagcaccgggtgggtgtcattcaggtgaatggcaatcttgtccgccaggttgtcataggttttatgcaacatgtaatggcgactcaggatatcctgcaccgtggccgacacgaggaaatactcctggcgcaggcgcagctcgcggccggagtaggtcgagtcgtccggatagagcacgcgggagacgttttcggagtggtttttatcctctaccgcggcgaagtagtcgccctggttgaatttaccgaggttaatttcgctactggcctgcgcgctccacagacgcagtgtgttggtggcgtcggtgtcaaagccggggatgatctggtcgtaggcttccgcaatgatctcctccgtctcaatccagcgggttttctttccttcctgctgaatgcggccgccgaagcgcactttatagcgggtgttgtggcgctcaaactcccacgggttaccgtactccagccagtagtcaggagactctttttgccggccatcgacaatattctgtttaaacatcccgtagtcgtagcggatgccgtaaccgcgtcccggcagacccagcgccgccagggagtcaaggaagcaagccgccaggcggcccagaccgccgttgccaagcccggggtcattctcttcatcgatcagctcttcgagatcgagccccatctccgccagcgcgctgctcacatcgtcataaatgcccagcgacagcagcgcattcgagagggtgcggccgatcagaaactccatcgacagatagtacacctggcgcacttcctgggagagctgcgcgcggttggagcgcagccagcgctccaccatgcgatcgcgaacggcaaacagcgtggcgttaagccattcatgcttgttggcgatggccggatctttaccgatgataaacatcagtttataggcaatagaatgctttaa

SEQ ID NO: 3736 - DNA, 2127 bp, Klebsiella pneumoniae
acgaggaatcaaatggctcgtacaacacccatcgcacgctaccgtaacatcggtatcagtgcgcacatcgacgccggtaaaaccactactaccgaacgtattctgttctacaccggtgtaaaccacaaaatcggtgaagttcatgacggcgccgctaccatggactggatggagcaggagcaggaacgtggtatcaccatcacttccgctgcgactactgcattctggtctggtatggccaaacagtatgaaccgcaccgcgtaaacatcatcgacaccccggggcacgttgacttcactatcgaagtagaacgttccatgcgtgttcttgatggtgcggtaatggtttactgcgcagttggtggtgttcagccgcagtctgaaaccgtatggcgtcaggcaaacaaatataaagttccgcgcatcgcgttcgttaacaaaatggaccgcatgggcgctaacttcctgaaagttgttggtcagatcaaaacccgtctgggcgcgaacccggttccgctgcagctggcaattggtgctgaagaaggttttaccggcgttgttgacctggtgaaaatgaaagccatcaactggaacgatgcagaccagggcgtaaccttcgaatacgaagatatcccggctgacatgcaggacctggctgatgaatggcaccagaacctgatcgaatccgcagctgaagcttctgaagagctgatggaaaaatacctgggtggtgaagaactgactgaagaagagatcaaaaaagctctgcgtcagcgcgttctgaacaacgaaatcatcctggtaacctgtggttctgcgttcaagaacaaaggcgttcaggcgatgctggatgcggtaattgattacctgccatctccggttgacgtacctgcgatcaacggtatcctggacgacggtaaagataccccggctgagcgtcacgcaagcgacgacgagccgttctctgcactggcgttcaaaatcgctaccgacccgttcgtgggtaacctgaccttcttccgcgtgtactccggtgtggttaactctggtgataccgtactgaactccgtgaaagctgcacgtgagcgtttcggtcgtatcgttcagatgcacgctaacaaacgtgaagagatcaaagaagttcgcgcgggcgacatcgctgctgctatcggtctgaaagacgtaactactggtgacaccctgtgtgacccggatgcgccgatcattctggagcgtatggaattccctgagccggtaatctccatcgccgttgagccgaaaaccaaagctgaccaggaaaaaatgggtctggctctgggtcgtctggctaaagaagacccgtctttccgcgtatggactgacgaagagtctaaccagacaattatcgccggtatgggtgagctgcacctcgacatcatcgttgaccgtatgaagcgtgaattcaacgttgaagcgaacgtcggtaaacctcaggttgcttaccgtgaagcgattcgcgcgaaagttaccgatatcgaaggtaaacacgccaagcagtctggtggtcgtggtcagtacggtcacgttgtgatcgacatgtacccgctggagccgggctctaacccgaaaggttacgagttcatcaacgacatcaaaggtggtgtaattcctggcgaatacatcccggccgttgataaaggcatccaggaacagctgaaagctggtccgctggcaggttacccggtagttgatatgggtatccgtctgcacttcggttcttaccacgacgttgactcctctgagctggcgtttaaactggctgcgtctattgcctttaaagaaggctttaagaaagcaaaaccagttctgcttgagccgatcatgaaggttgaagtagaaactccggaagagaacactggtgacgttatcggtgacttgagccgtcgtcgcggtatgctgcgcggtcaggaatccgaagtaaccggcgttaagatccacgctgaagtaccgctgtccgaaatgttcggttatgcaactcagctgcgttctctgaccaaaggtcgtgcatcatacaccatggaattcctgaagtatgatgatgcgccgaacaacgttgctcaggccgttattgaagcccgtggtaaataa

SEQ ID NO: 3737 - DNA, 993 bp, Klebsiella pneumoniae
gggataatccagttggaaactggccaggcacaaacagcacacacctcgcaggaatacgttatgaaaaatgttggttttatcggctggcgcggaatggtcggctctgttctcatgcaacgcatggttgaagagcgcgatttcgacgccattcgcccggtgttcttctctacctcccagctgggacagccagcgccgtcattcggcggtagcaccggtggcacgctgcaggatgcgttcgatctggacgcgctgaaggcgctggacattattgtcacgtgccagggcggcgattacaccaacgagatttacccgaagctgcgcgcaagcggctggcagggttactggattgacgcggcttcttcgctgcgcatgaaggacgatgcgatcattatcctcgacccggtaaaccaggatgtgatcaccgccggcctgaacaacggcgtgaaaacctttgtcggcggcaactgcaccgtcagcctgatgctgatgtccctcggcggcctgtttgctcaggatctggtggagtgggtcagcgtggcgacgtaccaggcggcttccggcggcggcgcgcgtcatatgcgcgagctgctgagccagatggggcagctgcataatcatgtggccgcggagctggcggacccggcttccgccatcctggatattgagcgcaaagtgacgtcgctgacccgcagcggcgagctgccggtcgataactttggcgtaccgctggcgggcagcctgatcccgtggatcgacaaacagctggataacggtcagagccgcgaagagtggaaaggccaggcggagaccaacaagatcctcgccacctcgtccgttatcccggtagacggcctctgcgttcgcgttggcgcgctgcgctgccacagccaggcgtttaccatcaagctgaagaaagatgtttctatcccgaccgttgaggagctgctggcccgcgcacaacccgtgggccaaagtggtaccgaacgatcgtga

SEQ ID NO: 3738 - DNA, 2385 bp, Klebsiella pneumoniae
acggttgcccatcacgccgtcatgacacctgcattcgctgaccaggagccgcccttgccaacctcatctgcaaccaaaaccatcttaaccgccgcccactggggaccgatgctggtggaaacggacggggaaaacgtcctctcttcccgcggcgcgctggcgacaccgtttgccaactcgctgcaaacggcagtgcgcgatcaggtgcacagcaaaacccgcgtgcgctatccaatggtgcgtaaaggcttccttgcttcaccggacaagccccagggggtccgcggtcaggatgaattcgtgcgggtgagctgggagcaggcgctggatctgatcgatgcccagcatcggcggatccgcgacagctacggtccggcctccatttttgccggctcctacggctggcgctctaacggcgtattgcataaggcggcgacgctgctgcagcgctatatgagcctggcgggcggctataccggccatcttggcgattactccaccggcgcggcgcaggcgatcatgccttacgtcgttggcggcaatgaggtgtatcagcagcagaccagttggccgctggtgctcgagcacagcgaagtggtggtgctgtggagcgccaacccgctgaacacgctgaaaatcgcctggaatgcctccgacgagcaagggatcccgtggtttgatcggctgcgccagagcggtaagcggctgatctgcatcgatccgatgcgatcggaaaccgtcgatttctttggcgattcgatggagtggatcgcgccgcatatgggcaccgacgtcgcgctgatgctggggatcgcccatacgctggtggaaaatgactggcaggatgatgcgtttcttacccgctgcaccagcggctacgatatttttgcccgctatctgaccggcgaaagcgacggcgtagcgaaaaccgctgagtgggcagcagcgatctgcggcgttaaagcagataaaatccgcgaactggcgcaacttttccacgaaaataccactatgctgatggccggctggggcatgcagcgtcagcagtatggcgagcagaaacactggatgctggtcactctggccgccatgctgggacagatcggcacccccggtggcgggtttggtctttcctatcattttgccaacggcggcaacccgacccgccgcgcggcggtgctgggctcgatgcaggggagcgtggccggaggcgtggacgcggtggagaagatcccggtcgcacgaattgtcgaggcgctggagaatccgggggcggagtatcagcacaacggcatggcgcggcgctttcccgatattcgctttatctggtgggccggcggcgccaactttactcatcatcaggacaccaaccgactgattcaggcgtggcagaaaccggagcttatcgtcatttccgaatgcttctggaccgccgccgcgcgccatgccgatatcgtcctgccggcgaccacctcgtttgagcgcaacgatctgaccatgaccggggactacagtaaccagcatctggtgccgatgaagcaggtggttgccccgcgagatgaagcgcgcgacgatttcgcggtctttgccgacctcagcgaacgctgggaggcgggtggccgcgaacgcttcaccgaagggaagagtgatttgcagtggctggagactttctatcagatggccgcccggcgcggcgcccagcagcaggtgacgctgccgccatttgccgaattctggcaggctaaccagctgattgagatgccggaggagccggagaatgcccgttttgcgcgtttcgccgccttccgcgccgatccccaggccaacccgctgaaaacggcgagcggtaaaatagagatccactcgccgaccatcgccgcttttggttacgccgactgtccgccgcatccgatgtggctggagcccgacgagtggcatggcaacgcagaggcggggcagctgcagctgctgtcggcccatccggcccaccgtctgcacagccaactgaaccacaccgcgctgcgcgagcgctatgccgtcgccgggcgcgaaccggtgactattcatccgcaggatgcgcaggcgcgcgggattgtcgatggcgatctggtgcgggtatggaacgcccgcggtcaggtgctggccggcgccgtggtgacggaggggatccgcccgggggtgatttgcctgcatgaaggagcgtggcccgacctggatccgcaggtcggcatctgcaaaaacggggcggtgaacgtcttaaccaaagatattccgacatcccggctgggcaacggctgtgccgggaacaccgccctggcgtggctggagaaatataccggcccggcgctgccgcttacggcatttgatccgccggccaacgcataa

SEQ ID NO: 3739 - DNA, 1398 bp, Klebsiella pneumoniae
ttttgtgtacaagaattgggtaagccgcgattggggttagacagaaaacaagccgtattgaatagagagggtgatatgacagcagcgccgctttggttgattcagaacgtacgcctggcagaccgcgacggcctgtggcaaatagccattgataagggccgctttggcgcgatcacgccgatgggggaggcgcacgatgaaagctatgaggtattgaacgctcgcggcgggctagcgatcccgccttttatcgagccgcatatccatctggataccacccagacggccggcgagccgaactggaatcagtccggtactctgttcgaggggattgagcgctgggcggagcggaaagcgctgctcagccatgaggacgtcaaagcccgggcgtggaaaaccctgaagtggcagatcgccaatggcgtgcagtttgtccgcactcatgtcgatgtttccgatcccacgttaacggcgctgaaggcgatgctggaggtcaaacaggaggtggcgccatgggtcgagttacagattgtcgcttttccacaggaggggatcctctcttaccccaacggcgaggcgctgctggaggaggccctcaagctgggggcggacgtcgtcggggcgatcccgcattttgagttcacccgtgaatatggtgtggaatcgctgcatatcgccttccgtctggcgcagcaatatgaccgcccactggatattcactgcgatgaaattgacgatgagcagtcgcgctttgttgaaaccgttgccgcgctggcgctgaaagcggggatagggccgcgggtaacggccagccataccaccgctatgcactcctataatggcgcttatacctcgcgtctgttccgcttgcttaagctctccggcatcaactttgtcgccaatccgctggtgaatattcatctgcagggccggtttgacgactacccgaagcgacggggcattacccgggtgaaggagctgttggcggcggggatcaacgtttgctttggtcatgatgacgtctttgacccgtggtacccgctggggaccggcaatatgctgcaggtcctgcatatggggctccatgtttgccagctgatgggctaccagcagatcaacgacggcctgcagcttatcaccgacaacagcgcccgtacgtttggcctcgaggattacggcattgtcagcggcaacccggctaacctgatcattctcccggcggagaatggctttgaggccgtccgctgccaggtgccggtgcgctggtcaattcgccagggaagggtgatcgcgaccacccagccggcgcaaagctggatccaaactgaccgcggtggcgaggagctttcttttatgaggaacagcccccttgcggatgcaaaggggccgaaggcttag

SEQ ID NO: 3740 - DNA, 1728 bp, Klebsiella pneumoniae
ctcgtgccacagcgtcaggcggtgttttattcttctttttccaggtttgcttgcatgaaatatattagaacgatgacgcagcagaagcttagtttttggctggcgctgtacatcggctggtttatgaacgtcgccgtttttttccggcgtttcgatggttatgctcaagagttcactttctggaaagggctttccggtgttgttgaactggttgccacggtatttgtcaccttcttcctgttacgtcttctgtcgctgttcggccgccgtatctggcgcattctggcgacgctgattgtcctgttttccgccgcggcgagttactacatgacgttcctcaatgtggtgattggctacgggattatcgcttcggtgatgaccaccgatatcgacctgtcgaaagaggtcatcggctggcacctgatcctctggctggtggcggtgagcgcgccgccgttgctgttcatctggagcaaccgctgccgccatacgctgctgcgccagctgcgcaccccgggccagcgggttaaaaacgtgctgatcgtggtgctggccggactaattgtctggggacccatccgcctgctagagctgcgccagcatgatgtggagcgccattcggaagtggatatgccgagctatggcggggtgatcgccaactcttacctgccgtcgaactggttgtcggcgctgggactgtacgcctgggcgcaggtggatgaatcctcagacaacaaatcgctgattaacccggcgaagaagttcacctacgtcgcgccggaaggtctggatgatacctatgtggtgtttatcattggcgaaacgacccgctgggaccatatgggcatcctcggctatagccgcaataccacgccagagctggagaaagagaagaatctcgtcgccttccgcggttactcgtgcgataccgctaccaaactgtcgttacgctgcatgtttgtgcgcgagggcggggcggaagataacccacagcggacgctcaaagagcagaatgtctttgccgtgctgcatcagctgggcttcagcggcaatctgtacgccatgcagagcgagatgtggttctacagcaacacgatggccaacaatatcgcctaccgcgagcagattggcgccgagccgcgcaaccgcggtaagagcgttgacgatatgctgctggtggatgagatgaagcgcggtatggcgcagggcaacgcctccggtaagcatctgatcattctccacaccaaaggctcccactttaactacacccaacgctacccgcgcagcttcgcccagtggaaaccggagtgcgtcggcgtcgacaacaagtgctcgaaagcggaactgatcaattcctacgacaatagcgtgacctatgtcgatcactttatcgtcagcgtcctcgaccagctgcgggataagaaagcgattgtgttctatgccgccgaccacggggagtcgattaacgagcgtgaacacctgcacggtacgccgcgcaagatggcgccgccggagcagttccgcgtgccgatgatggtgtggatgtcggataagtacctggaaaatcccgatcacgccgccgcgtttgcccatctgcagcagcaggctgcgatgaaggtgccgcgccgtcacgtcgagctgtacgacaccattatgggctgcctcggctatacctcgccggatggcgggatcaatgagaacaacaactggtgccggtggaaaaagtaa

SEQ ID NO: 3741 - DNA, 1761 bp, Klebsiella pneumoniae
tctcacgcacagtttgcttcacactcaccgaagcgactgtctacgcttaatagacaaggccgggtatgcccggccccgaactcacgctatccggaggtccgtatcgctatgttcagccagaaattacgccacgttgaagacgacgagttaaggatcgacatcgatccctgctacgaagccgatccgtacgaattaaagctggatgagatgatagacgctgaaccggagcctgaggtgatcgaggggcttccggcgtctgatgccctcaccccggcggatcgctatcttgagctgtttaccaacgtgcagaaatcacgcattttcgcggacagcaaaaccttccccgactgcgcgccgaaacacgatccgctggacatcctgcggaactaccgcaaggtcaaacgccagcccgacttcgatctgcggcagttcgttgaggacaacttctggctgccggagagccagagcgacatctatatctccgaccccagcctgaccctgaaagaacacatcgacaagctgtggccggtgctgacccgcgagcctcaggatcatatcccgtggtcatcgctactggcgctgccgcaggcctacatcgtgcccggcggtcgctttagcgaaacctattactgggactcttatttcaccatgctggggctggcggagagcggccgggaagatttgctgaaatgcatggccgataactttgcctggctgattgaaacctacggccacattccgaacggcaaccgcacctactacctcagccgctcgcagccgccggtgttcgccctgatggtcgaactctttgaagaggatggcgtgcgcggcgcgaagcgctatctggaccatctgaagatggagcacgccttctggatggacggcgccgagtcgttgatcccgcaccaggcgtatcgccacgtggtgcgtatgccggatggctccctgctcaatcgctactgggacgaccgtgacacgccgcgggatgagtcgtggcgcgaagacgtggagaccgcccgacactccgggcggcccgccaatgaagtataccgcgacctgcgggcgggcgccgcgtccggctgggactactccagccgctggctgcgggatatcacgcggctggccagcatccgcacgacgcagtttatccccatcgacctgaacgccttcctgttcaagctggagacgaccattgccaacctctccggcctgaagggcgatcgcgagacggagacggccttccgccagaaggcccaggatcggcgggcggcggtcaaccgctatctgtgggatgatgagaacggctgtttccgcgattatgactggcgccgtgaacagctggcgctgttttccgcagccagtatcgtcaccctttacgtcggcctggcgacccacgaacaggcagaacgccttgccgatgcggtgcgggcccgcctgctcacccccggggggatcatggccaccgaatacgaaagcggtgagcagtgggataaacccaacggctgggcgccgctgcagtggatggcgatccagggatttaaacgttacggccaggatccgctgggagatgagattgcctggagctggctgcagacggtcaaccacttttacaagcagcatcacaagctgattgaaaaataccatattgccaccggcgtcccccatgagggtggcggcggggagtatcccctgcaggatggctttggctggaccaacggcgtggtgcgccgactgattggcctgtacggtgagccaacctag

SEQ ID NO: 3742 - DNA, 480 bp, Klebsiella pneumoniae
cggtctggacaatatctcggatgtggccaccatctcctgggggcgggcgcttggcgaatgggcttcttctcagccaatctgtttgcgctgtgcgcgatgctgacctcctactggggactgggcggcagcttcctgaccaatatcttcgatcagttccgcctggggaatgacgaacagcccgcccggcgcctgatggtgctgctggtggtggcgatcccgccgttcgtactggcctatagcggcatggtctccttcgtcaacgcgctctattttgccggggtgttcagcggcgtcattttatcgattatgccgatcctgatgctcaagggcgcccgccagcgtggcgatctgaccccgggctggacctgtccggcctggatgacccatccgcttatccaatgcttcattgtgttgttgtatctttgcagcgccgcctacgcgatagcatccgcggtgggctacctacccgcaggctggtaa

SEQ ID NO: 3743 - DNA, 765 bp, Klebsiella pneumoniae
ccttcgctgcagatacggcaacgaaggcagccccggcggctgagagtaaatcggcatttaaaaatgacgatcagaaatcggcctatggcgctgggcgcgtccatggggcgttacatggaaaactccctgaaagaacaagagaagctgggcattaagctggataaagcccagctgatcgccggcgaacaggacgcgtttgccgataagagcaaactgtccgaccaggagatcgaacagactctgcaggcctttgaaacgcgcgtgaagaccgcggctcagcagaaaatggaaaaagacgccactgagaacgaagccaaaggcaaagcgttccgtgacagctttgccaaagagaagggcgtgaaaacctcaaaaactggcctgctgtataaagtcgagaaagaaggcgctggcgatgcgccgaaagacagcgataccgtggtggtaaactacaaaggtaccctgatcgacggtaaagagtttgataactcttatactcgcggcgagccgctctctttccgtctcgacggcgtgatcccgggctggactgaaggcctgaagaatatcaagaaaggcggcaaaatcaagctggttattccgccggacctggcctacggtaaaactggcgtcccgggcatcccggccaactctacgctggtctttgatgtagaactgctggatatcaaaccggcgccgaaggcagatgcacagccggaagccgcaggcgatgcgaaagccgcggacgcgaaagctgacgctaagaagtaa

SEQ ID NO: 3744 - DNA, 369 bp, Klebsiella pneumoniae
atgacgctgcagattatctcagcggaagagataatacagtttcacgacaggctgctccgcgtcacgcctggcgttgccggtatgcccgatccggggcgtgccgaagcgataatgtatagggtgctaaacaaaattgaatatgaaggtgtgacagacgtgtggcgactcgctgcgatgcatctgctggcgatttctcgcggtcatatatttaatgatggtaataagcgtacggcactgtttatcaccctgctttttttaaagcgaaatggaattatattgccggcgaatccagacttcgtcggcatgaccgtcgaggcagcagcagggcaacttaccctggaacagattgtcgcgcgtttgcgtggatga

SEQ ID NO: 3745 - DNA, 321 bp, Klebsiella pneumoniae
ccagtacagcagcttttttgttggtgtaggtcagaatatccagggcctgcgacactttcttaccgcgaatcaggtcagctacaaggcgaaccttctgagcagaagaacgagcatggcgatgttgagctaaagtttccatctcttcctcctaccttatttcttcttcgcttttttatcagcagcgtggccgcgataagtacgagtcggtgcgaattcacccagtttgtgaccgaccatttcgtcggaaacaaatactggaacgtgctgacgaccattatggacagcgatggtcaaaccgatcatgttaggaaagatcgttga

SEQ ID NO: 3746 - DNA, 2628 bp, Klebsiella pneumoniae
aaacggcagcattgccgcggagaagcccactggcccctggccgctggttttgccggtggcgatattcactttctccgggggtatcccctgctccgtggtctgcgccgccatcggcgcgaagcgttgcagcagacgcgctttctgcttatcgccatcatggagcatgcccacccacaggtagacgcgaatcgcgtcatagctgccgatcggcggcttttcggttttcagctgccagcctttccctttctcatagcgcacccagtccggggtaaagcctttcggcgcggtctccagcagcaggcgcaggttactgtcgcgcagagcgggccacggcgcgccaaaacgcacaaagtaggtggccagctgcggcggaagatagctggggttaaaccgccagccgctgtcatcggcaaaaccgacttttcccggcagcagcatcgtgccgaggcccggcaccgccaccgtctcttcagcgacaatccgcgccagcagggctttaccggtctcggtgtactgcggctgttgccacaggcgccccgcctccagcagcgcccaggctatccacagatccgagtcggacgccgagttgctgtccagcagggtccactgctcatcgtcctttttgccccacagccagcccggcaaatgttgtttcagatcgccttccgccaggttgttctgcgtccaggtcagcagtttgtcgaaccccgcgcgatcgttggccgccagggcgaaaaacaggccatagctctgcccttcggaggtggagattttgcgcgcatcgctggggtcaatcacccgtccctcggggctgacgtacgcttgtttaaactgctcccaggcgggccactggcaggcggcgcccacctggcccgccgccagcagcagcgccgagagcaccgcgccacaaagtactttcatcatggtttactcatcatccaggctaagacggcggcggctgatgatgcgcagcatgcgccacagcacccatgccagcagcacaatgctgatggcggcgaagatcgccagcagtatcgggtggttagacagcgcgaaccagatgcgctcgaaccagggcagatgacccacgtagtaaatatcccccacccgcagactgttgacgccggattcgcggatcaccgccaccgagccaaacatcgctgcccgcttaccgctgtcgttgagggcgttggtcagcagttcattaccgcgcgggctgtcggccagcagggccaccacgctgcgctgatcgttatacggcgactggaagccaatcaccgccgccatcggcccggaagaggtaatgtcggtgcgggtattgggcgtgcgggcctcatcgtcgggataaatgctcgccaggtcatagtggcgcatcggcattttcacccagcttttggtcgcctcgaccagcaggttgattttggtgtcgtccttgagggacgacgggatcgcgccgatcagcagcagatccgcatctttgttcttgatctggttgccatcgtcggtcatttgcagattaatcgccgccagaccggtctgcgagccgatgccccccagcgcctgcagcagcgtcgccacctggccctgggtcggcgccttcggcaccaccaccagcgtgtcggaaaggtcggccatacggctgtaagggaagcccgcattggcgaagacgcgcaggtccggcaaggcgataaagtgataatacttcgagaagtcgatggtcgaatcgtcgccgatcaccacgtggttctgcaccggctggaaggtaatacagttgtcgatggagccgccgggcatcgggttcatatactggaagtcaaagcgcagctggttgaccgccccaagacgcagcgcggggatggtgacctccgatttgccgtccagcagcccctgcagcaccggcaggcgcaggatcagtttgttcatgtcctgggagctgttaaggctgaacgactgcaggaactggtcgttgaggctgatatccatccgcgagctgtccttcaccggcggcatggtgtagcggtatttcagatccatatcgatgccgttggcccgcagcagatagagatccggcggcaggttaagcgccacggtgatggcatccggcaccagcccgctggactgcagctgttgctcataggttttcagctcagcgaaggtgaccgagcggtcggtgcgcacccagttcggcgcgtcgtaaggctgacgcggctgcagggttttgatgccgtccacggtgacgctgctgccgcggaacagaatattgccctgagcaatccccttcgccgccagcagcaggtcgttatcatcgcggccgaaaatcaccagcagcttgacgtagggatcgttcgggttgtcgatcatttcgatggtcggcgccttgaccggcggatgatcgcgcaggaagtccggacgcttgtcgttggtggcgaagacaatggcgttacgatccggcagttcattgaaatagaccgggaactgctggccgcgccagccggccttgctgccgaaccaggaggcgactatcgccgccgcctgctgctgggtgaccgctggcgagcccgggaaaatcatcggcagcttcagcgggcggttatcgcgcggatcgtagaacggcaccgggaagtgtga

SEQ ID NO: 3747 - DNA, 384 bp, Klebsiella pneumoniae
cggagcactaaaatgatccaagaacagactatgctgaacgtcgccgacaactccggtgcacgtcgcgtaatgtgtatcaaggttctgggtggctcgcaccgtcgctacgcaggcgtaggcgacatcatcaagatcaccatcaaagaagcaattccgcgtggtaaggtcaaaaaaggtgatgtgctgaaggcggtagtggtgcgcaccaagaagggtgttcgtcgcccggacggttctgtcattcgcttcgatggtaatgcatgcgttattctgaacaataacagcgagcagcctatcggtacgcgtatttttgggccggtaactcgtgaacttcgtaccgagaagttcatgaaaattatctctctggcaccagaagtactctaa

SEQ ID NO: 3748 - DNA, 1008 bp, Klebsiella pneumoniae
aacatgactaagcccatcgtttttagtggcgcacagccctcaggtgaactgaccattggcaactatatgggtgcgctgcgtcagtgggtaaacatgcaggacgattaccactgcatctattgcatcgtggaccagcacgccatcaccgtgcgccaggatccgcagcagctgcgcaaggcgacgctggacaccctggcgctgtatctggcctgcggcatcgacccgcagaaaagcactatcttcgtgcagtcgcacgtgccggaacatgcccagctaggctgggcgctgaactgctacacctatttcggcgaactgagccgcatgactcagtttaaagacaagtcagcgcgctacgcggagaacatcaacgccggtctgtttgattatccggtactgatggccgctgacattctgctgtaccagaccaaccaggttccggtgggcgaagatcagaaacagcaccttgagctaagccgcgatatcgcccagcgttttaacgccatctacggcgatatttttaaagtgcctgagccgtttatccctaaatccggcgcgcgcgtgatgtcgctgctggagccgacgaaaaagatgtccaagtccgacgacaaccgcaacaacgtcatcggcctgctggaagatccgaaatcggtggtcaagaagattaaacgtgcggtcaccgactccgacgagccgccggtagtgcgttacgatctgaaagagaaagcgggcgtctccaacctgctggatatcctctccgcggttaccgggaaaactattcctgagctggaacagcattttgaaggcaaaatgtatggccacctgaaaggcgaagtcgccgaagcggtatcgggcatgctgattgacctgcaggagcgctatcaccgtttccgtaacgacgaagcgtttctcaatcaggtgatgaaagacggcgcggaaaaggccagcgcgcgggcttctcaaaccctgaaagcggtatacgaagcgattggctttgtcgccaagccgtaa

SEQ ID NO: 3749 - DNA, 258 bp, Klebsiella pneumoniae
cgtgagactaaaatgagcgaacttttctccactcctgaccacaccctggatgccctggggctccgctgcccggagccggtcatgatggtgcgtaaaaccgtgcggacgatgccggtgggcgagacgctgctgattattgctgacgatccggccaccacccgcgatatcccgggattctgccgctttatggagcatgagctggtggcccaggaaaccgaagccctgccgtaccgctacctgatccgcaaaagccactga

SEQ ID NO: 3750 - DNA, 1260 bp, Klebsiella pneumoniae
ttcaaagctaacgaattagcccagaactttagctacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtgccagtcacgtcagtagtacggaagtagaactgcggacggtagcctttgaagaacggagtatgacggccgccttcgtctttggacaggatgtacacttcagattcgaacttggtgtgcgggttgatggtgcccggcttagccagtacctgaccacgttcgatttcttcacgtttgataccacgcagcagaacacctacgttctcaccagcacggccttcgtccagcagtttgcggaacatttcaacgccagtacaggtggttttcgcggtttctttgataccaacgatttcaacttcttcacctactttgatgataccgcgctctacacgaccggtaacaacggtaccacgaccggagatggagaatacgtcttcgatcggcagcaggaacggcttgtcaatcgcacgctctggttccgggatataggtatccaggtggccagccagttcgatgattttcgcttcccactctgcgtcgccttccagcgctttcagagcagaaccacgaacgatcggggtgtcgtcgcccgggaaatcgtactgagacagcagttcacgaacttccatctcaaccagttccagcagctcttcgtcatcaaccatatcgcatttgttcaggaacacgatgatgtacggaacgcctacctgacgacccagcaggatgtgctcacgagtctgcggcatcgggccgtcagtcgcagcaacaaccaggatcgcgccgtccatctgcgcagcaccggtgatcatgtttttaacatagtcggcgtggcccgggcagtctacgtgcgcgtagtggcgagtcggggtgtcatattcaacgtgagaggtgttgatggtgataccacgagctttttcttccggcgcgttatcgatctggtcgaatgcgcgagcggaaccaccgtaggttttagccagaacggtagtgatggcagcagtcagggtagttttaccatggtcaacgtggccgatagtaccaacgttgacgtgcggttttgtacgttcaaatttttctttagacacggctatattccttactatagtgctctccccttcggagagagcacgggacttaggttttaa

SEQ ID NO: 3751 - DNA, 1335 bp, Klebsiella pneumoniae
cagatggctaaacaaccgggattagattttcaaagtgccaaaggtggccttggcgaactgaaacgcagacttctgtttgtggtcggtgcgctgatagtgttccgtattggctcttttattccgatccctggtattgatgccgctgtacttgccaaactgcttgagcaacagcgaggcaccatcattgaaatgttcaacatgttctctggtggtgctctcagccgtgcttctatctttgcgctggggattatgccgtacatttcggcatcgatcatcgtgcagctgctgacggtggtttatcaaccgctggcggaactgaagaaagaaggggagtctggtcgtcgtaagatcagccagtacacccgctacggtactctggtgctggcgatattccagtcgatcggtattgctaccggtctgccgaatatgcctggtatgcaaggcctggtgattaatccaggctttgcattctatttcaccgctgttgtcagtctggtcacagggactatgttcctgatgtggctcggcgaacagatcactgaacgtggtatcggtaacggtatctcgatcattatcttcgccggtatcgttgcgggactcccgccggccatcgcccatactatcgagcaagcgcgtcaaggcgacctgcacttcctcctgttgctgttggttgcagtattagtatttgcagtgaccttctttgttgtattcgttgagcgtggtcaacgccgcattgtggtaaactacgcgaaacgtcaacaggggcgtcgtgtctatgctgcacagagcacacatttaccgctgaaagtgaatatggcgggggtaatcccggcaatcttcgcttccagtattatactgttcccggcaaccatcacgtcatggttcgggggtggtactggttggaactggctgacaacaatttcgctgtatttgcagcctgggcaaccgctttatgtgttactctatgcgtctgcaatcatcttcttctgtttcttctacacggcgttggttttcaacccgcgtgaaacagcagataacctgaagaagtccggtgcatttgtaccaggaattcgtccgggagagcaaacggcgaagtatatcgataaagtgatgactcgcctgactctggttggtgcgttgtacattacttttatctgcctgatcccggagttcatgcgtgacgcgatgaaagtgccgttctacttcggtgggacctcgctgcttatcgttgttgtcgtgattatggactttatggctcaagtgcaaactctgatgatgtccagtcagtatgagtctgcattgaagaaggcgaacctgaaaggctacggccgttaa

SEQ ID NO: 3752 - DNA, 765 bp, Klebsiella pneumoniae
gtcatggataaattacaggcgatccgcggcatcgcatttgatctcgacggcacgctggtggacagcgcgccgggtctaacctcggcggttgataacgccctgtacgccctggagctgccggtggcgggagaagaacgcgttatcacctggatcggtaacggcgccgatgtcctgatggagcgggcgctgacctgggctcgtcaggagcgagcaacgttacgtgcggcgatgggtaagccttccgtcgacgatcatgatattccgcaagacgagcagctgcgcattttgcgtaaactgtttgaccgctattacgccgaagcggcggaagagggcagtttcctgttcccggcggtggccgatacgctcggcgcgctgtatgccaaaggcctgccgctggcgctggttaccaataagccgacgccgtttgtcgccccgctgctggacgcgctcgatattgcgaaatattttaccgtggtgattggcggcgatgacgtgcagaataaaaagccgcatccggaaccgctgctgctggtggcggaaaagctctctctggctccagccgagctgctgtttgtcggcgattcgcgcaatgatattcaggcggccaaagcggcaggctgctgctctgttggtctgacctacggttataactatggtgaaccgcttgcgctgagcgagccggactatctcttcgaccagtttaacgaactcttacccgctctcgggttaccacacagtgaaactcaggaattgaaacatgactaa

SEQ ID NO: 3753 - DNA, 1542 bp, Klebsiella pneumoniae
gcccaggataagctaatccctcgccggctgacgccgcgcgagggatttttttcgcacagtggacgtgtctggcaggtgacctcttcttctttgattacccctgtttcctcgcttcccctgtgcatgaacttttcatggagagaaaggatgaaggtgataaaggggttggtcctactgtgcctgatgatgctcgcgggctgccagtctgaggaagagaccagccagttcctgctggcctgtaaatacgatgcgccagcgacgatcgcaaccatgcgggaaaacggcatggatggggatggtcaggataaaacgggcttaagcggcttgatggtcgctgctgcggaaaatcgacgcgatgtggttgaattgctgcttaagcgtcgggcgaagccgaacctccagacgcgccagggcgtcacggcgctgatgctggcggcggcgcgtggcagcgataccgcgattatcggcgatcttctccaggcgggagcgtcggtgaatcagacctccatcgacaagagtacggcattgatgtccgccatctccgacggcggggacgtcagaaacgactatcagcatattctggcgatgaaaaagcccgatgcgcctgtcgaagaggagagtacgctggacaagatagttggcgcaacggcggcgaaatcgctggcgacgggcaatcgcgcgctgatgaccgaagacatggcgttacaactggcgcccggcgcgtttaagaagaacgtcgacgagatagtggcgctgctcctcaagcacggcgcggacgtgaaggccgtcaacgcgtccggggaatcggcctttttcctcgctgtcgatcacgcgcgatcggcggaaaccatcacgaccctggccaacgccggggcggacaccagcctggcggataaatccggcaccacaccgctgatgctggcggcggcgggggatgatcccgatctggtgctggcgctgtcggcctccggggtggaagtggatcagccgaaccgtgaaggactcacggcgctgcaggtggcggcggggcagggggcgcctgcggtgatcgcggcgctggtgcagcgcggcgcaaaggtggaccagctttccgccaacgatctcagcccgctgatgctggcggtcaaaatgaataataaagccaatgtcgaggcgctgcttgcggctggcgccagcgtcaacctcagcaataaggccggctatacggcgattggctacagccgggccggcgaggttcgccagctgctgctggcacagcatgccgagctgaaggggcaggccgcgcatatggcgcaaagcgaactgcagttttgtgctaatgcctttgccgacaagctggcatacagcgacatcgcccgggcggtgaataacgatacccgcccggatattatgcgtcatcagcaatcctgcctggagctgggggagctgacgatgctactgggagagtttacattcaccccggcgggcgcgacctatctcggcgagccggtgacatgtaaggtatccgagtatcgcaaaacgtttgaggtcaactgccgctaa

SEQ ID NO: 3754 - DNA, 1236 bp, Klebsiella pneumoniae
aatatttacaaaacccgacaattggggaacgaggaacgcggtgtggaaaggtttgatgccattgtcgttggcgccggagcggcgggaatgttttgcgcagcgcaggcgggccagcttggctgccgcgtcctgctgctggataacggcaaaaagccggggcgaaaaattctgatgtccggcggcggccgctgcaactttaccaacatgtatgttgaaccggcggcctatttgagccaaaacccgcatttttgcaaatctgccctggcgcgctacacccagtgggactttatcgagctggtcggcaaatatggcatcgcctggcatgagaagaccctcggccagctgttttgcgatgattcggcggagcagatcgtcaatctgctgctcgcggaatgtgaaaagggcggcgtgcagatccgtctgcgcagcgaaatcctcagcgtggagagcgatgaacaaggctaccggctacaggtgaacggcgaaacgctgatgaccaaaaagctggtgatcgcctccggcggtctgtcgatgccggggctcggcgcctcgccgtttggctataaagtcgccgagcagttcggcctgaaggtgctgccgacccgcgcgggactggtgccgtttaccctccacaagccattgcttgagcagctgcaggtcctctccggcgtgtcggtgccgtcgaccattaccgccgagaacggcactctgtttcgcgaaaatctgctgttcacccaccgcggcctttccggaccggcggtgctgcaaatttccagctactggcagcccggcgagttcgtcaccgttaatctgctaccggactgcgatcttgatgacttccttaacgagcagcgcagcgcgcatcccaaccagagcctgaagaacaccctggcgatgcagctgccgaagcggctggtggagtgtctgcagcagctggggcagatacctgatgtgacgctcaagcaactgaacgttcgcgatcagcagacgctggtggagacgttaaccgcctggcgcgtgcagccgaacggcaccgaaggctaccggacggcggaggtgaccctcggcggcgtggacaccaacgaactctcgtcgcgtaccatggaggcgcgtaaggcgccgggtctctactttatcggcgaagtgatggacgttaccggctggctcggggggtataacttccagtgggcgtggtcaagcgcctgggcctgcgcgcaggcgctggtggaagggtaa

SEQ ID NO: 3755 - DNA, 678 bp, Klebsiella pneumoniae
aaaggtcacaatatgaatccgtttactaccgtacagcgcaaaaaagcgctcgtctggctttcgctatttcatttgctggtcatcacctccagcaactatctggttcagctgccgatctccatctttggtttccataccacctggggcgcgtttagttttccgtttattttcctcgccaccgacctgacggtgcgaatttttggcgccccgctggcgcgacgcatcattttcgcggtgatggtcccggcgctggccatctcttacggcatctccgcgctgttctacatgggcgaatggcagggctttgccgcgctgggcacctttaatctcttcgtcgcgcgcatcgccgtcgccagctttatggcctatgcgctggggcagatcctcgacgttcacgtctttaaccgcctgcggcagagccgccgctggtggttggcccctaccgcctcgacgctgttcggcaacatcagcgataccgtggcgtttttctttatcgctttctggcgcagcccggacccgtttatggccgcccactggggggaaatcgccctcgtcgactacagctttaaagtgcttatcagcatcattttcttcctgccgatgtacggcgtgctgttaaatatgctgttgaaaagactggcggataaatctgatttgtcggcattacagccgagttaa

SEQ ID NO: 3756 - DNA, 465 bp, Klebsiella pneumoniae
tgtacgcgcaaaaaacagcgctccgccagacagcaattttgggtacactggcgcctctgttttgcactggatttgccgcccatgaaactgaccattatccgtttacagcacttcagcgatcaggatcgcattgatctggggaaaatctggccgtcacaggatctgtcgacgctgacccttgatgaaaaccatcgtctctacgccgcccgctttaacgagcgcctgctgggcgccgtgcgcgttaccctgcgcggcgtcgaaggtgagcttagcgatctgtgcgtgcgtgaagtgacccgccgccgcggcgtcgggcaatacttagtggaagagacgttgcgtgataacccggcgatcaatagctggcgcgtcgccgaccatggaatggaggaccgcggcgtgatggcggcctttatgcaggcgctcggctttagcgcccagcagaatggttgggaaaagcattaa

SEQ ID NO: 3757 - DNA, 993 bp, Klebsiella pneumoniae
ttgaccagcaaaacagcgcagcgcacactagcgcttatatcgattccattgcaggttctggctatgtctaaaaaaattgccgttattggcgaatgcatgattgagctgtcagagaaaaacggggccgttaaccgcggctttggcggcgataccttaaacacctcggtctatatcgcgcggcagacggatgtcagcgcattgagcgtccactacgtcaccgccctgggaaccgatgcgttcagccagcagatgctcgacagctggcaacaggaaaacgtcaacaccgatcttatccagcggatggccgaccgcctgccggggctgtattacattgaaaccgatgataccggcgagcgtaccttctactactggcgcaacgaggcggcggcaaagttctggctggagagcgatcgcgcggcggcgatttgcgaagagctggccactttcgactatctctatctgagcggcatcagtctcgccattctcagcccggccagccgcgacaagctgttcacgctgctgcgtgagtgccgcgccaacggcggcaaggtgatcttcgacaacaactatcgtccgcgcctgtgggccagccaggcggaaacgcagcaggtctatcaggagatgctcgcctgcaccgatatcgcgtttctgaccctcgatgatgaagacgcgctgtggggagaaaaaccggttgctgaggtgatcgcccgcacccacgccgccggcgtggaagaggtggtggtgaagcgcggcgcggatgcctgcctggtctcggttagcgggcaaccgctgcgggaagtgccggccgtcaggctggccaaagagaaggtggtggataccaccgccgccggagactccttcagcgccggctacctggccgttcgcctgaccggcggcgatgccgaatccgccgccagacgcggacacctgaccgccagcacggtgatccagtatcgcggggcgatcatcccgcgggaagcgatgccgcagtaa

SEQ ID NO: 3758 - DNA, 378 bp, Klebsiella pneumoniae
ggatttttaaacatgtcttccattcaactctgcgccgcccatcaggcgacctctggcttcgacggcgatgcgatcgcccagtacatgcgtaccgattttattacgctgcaggaacatctcagcgttcatgaggcgcgcgaacactttatctcccagctggccagcgatgatattcccgggcaggtgtttgtcgtcgccggcaagaagctgcgtggcagcctgtcggtcaaaaagctactccaggaaacggatatcaaccagtctatccgccacctgatggacagctgcctgtttcgcgtcaaacctgacgatgagcgccagcaggtgattgccgagctcagcgagcgcggcctcgacctggtcccccgtcgtcgataa

SEQ ID NO: 3759 - DNA, 705 bp, Klebsiella pneumoniae
gaccaaataaatttcaaggagatgcggatgaagcagtatttgattgccccttcgattctgtcggctgattttgcccgtctgggtgaggataccgcgaaggcgctggcggcgggtgcggatgtcgtgcacttcgacgttatggacaaccactacgtgccaaacctgacgattggcccgatggtgctgaagtcactgcgtaattacggtattaccgcgccaatcgacgttcacctgatggtgaagccggtcgaccgcatcattcctgattttgccgaagccggcgctagcattatcaccttccatccggaagcctccgaacacgtcgatcgcagcctgcagcttatcaaagagcacggctgtaaagcgggcctggtgtttaacccggcgacgccgctgagctacctcgattacgtgatggataagctggacgtgatcctgctgatgtcggttaacccgggctttggcggccagtcctttattccccagacgctggataaactgcgtgaagtgcgccagcgcatcgatgcgtccggctacgacatccgcctggaagtggatggcggcgtgaaagccagcaatatcggcgaaatcgccgcggcgggtgcggatatgtttgttgccggttcggcgatcttcggtcagccggactacaagcaagtcattgatcaaatgcgtagtgaattagcgaaggtgagtcatggataa

SEQ ID NO: 3760 - DNA, 912 bp, Klebsiella pneumoniae
ttcgccgtaaattgcgctttaccccgcactggcagcgccttgagctgccggacggcgattttgtcgatctggcctggagcgaagacccgcaccaggcgcgccataagccgcgcctcgtcgtttttcacggccttggaaggcactctgcacagcccgtacgcccatggtctgatccacgcggcgatgcagcgcggctggctgggcgtggtgatgcatttccgcggctgcagcggcgaacctaaccgcaatcaccgcatctatcactccggcgaaacggaagatggcacctggtttttgcactggctgaagcgcgagtttggtcccgcgccgaccgcggccgtcggctattcgctgggcggcaatatgctgggctgcctgctggcagaagaaggcgaccgctgcccgctggatgcggcggtgatcgtctccgcgcctttcatgctcgaagcctgcagctatcatatggataagggcttctcgcgggtttatcagcgctatctgctcaatctgttaaaagccaacgcttcacgcaagctgaaagcgtacccgggctcgctgcccgtcgatttacgccagctcaaagggatgcgccgcatccgggaatttgacgatatgatcaccgccaaaatacatggctttgccgatgcgctggattattaccggcaatgcagcgccatgccgcggctcagcgatatcactaagccgacgctcatcattcacgcgaaagacgatccgtttatggatcaccactcgattccgccgcaggagcaactgcccgcgaacgtagagtatcaattgaccgagcaaggcggccacgttggttttgtcagcggcactctgcgtaaaccggagatgtggctggaaagacgcattcccgactggttaaaccgctggctggaggttcccgcatga

SEQ ID NO: 3761 - DNA, 216 bp, Klebsiella pneumoniae
ataaaggtaaatcttatggcagtgcgtaaacgttttattgccggggcgaaatgtccggcgtgccaggcgcaggattcgctggcaatgtggcgtgagaataatgtcgatgttgttgagtgcgttaagtgcggtcatcagatgcgtgaggcagataaagaggcccgtgagcatgtacgcaaagaggagcaggtgattggcatttttcatcccgactag

SEQ ID NO: 3762 - DNA, 885 bp, Klebsiella pneumoniae
atacattcaaattttagattgattatgcacaagacaaccctggagcagtgggcgttactcgaaaaggtagtggaattggggagctttgccagagcggcggaggagaccaaacgcagtcagtcatcggtaagctataacctcgcgctgctgcaggagcgcttaggcgtggcgctgctggcgccgtccggccggcgggcggtgctgacgccggctggcgaactactgctgaatcaggtcaagccgctgctgcaggccttcgcctacgtcgagacgcacgccgccactctgcgcaacggggcgcggacccgcctggatctggtggtcgacagtattttcccgcgccagcggctgttcgcgattttacgccagtttcagcagcgctatccgcagacccaggtcaggctcaccgaagtgctggaaaacttggatgacgagagcgcggcgcggacggaagccgatgtgatggtgttgacccgccgccaggatattaccggccgcggggagtggctgatgaatattgatttcatcgccgtcgcccaccgcgaccaccctctcgccgcgctggacggaccgctggaggatagcgcgctggcgccatggccgctggtgcgcattgccgatcagggcggcgatagccaggcgccgcgagacgcctggaccttctccaccattgatgccgccattgatgcggtgatgtatcaggtcggcttcggctggctgccggaggagcgcattcgcccccatctcgaccagggcgtgctgaagcggttgcccctcagccatggcgcgcgccgcgcgacgccgctgcatctgatcgtcaagcgggacctggcgccgatcgacgaacaggtggccacgctgctggcgttgttccggacgccctga

SEQ ID NO: 3763 - DNA, 183 bp, Klebsiella pneumoniae
accatggcaaagactattaaaattactcaaacccgcagtgcaatcggtcgtctgccgaaacacaaggcaacgctgcttggcctgggtctgcgtcgtattggtcacaccgtagagcgcgaggatactcctgctgttcgtggtatggtcaacgcggtttccttcatggttaaagttgaggagtaa

SEQ ID NO: 3764 - DNA, 393 bp, Klebsiella pneumoniae
ataatggcaaaggcaccaattcgtgcacgtaagcgtgtaagaaaacaagtctctgacggcgtggctcatatccatgcttcttttaacaacaccatcgttaccatcactgatcgtcagggtaacgcactgggttgggcaacagccggtggttccggtttccgtggttctcgcaaatccactccgttcgcagctcaggttgcagcagagcgttgcgcagaagccgtaaaagaatacggcatcaagaatctggaagttatggtcaaaggtccgggtccgggtcgcgaatctaccattcgtgcactgaacgccgctggtttccgcatcactaatattactgatgtgactccgatccctcataacggttgtcgtccgccgaaaaaacgtcgcgtataa

SEQ ID NO: 3765 - DNA, 2322 bp, Klebsiella pneumoniae
aatatgcaaaaattaaccgttggtttaattggtaatcctaattccggcaagaccaccttatttaatcagctgaccggcgctcgccagcgcgtgggcaactgggctggggtgaccgttgagcgtaaagaggggattttcgccaccactgaccaccaggtcacgctggtcgacctcccgggaacctactccctgaccaccatctcctcgcagacctcgctggacgagcagattgcctgccactacatcctgagcggcgacgccgacatgctgattaacgtggtcgatgcctccaacctcgagcgcaacctctatctgacgctgcagctgctcgagctggggatcccctgcgtcgtcgcgctgaacatgctggatatcgccgaaaagcagcaggtgcggatcgatatcgacgccctcgccgcccgtctcggttgcccggtcattccgctggtatcgactcgcggacgggggatcgaagcgctgaagatcgccctcgaccgtcatcaggcgaacagcgatcttgagctggtccactatccgcagccgctgctgcgcgaagctgacctgctggcgcagcagatgtcagcgcagatcccgccccggcagcggcgctggctgggtctgcagatgctggagggcgatatctacagccgggcctatgccggcgacgccgccgataaactggatatcgccctggcgaatctcagcgacgagatcgacgacccggcgctgcacatcgctgacgcgcgctatcagaccatcgccgccatttgcgacgccgtcagcaataccctgaccgccgaaccaagccgcttcaccgccgcgatggacaaagtgatcctcaaccgcttcctcgggttgccgatttttctctttgtcatgtacttgatgttcctgctggcgatcaacatcggcggcgcgctgcagccgattttcgatgccggctcggtcgcgatctttgtgcatggcattcaatggctgggttacaccctgcacttcccggactggctgaccgtgttcctcgcccaggggatcggcggcggtatcaacaccgtgctgccgctggtgccgcagatcggcatgatgtatctgtttctctccttccttgaggactccggctacatggcgcgcgccgcctttgtgatggatcgcctgatgcaagccctcggcctgccggggaaatccttcgtcccgctgattgtcggttttggctgcaacgtgccgtcggtgatgggcgcccgcacccttgacgcgccgcgcgagcgtctgatgaccattatgatggcgccgtttatgtcctgcggcgcgcggctggtgaagatcgccgtcttcgcggccgccttctttgggcagaacggcgcgctggcggtcttctcgctctatgtgctgggcattgtgatggccatcctcaccggcctgatgctgaagcacaccattatgcgcggcgaagcctcgccgttcgtgatggagctgccggtgtaccacgtcccgcatatcaagagcctgattatccagacctggcagcgcctgaaaggctttgtgctgcgcgccgggaaggtgatcgtcatcgtcagcatcttcctcagcgcgctgaacagcttctcactgagcggtaaggtcgtcgacaacatcaacgactccgcgctggcctcggtgagccgggtcattacgccggtgtttaaaccgatcggcgtgcatgaagataactggcaggccaccgtcggcctgtttaccggcgcgatggcgaaagaggtggtagtgggtacgctgaacaccctctataccgccgaagatatccagaatgaggaattcaatccgcagaccttcagtctcggcgaagaactgctcgccgccgtcgatgagacatggcagggactgaaagacaccttcagcctcagcgtcctggccaaccccatcgaagccagcaaaggcgatggcgaaatggccaccggcgccatgggggtgatgggcagtaaatttggcagcgcggcggcggcatacagctacctgatcttcgtcctgctctatattccctgcatctcggtgatgggcgccatcgcccgcgaatcaagccgcggctggatgaccttctccatcctgtgggggctgaatatcgcctattcgctctcgacgctctattaccagaccgttagctttagcgatcacccgcgctacagtctggtgtgtatcctggcggtagtgttgttcaacgtggtgctcttcggcctgttgcgccgggcgcgcagccgggtggacgtctcgctgctggccacgcgaaaaacgccggcctcctgctgttccagcccggctggcgattgccactaa

SEQ ID NO: 3766 - DNA, 231 bp, Klebsiella pneumoniae
ttatttgaaaattcttgggtggtttatcaacagttgataaaccacataaactatacgctttgtgaattatcccgcttcgccaataatggcgcctcatttaacgatctcgttatggcgaggctcctgcataaatacaagttaccgccctgttggtatcgagagagaccactcagggaaatacaggcttccatcgaatcaaggtgttgccaaggtaacttctggcggtcatga

SEQ ID NO: 3767 - DNA, 195 bp, Klebsiella pneumoniae
cgaggagaaaacaatcataaggcgccgtatgttcagactatgttaatttgtcattatgataatgtagtgtggaagcgaatcgcttcaccgggccgccatggtagcccaaaacgaagacgatacacaaagtcattctggctgtgtcaaaacgccggggctgtgcaggccgccagaagacctacgggaggggaatga

SEQ ID NO: 3768 - DNA, 939 bp, Klebsiella pneumoniae
gtcgtggaaaatttagatgtcatcaccatcggcgaagctatggccatgtttgtcgccaccgaaaccggggatctggccgaggtggagcatttcatgaaacgtgtcgccggcgccgagctgaacgtcgccaccggcctggcgcgcctgggcctgaaagtcggctgggtgagccgcgtcggcaacgacagctttggccgcttcgtactgcaatcgctggcgaaagaggggatcgatagccacgctgtggccatcgacaaccgcttcgctaccggtttccagatgaaatcgaaagtcgaaaatggaaccgatcccattgtggagtatttccgcaaaggatccgcagccagccatctttcgccggacgattttcgcgccgactacttcaccagcgcccgccatctgcacctgagcggcgtcgcggcggccctttctgagagctcttacgcgttgctggagcatgcggcgaaggtaatgaaagccgaaggaaaaaccctctctttcgaccccaatctgcgcccggtgctgtggaaaagcgaagccgagatggtggagaaactcaaccgtctcgccttccaggctgactgggttttgccaggcttaaaagagggcgtgattcttaccggccagcagaccccggaagggattgccgatttctatctctcccgcggcgtcaaggcggtagtcattaaaaccggctgcgacggcgcctggttcaagagcgccagcggcgaacagggaacggtcgatgccattaaagtcgataacgtcgtcgataccgtcggtgccggcgacggctttgccgtcggggtgattagcgccctgctggaaggcaaaaccctgcttcaggcggtgaaccgcggcaataaaatcggttcgctggcgattcaggtccagggcgacagcgaggggctgcccactcgcgacgcgctgggcgagtaa

SEQ ID NO: 3769 - DNA, 546 bp, Klebsiella pneumoniae
tcggaggaaaaaatgtctcgtgttgctaaagcaccggtcgttgttcctgccggcgttgatgtaaaaatcaacggtcaggttattacgatcaaaggtaaaaacggcgagctgactcgtactctcaacgatgctgttgaagttaaacatgcagataatgcactgaccttcggtccgcgtgatggttacgcagacggttgggctcaggctggtaccgcgcgtgccctgctgaactcaatggttatcggtgttaccgaaggcttcactaagaagctgcagctggttggtgtaggttatcgtgcagcggtcaaagggaatgtagtaaacctggctttaggtttctctcacccggttgatcatcagctgcctgcgggtatcactgcagaatgtccgactcagactgaaatcgtgctgaaaggcgctgataagcaggtgatcggccaggttgcagcagatctgcgcgcctaccgtcgtcctgagccttacaaaggcaagggtgttcgttacgccgacgaagtcgtgcgtaccaaagaggctaagaagaagtaa

SEQ ID NO: 3770 - DNA, 1287 bp, Klebsiella pneumoniae
ataaaaggaaaaataatgaaaaggcaactctcgctgctggccgtcgcgctgctgctggcgcaaccggttctggctaaagacatcccgctgaacagggcggcggccctcgccaatagcgtgacgccggctgcctccagccaggcgtatgacgatcttgagcaacaggcgctggcgcagctacgccacgctctgcaggggaatgccgccacgctgacccgcgatcggctggcgcacaccaaacaaaaccaaactcaggccgataccgcctggctgaaggccagcggctatgacttccagacccgggccaaccagcaggcgggcattgcgctgctgtcggcgttcagcaccctgccggagaccgtcgtgaagcagaatctggcgacggtgaccgccatcaatcgcgacgccgtgcagaccacgcgccgtcaggcgctggccgatgcggaaggcattagctacctctacttcctcagcgatgcgctggggccacgccttggcaaagcgtttctgaccgcctatgaccagggcgcgctggggaaagcggcagcgttgatcaaagcctcggaggtcagcaccggcgaggcgaaaaagcacttcaataatccgcggccgtttctggtgcagggcaacaccattcacctggtgcctgacgatgtggtggtgaaagataaccagccctacaccgccgacggcggctcgtttcccagcggccacaccaacaccggctataccgatgcgctgctgctggcggcgatgatcccggagcgctacgacgcgctggtggcgcgcggcgcccgctatggctactcgcgcatcgtgctgggcgtccactacccgctggacgtgatcggctcgcggatggtggccgagcgcaacgtggcccactatcttaacgatccgcactaccgggtattatttaacgaagcccgcgatcagctgcgcgccgcgctggcgaaggcctgcggcacatcgcttgccgagtgcgcgaagagcagcgtgaaagacgatccctggcgcgatccggcgatgcgtgatttctctcgcttcaccatgacctacgatctgccgcagcagaagggtccgcagccgcgtttacaggtgccggagggggcggaagtgctgctggaagatgccctgccgcatctgtcagcggctcagcgtcgaacgttgatggtcaacaccgcgctgccggcgggttacccgctatccggcgccacccccgaacagcaattctggcagcggctgaatctgtcggcggcctgggagatggcgcaaaaaaggcagtaa

SEQ ID NO: 3771 - DNA, 1377 bp, Klebsiella pneumoniae
ttatttctgaaatgtttccagggtgttatttttaagccacagacgtcaaatatcccttcttgctctgtggttattcccaaaggacaccctatgaaaacctctatctttaaaagcctctatgtccaggtgctgacggccatagcgatcggtattctgctgggccatttttacccggaactgggcgcgcaaatgaaacccttcggcgacgccttcgttaagctgattaaaatggtgattgctccggttatcttctgtaccgtcgtgacggggatcgccgggatggaaagcatgaaagccgttggccgtaccggggcggtggcgttgctctatttcgaagtggtcagcaccatcgcgctgattatcggtctgattatcgtcaacgtggtgcagccgggcgccgggatgaacgtcgacccgtcgacgctcgatgcgaaagcggtggcggtgtacgctgagcaggctaaagatcaaggggtagtggcctttttactggatgtgatcccgggcagcgtcattggcgccttcgccagcggcaacattctgcaggttctgctgttcgccgtcctgtttggttttgccctgcaccgtctgggcagcaagggccagctgattttcaacgtcattgaaagcttctcccaggttatcttcggcattatcaatatgatcatgcgcctggcgccgatcggcgccttcggagccatggcctttaccatcggtaaatatggcgtcggcaccctggtgcagctggggcagctgattatttgcttctatatcacttgtatcctgttcgtggtggtggtgctggggagcatcgcccgggccaccggcttcagcatcttcaaatttatccgctatatccgggaagagctgctgattgtgctggggacctcctcatcagaatcggcgctgccgagaatgctcgacaagatggagaagctgggctgccgtaaatcggtggtaggcctggtgatcccgaccggctattcgttcaacctcgatggcacctctatctatctgacgatggccgcagtctttatcgcccaggcgaccaacagccatatggatattttccatcagatcaccctgctggtggtgctgttgctctcctcgaaaggggcggcaggggtgaccggcagcggcttcatcgtgctggcggcgaccatctcggccgtcggtcatttaccggtggctggcctggcgctgatcctcggtatcgaccgctttatgtccgaagcccgcgcgctgactaacctggtgggtaacggcgttgccacggtggtggtggcgaaatgggtgaaagaactggatgccaaacagatggatgacgttctgaataaccgtgttccggcgaacaaaacgcacgaattatcctcttaa

SEQ ID NO: 3772 - DNA, 1929 bp, Klebsiella pneumoniae
catagtctgaacatacggcgccttatgattgttttctcctcgttacaaattcgtcgcggcgtacgcgtcctgctggacaacgccaccgctaccatcaatcctggccaaaaggtcggtctggtggggaaaaacggctgcgggaaatcgacgctgctatcgcttttgaaaaacgagataagcgctgacggcggcagtatgacctttcccggcaactggcagctggcttgggtgaatcaggaaaccccggcgctaccgcagccggcaatcgattatgtcattgacggcgatcgagagtatcgccagctggaggccgcgctccagcaggctaacgaacgcaatgacggtcatgctatcgccaccgtccacggtaagctggacgccatcgacgcctggactatccgttcgcgcgccgccagcctgctgcacggtctggggttcagcaatgaacagcttgagcggccggtcagcgatttttccggcggctggcgtatgcgccttaacctcgcccaggcgctgatctgccgctccgatctgctgctgctcgatgaaccgactaaccacctcgatctcgatgcggtgatctggctggagaagtggctgaagggctatacgggaacgctgatcctcatctcccacgatcgcgattttctcgatcctatcgtcgacaaaattatccatatcgaacagcagacaatgtttgagtacaccggcaactacagttcgtttgaagtgcagcgcgccacccgcctcgctcagcagcaggcgatgtacgaaagccagcagcagcgcgtcgcgcacctgcaaagctatatcgatcgcttccgtgccaaagccaccaaggccaagcaggcgcaaagccggatcaaaatgctggagcggatggagcttatcgctccggcgcacgtggataacccgttccacttcagcttccgccagccggagagcttgcctaacccgctgctgaagatggagaaagtcagcgccggctacggcgagcgtattattctcgactccatcaagcttaacctggtgccgggctcgcgtatcggcctgctgggccgcaacggcgccgggaagtcgacgctgattaagctcctggcaggcgagctccagcccgtaagcggcgagatcggcctcgcgaaaggcatcaagctcggctacttcgcccagcatcagctggaattcctgcgcgccgatgagtcgccgctgcagcacctggcgcgtctggcgccgcaggagctggagcagaagctgcgtgattatctcggcggctttggtttccagggcgataaggtgagcgaagaaacccgccgcttctccggtggagaaaaggcgcgcctggtactggccctgatcgtctggcagcgccctaacctgctgctgctcgatgaaccgaccaaccaccttgacctcgatatgcgtcaggccttaaccgaagcgctgatcgactttgaaggggcgctggtggtcgtatcgcacgatcggcacctgatccgttccaccactgacgatctatacctcgtccacgatggtaaagtcgagccgttcgacggcgatctggaagattatcagcagtggctcagcgactcgcaaaaacaggagtcccagagcggcgaggcgccaaaagagagcggcaatagcgcccaggcgcgcaaagaccagaagcgtcgggaagcggagctgcgcagccagacccaaccgctgcgcaaagagatcgcccgtctggaaaaagagatggacaagctcaacgcgcagttggccagtgcggaagaaaaacttggcgacagtgagctttatgacgcctcacgtaaagccgagctgaccgaatgcctgcagcaacaggccagcgcgaagtccgggctggaggagtgcgagatggcctggctggaggcccaggagcagctggagcgcatgcttcaggaaggctaa

SEQ ID NO: 3773 - DNA, 909 bp, Klebsiella pneumoniae
aaatccatgaaacaggtcggcttacgcatagatgtcgatacctttcgcggcacgcgggacggcgttccgcggctgctggagctgctgggccggcatgggatccaggcaagcttcttcttcagcgtcgggccggacaatatggggcgccatctgtggcgcctgataaaaccgaagtttctgtggaagatgctgcgttccagagccgcctcgctgtacggctgggatattctgctggccggcaccgcctggccggggcgccgcatcggcgcagggaacgaagcggtgatccgcgccgccgccgaatctcatgaagtcggcctgcacgcctgggaccactacagctggcaggcgtggagcggcgtctggccgcaggaaaggctggcgctggaggttgagcgcggcctgctggagctcgagcgcatcatcggccggccggtgacctgctcggccgtcgccggctggcgcgccgatcagcgggtggttaaagccaaagaatccttcgattttctctacaacagcgactgtcgcggcacgcggccgttcctgccccagctcggtagcggcacgttcggtacggtgcagatcccggtcacgctgccgacctgggatgaggcggtgggcacggcggtggatatcgccggctttaaccgctacctgctcgactgcatccatcgcgacccgggcgtgccggtctataccattcacgccgaagtggaaggtattgcttacgccgatcagttcaatgaactgctgaccatggcggcggaagaggaaattcagttttgcccactgagccagctgctgcccgctgactttagcgagctgccgtctggcaaagtggttcggggtgaactggctggccgggaaggctggctcggacgtgaacaattactgacttcgggtgtttga

SEQ ID NO: 3774 - DNA, 1113 bp, Klebsiella pneumoniae
accatgatgaaagtactttgtggcgcggtgctctcggcgctgctgctggcggcgggccaggtgggcgccgcctgccagtggcccgcctgggagcagtttaaacaagcgtacgtcagccccgagggacgggtgattgaccccagcgatgcgcgcaaaatctccacctccgaagggcagagctatggcctgtttttcgccctggcggccaacgatcgcgcggggttcgacaaactgctgacctggacgcagaacaacctggcggaaggcgatctgaaacaacatttgccgggctggctgtggggcaaaaaggacgatgagcagtggaccctgctggacagcaactcggcgtccgactcggatctgtggatagcctgggcgctgctggaggcggggcgcctgtggcaacagccgcagtacaccgagaccggtaaagccctgctggcgcggattgtcgctgaagagacggtggcggtgccgggcctcggcacgatgctgctgccgggaaaagtcggttttgccgatgacagcggctggcggtttaaccccagctatcttccgccgcagctggccacctactttgtgcgttttggcgcgccgtggcccgctctgcgcgacagtaacctgcgcctgctgctggagaccgcgccgaaaggctttaccccggactgggtgcgctatgagaaagggaaaggctggcagctgaaaaccgaaaagccgccgatcggcagctatgacgcgattcgcgtctacctgtgggtgggcatgctccatgatggcgataagcagaaagcgcgtctgctgcaacgcttcgcgccgatggcggcgcagaccacggagcaggggatacccccggagaaagtgaatatcgccaccggcaaaaccagcggccaggggccagtgggcttctccgcggcaatgctgccgtttttacaggacgacgaggcccggtcggtgcaacgccagcgcgtcgccgataactatcccggcgcggatgcctactacagcgcagttctgacgctgttcggccagggttgggatcaacaccgttttcgtttcacggcgaatggtgaattacaacctgactggaaccaggaatgcgcaagctcacactaa

SEQ ID NO: 3775 - DNA, 669 bp, Klebsiella pneumoniae
agtagagtgaatgaactgtcttttatggctgaggaatcgctgacgatgctaacaattctgggtaaacgctcttcaatcaatgtacggaaagtgttgtggacctgcgaggaagccgggctggcgtaccagcaggaagattacggcagcggatttaagcccctggatacgcctgagtttcagcgtctgaatcctaacagcctggtgccggtgctactggacgatgacttcgtgctctgggagtcgaacagtatctgccgctatctggcgcgcaaagcggagcgctgggatctgctgcccgccgagccgcagcccgccgccgaggtggagcactggatggactggcaggcgaccgagtttaacactgcctggcgccatgcttttatggggctggtgcgtaaagatccgcgctttcaggatccggtggcgattaaagagagtattgccgcctggacccactgcgtgcgcattgttgaagcgcagctgcagcgtaccggggcgtggatagccggcgagcgcttcaccctggccgatatcgtgctggggctgtcggtgcatcgctggaaaatgacccctttcgcccatccggagatgccagccgtggagcgctggtatatggcgctcaatcagcgcccggcgtttatgcgccatggcaataacggcgtggcctga

SEQ ID NO: 3776 - DNA, 651 bp, Klebsiella pneumoniae
cccaaaacgaagacgatacacaaagtcattctggctgtgtcaaaacgccggggctgtgcaggccgccagaagacctacgggaggggaatgatgtctcagacagcgaaagtgttgctgctgtatgcccacccagaatctcaggattccgtggccaaccgggttttattagagccggccttacagttgccgaacgtcaccgtgcacgatctctacgcgcactatccggatttttttatcgatattgcttacgaacaggacctgctgcgccggcatgaggtgattgttttccagcaccctttatatacctggagctgtccggcgctgcttaaggagtggctggatcgtgtgttaagccgcggcttcgccagcggcgccggagggaacgaactggcgggaaagtactggcgcagcgtgatcactaccggcgagcctgagagcgcctaccgtcgcgatgctaatcgctatccgatgaacgatattttacgtccttttgaactgaccgccggcatgtgccgtatgcactggatgagccccattatcgtctactgggcccggaggcagcagccagaggagctgcgcagccgcgccctggcctaccgggactggttggccaaccccatcgccgccggaggtgtccatggcgggatctga

SEQ ID NO: 3777 - DNA, 750 bp, Klebsiella pneumoniae
tcgccggcgaaatgggtccacactgactccatcgacaacatacgggggtgcaacatgatctatttacgcaaagcgaacgaacgtggccacgctaaccatggctggctggattcctggcatactttctctttcgccaactattatgacccgaactttatgggcttctccgccctgcgggtgattaacgacgacgtcatcgacgccggtcagggcttcggtacccacccgcacaaagacatggagatcctgacctatgtgctggaaggggcggtggagcaccaggacagcatgggcaacaaagagcaggtgccggcgggcgagttccagatcatgagcgcgggtaccggggtgcgccactctgagtacaacccgagcaaaaccgatcgtctgcgtctgtatcagatctggattattccggaagaaaccggcattaccccgcgctacgagcagcgccgcttcgacgccgcccagggcaaacagctggtgctgtcgccggatgcgcgagatggctcgctgaaggtgtaccaggatatggaactctatcgctgggcgctgctgaaagatgagcagtcggttcaccagattgccgcggaacgccgcgtgtggatccaggtggtcaaaggcgaagtgaccatcaacggtaccaaagccaccaccagcgacggtttggccatctgggacgagcaggcgatttcggttcatgccgacagcgatagcgagatcctgctgttcgatctgccgccggtttga

SEQ ID NO: 3778 - DNA, 354 bp, Klebsiella pneumoniae
aggagagccctgacgccgggggcgtcagggcgaaggatcacaacgactggtggcgggtctcgtgggtcagcagcagggcgatcagcgtcagcgccgccatcgccgccagataggtgccgaccgccgcgagaccgtagttaccctgcagccaggcggcaatgtacggcgcgaccgaagcgccgaggatcgacgacacgttataggagaacgacgcgccggtgtagcgcacctccgtcgggaacagctccgggagcagcgcgcccatcgggccaaaggtcagtcccatcaggcttaagcccagcagcaggaaggcgaagaccagcagcggattgccggagcccagcagcggtttaa

SEQ ID NO: 3779 - DNA, 1521 bp, Klebsiella pneumoniae
gagggtaagaacgtggaaaccaaagatatgattgtgataggcggatgcatcaacggtgccggtatcgcggcagatgccgccgggcgtggtttatccgtactgatgctggaagcgcgcgatctcgcctgcgccacctccagcgccagttccaaactgatccacggcgggctacgctacctcgaacactatgagttccgtctggtcagcgaagcgctggccgagcgtgaagtgctgttaaaaatggccccgcatatcgccttcccgatgcgctttcgcctaccgcatcgcccgcatctgcgcccggcatggatgatccgtatcggcttgtttatgtacgatcatctgggcaaacgcaccagcctcccgggatccaccgggttgcgttttggcgcagaatcggtacttaaaccggaaattgtgcgcggtttcgaatattccgactgctgggtcgacgatgcccgcctggtgctggccaacgcgcagatggtcgtccgcaaaggcggcgaagtgcgtacccgcacccgcgctatctcggcgaaacgtgagaatggcctgtgggtggtggaagcggaagatattgatagcggtgagaagtttacctggaaggcgcgcggcctggtcaatgccaccggcccatgggtcaaacagttcttcgacgaagggatgcatctgcgctcgccttacggcatccgtctgatcaagggcagccacatcgtggtgccgcgggtgcatacccagaaacaggcttatattctgcagaacgaagataaacgcatagtgtttgttattccgtggatggatgagttctctatcatcggcacgacggacgtcgagtataagggcgatccgaaagcggtggccattgatgataaagagatcaactatctgctgaacgtctataacgcgcactttaaaaagaccctcagccgggacgatatcgtctggacctactccggcgtccgtccgctgtgcgacgacgagtcggattcgccgcaggccattacccgcgactataccctggatattcacgatgagaacggtcaggcgccgctgctgtccgtcttcggcggcaagctgaccacctatcgcaaactggccgagcatgcactggaaaaactgaccccctattacaaagggatcggcccggcatggaccaaaaccgcggtgctccccggcggcgatatcggcggcgaccgcgacgactacgcggcaaaactgcgccgtcgcttcccattcatcagtgaatcactggcccgccattatgcccgcacctacgggagcaacagcgagtggatcctgaaggaagccagcgccctgagcgatctcggggaagatttcggccacgagttttatgaagccgagctgaaatatctggtggagcacgagtgggtgcgcagcctggatgacgccatctggcgtcgtaccaaacagggcatgtggctgactgccgagcagcaggcgcgcatcagcgaatggctggcgcagcatgcgggaaagtctgagctgtcgttagcgtcgtaa

SEQ ID NO: 3780 - DNA, 1050 bp, Klebsiella pneumoniae
aaaaggaagaaattacgtatgacgccggaaaacgacgatcgacgcccgccacaggaaccggatacgcagccggagaaaagcaaaagcacgctcgaggcccttaatgacaccgccgtcgggcaaaaagccagccaggcgctgaagaccgtcaccggaacggcggccaaagtgcagcgcaacccggtgatcgcccatctgttgcgcgccgcagagcgcttcaatgaccggctcggcaatcagtttggggcggctatcacctatttctcgttcctgtcgatgatcccgatcctgatggtctcctttgccgccgccggcttcgtgctggcctggcacccaaccctgctgcaggacattttcgacaaaattctgcaaaacgtcagcgacccaacgctggctgcaacgttgaaaaacaccatcaacaccgcggtgcaacagcgcaccgccgtcggtctggtcggcctgctggtcgccctctattccggtattaactggatgggcaacctgcgcgaagcgatccgcgctcaatcgcgcgacgtctgggagcgccggccgcaggacgaggagaaaatctgggtcaagtacttccgcgatcttatctcgctgatcggtctgctggtggcgctgattattacgctgtccatcacctccgtcgccggctccgcccagcagatgattatctccgcgctgtatctcgacaacattgaatggctgaaacccgcctggcggctaatcggcctcgccatctcgatttttgccaactatctgctctttttctggattttctggcgcctgccgcgccatcgtccgcggcgcaaggccctgtttcgcggcacgcttatcgcggcgattggctttgaaatcataaaaatcgtcatgacctggacactgccggcgctggtgaaatccccctccggggcggcgttcggatcggtgctggggctgatggcctttttctatttcttcgcccgcctgacgctattctgcgccgcgtggatcgccaccgcggagtataaagacgaccggcggatgccgggcaaaacccaccgctga

SEQ ID NO: 3781 - DNA, 441 bp, Klebsiella pneumoniae
tctgacaggaatattgcgatactggagttaaattttatgcaagcgcgtgtgaaatgggtagaagggttaacctttatcggggagtccgcatcgggacaccagattctgatggatggcaactccggggataaggctcccagcccgatggagatggtgctgatggcggcgggcggttgcagtgcgatcgatgtggtctccattctgcaaaaaggtcgtcacgacgtgaccaattgcgaagtgaagctgacctccgagcgtcgcgaagaggctccgcgtctgttcacgcatattaatctgcattttatcgtcaccggcaaggcgctgaaagatgccgcggtctcccgggcggtggacctgtcggcagagaaatactgctcggtggcgctgatgctggaaaaagcggtgaacatcactcactcctatgaagtgatcgaggcgtag

SEQ ID NO: 3782 - DNA, 1362 bp, Klebsiella pneumoniae
ggacgtcgtttccttcgcgctgctgattctggtgctgttagtgatgccgaccggcattctgggccgcccggaggtggaaaaagtatgaaaccgatgcaaattgcaatggcgctgctctctgccgtgatgttcttcattctggcgggcgtctttatgggcgtgcagctggagctgaacggcaccaaactggtggtcgataccgccgccgatattcgctggcagtggatcttcatcggtaccgcggtggtctttttcttccagctgctgcggccgctgttccagaaagcggttaagaacgtctccgggccgaagtttattatgccggcgattgacgggtcgacggtgaagcagaagctgttcctgatagccctgctggtgattgccgtggcctggccgtttatggtgtcgcgcggcacggtggatatcgccaccctgacgatgatctatatcatcctcggcctcgggttgaacgtggtggtcggcctttccggcctgctggtgctgggctacggcgggttctatgccatcggcgcgtatacctttgcgctgctgaaccactattacggtctcggcttctggacctgtctcccgctggccggcctggtctccgcggcggccggtttcctgctgggcttcccggtattgcgtttgcgcggcgactacctggcgattgtgaccttaggcttcggcgagatcgtgcgcattctgctgctcaacaataccgagatcaccggcgggccgaacggcatcagccagatcccgaaaccgaccttctttggcctcgaatttagccgcagcgcccgcgaaggcggctgggataccttcagcaacttcttcggcgtcaaatacgatccctccgaccgggtgattttcctctacctggtggcgttgctgctggtagtgctcagcctgttcgtcatcaaccgcctgctgcgaatgccgctgggccgggcgtgggaagcgctgcgtgaagatgagatcgcctgtcgttcgctgggcctgagcccgacgcgcatcaagctgaccgcctttaccatcagcgccgcgtttgctggcttcgccggcacgctgttcgccgcgcgccagggcttcgtcagcccggaatcctttaccttcgccgagtcagcctttgtgctggcgatcgtcgtgctgggcgggatgggctcgcagttcgcggtgatcctcgcggctattctgctggtggtctcgcgcgagttgatgcgtgacttcaacgaatacagcatgttaatgctcggcggcctgatggtgctgatgatgatctggcgtccgcaggggcttctgccaatgacgcgcgtgcagttgaagctgaaaaacggtcaggcgaaaggagagcaggcatga

SEQ ID NO: 3783 - DNA, 591 bp, Klebsiella pneumoniae
cccggttttgattgttccggagccgctatgatcctgcttatcgataactatgactctttcacctggaatctgtatcagtacttctgcgaactgggggcggaagtgctggtcaggcgcaacgatgcgttgacgctggaggagatagcggcgctggcgccggagaaaatcgtgatctcgccaggcccctgcacgccggatgaggcggggatttccctcgcggttatccgccactatgcggggaaaacgccgctgctgggcgtctgtctcgggcatcaggcgatcgcccaggcgtttggcgcgactatcgtgcgggcggcccaggtgatgcatggtaaaacctcgcttatcgagcataacggcgaaggggtgtttcaggggctgaataatcccctgacggtgacccgctatcactcgctggtgattgacccgccgacgctcccgtccgagtttaacgtcactgcccgcagcgccagcggtgagattatggggatccgtcaccgcgaatgggatctcgagggcgtgcagtttcatccggaaagcatcctcagcgagcagggccatcaattgctggccaactttttgaaacggtga

SEQ ID NO: 3784 - DNA, 411 bp, Klebsiella pneumoniae
ggttttactgagaaggataaggtcatgcgccatcgtaagagtggtcgtcaactgaaccgcaacagcagccatcgccaggctatgttccgtaacatggcaggttcgctggttcgtcatgaaatcatcaagacgaccctgccgaaagcgaaagaactgcgtcgcgtagttgagccgctgattactcttgccaagactgatagcgttgctaatcgtcgtctggcattcgcccgcactcgtgataacgagatcgtggcaaaactgtttaacgagctgggcccgcgtttcgcgagccgcgccggtggttacactcgcattctgaagtgtggcttccgtgcaggcgacaacgcgccgatggcatacatcgagctggttgatcgtgctgagccgaaagcagaagctgctgcagagtaa

SEQ ID NO: 3785 - DNA, 285 bp, Klebsiella pneumoniae
gactttactgactcagaaggcgggtgcgtaatgaccgataaaatccgtactctgcaaggtcgcgtagttagcgacaaaatggagaaatccattgttgttgctatcgaacgtatggtgaaacacccggtttacggtaaattcatcaagcgtacgaccaaactgcacgtacatgacgagaacaacgaatgcggtatcggcgacaaggttgaaatccgcgaatgccgtccgctgtccaagactaagtcctggacgctggttcgcgttgtagagaaagcggttctgtaa

SEQ ID NO: 3786 - DNA, 1680 bp, Klebsiella pneumoniae
acaattactgacttcgggtgtttgatgaaaagcattcgctatggcgtctctctgattgcgctgtttgcgctgtattatctgctgccgctcaatttccgtttgctttggcaacccgacgaaacccgctacgcggagatcagccgtgaaatgctggccaccggcgactgggtggtaccgcattttctcggcctgcgctacttcgaaaaaccgattgccggttactggatcaacagtatcggtcagtggctgtttggccataataacttcggcgtacgcttcgggtcggtcttcgccatcaccatgaccgccctgctggtggcctggctggcgtggcggatctttcgtgataagcgggtagctatcctgtcgccggttatcttcctcaccgcgatgctggtgtatgcgattggcacctatgcggtgctggacccgatgatcaccctgtggctggcgctggcgatgtgcagcttctggggcgcggcgcaggcgcagagccgcagcggcaaaatactgggctacgtgctgctgggcgtcgcctgcgggatgggggtgatgaccaagggcttcctggcgctggcggtgccggtggtgggcgttctgccgtgggtgatcgcccgtaaacgctggcgtgaagtgctgacctacggctggctggcggtgatcgtctgtacgctggtggtgctgccctgggggctggctatcgctcagcgcgagccggacttctggcgctacttcttctgggtcgagcatattcagcgttttgctgaaaaagacgcccagcacaaagcgccgttctggtactacatcccgttcctgatcgccggcagtctgccgtggctggccctgctgccgggggcgctaaagcgcggctggcttgagcgcgatgaggcccgcggcgcgctgtatctgttaggttgggtggcgatgccgttcctgttcttcagtatcgccaaaggcaaactgccgacctatattctgccgtgctttgcgccgctgtcgatcctgatggcccgctacgcgctggaggccgcaaagaccggcgcgaaagcgttgcgcatcaacgggatgatcaacctgggcgttggtttgctggggcttatcgccgtgctggtggtctcgccgtggggcttcatgcataagccggtgtggaccaagattgagctgtataaatgtctgctggcggcgatcgcttttgccgtctgggcgctgatgggctggctggcgatgaaagactctggccgccgctggagcctcgccgcgctctgtccgctcggcctggcgctgctggtgggcttcgccatcccggaccgggttatcgacagcaaacagccgcagttcctcgtggatatcgtcagcgaatccctgcagcccagccgttacgtcctgaccaacaacgttgggatcgccggcggcctggcctgggagctgaagcgaagcgatattattatgttcgacaaacagggtgagctgaagtacggtctcgactggccggatgctcaggaaagctttgtcagccaggccggttttgccgactggctggccgcgcatcgtcagcaggggccggtctcactggtgctgttgatggataaaggagagagtatgctcgacttaccgttaccgaaaccggataacgcctacgagctgggccgggtcgttttccttcagtacctgccgcaatga

SEQ ID NO: 3787 - DNA, 975 bp, Klebsiella pneumoniae
cgtttttatgacagcgttatgttttgcaacgcttttagcagaaatgaaacagcgcggcggcgcagcggtaatctcggccgatctgcggtaaactatcggttaacttgtttacttcccggaatctctgcatccatgctcagttatcgccacagctttcacgcaggcaaccacgccgacgtcctcaaacacaccgttcagagcctgatcattgaatcactgaaagagaaagaaaaaccgtttctctacctggacactcacgccggcgcgggccgctatcagctgagcggcgagcacgccgaacgtaccggcgagtatcttgaaggcatcgcccgcatctggcagcaggacgacctgccggcagagctggagccgtatatttcggtcgtagaacacttcaaccgtaacggccagctgcgctactacccgggctcgccgctgattgcccgccagctgctgcgcgagcaggacagcctgcagatgaccgagctgcacccgagcgacttcccgctgctgcgcgctgaattccagaaagacagccgcgcgcgcgtcgataaagccgatggctaccagcagctgaaagccaagctgccgccggtatcgcgccgcggtttgattctgatcgacccgccgtacgaaattaaaaccgactatcaggcggtggtcaccgggattaacgaaggctacaaacgcttcgccaccggcacctacgccctgtggtacccggtggtgctgcgcgcgcaaatcaaacgcatgatcaaagagttagaagccaccggcatccgcaaaatcctgcagattgagctggcggtgcgtccggacagcgaccagcgcggcatgaccgcctccgggatgatcgtcatcaacccgccgtggaagctggagcagcagatgaataacgtgctgccgtggctgcacagcaaactggttccgaccggcaccggccacgccaccgtcagctgggtcgtaccggagtaa

SEQ ID NO: 3788 - DNA, 204 bp, Klebsiella pneumoniae
cttttaggtgaacccagtgcattgacggagtgcggggggcgctataaggtaggaaatatcttctacaatgaagtccttaaaggctaccctcccgcgaatgtagcacgcaggacgcgggcgaaacggcagcgccagctgtcaggtccaatggtcatcgacaaacttatggaaggagtaacactatggcttacaaacatattctga

SEQ ID NO: 3789 - DNA, 282 bp, Klebsiella pneumoniae
tcggccaccgagaagatcacgccgcctttggcggtgccgtccagcttggtcagggtgatcccggtcaaacctaccgcctcatggaacagtttggcctggctaatagcattctgcccggtgctggcgtcaatggttaacatcacctcgtgcggcgcgtcgacgtccagctttttcattacccggacaatcttcttcagctcttccatcaggtgcgatttattttgcaaacgcccggcggtatcggcaatcagtacgtcaacatggcgcgccttcgccgcctga

SEQ ID NO: 3790 - DNA, 606 bp, Klebsiella pneumoniae
caattaaccgatacgccgccttcgcgctggattagtcagccccggcgcggcgtaccagtccagtgggaggacgctttgagcacgactaaccatgatcaccacgtctatgtcctgatgggcgtttccggcagcggaaaatccgctgtcgccagcgaagtggcgcatcaactgcatgccgcgtttcttgacggcgactttctccatccgcgcagcaatatcaccaagatggcctccggcgagccgctcaacgatgacgaccgcacgccgtggctgcaggcgctaaatgacgccgcgttcgccatgcagcgtaccaacaaggtgtcgctgatcgtctgctcggcgctgaagaagagctatcgcgacattctgcgcaagggcaacccgaacctctccttcatctacctgaaaggcgatttcgacgtgatcgaaagccgtctgaaggcgcgtaaagggcacttctttaaaacccaaatgttggtgacgcagtttgaaacgctgcaggaaccaggcgccgacgagagcgatgtgcttatcgtcgatatcgaccagccgctggaaggcgtggtggccagcaccatcgaggtgatcaacaaaggcagtcactag

SEQ ID NO: 3791 - DNA, 390 bp, Klebsiella pneumoniae
gtaatgcgttttgccctcacggtgaccggcccagcctatggcacgcagcaggcgagcagcgcctggcaatttgcccaggccgtgctgcaggaaggccatgagctggcgtgcgtttttttctatcgcgaaggcgtgcttaacgctaaccagttgacggcgcccgccagcgatgagttcgatctggtgcgcgggtggcaatccctccacgatgagcacggcgtcgcgctgcatatctgcgtggcggccgccctgcgtcgtggcgtaacggacgaacgcgaagcgcaacagctcgctctgcctggccacaatttgcagccgggttttaccttgagcgggctcggcgcgctagcggaagcggcgcttacttgcgatcggatggtgcagttctga

SEQ ID NO: 3792 - DNA, 438 bp, Klebsiella pneumoniae
gagatgcgtttaaatactctgtctccggccgaaggctccaaaaaggcgggtaaacgcctgggtcgtggtatcggttctggcctcggtaaaaccggtggtcgtggtcacaaaggtcagaaatctcgttctggcggtggcgtacgtcgcggtttcgagggtggtcagatgcctctgtaccgtcgtctgccgaaattcggcttcacttctcgtaaagcgatgatcaccgcagagatccgtctctccgatctggctcacgtagaaggcgatgtagtagacctgaacgcgctgaaagcggctaacattatcggtgtccagatcgagttcgcgaaagtgatcctgtctggtgaggtaactcgtccggtaactgttcgtggcctgcgtgtgactaaaggtgctcgtgctgctatcgaagctgctggcggtaaaattgaggaataa

SEQ ID NO: 3793 - DNA, 777 bp, Klebsiella pneumoniae
cggatgaacgacatctggtggcaaacaatcggcgaaggagattgtcatcttgtgctgctgcacggctgggggctgaacgctcaggtatgggattgcatcacgccgcagctggcttcgcattttaccctccacctggtggatctgccgggctatggccgcagcggcgggtttggggcgatgtcgctggaggcgatggcgcagcgggtgctggagcaggcccctccacaggcggtgtggctgggctggagcctgggcgggctggtggccagccaggtcgcgattatgcgtccggaacgcgtgcaggcgctggtgacggttgcctcttccccctgtttcgcggctcgtgacgactggcccggcatcaagcccgaggtgctggccggatttcagcagcagctgagcgacgatttccagcgcaccgtcgagcgattcctcgccctgcaaaccatgggcacagagagcgcgcgtcaggatgcgcgggcgttaaagcaggcggtgctctcgctgccgatgccttccgccgaggcgctgaacggcggtctggagatcctcagaaccgtcgatctgcgccaggcgctggtcgggctgccgatgccgtttctgcggctgtacggtcgactggacgggttggtgccgcgcaagattgtcccgctgctggataagctatggccggaaagcgagtcaatcctcttcgataaggccgcgcatgcgccgtttgtttcccatcccgcggccttctgcgagccgctgctggcgctgaagacgcggctggggtaa

SEQ ID NO: 3794 - DNA, 447 bp, Klebsiella pneumoniae
agcgcccgcctggtgactatgactccgaagggattaccaacggtagtgagcgaacgccttgttggcttcggccatacggtgaacgtcttcacgtttcttaactgcagtacctttgttgtctgcagcatcagtgagttcgttcgccaggcgcagagccatggatttatcaccgcgtttacgagcagcttcaacgatccaacgcattgccagggcattacgacggaccggacgaacttcaactggaacctgataagtagaaccacctacgcggcgggacttaacttcgacagtcgggcgcacgttttcgagcgcaacttcgaaggcttccagttcagatttaccagaacgctgagccagggtctccagcgcgctgtatacgatagtttctgcagtagattttttaccatctaccatcaggatattgacaaatttagccagcagttctga

SEQ ID NO: 3795 - DNA, 903 bp, Klebsiella pneumoniae
ctcgcgccagaaagagagatgattatgactcaacacgatcaattacatcgttatctgtttgaaaactatgccgtgcgcggcgagctggtgacggtgtcggaaaccctggaacagattctggcgaatcacacctatccccaaccggtcaaaacggtgctggcggagctgttggtcgccaccagtctgctgaccgcgacgctgaagtttgccggcgacattaccgtacagctgcagggggatggccctttacagctggcggtgatcaacggcaataaccagcagcagctgcgcggcgtcgcgcgcgtgcagggcgagattgcggacgatgcggatctgaaaacgatggtcggcaacggctacctggtcattaccatctctccggaagaaggtgagcgctatcagggcgtggtcggtctggaaggcgatacgctggccgcctgcctggaagattatttccagcgttcagagcagctgccgacgcgccttatcatccgcaccggcgatcatgaaggccagccgatggcgggcgggatgctgctgcaggtgatgccggcgcaggatgcccagactgccgacttcgagcacctggcgacgcttaccgagaccattaaggcggaagagctgttcaccctgccggcaaatgatgtgctgtggcgtctgtaccatgaagaagaagtcacggtctacgacccgcagagcgtggagttcaagtgcacctgctctcgcgaacgctgcgccggcgcgctgaagacgctaccggatgaagagattgatagcatcctcgccgacgaaggcgaaattgatatgcactgcgactactgcggtaaccactatatcttcaatgccatggatattgccgagatccgtaataacgcctctccggccgatccgcaggttcattaa

SEQ ID NO: 3796 - DNA, 855 bp, Klebsiella pneumoniae
atgaccaaagaaatgcaaactttagctttagcccccgttggtaacctggaatcgtacatccgggccgctaacacttggccgatgctgtcggctgatgaagagcgggagcttgctgaaaagctgcattaccagggcgatctggaagcagcgaaaaagctgattctgtctcacctgcgctttgttgttcacattgctcgtaactactcgggctatggcctgccgcaggcggatctgatccaggaaggcaatatcggcctgatgaaagccgtgcgtcgcttcaacccggaagtgggtgtgcgcctggtctccttcgccgtgcactggattaaagccgaaattcacgaatacgtgctgcgcaactggcgtattgtgaaggtcgctaccaccaaagcacagcgtaagctgttctttaacctgcgtaaaaccaaacagcgtttgggttggttcaaccaggatgaagtggaaatggtggcccgtgagctgggcgtgtcgagcaaagacgtccgcgagatggaatcccgtatggcggcccaggacatgaccttcgacatgtcgtccgacgatgagtccgacagccagccgatggcgccggtcctgtatctgcaggacaaaacgtctaactttgctgacggcatcgaagacgataactgggaagagcaggcggcgaataagctgactgacgcgatgcagggcctggacgagcgtagccaggacatcatccgcgcccgctggctggacgaagataacaagtccacgctgcaggaactggccgaccgctacggcgtctccgcagagcgcgtgcgtcagctggaaaagaacgccatgaaaaaactgcgtgccgctatcgaagcctga

SEQ ID NO: 3797 - DNA, 993 bp, Klebsiella pneumoniae
atatggaaagagtttttacccagatcgataccaatgagcgcaatgttttccatgatagttctccgaatgaaagcctatcctcagcatagtaccgggaaggagggagtgaccatctcattaagtattatgtctgaaaactccaccttttctcccgtcctcaccggccgggaacgtacggctgtccctgcaaaatctctgagcttcgtcgaaggggtatcgatgattgtcggtaccaatattggcgcgggcgtcctttctatcgcctatgcgtcgagcaaagcgggcttcttaccgctgctgttctggctggtgctggtgggcagcctgacgacggtgactatgctctatgtcgcggaatccacactgcgcacccgtaaacatctgcagctcagtggattatcgaagcgctacgtcggcggctttggcgcgctgatgatgtttctctccgtctgcgtcaatagcgtcggggcattgacggcgtatatgaccggcagcggtaagctgctgcactccctgtttggcatctcgccggcgctgggcagcgtgctgtttttcgttccggcggcaggggtactctacctggggctgaaggcgatcggccgcggtgagaaatttatcagcatcggcatggtggtgatgatctcggtgctggtgattgccacgctgctgaaagagaccacccgcgtcggctatctgctcgacggcaactggctgtatatggttccggtcttcaacgtcgtggcattctgcttctcggcacagtatatcgtgccggagatggcgcggggcttcgccgacaaaccggaaaaattgcctaaagccatcatggtcggcatggcgctgacctttaccctgctggcgctggtgccgttgtcggtgatctcgcttaacggtctggacaatatctcggatgtggccaccatctcctgggggcgggcgcttggcgaatgggcttcttctcagccaatctgtttgcgctgtgcgcgatgctga

SEQ ID NO: 3798 - DNA, 1707 bp, Klebsiella pneumoniae
aatggtgaagaaggagcggaacgggttatcctgcgggcgcggcggattaatccacgcatccgcgcgggccagcaccacgcgcaccagttcacggcggcgcgaaagcggaatatcttcatcaaacttgaggcgcaggaagcgctcgtcagaggtgacaagctgggccggaatcgagatagccccggactgcaggatcagctcaatctcttcgatgtcatcctccagatggcgattatcaggcgcgaccacgcggcagccgcccatcgacaggtccgcggtatggctgcgcgagacgatgccgctggcgtaatggatcaccaccggaatatcgacatcgatacgaatggtttttcgcacctgccgcgtttcgcgcgccacggcaatcgccgccagcaggaagatcagactgtagatcccccacccgacgttgagggcgataacgttgggatccgagccaaaatagtcatggccaatcgcccggacgatgccgaccaccacccccagcgccagcaggcaggccaccaccaggtgcgggcgcaccacggtgaaatcgaagtagccgacgtccagcaggccgcccttatcggtgacgttgaacttgccgcgtttagggaaaatcatcgtcaccagggtcggcagcaccaggtggaaggccagcacaatatcgtaaatttccccccagaagctgtagcgatagcggccgttcattcgcgaaccgacgtaaatagcgaggaacaggtgcggcagggcataggagacgatcaggctcgccgacgagtaaataatattgaggttaaacagcaggtaagccagcggggcggtgacaaacaccaccctgggcagcgcgaactggtagtagagcatggcgctgagatagcacaagcgctgctgaaaagtcagcccgcggccaaacagcggattatcgacgcggaaaatctgcgtcatcccgcgcgcccagcgggtacgctggatgacgtgcaccaccaggcgttcagtagcgaggcctgcggccagtgggatatcgagaaaggccgacttccaccccagacgctgaaacttcagcgccgtatgagcatcttcggtcaccgtttcgacggcgaaaccgccgatctgcgccagcgcctcgcgacggatcaccgcgcaggagccgcagaaaaaggtggcgttccagttgtcgttcccctgctgaatcgggccatagaacaacatcccttcgttgggaatgttgcgtccgacggagaggttacgttcaaacgggtccggggaatagaagtagtgcggcgtctgcaccagagccagcatcgggtctttcaggaaaccgccgacggtggcctgcaggaagacgcgcgtggcgacgtggtcgcagtcgaaaacgcagataagctccccctgagtcagggtcagcgcatggttaaggttccccgctttggcgtgcttgttgtcattgcgggtgatatagcccaccccaacgtcggcggcgaagacggcaaactcgctgcgcttaccgtcatccagaagatagattttcattttatcttttggataatcaatgcattgtgccgccaggacggtatcgcgcaccacctccagcggttcgttatagctcggaatatagatatcgaccgtcggccacttactcatatcatccggcagcggaacaatgccgcgcttcagcggccagaccgtctgcagatagttaagcagtag

SEQ ID NO: 3799 - DNA, 1008 bp, Klebsiella pneumoniae
taccaaagagaggacacaatgcagggttctgtgacagagtttctaaaaccgcgcctggtcgatatcgagcaagtgagttcgacgcacgccaaggtgacccttgagcctttagagcgtggcttcggccatactctgggtaacgcactgcgccgtattctgctctcatcgatgccgggttgcgcggtgaccgatgttgacattgatggtgtactgcacgagtacagcaccaaagaaggcgtacacgaagacatccttgaaatcctgctcaacctgaaatggctggcggtgagagttcatggtaaagatgaattcatccttactttgaataaatctggcattggccctgtgaccgcagccgacattacccacgacggtgatgtcgaaatcgtcaagccgcagcacgtgatttgccacctgactgatgagaacgctgctattagcatgcgtatcaaagttcagcgcggtcgcggttatgtgccggcttctgcccgaattcattcggaagaagatgagcgcccaatcggccgtctgctggtcgacgcctgctacagccctgtagagcgtattgcctacaatgttgaagctgcgcgtgtagaacagcgtaccgacctggacaagctggtcatcgaaatggaaaccaacggcacaatcgatcctgaagaggcgattcgtcgtgcggcaaccatcctggctgaacaactggaagcttttgttgacctacgtgatgtacgtcagccagaagtgaaagaagagaaaccagaattcgatccgatcctgctgcgccctgttgacgatctggaattgactgtccgctctgctaactggctcaaggcagaagctatccactatatcggtgatctggtacagcgtaccgaggttgagttgctgaaaacgccgaacctgggtaaaaaatctcttactgagattaaagacgtgctggcttcccgtggactgtctctgggcatgcgcctggaaaactggccaccagcaagcattgctgacgagtaa

SEQ ID NO: 3800 - DNA, 624 bp, Klebsiella pneumoniae
aggcgtgaggagatagcaatggaattagtattgaaagacgcgcagagcgcgctgactgtttccgaaactaccttcggtcgtgatttcaacgaagcgctggttcaccaggttgttgttgcttatgcagccggtgcgcgtcagggcactcgtgctcagaagactcgtgctgaaatcactggctccggtaaaaaaccgtggcgccagaaaggtaccggccgtgcgcgttctggttctatcaagagcccgatctggcgttccggtggcgtgaccttcgctgctcgtccgcaggaccacagtcaaaaagttaacaagaagatgtaccgcggcgcgctgaaaagcattctgtccgaactggtacgtcaggatcgtctgatcgttgtcgagaagttctctgttgaagcgccgaaaactaagctgctggcacagaaactgaaagacatggctctggaagatgtgctgatcatcaccggtgagctggacgagaacctgttcctggccgcacgtaacctgcataaggttgacgtacgtgatgcgaacggtatcgacccggttagcctgatcgccttcgacaaagtcgtaatgactgctgatgctgttaagcaagttgaggagatgctggcatga

SEQ ID NO: 3801 - DNA, 1638 bp, Klebsiella pneumoniae
tccaggttactcccaaagtatgatgaatcactaaaatcgtcatactttcctgtcgtagagattgccatcttgtctattatccgcctcaccctgctggcgctggtcgcctgcgtccctctgctggctcaggccgcgccgtaccagctcaccaccgcctggccggttaacgtcggcccgctgaatccccatctctatacgcccaaccagatgtttgcacaaagcatggtctatgaaccgctggtgaagtatcaggctgacggcagcgtacagccctggctggcaacccgctggcgtcactccgccgacggaaaaacctggtggttcaccctgcgcgacgatgtggccttctccaacggcgaaccgtttaacgcccaggccgcggcggccaattttcaggcggtgctggccaaccgccaacgccacgcctggcttgagctcgccaaccaaataaccgacgtgcgggccctcagcgccaccgagctgcagatcaccctgaaaagcgcctacgcccccttactgcaagagctggccctgccccgcccgttccgcttcatcgccccctcgcagtttatcgatggcggcaccgccaggggcattaaagccccgatcggcaccggcccttggcggctggcaaactcgcagctcaatcagcgcgatgtgctggtgcgcaatgagcgctactggggtcgcaaacccgcgctacagcaaatcaccatcaaggtgatccctgacgccaccagccgggcggtggcgttcgaaaccggggaaatcgatatgctctacggtgacgaagggctgctgccgctggacaccttcgaacgctttcgccatcaccccggctacgtggctcgtctgtccgccccggcggagacggtaatgctggcgctaaacgccagccagggcccgacccgcgagctgacggttcgcgaagcgctcaactacgccgtcgataaacagacccttgtcgatagcgtgttgtatggcacccagcaggttgccgacaccctgtttgccccctccgtcccttacgccccgcaggatctgacgccgcgccgttacgacccgacaaaagcccgcgccctgctggaacaggccggctggcagcagctggaaggccagccctggcgacaaaaagccgggcaaccgctggcgattgagctggcgtttattggcaccgacgcgctggctaaatcgatggccgaaattattcaggccaatctgcggcaggtcggcgtacaggtcaccctggtgggcgaggaggaaagcagcatttacgcgcgccagcgcgaaggccgcttcggcatgatcttcaatcgcacctggggcgcgccctacgatccgcatgcctttttaagctcgatgcgcgtcccgtcgcatgcggattaccaggcccagcgcggcctgccagacaaggcactgattgataaagagattagtgaagtgctgaccaccggtgacgaggcgcagcggagaaaactgtaccatgatgtgctgacccgtctgcatcaggacgcggtgtatctgcccatcagctatgtctcgctgatgtcggtcgcgcgccaggaggtcggggagatcccgttcgccccggtgaccagcgagatccctttcgaccagattaccccggtaacgccataa

SEQ ID NO: 3802 - DNA, 696 bp, Klebsiella pneumoniae
ggcactttttgcccgagaggattaagaatgattcgctttgaacaagtcagcaaagcctatctcggtgggagacaagcgctgcagggggtgaccttccacctgcagccgggcgagatggcgtttctgaccggccattccggcgcagggaagagtaccctgctgaagcttatctgtggtatcgaacggcccagcgccgggaaaatcttcttcagcggtcatgaaatcagccgtctgaagagccgtgaggtgccgttcctgcgccgccagatcggtatgattttccaggaccaccatttgctgatggatcgtaccgtgtatgacaacgtggcgatcccgctgattatcgccggcgccagcggcgatgatattcgtcgtcgcgtctcggcggcgctggacaaggttggcctgctggacaaagcgaagaattttcccattcagctctccggcggtgagcagcagcgcgtgggaatcgctcgcgcggtggtcaacaagccggcggtgctgctggcggatgaaccgaccggcaacctcgacgaggcgctctcggaggggattttacgtctgtttgaagagtttaaccgcgtcggggtgacggtactgatggccacgcacgatctggggcttatctccagtcgtccgtaccgcgtgctgacgcttagcgacggccatctgcatggaggcattcggggtgaataa

SEQ ID NO: 3803 - DNA, 198 bp, Klebsiella pneumoniae
ggttgttattgtaggtcacggtggcggattgaaataatcaaccaccgtaacaacctaagtattgctaggaatggcccttttaccatggcgcggcaaaaaaaattaccccagccgcgtcttcagcgccagcagcggctcgcagaaggccgcgggatgggaaacaaacggcgcatgcgcggccttatcgaagaggattga

SEQ ID NO: 3804 - DNA, 2583 bp, Klebsiella pneumoniae
cctctcgattgtcatatcgcggtgatttttacagcatatttttgccttctcacccacactatagtgttcaggatcacacttttcgctcatccccgccactcctccctgtctaatccccgtcaggatgaggacgatgaatcgggaggtcggcacactagcgccatcgttttagtaaaggacccggatctcattatgtcacagactacatttaacaaagctcagtttcaggctgcactgacgcgtcagtggcagcattttggtttacagtccgcttccgagatgacacagcgtcaatggtggcgcgcagtcagcggagcgttggcggaactcctggcggcgcagccggtagcgaaaccggcgcaaggacagcgtcacgttaactacatctcaatggagtttctgattggtcgtctgaccggcaacaacctgctcaacctgggctggtacgagggcgtcagcgacgcgctgaaaggctacgatgtcaacctcaccgatctgctggaagaagagactgacccggcgctgggtaacggtggcctgggacgtctggcagcctgcttcctcgactccatggcgacggtggggcagtcggcgaccggttacggtctcaactatcagtatggcctgttccgccagtcatttgacgatggccagcagatggaagcccctgacgactgggggcgcagcagctacccgtggttccgtcataacgaagcgctggatgtccaggtaggtatcggcgggaaagtcagcaaaaacggcgaatggcagccggcgttcgtcattaccggcgaagcctgggacctgccggtgcttggctatcgcaacaacgtcgcccagccgctgcgtctgtggcaggccaaacacgctcatccgttcaacctgaccaaattcaacgatggcgatttcctgcgcgccgagcagcagggcatcgacgcggaaaaactgaccaaggtgctgtacccgaacgacaaccatcaggccggtaaaaaactgcgcctgatgcagcagtacttccagtgcgcctgctcagtggccgatatcctgcgccgtcatcatctggcaggccgcaagctggccgagctggcggattacgaagtgatccagctgaacgatacgcacccgaccatcgccatcccggagctgctgcgcgtgctgattgacgagcaccagctgagctgggacgacgcctgggcgatcaccagcaaaacctttgcttacaccaaccacaccctgatgccggaagcgttggaatgctgggatgagaagctggtgaaagcgctgctgccgcgccatatgcagatcattaaagagatcaacgaccgctttaaacagctggtggacaaaacctggccgggcgataagcaggtctgggcgaagctggcggtggtgcatgacaaacaggttcggatggccaacatgtgcgtggtgggcggctttgctgtcaacggcgtggcggcgctgcactcggatctggtggtaaaagatctgttcccggaatataaccagctgtggccgaacaaattccataacgtgaccaacggcatcacgccgcgccgctggatcaagcagtgcaacccggcgctggcctcgctgctggatgagacgctgaaaaaagagtgggccaatgacctcgaccagctgatcaacctggaaaaatatgctgacgatgcggcgttccgtcagacttatcgcgatatcaagcaggccaacaaagttcatctggctgagtttgtgaagcagcgtaccgggattgagatcaacccgcaggcgatcttcgatatccagatcaaacgtctgcacgagtataagcgtcagcaccttaacctgctgcatatccttgcgctgtacaaagagatccgcgaaaacccgcagtccgaccgcgtaccgcgcgtcttcctgttcggcgcgaaagcggcgccgggctactatctggcgaaaaacattatttttgccatcaataaggtagcggaagcgatcaacaacgacccgaaagtcagcgataagctgaaggtggtcttcctgccggactattgtgtatcggcagcagaaaaactgatcccggcggcggatatctccgagcagatctccaccgcgggtaaagaagcctctggcaccggcaacatgaagctggcgctgaacggcgcgctgaccgtcgggacgctggatggcgctaacgtggaaatcgctgagcaggtgggcgaggagaacatctttatcttcggccacacggttgaagaggtgaaagccctgaaagcgaaaggctacgatccgctgaaatggcgtaaaaaagacaagctgctcgatgcggtgcttaaggagctggagaacggcacctacagcaacggcgacaagcatgccttcgatcagatgctgcacagcctgctgcagggcggcgatccgtacctggtgctggccgatttcgaagcctacgtagcggcgcaaaaacgggtagatgagctgtatcgcgaccaggaggcctggacccgcgcggctatcctcaacaccgcgcgctgcggcatgttcagctccgaccgctcgatccgcgattatcagcaacgtatctggcaggcgaaacgctaa

SEQ ID NO: 3805 - DNA, 521 bp, Klebsiella pneumoniae
aggagggattgccagatgttgatgcagcatatcggtgtcggctattttgggtattaccgagcaactgcttatgcgatgaaacactctcttatgcccgagattgcgaagttaagaatgaaggctctgaacttctgggataagcacgggatccgtgccgcagctgatgcttttgacgtatcaacgcgaacactctactggtggcgccggttactgcgcaccggtggtccagaagcactaattccaagaagcaaagcccctctggttcgccgttcaaggcactggcatcctgatgtactcaaggagatcaggcgtctgagaactgagttacccaatctcggcaaagagcagatttttgtcaggctgaaaccatggtgtgaagcgcggcattttacctgtcccagcacgtcaaccattggaagaatcattgctggtgctcacgataaaatgcggatgatccccgtacgcctcagcgccaggggcaaagcccggttgtcttcagccggggtggagataagcgctcc

SEQ ID NO: 3806 - DNA, 2517 bp, Klebsiella pneumoniae
ctggcaggttgccgcgaactcctatcgcgaactttatcaacgcttgatgtaaccactggagtcattgttatgaatgtaccctttagctatgcatcaccgacgctgagcgttgaggcgttaaagcattctattgcctataaactgatgtttatcatcggtaaagatccggccatcgccaacaagcatgaatggcttaacgccacgctgtttgccgttcgcgatcgcatggtggagcgctggctgcgctccaaccgcgcgcagctctcccaggaagtgcgccaggtgtactatctgtcgatggagtttctgatcggccgcaccctctcgaatgcgctgctgtcgctgggcatttatgacgatgtgagcagcgcgctggcggagatggggctcgatctcgaagagctgatcgatgaagagaatgaccccgggcttggcaacggcggtctgggccgcctggcggcttgcttccttgactccctggcggcgctgggtctgccgggacgcggttacggcatccgctacgactacgggatgtttaaacagaatattgtcgatggccggcaaaaagagtctcctgactactggctggagtacggtaacccgtgggagtttgagcgccacaacacccgctataaagtgcgcttcggcggccgcattcagcaggaaggaaagaaaacccgctggattgagacggaggagatcattgcggaagcctacgaccagatcatccccggctttgacaccgacgccaccaacacactgcgtctgtggagcgcgcaggccagtagcgaaattaacctcggtaaattcaaccagggcgactacttcgccgcggtagaggataaaaaccactccgaaaacgtctcccgcgtgctctatccggacgactcgacctactccggccgcgagctgcgcctgcgccaggagtatttcctcgtgtcggccacggtgcaggatatcctgagtcgccattacatgttgcataaaacctatgacaacctggcggacaagattgccattcacctgaatgacacccacccggtgctgtcgataccggagctgatgcgtctgcttatcgacgaacataagttcagctgggacgaggcgttcgaggtgacctgtcaggtcttctcctataccaaccacaccctgatgagcgaagcgctcgagacctggccggtggatatgctgggtaaaattctgccgcgccatctgcagattatcttcgagattaacgactatttcctcaagaccttgcaggagcagtatccgaacgataccgaccttctcagccgcacctcgattatcgacgagtctaacggccgccgtgtgcggatggcctggctggcggtagtggtcagccacaaggtcaacggggtgtccgagctgcattcccgactgatggtggagtcactgtttgccgaattcgccaaaatcttcccaatgcgctttatcaacgtgaccaacggtgtgacgccgcgccgctggctggcgctggccaacccgccgctgtcgaaagtgctggatgagcatatcggccgcacctggcggaccgatctgagtcagcttgatgagctgaaacagcatatcgactacccgatggtcaatcaggcggtgcgtcaggccaagtttgagaacaaacagcggctggccagctatattgctcaacagctcaatgtggtggtcaatccgaaggcgctgtttgatgtgcagatcaaacgtatccatgaatacaaacgccagctaatgaatgtgctgcacgtcatcacccgctataaccggatcaaggccgatccgcaggccgagtgggtgccgcgggtgaatattttcgccggtaaggcggcctcggcctactacatggccaagcacattattcacctgatcaacgatgtggcggcggtgattaataacgatccgcagattggcgacaagctgaaggtcgtctttatccccaactacagcgttagcctggcgcagctgatcattccggcggcagacctgtcggaacagatctccctcgcaggcactgaagcttccggcaccagtaatatgaagtttgcccttaacggcgcgctgactatcggcacccttgatggggcaaacgtggagatgcaggagcacgtgggggaagagaatatctttatcttcggcaacaccgcggaagaggtggaggagctgcgtcgcagcggctataaaccacgcgaatactacgagcaggatgaagagcttcaccaggcgctgacgcagatcggtaccggcgtcttcagcccggcggaaccggggcgctaccgcgacctgctggattcgctgattaactttggcgaccactaccaggtgctggcggactatcgtagctatgtggactgccaggatcgcgtcgacgagctgtatcaaaacccggaagagtgggcctataaggcgatgttgaatattgccaacatgggctacttctcttctgaccggacgatccaggagtacgcgaaatatatctggcatatcgacccggtaaggctgtaa

SEQ ID NO: 3807 - DNA, 528 bp, Klebsiella pneumoniae
atacgactctggaactttatggcagttttgcaagtgttacatattccggacgagcgccttcgcaaagtcgccgagccggtcaaagaagtgaatgcggaaattcagcgtatcgtcgatgatatgttcgacaccatgtacgccgaggaaggcatcggtctggccgcaacccaggtcgatatccatcagcgcattatcgttattgatgtgtcggaaaatcgtgaagagcagctggtattaattaacccggaaatgctggagaaagatggcgaaaccggtattgaagaaggctgcttgtctattcctgaacagcgcgccctggtgccgcgtgcggaaaaagtgaagatccgggcactggatcgcgatggtaagccgtttgaactggaggccgatggcctgctggctatctgtatccagcatgagatggatcacctggtcggcaaactgtttattgactatctgtcaccactcaaacaacagcgcattcgtcagaaggtagagaaactggatcgtttacgttcccgtgcctga

SEQ ID NO: 3808 - DNA, 1461 bp, Klebsiella pneumoniae
gaaggcgtctgccgccagcacgtcggcccacaggtagctgtagtaacctgccgcatagccgccagcgaagatgtggctaaaggcgtgcgggaagcggccccaggtcggccccggcaccacggcgacctgctttttaatctcggccagggtctcaaggattttcgccccctgctccggtttgtactccgcatgcaggcggaaatcgaacaggccgaactccagctggcgcagaataaacatcgccgcctggtagtttttcgccgccagcattttctccagcagctcctgcggcagcggttctccggtttcataatggccggagataaacgccagcgcttccggctcccagcaccagttctccataaactggctcggcagctcgaccgcatcccacggcaccccgctgatgccggaaaccccggcggtgtcgatgcgggtcagcatatggtgcagaccgtggccgaactcgtggaacagggtgatcacttcgtcatgggtgaacagcgccggcttgccgttgaccgggcggttgaagttacaggtcaggtaggcgaccggcttctgcagggaaccatccagtttacgcatctggccgacgcagtcgtccatccacgcccccccgcgcttatgctcgcgggcatacaggtcgagatagaaactaccgcgcagctcgttgtgttcgtcatacagctcgaagaagcgcacttccggatgccacacatcgacatcggtacgctctttagcggtaataccgtaaatgcgcttaaccacttcaaacaggccgctaacggctttgttttccgggaaataggggcgcagctgctcatcactgatgctgtagaggtgctgcttctgtttttcgctgtagtaggcaatgtcccacggctgcagctcatcgacgccaaactcggctttggcgaaggcgcgcagctgggccagctctttttcgccctgcggacgggcgcgttttgccaggtcggtgaggaaatcgagcacctgctgcggatccttcgccattttggtggcgagggatttatacgcatagctgtcaaagcccaacagctgcgccagctcgtgacgcagggcgaggatctccgccatcaccgggctgttatcccatttcccggcgttcgggccctgatcggaggcgcgggtggaataggcgcgatacatctcttcgcgcagcgcctggttatcgcagtaggtcatcaccggcagatagctcggaatatccagggtcagcagatacccttcctgctctttggcctgcgcctgagcctgagcggcggccagcgcgctttccggcatgccggccagatcggcgacatcggtcaccagcttgttccagcccatggtggcgtcgaggacgttgttgctgtactggttgcccagctcagagaggcgcgcggcgatttcaccgtagcgtttctgcgcctccggcggcaggccaatcccggataa

SEQ ID NO: 3809 - DNA, 741 bp, Klebsiella pneumoniae
gcgattcgctgcatgttaatgattacctcttttgccaacccgcgggtggcccaggcgtttgtcgattatatggcgacgcaggggattatcctgaccatccagcagcatacccagagcgacgtctggctggctgatgagagtcaggccgggcgcgtcagggctgagctggcgcgttttctcgaaaacccggcggacccgcgctatctggcggcgagctggcagtccggacagaccaatagcgggttgcgctatcagcgctttcctttctttgccacgctgcggcataacgccggcccgttcacctgggcgattctgctgatctgcatcgcggtgttcatcctgcaaaatctgctgggcgatcagccggtgatgatttggctggcctggccctacgatccttcgctgcagttcgaagcctggcgctatttcagccatgctttcatgcatttctcgctgatgcatattctcttcaacctgctatggtggtggtatcttggcggcgcggtggaaaagcgcatcggcagcggcaagctggtggtgatcaccgtcatcagcgctctgctgagcggcttcgtgcagcaccagtttagcggcccgtggtttggtggcttgtcgggcgtggtctacgcgctgatgggctacgtctggctgcggggtgagcgcgaatcgcaaagcggtatttatctgcagcgcggggttgatactcttctctttagtgtgggtaaatgctggctggtttga

SEQ ID NO: 3810 - DNA, 381 bp, Klebsiella pneumoniae
tattttttatgggtaaccctaatgagtaaaatgcccctcttttttgttctggtcgtcgcggtgattgtggtggcggcttcgtttcgctatgtccagcagcgccgtgagaaacaggcgaatgacgccgcgccgttgctacaaaagcgggttatcgtcagcaataaacgggaaaaagtgattaacgatcggcgctcgcggcagcagacggtgacgcctgcaggcagtgagatgcgctatgaagcgagctttcgccccgaaaacggtggtctggaggtggtgtttcgccttgacgcgccgcaatatcacgcgctgagcgtcggcgatcgcggaatgttgagttataagggcacagcgttcgtggcgtttacgcccgatccctga

SEQ ID NO: 3811 - DNA, 2043 bp, Klebsiella pneumoniae
  unsure (1164),(1205): Identity of nucleotide at the above locations are unknown.
taccgggtatgtattcagtatcagtggagaacaccgttgcgcgtcagccgttcacttacaatcaaacagatggcgatggtcgcgagcgtgtccatggcctttgtattggttttttgtactattttgctgtttcactttgtgcaacagagtcgctttaccacggccacgcagttagaaagtatcgcgcgatccgttcgcgaaccgctgtctgcggctattctgaaagccgatattccggaagcggaagccattttaagccgtatccagcctgctggcatcgtcagccgggcggatgtggtattgccgaaccagttccaggcgctgcggatgcgatttatccccgagcggccggtgccggtaaccgtcacccggctgtttgagctgccggtgcagatttcgctgcccatttattcgctggagcggccggccaacccgcagccgctggcctatctggtgctgcaggccgactcctatcgcatgtataaattcgtcatgagcgcccttgctacgttagtgactgcttacttacttctggtgctgatgctgacggtggcgctcacctggtgcatcaaccggcttatggttcgccctctgcggcgtatcgcccgcgagctgaacgatctctcccagcaggagcgtcttggccatcagctgaccctcccgcgcctgcaccatgacgacgagatcggtatgctggtgcgtagctataaccgcaaccagcagagcctggtccgccagcatgatgagctgtccatccagtcgacccgcttcccggtctccgagctgccgaataaagcctttttgctggcgatgctggagcagacggtggcccgcccgcagagcgccgcgctgatcgtcgtcgcctgtgaaaccctgcaggacgccgccggggtcctcaaggagagtcagcgcgaaatgctgctcctgacgctggtggagaagctgcgggccgcgatcccgccgcagatggtgctggctcaggtgagcgggtatgacttcgcgattctcgccgatggccttgccgaaccgtggcaggcggtgacgttaagtaagcaagtgctcactattattaatgagcgtttaccgctgcatgggctgcagctgcgcccctacgccagcgtcgggatcgccctgttccacgccgggctcagcgccgagcagttntaccggcgcgcggtgtcggccgctgtcaccgcacgacgtanaggcaaaaaccagatcgagttcttcgatcccgagcagatggaaaaggctcagcgccgcctgatggaagagcacgacattatgacctcgctcgataaccagcagttcgcgatctggctgcagccgcaggtggcctgcgccagcggcgagatctgcggcgccgaggtactgctgcgccagcggcaggcggatggcagctggtcgctaccgccggcgctgattgagcgcattgagtcctgcgggctgattatcccggtcggctactgggtgatggaagaggcctgccgccagctggcggcctggcaaagccaggggattatgctgccgctgtcggtcaatgtttccctgctccagctgctggaacacgaccgcggcgaggagatgctgaagctgatcgcccgctaccgcatcgccccgggtaccctcatcctcgaggtgacggagagctgccggatggacgatccgcaggatgtgatggcccggttgcgaccgctgcgcgaggccggggtgcacattgcgctggatgattttggcatgggttatgccgggttgcaccagctgcagcagatgaaggccctgccggtggatattctgaaaattgataaggtattcatcgatatgctgccggaggatgtcagcatggtgccggcgatgatccagctcgcgcgcggcctgtcgctgcgtatcgtggcggaaggggtggagaacgacgcccagtaccgctggttgcaagccgccggcgtcgaagtgctccagggccatctgttcggttgcgctttaccgcaggaggcattcagcgcgcgctatctctccccggttcgggaggatgaaaatttgtaa

SEQ ID NO: 3812 - DNA, 225 bp, Klebsiella pneumoniae
tatatttcatgcaagcaaacctggaaaaagaagaataaaacaccgcctgacgctgtggcacgagtcagtaggctaatagggtgcgttagggttggttatcagaaacctctacaaaccgcgataagtagaccacagggaacgagaaaagtatcaggagggaatgtgatccagccaaacatttacaaaacatttggctggattggcactatttgcttagggaaataa

SEQ ID NO: 3813 - DNA, 264 bp, Klebsiella pneumoniae
gcagcagaatgcgcacgatctcgccgaagcctaaggtcacaatcgccaggtagtcgccgcgcaaacgcaataccgggaagcccagcaggaaaccggccgccgcggagaccaggccggccagcgggagacaggtccagaagccgagaccgtaatagtggttcagcagcgcaaaggtatacgcgccgatggcatagaacccgccgtagcccagcaccagcaggccggaaaggccgaccaccacgttcaacccgaggccgaggatga

SEQ ID NO: 3814 - DNA, 468 bp, Klebsiella pneumoniae
gtacgccgatgcgttgctgcaaaaaataaatcaggagtaaatatgtatcgtattggtgaactggcaaaactggccgacgtgacgcctgataccatccgctactatgaaaagcagcagatgatggatcatgacatacgcaccgagggaggatttcgtctgtactcggataacgatcttcaacggctgcgctttattcgttatgcccgacaactgggtttcaccctggaagcgatccgcgaattattgtcgatccgcatcgatccggagcatcatacctgtcaggagtcgaaagggatcgttcaggcgcgattaagtgaagttgaggcgcggattaaagagctacagacgatgcgccgctctctgcagcggctcaacgatgcctgttgcggcactgcccacagcagcgtttactgttctatccttgaggcccttgaacaaggggccagcaacggcaatggcggacgttga

SEQ ID NO: 3815 - DNA, 987 bp, Klebsiella pneumoniae
cttgcccggtggcgctgcgcttaccgggcctacgatgtgccctatgtaggccgggtaaggcgtaggcgccacccggcattgttcaggaacccaatctcaatgtcatcatcccgtccggtattccgctcgcgctggctgccctatgtgctggtcgcgccgcagctgattatcacgttgattttctttatctggcccgcaggcgaagcgctgtggtactcgctgcagagcgtcgatccctttggcctttccagccagttcgtcggcctggataacttcgttgcgctgttccacgatccgtactacctggactcgttctggaccaccataaaattcagcgccctggtgaccgtcagcggcctgctcatttcgctgtttttcgccgcgctggtcgactatgtggtgcgcggcagccgcttttatcaaacgctgatgctgctgccgtacgccgtggcccccgccgtcgcggcggtgctgtggatcttcctctttaaccccgggcgcgggctgatcacccatttcctcggcgagctgggctatgactggaaccatgcgcagaacagcggccaggcgatgtttctggtggtcttcgcctcggtgtggaagcagataagctacaacttcctgttcttcttcgccgcgctgcagtcgattccgcgttcgctggttgaggccgccgccatcgacggcgccgggccgattcgtcgcttctttaagctggcgctgccgctgattgcgccggtgagtttcttcctgctggtggtcaacctggtttatgccttcttcgacaccttcccggtgatcgatgccgccaccgctggcggcccggtgcaggcgaccaccactctgatctacaaaatctatcgcgaaggtttcgccgggctcgatctatccgcttccgccgcgcagtcggtggtgctgatgttcctcgtcattatcctgacggtggtgcagttccgttacgttgaaagtaaggtgcgttaccaatga

SEQ ID NO: 3816 - DNA, 1026 bp, Klebsiella pneumoniae; identical to SEQ ID NO: 2067

SEQ ID NO: 3817 - DNA, 453 bp, Klebsiella pneumoniae
atccgcgttcgttttcgctgggccgtgaggcgcagacgctccgcctgcgactgctgctggaggcggaagatgagcggtaaacgctggatcttcctgtggctaccgctgtcgctgctggcggccgagcgtgaccctttccagccggttgaggatccctgccgcacggcgcagctttcgcaatggcgctatggcggggcggttggggatgatgctggctggacggggtttctgcaggatgggaacggaaagtggcgacgggtacgcatggatgagcaattgcccacgggctggcgggtgagccggctgacggccggtgagctggacatcgtcacgtcttcgggatgtgaaccgccagcgtggcgctggcaacgtgaagggaaacaacatgatgcgatggataagcctgctgcttctgctgctgccgctggcggtggcccccgccgcccgcaatga

SEQ ID NO: 3818 - DNA, 879 bp, Klebsiella pneumoniae
cgcggcgctcgacccgcgcctgcgccgccacgaggaggtgagcgcatgagagggcaacaaagctttcgctggccggtaaaactggccatgctggttatcgcgctgctggcggtcatcgccatcggcagcggctggtggctgccctgggatccagcggcgattgaccttcagcagcggctgctgccgccgggcgcagcgcactggctcggcaccgatcatctcggccgggatattttctcacgcctgctggccgccacccgcgtttcgctgggggctgtgatggcttgtctgctgctggtgctgctgatcggcctggcggtcggcggctgcgccggactgctgggcggccgcgccgaccgcggcctgatgcgcatcgccgaactgtttatgacttttccgacctcgatcctgtcgttctttatggtgggagtgctgggtaccgggctgaccaatgtgatcctcgccattgcgctgtcacactgggcctggtacgccagaatggtgcgtaacctggtggtttccctgcgccagcgcgaatttatcctcgccgcccgtctgagcggcgccagccagtggcggctgttcagcgaccatctggccggcgcggtgatcccctcgctgctggtgctcgcctcgctggatatcggccatatgatgcttcacgtagccggcatgtcgttcctcggtctcggcgtcagcgcgccgacggcggaatggggggtgatgatcaacgacgcccggcagtatatctggacccagccgctgcaaatggtctggccggggctggcgctgttcatcagcgtgatggcttttaacctgctgggcgacgcgctgcgcgatcgtctcgatccccacctgatcgcggagcatagccactga

SEQ ID NO: 3819 - DNA, 579 bp, Klebsiella pneumoniae
cagcccctgctggagatggccgagcagaagaccgatggccacgggcagacacagcaccagcgtttgccgcagtgcatagttgacttccgggtggtaaatcagcctgcgccacatgagggaaaaacaaaaacggcgtactgcgggagcaatacgccgcttagcaacttaacgggtgccgtagacgacgatggttttaccgtgcgcggaaatcaggttctgatcttccagcattttcaaaatacgaccaacggtttcacgagagcagccgacgatctgaccaatttcctggcgggtaattttaatttgcataccgtccgggtgggtcatggcatccggttgcttcgccaggttcagcagcgtctgggcgatacggcccgtcacgtcgaggaaggcaaggttgcccactttctcagacgtgacctgcagacggcgagccatttgcgaagagagacgcatcagaatgtccgggttcacctggatcagctgacggaatttcttataagagatttcggccacttcacatgcggttttcgcccgtacccaggcgctacgctcctgaccctcttcaaacaggcctaa

SEQ ID NO: 3820 - DNA, 477 bp, Klebsiella pneumoniae
acattagatcgccgaaataatatttcgcgcatttttgattacaggctgactttgcggcatatcaataaaaaggtgattttcactttaaaaatagcctgcagcgcatcatatgtattgatgataaaaaccattctcattatcatcgattacagaacgttttttcttttttcgttggctacggtccccggcgcaactgcctccaggcgtccggaaaattcttcttcggttagcgatagacaagtaggccctatgcaattcacacctgatagtgcgtggaaaattaccggtttttctcgcgatattagcccagcataccgtcagaaactgctctccctcggcatgctgcccggttcctcttttcatgtggttcgcgtggcgccgctcggcgatcctgttcatattgaaacccgacgcgtcagtctggtattacgcaaaaaagatctcgccttaatcgaactggaagcggttgcacaataa

SEQ ID NO: 3821 - DNA, 1170 bp, Klebsiella pneumoniae
cgtctctgtcgaataataagcacgatgcctgaccccctctccccgcgtgggagaggcggggggcgtattcccgctattccggggaatgcttttgtgagcaatacagacgccctgtcgccaggcggggcgtcactagagagaatccgggttatgttgcagtttattctccgacgtctgggattagtcatcccgacatttatcggtatcacccttctcacctttgctttcgtccatatgatccccggcgatccggtgatgattatggcgggcgaacgtggtatttcccccgaacgtcacgcgcagctgctggccgaaatgggccttgataagccgctgtggcagcaatatgcccactatatctggggcgtgctgcacggcgatttaggcatctcgctaaaaagccgcattcccgtgtggcaggagtttgtcccgcgctttaaagccactcttgagctgggcgtctgcgcgatgatcttcgccgtcgccgtcggcattccggtgggcgtgctggctgcggtaaaacgcggctccatctttgaccacaccgcggtgggcctggcgctgaccggctactcaatgcctatcttctggtggggcatgatgctgattatgctggtttcggtgcagctaaacctgacgccggtctccgggcgcatcagcgatacggtcttccttgacgataccctgccgctgaccggctttatgctgatcgacaccgccatctggggcgagcagggcgactttattgacgccttaatgcatatgatcctgcccgctatcgtgctgggcaccatcccgctggcggtgattgtacgtatgacccgttcgtcgatgctggaagtgcttggcgaagactatatccgtaccgcgcgcgccaaaggcctgacccggatgcgggtgatcgtgatccacgcgctgcgtaacgcgatgctgccggtggtcacggtgattggtctgcaggtgggcaccctgctggcgggcgccatcctgacggaaaccattttctcatggcctggtttaggtcgctggctgatcgacgcgctgcagcgtcgcgattatccggtggtgcagggcggggtgctgctggtggcgacgatgattatcctcgtcaacctgctggtcgacctgctgtacggcgtggtgaacccgcgtatccggcataagaagtaa

SEQ ID NO: 3822 - DNA, 1110 bp, Klebsiella pneumoniae
ggtggatgtcgcgttatggagaggcttactgttaccctcggggaacgtagttacccgattaccatcgcggctggtttgtttaacgatccagcttccttcctgccactcaagtcgggcgaccaggctatgctggtcaccaacgaaacgctggcgccgctttatctggataccgtccgctctgcgctggagcagtcaggggtcaacgttgacagcgtcattctgccagacggcgagcaatacaaaagcctggcggtgatggataccgtgtttactgcgctgttgcaaaaaccacatggccgcgacaccactctggtggcgcttggcgggggggtgatcggtgatttaaccggtttcgccgcggcaagctatcagcgcggcgtgcgtttcatccaggtccctaccaccctgttgtcgcaggtcgactcgtcggtcggcggcaaaaccgcagtgaaccaccctctcggcaaaaacatgattggcgccttctggcagccggtttccgtggtagttgatcttaactgtctgaaaactctgccgaagcgcgagctcgcttccggactggctgaggtcatcaagtacggggtgatcctggatggtgaattcttcagctggctggaaaacaacattgatgcgctgctggcgctggacgataccgccatggcgtactgcattcgccgctgctgtgaactgaaagcggaggttgtggctgccgacgagcgtgaaaccgggttacgtgctttactcaatcttggacataccttcggccatgctatcgaagcggaaatgggctacggtaactggctgcatggcgaagcggtggcggcaggtatggtgatggtggcacgcacgtccgaacggctggggcagttccgcgcacaggatactcagcgcattatcgagctgctcaagcgtgcaggcttaccggtacgcggcccgcaggaaatgagtgcgcaggcgtatttgccccatatgatgcgcgataaaaaggtactggctggcgaaatgcggctggtgctcccgctcgcaataggaagcagcgagctgcgcggcggagtgccgcacgatgtggttcttggcgcgattgctgatactcagcaggcgcaacaataa

SEQ ID NO: 3823 - DNA, 537 bp, Klebsiella pneumoniae
gcacggcgtcgcgctgcatatctgcgtggcggccgccctgcgtcgtggcgtaacggacgaacgcgaagcgcaacagctcgctctgcctggccacaatttgcagccgggttttaccttgagcgggctcggcgcgctagcggaagcggcgcttacttgcgatcggatggtgcagttctgatgaaacgtgtggcttttgtattttcctctgcgccgcacggcagcgccgctggcagggaaggcctcgatgccttattagcaacctccgcgctcaccgacgatattggcgtgttttttgtgggcgacggcgtgtttcagctgttacccgaacagcggcctggcgctgtgctggcccgcgactacatcgctacctttaaattgctgtcgctatatgatatcgaccagtgctggctgtgcgccgactcagcgcgagagcgcggcctggatcccgcgaccccgtgggtggtggatgtcgaatgcctggcgccggatgccctgcgcgcccgtctgcatgaatttgatgtgattttgcgtttctga

SEQ ID NO: 3824 - DNA, 1503 bp, Klebsiella pneumoniae
cgtcctatgctacatttatttgccggtctggatttacataccggactattattattgcttgctttagcttttgtactgttttacgaagcgattaacggtttccatgataccgcaaacgcggtggctacggttatctacactcgcgcaatgcgctcacagctcgctgtggcgatggcggcgctcttcaacttcttcggcgttctgctgggcggtctcagcgtagcctatgccatcgtgcatatgctgccgaccgatctgctgcttaacatgggttccgcacatggcctcgccatggtgttctctatgctgctggcggcgatcatctggaacctcggcacctggtacttcggtcttccagcttccagttctcataccctgattggcgccatcatcggcattggtttaaccaatgcgctgatgaccggtacttccgtggttgatgcgctgaatatcccgaaagtcatcggtatttttgcttcgcttatcatctcgccgatcgtcggtctggtgatcgcgggcggcctgattttcctgctgcgtcgctactggagcggaaccaaaaaacgcgcgcgtatccacctgacgcccgcagagcgtgaaaagaaagacggtaagaaaaagccgccgttctggacccgtatcgcgctgatcctgtctgctattggcgtgtcgttctctcacggtgctaacgatgggcagaaaggcattggcctggtgatgctggtgctgatcggcgtcgcgccggcgggtttcgtggtgaatatgaatgcctctggttacgaaatcacccgtacccgcgatgcggtcaacaacgtggaaaccttcttccagcagcgtcctgaactgctgaaaaaagccaccggcgtcgatcagctggtgccttctccggataccaataccgcggccaatggcgagttccactgccatccggcgaacaccatcaacgcccttgaccgcgtcaaaaccatgctgaccggcgttgagaactacgagtcgctaaaaccggaacagcgcggccagctgcgtcgcatcatgctctgcatctccgacaccaccgacaaggtggcgaagctgccggatgtgagcgctgacgaccagcgtctgctgaagaaactgaaaaccgatatgctgagcaccatcgagtacgcgccaatctggattatcatggctgtcgcgctggcgctgggtatcggcaccatgatcggctggcgccgcgtggcgaccaccatcggtgagaagattggtaagaaaggcatgacctacgctcaggggatgtcggctcagatgaccgcagcggtttctatcggtctggcgagctacaccgggatgccggtttccaccacccacgtactctcctcctcggtagcggggacgatgctggtggatggcggtggtctgcagaaaaagacggtgaccagcattctgatggcctgggtgctgaccctgccggcagcgattatcctttcaggcgtcctttactggctctccctgaaactgatttaa

SEQ ID NO: 3825 - DNA, 741 bp, Klebsiella pneumoniae
aaaggagtgctttttttcatgtccaggtcgcttttaaccaatgaaaccagcgagcttgacctgctggatcaacgtccctttgaccagaccgatttcgatattctcaaatcttatgaagcggtagtggacgggttggcgatgctcatcggttcgcactgtgaaatcgtgctgcattctttgcaggatctgaaatgctctgccatccgtatcgccaatggtgaacataccggccgccaaatcggttcaccgattaccgatcttgcgctgcgcatgctgcacgatatgacgggcgccgatagcagcgtttccaaatgctactttacccgtgctaaaagcggcgtactgatgaagtcggtgacgattgccattcgcaaccgcgatcaccgggtgattggtctgctgtgtatcaacatgaatctggatgtgccgttttcccagatcatgagcacctttattccgccagaaacgcctgaagtgaactcgccggtgaactttgcttcttcggtagacgatctggtcgcccagacgctggagttcaccattgaagaggtgaatgccgatcgcagcgtgtctaacaatgcgaaaaaccgtcaaatcgtgctgaatctctacgagaaagggatcttcgatattaaagacgctattaaccaggtagccgatcgtctgaacatctccaagcacaccgtctacctctatattcgccagttcaaaagcggcgatttccaggggctggataagtaa

SEQ ID NO: 3826 - DNA, 1998 bp, Klebsiella pneumoniae
gacgttcaccgccccgtttttgcagatgccgacctgcggatccaggtcgggccacgctccttcatgcaggcaaatcacccccgggcggatcccctccgtcaccacggcgccggccagcacctgaccgcgggcgttccatacccgcaccagatcgccatcgacaatcccgcgcgcctgcgcatcctgcggatgaatagtcaccggttcgcgcccggcgacggcatagcgctcgcgcagcgcggtgtggttcagttggctgtgcagacggtgggccggatgggccgacagcagctgcagctgccccgcctctgcgttgccatgccactcgtcgggctccagccacatcggatgcggcggacagtcggcgtaaccaaaagcggcgatggtcggcgagtggatctctattttaccgctcgccgttttcagcgggttggcctggggatcggcgcggaaggcggcgaaacgcgcaaaacgggcattctccggctcctccggcatctcaatcagctggttagcctgccagaattcggcaaatggcggcagcgtcacctgctgctgggcgccgcgccgggcggccatctgatagaaagtctccagccactgcaaatcactcttcccttcggtgaagcgttcgcggccacccgcctcccagcgttcgctgaggtcggcaaagaccgcgaaatcgtcgcgcgcttcatctcgcggggcaaccacctgcttcatcggcaccagatgctggttactgtagtccccggtcatggtcagatcgttgcgctcaaacgaggtggtcgccggcaggacgatatcggcatggcgcgcggcggcggtccagaagcattcggaaatgacgataagctccggtttctgccacgcctgaatcagtcggttggtgtcctgatgatgagtaaagttggcgccgccggcccaccagataaagcgaatatcgggaaagcgccgcgccatgccgttgtgctgatactccgcccccggattctccagcgcctcgacaattcgtgcgaccgggatcttctccaccgcgtccacgcctccggccacgctcccctgcatcgagcccagcaccgccgcgcggcgggtcgggttgccgccgttggcaaaatgataggaaagaccaaacccgccaccgggggtgccgatctgtcccagcatggcggccagagtgaccagcatccagtgtttctgctcgccatactgctgacgctgcatgccccagccggccatcagcatagtggtattttcgtggaaaagttgcgccagttcgcggattttatctgctttaacgccgcagatcgctgctgcccactcagcggttttcgctacgccgtcgctttcgccggtcagatagcgggcaaaaatatcgtagccgctggtgcagcgggtaagaaacgcatcatcctgccagtcattttccaccagcgtatgggcgatccccagcatcagcgcgacgtcggtgcccatatgcggcgcgatccactccatcgaatcgccaaagaaatcgacggtttccgatcgcatcggatcgatgcagatcagccgcttaccgctctggcgcagccgatcaaaccacgggatcccttgctcgtcggaggcattccaggcgattttcagcgtgttcagcgggttggcgctccacagcaccaccacttcgctgtgctcgagcaccagcggccaactggtctgctgctgatacacctcattgccgccaacgacgtaaggcatgatcgcctgcgccgcgccggtggagtaatcgccaagatggccggtatagccgcccgccaggctcatatagcgctgcagcagcgtcgccgccttatgcaatacgccgttagagcgccagccgtaggagccggcaaaaatggaggccggaccgtagctgtcgcggatccgccgatgctgggcatcgatcagatccagcgcctgctcccagctcacccgcacgaattcatcctgaccgcggaccccctggggcttgtccggtga

SEQ ID NO: 3827 - DNA, 525 bp, Klebsiella pneumoniae
cgaaagcaccgccgggctctatattcgctatatgttaggagatcattgatgatgacggagaacaataacccggtggtgatgacctggtttcagcagcagcagacgcctgccggatggttcgatctgttgattattatgatcgaaggtatgctaaataatgccggcgagctggaaagccagcccttcctgcgtcagatgggcgcctcgctggcggagacccatccgctgccggcgtcggagacggtgggggatctggaggccaacatcaaccggctgctgactcattttcactggggcgtggtgaccatcgatgtcggtgaggacggcctgcgcctgcgccatcaggcgttgccggtcagccgcgacgaagcggggcgcgtgcgctggtgcaacgcgttctgtgccatactcgaggggttatattctcgctggctgcagagtcagggaggcagtgcccacgtgatactgcagcgtgagcgggtgttctccgtctctgacgttcagtttctctactaccatccataa

SEQ ID NO: 3828 - DNA, 1569 bp, Klebsiella pneumoniae
gccaataaccgcagcatggcgagttatcagacattttcggcgcgttctggcatacgcgttcatactttttgggaaagtaatacaaggcgaaggaatatgaatacaactgcacctacgggcttgctgcagcaacctcgtccgttctttatgatcttctttgtggagctctgggaacgttttggctattacggcgttcaggggatcctggcggttttctttgttaaacagctgggcttctctcaggaacaggcctttatcaccttcggcgccttcgcggcgctggtttacgggctgatctccatcggcggctacgtgggcgaccatttgctggggaccaaacgcacgctggtgctcggcgccattgtgctggctatcggctactttatgaccgggatgtcgctgctgaaaccgcagctgatctttatcgctctcggcaccatcgccgtcggcaacggtttgtttaaagccaacccggcgagcctgctctccaaatgctatccgccgaaggatgcccgtctcgacggggcatttaccctgttctatatgtcgataaacatcggttcgctgctgtcgctgtcgctggcgccggtgatcgccgaaaaatttggctacgcggtaacctataacctgtgcggcgcggggctgattatcgcgctgctggtctacttcgcctgccgcgggatggtgaaagatattggctccgagccggatcatcgccccctcagcctacgcaatctggcgctggtgctggccggtacggtggtaatgatttttctctgcgcctggctgatgcataacgtgatgatcgccaacctggtgctgattgttctgtcggtcgtggttattgcgttctttttccgtgaggcgtttcgcctcgataaaactggacgcaacaaaatgttcgtcgcctttattctgatgatcgaggcggtgctgttttacattctgtatgcccagatgccgacctcgctgaacttcttcgccatcaacaacgtccatcatgagatccttggctttaccatcaacccggtcagcttccaggcgctgaatcccttctgggtagtggtcgccagcccggtgctggcggcgatctacacccatctcggtcataagggtaaagacctgaccatgccggtgaaatttaccctcgggatgttcctctgcgcgctgggcttcctgaccgccgcagccgccgggatgtggttcgccgacgcccaggggttaacctcgccgtggtttattgtgctggtctatctgttccagagtctgggcgaactgttaatcagcgctctggggctggcgatggttgccgcgctggtgccgcagcatctgatgggctttattctggggatgtggtttctgacccaggccgccgctttcctgctgggcggctatgtggcgacctttaccgcggtgccggaaaacatcaccgacccgctgcagaccctgccggtctacaccaatgtgttcagtaaaattggcctggtgacgctgggcgtcacggtggtaatggcgctgatggtgccgtggctgaaccggatgattaataccccggccagcgccgaataa

SEQ ID NO: 3829 - DNA, 357 bp, Klebsiella pneumoniae
gcgggtcgccggggaggaggtatgatcagcactattgcgctgttttgggccctgtgtgtcgtttgtgtggtgaatatggcacgctacttctcatcgttgcgtgcattattggtggtgctacgtggttgcgatcccttgctctatcagtatgttgatggcggcggcttttttacctcgcacgggcagcccagcaaacagatgcggctggtgtggtatatctatgcccagcgctaccgtgaccatcacgatgatgaatttattcgtcgctgcgaacgtgttcgtcgccagtttatcctgaccagcgccctgtgcggcctggtggtggtgagcctgattgcgctgatgatctggcactaa

SEQ ID NO: 3830 - DNA, 219 bp, Klebsiella pneumoniae
tgcgccagccgcgccacgacgcccatgtcatgcgtcaccagcagcagtcccagaccgcgcctggcgacaatatccgccagcaggtcgaggatgcgcgcctgggcgatggcatcgagatcggtcgtcggctcgtcggcgatgataaagggcgcgcggctgagcagggcgagagcgaccatcatccgttgcagcatgcccccgctcatttcaaaagggtag

SEQ ID NO: 3831 - DNA, 519 bp, Klebsiella pneumoniae
gccggactacgcttcaatgagtggaagcggagggactatataatgaaaggtgatgtcaaaatcataagttatctcaataaattattgggaaatgagctagtcgcaattaatcagtactttcttcatgcgagaatgtttaaaaattggggcctgatgcgcctcaacgatattgagtaccacgaatccatcgacgaaatgaagcacgccgataagtatatcgagcgtattctttttctcgaaggtatccctaatctgcaggatctcggcaaacttggcatcggtgaagatgtggaagagatgctgcggtccgatttgaggctggagctggaaggggcgcaaaatttgcgtgaggctattgcctatgccgacagcgtccatgactacgtcagccgcgatatgatgattgagatcctggcggatgaagaaggccatatcgactggctggaaaccgaactcgatttgattggcaaaatcggtctgcaaaattacctgcagtcgcagatcaaagtgtcagattag

SEQ ID NO: 3832 - DNA, 2478 bp, Klebsiella pneumoniae
tttctctcgcttcaccatgacctacgatctgccgcagcagaagggtccgcagccgcgtttacaggtgccggagggggcggaagtgctgctggaagatgccctgccgcatctgtcagcggctcagcgtcgaacgttgatggtcaacaccgcgctgccggcgggttacccgctatccggcgccacccccgaacagcaattctggcagcggctgaatctgtcggcggcctgggagatggcgcaaaaaaggcagtaatgtggtttccggcacgctgcactgcgtgtcgcgcttttccggcaacgggcggacttatcgcagcaatacccaggctgacgcaccgcccgtcattgaaattcccccaactatcccccattctagatctcatgcataagcgccggacgcgcgcttcattcacccttttcaacaggacagcgcatatgaccaatccattattgacgcctttctccctgccgcctttttctgcgatcaaaccagagcacgtggtccctgcggtcaccaaagcgctggaggattgccgggccgcggtggaaagcgcggtggcgcatggcgcgccgtatagctgggaaaatctttgccagccgctggcggaagtggacgatgtgctgggacgcatcttctcgcctgtcagccatctgaattcggttaaaaacagccctgaactgcgtgaggcctacgaacagacgctgccgctgctctccgagtacagcacctgggtcggccagcatgaaggcctgtataaagcctatcgcgacctgcgcgatggcgataactacgccacgctgaataccgcgcagaaaaaagcggttgataacgcgctgcgcgattttgaattatccgggattggcctgccgccggaggcgcagaaacgctacggtgaaatcgccgcgcgcctctctgagctgggcaaccagtacagcaacaacgtcctcgacgccaccatgggctggaacaagctggtgaccgatgtcgccgatctggccggcatgccggaaagcgcgctggccgccgctcaggctcaggcgcaggccaaagagcaggaagggtatctgctgaccctggatattccgagctatctgccggtgatgacctactgcgataaccaggcgctgcgcgaagagatgtatcgcgcctattccacccgcgcctccgatcagggcccgaacgccgggaaatgggataacagcccggtgatggcggagatcctcgccctgcgtcacgagctggcgcagctgttgggctttgacagctatgcgtataaatccctcgccaccaaaatggcgaaggatccgcagcaggtgctcgatttcctcaccgacctggcaaaacgcgcccgtccgcagggcgaaaaagagctggcccagctgcgcgccttcgccaaagccgagtttggcgtcgatgagctgcagccgtgggacattgcctactacagcgaaaaacagaagcagcacctctacagcatcagtgatgagcagctgcgcccctatttcccggaaaacaaagccgttagcggcctgtttgaagtggttaagcgcatttacggtattaccgctaaagagcgtaccgatgtcgatgtgtggcatccggaagtgcgcttcttcgagctgtatgacgaacacaacgagctgcgcggtagtttctatctcgacctgtatgcccgcgagcataagcgcgggggggcgtggatggacgactgcgtcggccagatgcgtaaactggatggttccctgcagaagccggtcgcctacctgacctgtaacttcaaccgcccggtcaacggcaagccggcgctgttcacccatgacgaagtgatcaccctgttccacgagttcggccacggtctgcaccatatgctgacccgcatcgacaccgccggggtttccggcatcagcggggtgccgtgggatgcggtcgagctgccgagccagtttatggagaactggtgctgggagccggaagcgctggcgtttatctccggccattatgaaaccggagaaccgctgccgcaggagctgctggagaaaatgctggcggcgaaaaactaccaggcggcgatgtttattctgcgccagctggagttcggcctgttcgatttccgcctgcatgcggagtacaaaccggagcagggggcgaaaatccttgagaccctggccgagattaaaaagcaggtcgccgtggtgccggggccgacctggggccgcttcccgcacgcctttagccacatcttcgctggcggctatgcggcaggttactacagctacctgtgggccgacgtgctggcggcagacgccttctcacgcttcgaagaagaagggattttcaaccgtgaaaccggtcagtcgttcctcgacaatatcctgagccgcggcggttccgaagagccgatggagctgttcaaacgcttccgcgggcgcgagccgcagctggacgcgatgctggagcattacgggatcaaaggctga

SEQ ID NO: 3833 - DNA, 546 bp, Klebsiella pneumoniae
gggatctcgcttccctgcttgatgctggcaggctgcatgtgggaggccaataaacgcgggctggcaataatttcgacctgctgcttgcgctccagcgcggatagctccagctcaagcaagcgaccgttgatcttgccgatgttaaaccctgcgcgggtgctggcatcgtttaccgatacatcgctgcttagggtggtgatttgcccggagcctggcgggcttccggcttccgcaagccgccacttcacccccagctcacgaaggctggtttcgctcatcgacacgatatgggcggccagctccacctggccgaccggcagatccatctcctgcgcccaggccttcaacgccggcaggtgccgggcatcatcgcggatcagcagccgattagtccgcttgtccgccatcaggtgtcccctggcgctgagcagctttccgccgcttttagccagctcctcagcgtcggcaaagtgcagggtcacgctctccgcctgcaggggcaggttttgcaggcgtttctcctgttcggcttcacgctgcgcctga

SEQ ID NO: 3834 - DNA, 273 bp, Klebsiella pneumoniae
cgccacccacgatggacgccactggcgacgctaccccgaaccacaccggttaaccacccgcgaggagcaagcctgatgatgtctctcgccgatattctgcaactggtggtgctctgcgccctgctattttttccgctgggctacctgacgcgccactatcagcgccggatccgcacgacgttaagactgatgttctttaaaccccgttacgtgaaaccggcaggggtattacgccggggaacaacggttaagcaaggcaaagcgaacaaatga

SEQ ID NO: 3835 - DNA, 282 bp, Klebsiella pneumoniae
gccatgccacgttctctcaagaaaggtccttttattgacctgcacttgctgaagaaggtagagaaagcggtggaaagcggagacaagaagcccctgcgcacttggtcccgtcgttcaacgatctttcctaacatgatcggtttgaccatcgctgtccataatggtcgtcagcacgttccagtatttgtttccgacgaaatggtcggtcacaaactgggtgaattcgcaccgactcgtacttatcgcggccacgctgctgataaaaaagcgaagaagaaataa

SEQ ID NO: 3836 - DNA, 423 bp, Klebsiella pneumoniae
ggagcgtcgctgatgttacaaccaaagcgtacaaaattccgtaaagtgcacaaaggccgcaaccgtggtctggcgcagggtacggatgttagcttcggcactttcggtctgaaagctgttggccgtggtcgtctgactgcacgtcagatcgaagcagcacgtcgtgctatgacccgtgcagttaagcgtcaaggtaagatctggatccgtgtattcccggacaaaccgatcaccgagaagccgctggaagttcgtatgggtaaaggtaaaggtaacgtggagtactgggttgccttgattcagccgggtaaagtcctgtatgaaatggacggtgtaccggaagagctggcccgtgaagcattcggcctggcagcagcgaaactgccgatcaaaaccacctttgtaactaagacggtgatgtaa

SEQ ID NO: 3837 - DNA, 345 bp, Klebsiella pneumoniae
tcccacgcacgggaggagaaaaccatgaaagcgattctgtttctggcggcgctgatgccgcttggcgtattagcccagccgatcaatattaataacaaccctaaccagccgggttacgtggtccccagccagcagcgcatgcaaaatgagatgaagatccagcaacagcagcagcagagcatgctgaagcaggacctgaacaatcagacccgctcgcagcagcagcatttgcaaaaccagctgcagactaatcagcagcgcgcggcccagggcggcaatctgaatgcgccgcagcaggtgcggccaaataacaacggtgggatgctgcggcagactaatccgtaa

SEQ ID NO: 3838 - DNA, 2562 bp, Klebsiella pneumoniae
cccgttccgctccttcttcaccattttacgctgcgtgttcgaactgttctggctgacgtggaaaacccgtcgcagccagcgcaatcgggcaacagtggcgaaaacggcgcaggaggatgggacgttatgaagcgattaaccacgctggcgctgctggcagggatgctctctgcgcctgcgctacacagtgaagaaccgggctccggcgccgctgccccgctgagcttcccgcagctcaacgacgcggcggacagcgagcccggcgacgaacctccggctgcctcgccggaggagggcgcctctccggcagcccccgccaccgccggcgatgcggcggcgacggcccctgcgccggttatgccggacttacccccgccggtgagcggcacggccgcgccggaggtcattcctgtcgctccggtctggggaggcgatctgaatctggcgcagatggggatgccggacgggattatcctcagcggcggccagcgacagggtggggtcagctttaccctgcctgccgatcaggtggtgatccattctcagctcagccttgccgttcgcgtatcgccggagatggcgagccgcaacgccactctgcagctgatgctcaacggtcaaccgctcggcacgctgccgctgggcgccgatggcgaggatgtctcccattatcagctggatattccgcccgcgctgatggtctccagcaataacctgagcgtgaagatcaacgatggcgataccctgcagtgccagcgtgacattcatgatacgtcgcgggtgacggtgctgcccacgtcgcatttcagctgggaaagccagcagctgaacatcagcgacgacctgagccacttcccgcggcccttctttgacagcatgcagatgaccccggcggacattgcggtcgcctatggggccaagccgtcggcggacgtcttcagcgccgcggcgctgatctcctcctggctgggtatccaggcggactatcgcggcattgccttcagcgctctgcgcgaccgtctgccggaacgccacggcatcgtgattggccatccgggggagcaggtgggcggcatgatgctgccggaaaccgataagccgctgctgcgcatcatcgccaaccccgccaatccggcctataaactgctgctgattgtcggcaaaaacgatacggcgctgcgcatagccgcctggcggttaacccgcggcaactttgcgccgcaaaccgcgacgctggatgtcgaaccgcagaccatcccggttggcaaagcatatgatgccccgcgctggatccccaccgatcgtccggtcaagctcagcgagctgctgcgtaaggatcaaagcccgaccgtcagcggcgtctggcacgaacctttacgtatcgccttccgcgccgcgcccgatctctatctgtgggatggagagaccattccgctacaggttggctaccgcttcccgtcggaaagctggattaatgaggacaagtccttgctgagcgtcacgctcaacggcaccttcctcaacaacctgccgatgaacaagcaggggccgctggagaaagtctggcgctacctcgggggcgatgcgcgccaggagcgctttaccatcccgctggcgccctacctgatttacggcgataaccagctgtcgatgtacttcaatgtggtgccgaaggacgatgttccgtgttcggtgctgctgaataacaatatcaagagccggatcactgacgactcctggatcgatttgagcaagacgcgtcacttctcgctgttgcccaatctctcctactttgtcggcgcctcgttccccttctcgcggctggcggactattcgcagacgacccttctgctgccggcggacccgtctgaaacccaggtggcgaccctgctgaatctggcggcacgctccgggaacgcgaccggcaccgcgttggcgaataaccgcgtcgtgctcgggatgcccaccggcgggggggatttgcagtcgctgcgtgaacgtgacgtgctggcggtcaccgctctcgatcagcaggcctttaaccagagcctgctggccgactcaccctaccgcccggtagataatgtgctgagcgtccgcgagccagacctgtggcaaaaagtccagcgccggctcaccggcgactggacttccgccagcctcgacgccgatcgctacttttcgtcgagcagcgcctggcgcgggttcatcagctatcgctcgccgtggaattccacccgcctggtggtggtggcgctggccagcaatgatgaccagctggcgcgactgaagaccgatctggaatcgccgcgcattaacgccgggatccgcggcgataccgcggtgatcaccagcgataacggggtgcgcagcttccaggtgagtacgccgttccccagcggtcagatgccgtggtacatgatggcggtctggtatgccagccagcattcaggtttcctggcggtgctggggctgattgccacctcgataatgggactggcgctgaccgcgatgtttaaacgtcacgcccgtaagcgtctgggttcgggggataaccaatga

SEQ ID NO: 3839 - DNA, 306 bp, Klebsiella pneumoniae
ttgactattttactgggttataatacgcccatcagcgggggtctacaaggtacggcacaaacaccatacctgaaccgtcgcggcgccgtttcgcaaaagcaggcgggatatctcggcgacggtgctgccggtcgtgacgacatcatccaccagagcgatatggagtccctgcacggcaaattcaagctgaaaggcatttttcaggttctgcctgcgctggcgggcattgagcgaatgttggacggcgccggctcgctggcgagtcaggccttcgcgatgccagacgcatcctcgccagcgggctaa

SEQ ID NO: 3840 - DNA, 336 bp, Klebsiella pneumoniae
ttttttaaacgcgcggatctacactcgcgccgagtttatacatataccggagtaactatgagtcgctatcagcatactaaaggacaaattaaagataacgccattgaggcacttctccacgatccgttattcaggcagcgcgtagagaaaaacaagaaagggaaaggaagctatcaacgtaaagataaacatgcaggaaggattgatcgggaggccagtggcaagcaagcgaatcgcttttttaccactggccttctgctttctctgctgattaagaacggttgttttgttctttcagcagatcgcgaatttcgctcagcagaacttcttctttag

SEQ ID NO: 3841 - DNA, 663 bp, Klebsiella pneumoniae
atgaaaaaacgcgtacttatgattgcggcgctggtcagcggcactctggccatttctggctgcaccaccaacccctataccggtgaacgtgaagcaggcaaatccggtattggcgcaggtattggctccttagtgggcgctggcgtcggcgcgctctcctcttccaaacatgaccgcggcaaaggcgcgctgattggcgcagcggccggcgcggcgctcggcggcggcattggttactacatggacgtgcaggaagcgaagctgcgcgacaaaatgcagggaaccggggtcagcgtgacgcgaaatggcgacaatatcgtgctgaacatgccgaataacgtcaccttcgacagcaatagcgccaacctgaagccggccggcgccaacaccctgaccggcgtggccatggtgctgaaagagtatgagaaaaccgctgttaacgtggtcggctacaccgacagcaccggcagcaaggatctgaatatgcgtctgtcgcaacagcgtgcggacagcgtcgccagcgcgctcatcacccagggcgtggcggccaatcgcattcgcaccaccggcatgggcccggcgaaccctatcgccagcaacagcacagcggaaggcaaagcgcagaaccgtcgcgtggaaattaccctcagcccgctgcagtaa

SEQ ID NO: 3842 - DNA, 1359 bp, Klebsiella pneumoniae
ggcatgaaacgcgtgcgcttttcgccgcgcagctcatttgctcgcacactgctcctgatcgtcaccttgctgttcgtcagcctggtgacgacctatctggtggtactaaatttcgcgatcctgccgagtctccagcagtttaataaagtgttagcctacgaagtgcgtatgctgatgaccgacaaactgcagctggaggatggcacccagctggtggtgcccccggcgtttcgtcgtgaaatttatcgcgagctggggatttcgctctattccaatgaagcggcggaagacgcaggcctgcgctgggcgcagcattatgaattcttaagtcagcagatggcccatcagcttggtggccccacagaggtgcgggtagaggtcaataaaagctcccctgtggtgtggctgaagacctggctgtcgcccaatatctgggtgcgggtgccgctgaccgagatccatcagggcgacttctcgccgctgttccgctataccctggcgatcatgctgctggcgataggcggcgcctggctgtttattcgtattcagaaccgcccgttggtggatctggagcacgcggcgctgcaggtcgggcgcggcattattccgccgccgctgcgcgagtatggcgcctccgaagtgcgttcggtgacgcgcgcctttaaccatatggcggcgggcgtgaagcagctggctgatgaccgtacgctgctgatggccggggtcagtcatgatttacgaaccccgctgacccgcattcgtctggccaccgagatgatgggtgagcaggacggctatctcgcggagtcgatcaacaaagatatcgaagagtgcaacgccatcatcgagcagtttatcgactatctgcgcaccgggcaggagatgccgatggagctggcggatctgaatgcggtgctgggggaagtgatcgctgcggagagcggctatgagcgggaaatcgccaccgccctgcaggccggcgaaattccggtacgtatgcacccgctgtctatcaagcgcgcgctggcgaatatggtggtcaacgcggcccgctatggcaatggctggatcaaggtcagcagcggcagcgaagcgagccgggcctggttccaggtagaagatgatggaccggggattaaacctgagcagcgggagcacctgtttcagccgtttgttcgcggcgacagcgcccgcagcaccagcggcaccgggctggggttggcgattgttcagcgtattatcgacaatcacaacggccggctggagattggctccagcgaacgcggcgggttactgatccgcgcctggctgccggtgcaccggatgctggcgccgatgaaacccgccagggagagctga

SEQ ID NO: 3843 - DNA, 1476 bp, Klebsiella pneumoniae
aaaagaagacggcgcaggggctcagacgcttctgtgccagtaaacaatgtggaaagccgatcccggcggaataaatcagtgaacaataacctgccctcagaagccgtcgcccatgccgtggcggtcctgaaaaatgaacatgtcatcgcctatcccaccgaagccgtgtttggcgtcggctgcgaccctgacagcgaaacggccgttatgcgcctgctggagctgaagcagcgtcccgttgagaaaggattgatccttatcgccgccagctttgagcaactgaagccctatattgatgattcacggttaagtgactcacagcgggaagccatcttctcttgctggccgggaccggtgacgtttgtattcccggcgcgtcctgaaacgccgcgctggctgacaggacgttttgattcactggccgtacgcgtgactaaccatccgctggtaatcgaattgtgcgaagcctacggaaaaccactggtttcgaccagcgccaatctcaccgggcaaccaccgtgccgtactaccgcagaggtccatgctcagtttggcgacagcttcccggtggtggatggcgccacgggcggccggcaaaacccatctgaaatccgtgatgccctgacgggtgaactgtttccgccaggggtgaacccatggaaacctattgccgttttggtaatccgatcgcgcacagcaagtcgcctgctattcatcagctgtttggcccgccagttaggaattactcatccttatggacgtgtactggcgccgctggacgattttgtctcttctctgaatcagttctttgcagaaggaggaaagggggccaacgtcaccgttccttttaaagaggaagcctttgcgcgtgccgatgaactgacagaacgcgcagcgctggcgggagcagtaaacaccctgaaacgcctggaagatggccgtttactgggggacaacaccgacggtattggtcttctgagcgatctggaacgcctgggattcattaagccacgccaacggatcctgctggttggtgctggtggggcatctcgcggggttcttttgccgcttctgtcgctgggatgcgccgtcacgatcgtgaatcgcacctattctcgtgcccgtgagttagccactctcttcgcccataccgggagcgttagcgcaagggagatggataccttatccggggaaacattcgatctgatcgtcaatgcgacgtccagtggaatagacggtgatgtaccagctatcccggcatctattgtcaacgctgacgtatattgctatgacatgttttaccagaaagggccgacaccgtttcttcactggtgccagcaatatggcgcagtccactgtgccgatgggctgggaatgctggtggcgcaagccgcccatgctgttctgctatggcacggcgttctgccggctatcgctccggtcattgaaacgctgcagcaggaactgaatgcatga

SEQ ID NO: 3844 - DNA, 1059 bp, Klebsiella pneumoniae
ggaaggttgcgctttgtccgtgataaactgagaaaatgtttcccgttgatcacagtcaggacgatgaaaaagaaaagacccgtacttcaggatgtagccgatcttgtcggcgtgaccaaaatgacggtcagtcgctatttacgcaacccggagcaggtctccgaagcgctgcgtggcaagattgccgttgccctcgatgaactgggttatattcccaatcgcgcccctgacattctttccaacgccaccagccgcgccatcggcgtgctgctgccgtcgttaaccaatcaggtcttttcggaagtactgcgcggtatcgaaagcgtcaccgacgccttcggctatcaaaccatgctggcgcactacggctataagccggaaatggaagagaaacgcctcgaatcgatgctctcctggaacattgacggcctgatcctcaccgaacgcacccatacgccgcgcaccctgaagatgatcgaagtcgccggcattccggtggtggagctgatggacagccggtcgccgtgtctcgatattgccgtcgggtttgataactttgaagccgcccggcagatgaccgcggcgatcatcgcccgcggccaccgccatgtcgcctatctgggggcgcgtcttgatgaacgtactatcatcaaacagaaggggtacgagcaggcgatgcttgacgccgggatgacgccctacagcgtgatggtggagcaatcctcgtcctattcttcggggattgagctgatgcgccaggcgcgccgcgaatatccgcagctcgacggcatcttctgcaccaacgatgacctcgcggtcggcgcggcgttcgagtgccagcgtctggggctgaagatccccgatgatatggcgatcgccgggttccacggccatgatatcggccaggtgatggagccgcggctggccagcgtcctgaccccgcgcgagcggatggggcgcatcggcgccgaacggctgctggcgcgcattcgtggtgaagcgattacccctaagatgttagatttaggtttcacattgtcaccgggcggatcaatttaa

SEQ ID NO: 3845 - DNA, 1278 bp, Klebsiella pneumoniae
catcgtcagcgattcctcagccataaaagacagttcattcactctactctattgccagccagcaacaaggcagagcgctggataatgtgtatagttgattccagcctgtttgccgaaaaggaacccgacatgttgaccccttttaccgttttgatgcctgcaaatattcgttttggccgtggtcaggccgagagcgccgccccctggctggcgcaacagggcggcccaatcctgctggtgcatggcgccagcccgcagcgggcggcgtttctccgccagcagctggagacgctgcagcttgcggtcacgacgctggcgataagtcgcgaaccctggcttagcgatatcgagcagggcgtccagctggcgcgcgagaaagggatcagagcggtggtcagcctcggcggcggcgcggtgattgacgccggtaaggcgattgcggcgctggtccccgccgccggcccggtgatcgactatctggaggtggtgggaacgggccgtcagctggaagccagtcccctgccgttcgtggcgatccccaccaccgctggcacgggcgcggaggtcaccaaaaatgcggtgatcaacgttccggaacagcagcggaaagtgagcctgcgcgacgaccgaatgctgcctgacctggcgattgtcgacccggcgctaaccgacaacgcgccgcggagcatcaccctgagctccggcctcgacgccctgacccaggtgatcgagccctggctctgcagccgggccactcccttcaccgatgctctctgccagcaggcgatcccgcggggaattcgcgcgctaaaaatcctgatggaacaagagtgtccggccagccgcgacgagatggcctgggtcagcctgtgcggcggactggcgctggcgaacgccgggctgggggtgatccacggcctcgccggcccgctgggcggcctgagccgcgcctcgcacggcgccctatgcggcagtttgttgccgtttggcctggcgctcaatgagtcgcagatcaacgaccctggcctgcgccagcgcgttaacgatgtccgccgctggctggccgacgggctggacgtccctgtggatcaggtctgggacagtctgcgggaatggagccatcgcgctggccttggcaccctgcgcgacctcggcgtagcgcgcgatgcgctggaaccggccgcgctggccgccagcacctcctcatcgatgaaggccaacccggtcagcctgagcggcgaacagctgctggagatgctggaggcggcgtgggagtga

SEQ ID NO: 3846 - DNA, 1578 bp, Klebsiella pneumoniae
ccaggtcagcggcgtccggagctccgtcagcttgctggtgcccgattcgccgtcgcgtccacgcacgtccattcccccctgcagccagctgccggttttctcctgcagcgactccatcatggtgtccacctgacgcagcatccgcgtctgggcggtgtccaccggcagatcggtgcgctggatccccggcagcgtggaaccgggcgcggcggccgactgggcaacctgccacggcatgtactgcccgtaggcggaggccgtccgcgtcggcgccgacgtttgcgacacgccgataaaggggttatccgccgccagcaccccgccgacggtcggcgtttcgctactgttggtgctttgcatgcccagcagtttgccgcgggcgctgcgcagataggtcatcgcctgctgatgatgtccctgggcctccgccactctcgccagcagcagcaggcgatccggggagttatcctggcgcaaaccgccggccagctgttcagcgcgatcgttgttccccgccgacagcgccacgtcgatggccccggcgcgcgcatcctggttcggcgtatcgcgcgtcatcaggtagtcatagaccaccccggcctctttgttcattttgccgctctggtacagccgcgccatggcgaacatcagatcggtattttgcggatcgctttgcatagcgcggatcagcttgtcatacgccgcagcgtaattgccctgctcgcgcaggcggtcggcttcgttgatcacatagccattgcgaatgctcgccagctgcgtcggcgtactgctggcctgcagctgcggattgctgatcaggttctgcgcctcgccggtcagcccggcctgattcaggacagcgatctgatcggcgtaatccccggcattgccggatacgccgctgctgatattgttgcgcaccagcgagaccgcggtggtcaggtcgccgctctcggccagcagacgcgccagcttgccggcgtccgccggggcttttggcggcgtggaggccatcgcccgcagggtattgctggcggcgatggtattgccctgcgccaggtagttttcggccgtcaccaactgcaggttgtagttcacccgctggcgcaaatcgcgcatgtcgctggtctggctgccgccgggaatgcgcgccagcagcgtctgcgcctgctgccaggcgccgttttcgctggcaaacagggcggcggcatacagcgcactgttgctggcgccggggcgataggccgccgacatcagcgaagaggcctcgctgccgttacccgatttttgcagcagccgggccaggtcgaggcgcagccagggatcgtccggatagcgggcgacgccttcgcgcagggtggcaatggcgccggctgggttaccgccgctgacctgcgcctgggcctgacggcgcagggcatcgcccggcataccggccaccacccgcggctgcagtttttgccgcaggctctgcgggagcgtctgcagcatcgcctgcgcctcggcggatttattctgctcgcgcagcacgtaatagaggttttcccgcgccgccgcgttctgcggatcgtcatttaa

SEQ ID NO: 3847 - DNA, 2130 bp, Klebsiella pneumoniae
gttgctaagcggcgtattgctcccgcagtacgccgtttttgtttttccctcatgtggcgcaggctgatttaccacccggaagtcaactatgcactgcggcaaacgctggtgctgtgtctgcccgtggccatcggtcttctgctcggccatctccagcaggggctgttattttccttagtccccgcctgctgcaacattgccggtcttgataccccgcataagcgctttttcaaacgcctgattatcggcggctgcctgtttgccggatgcagtctggtggtgcagttgctgcttgcccaggcgatacccctgccgtttattctcagcggcctggcgctcttgctcggcgttaccgcggagatcagttcgctgcacgcgcggctgctgcccgcgtcgctgatcgccgccatctttaccctgagcctggcgggcaatatgcccatctgggagccgctgctgatctacgccttcggcacgctgtggtacggcgtgtttaactggttctggttctggctgtggcgcgaacagccgctacgggagtcgcttagcctgctttaccgggagctggcggactactgtgaagccaaatacagcctgctgacccagcataccgatccctcgaccgccctgccaccgctgctcacccgccagcagaaagtggtcgatctgattacccagtgctatcagcagatgcatatgctggccgctaaccaacgcaacgatcataagcgcctgctgcgggcgtttcagatggggctggatctgcaggagcatatttcggtcagcctgcatcagccggaagaggtgcaaaagctggtggaacgcagccatgccgaagcggtgatccgctggaacgcgcagaccgtcgccgcccgcctgcgcgtgctggcggatgacatgctctatcatcgctttccaaagcgctttcagatggataaacagatcgaggctctggaaaagatcgccagacaacatccggataacccggtcggccacttctgcgcctggcacttcagccgcatcgcccgggtgctgcatacccagcgcccgctgtatgcccgggacctgatggccgacaaagagcgtcgtttaccgctattgcccgcgctaaagaactacctgtcgctaaaatctcccgcgctgcgcaatgccgcccgcatcagcgtgatgctgagcgtcgccagcctgatgggcaacgccctgcacttgcctaagccctactggatcctgatgacggtgcttttcgtcacccagaacggctatggcgccacccgggtgcgtattgttcaccgggcggcggggacgctcgccggcctgacgatcgccgggctgaccttgcattttcacgttccggagagctacaccctgagcgggatgctgctgattaccctgctcagctatctgatcattcgcaaacactatggctgggcgatggttgggtttacggtgacggcggtatataccctgcagctgctgacgcttaacggcgaacagtttattatcgcccggctgatcgacacccttatcggctgcctgattgccttcggcgggatggtctggctgtggccgcagtggcaaagcggcctgctgaaaaaaaacgcccacgatgcgctggaggccgaccagcaggcaattcgcctgatcctcagcgccgatccaaaagcccccgcgctggcctatcaacgcatgcgcgtcaaccaggcgcacaacgcgctctacaactccctgaatcaggcgatgcaggaacccgggtttaatacccactatctggaagatatgaagctgtgggtgacgcacagccagtttatcgtcgaacacatcaacgctatgaccaccctggcccgggagcatacgatgctgaccccggatcttgcccagcgctatctcgaatcctgtgagattgcgctgcagcgctgccagcagcggctggacagcgatggtcccggcagcgcaggggatgccaatattatggagtcgccggaaagcgaggtgccgatcggtccgttaagcaccctggagcagcatctgcaacgcattctgggccatctgaacaccatgcacaccatttcgtcagtggcatggcgtcagcggccgcaccatggcatctggctgcggaagatcaaccgttaa

SEQ ID NO: 3848 - DNA, 1329 bp, Klebsiella pneumoniae
gctggaaagcgggggtgtaaaaaggagttaatcatggttaggcttgaaaaaaacgatccgctgatgctggcgcgtcaattacccatcaaatccgtggcgttgatcctcgcgggcgggcgtggcacccggctgaaggatctcaccattaagcgtgcgaaacctgccgttcactttggcggcaagttccgtattatcgatttcgcattatctaactgcattaactcagggatccgccgcatcggcgttattacccagtatcagtcgcacacgctggtgcagcacatccagcgcggctggtcgttcttcagcgaagagatgaacgagtttgtcgatctgctgccggctcagcagcgcgtgcatggcgaaaattggtatcgcggcacggcggatgcggtgacgcagaacctggatatcatcagccgctacaaggccgagtacgtggtgatcctcgcgggcgaccatatttataagcaggactactcgcgcatgctgatcgaccatgtcgaaaaaggggcgcgttgcaccgtggcctgcatgccggtgcccattgaagaggcatccgccttcggcgtcatggcggtcgacgaaaacgaaaaaatcattgagtttgtcgagaaacccgccaacccgccggcgatgccgaccgacccgaccaaatcgctggccagcatgggcatttatgtctttgacgccgcctatctttatgagctgctggaagaagacgatcgcaacgagaactccagccacgatttcggtaaagacatcattccgaagatcaccgaagctggcatggcttatgcacatcctttcccgctctcctgcgtgcagtccgacccgaacgccgaaccttactggcgcgacgtggggacgctggaagcctactggaaggctaacctcgatctggcgtcagtcacgccggagctggatatgtacgaccagaactggccgatccgcacccatatggaatcgctgccgccggcgaagttcgtgcaggaccgctccggtagccacggcatgaccttgaactcgctggtttccggggggtgcattatctccgggtcggtggtggtgcagtcggtgctgttcccgcgcgtgcgggtgaattcgttctgtaacattgattcggcagtcttgttgccagatgtctgggtggggcgctcatgccgcctgcgtcgctgcgtgattgaccgcgcctgtgttatcccggaaggaatggtgattggtgagaatgcggaagaggatgcacgccgcttctatcgctcagaggaaggtatcgtgctggtgacccgcgacatgctgcggaaattagggcacaaacaggagcgctaa

SEQ ID NO: 3849 - DNA, 744 bp, Klebsiella pneumoniae
ttttcccggcgacagggtgtgataccctgtcgcccattttccgctcgctggagagtcatcatgcactttgatatcgcctggcaggaggtcgataccgttctgctggatatggacggcacgctcctggacctcgccttcgacaactacttctggcaaacgctggtgcctgaaacctggggggccgcccgcggcctcaatttgcaggaggcgaaagacgccatgcgccaggagtatcacgccgtgcagcatacgctaaactggtactgtctggattactggagcgagcgcctgggtttggatatttgtgcgatgaccagcgaacaaggtccgcgcgccacgctgcgcgaggataccgtgccgttccttgatgcgctcaaggcctgcggtaagcgacgcattctgttgaccaatgcccatccccacaatctggcggtgaagctcaaacacaccggcctggacgcgcaccttgatttattactttccacccacacatttggttatccgaaagaggatcagcgtctgtggcgcgccgtggcggaggaaactggccttgaggcgcacaaaacgctgtttgtcgacgacagcgaggcgatactggatgccgcgagggagtttggcattcgttactgcctgggtattaccaatcctgactccggactggcggaaaagcagtatctgcgccatccggggctgaatgattaccgacgactgatcccttcgcttaccccgaaggagaggcgatga

SEQ ID NO: 3850 - DNA, 1212 bp, Klebsiella pneumoniae
gtccgcaggcgcaggatattttattctaacgacccagattcgtgcgtgggtcatctacagaacaggatgatgatgagcgattttttgcctttttcgcgcccgtcgatgggcgacgcagagctggctgcgctgcgtgaagttttagcgtcgggctggatcaccaccgggccgaagaatcaggcacttgaagcggcattctgccagctgaccggcaaccgtcatgcgattgccgtcagttcagcgaccggcgggatgcatgtgaccctgatggccctgggtattggccccggcgatgaagtcattacgccgtcccagacctgggtctccactctcaatatgatctgcctgctgggcgccacgccggtgatgatcgatgtcgataacgacaatctgatgattacccctgacgcggtggaagcggcgatcacttcgcgtaccaaagcgataattcccgtgcactacgcgggcgcgccagccgacatcgacgccattcgcgcggtgggcgagcgccatggcatttcggtgatcgaagacgccgcccatgcggccggtacccattataaagcccgccacgtgggctggcaggggaccgccattttctcgttccacgcgatcaaaaacatgacctgcgccgaaggcgggctgattgtcaccgacgacgacgagctggcctctcgcatccgtagcctgaaattccatggtctgggcgtggacgcttatgatcgccagacccacggccgcgcgccacaggcggaggtgatcaccccgggcttcaagtacaaccttgccgatatcaacgccgctctggcgctggtccagctggaaaaactgagccacgccaatcagcgccggacggagattgcccagcgctacctgcgcgagctggcggacacgccgtttaaaccgctgagcgtcccgacctgggatcaccagcacgcctggcatctgtttatcatccgcgtcgatgaggccgcgtgcggcataagccgcgacgcgctgatggaaaagctgaaggcgatgggcatcggcaccggcctgcacttccgtgcggcccatacgcaaaaatattaccgcgagcgcttccctgaggtttccctgccgaataccgaatggaatagcgcccgcatctgctctctcccgttgttcccggatatgaccgatgacgatgtcactcgcgttatctccgcactgcgccagttgtcaggacgttga

SEQ ID NO: 3851 - DNA, 1212 bp, Klebsiella pneumoniae
ctctattctagacaaaaccccctgcaattgacagtctcactgtccaatcgcaaagattgtcaataccgcttatggcagggggtaaggatgacgcccgacgagatttggctgcggctgatgaaggtcagtagcttgtatggcgacaggatggtagagatcgctcagcgcttatgcgcagccgccagcgttgatcgtgaagcgctgcatgccgtcgggatgaccgcggcgcaggcaaagttatttttccggcttgacgagcatgagcttgacgagacgcggcgctggctgggacaaccggatcatcatctgttacggggtgacgatccgcgctatccattgcggttaaaggctatcgctgattaccccggcgcgttgctggtcagcggcggcctcgccctgcttcacagcgcgcagcttgccgttattggcagtcgctcgcactcctggtatggcgcccgctgggggaaactgttcagcgaaacgctggcgcagaaagggattaccatcaccagtgggctggcgttaggcattgacggggtcgcgcaccgcggcgcgctggcggcggagggtaaaactatcgcggtactgggcaatgggctgagtcaggtttatccgcggcgccatgcaaccctcgcccggcagatcatcgacaatggcggtacgctggtatctgaatttccactcattacgccgccgcttcccgcacatttccccaggcgcaaccggattatcagcggcttaagcctgggcgtgctggtgattgaggcggcgttgcgaagcggatcgctggtcaccgtccgctgcgccctggagcagggaagggatgtgttcgccctgcctggcccgataggcaatccgggatcggaaggcccgcactggttaattaagcaaggcgcggtgccagtgacctcgccagaggatattgtggaatactggcataacgaactggcctggctgactgatacgtctgattcgataaatatttgcgtcgatcagccgtctgtagcattgccatttccggagctcctggctaacgtaggagatgaggtaacacctgttgacgttgtcgctgaacgtgccggccaatctgtgccagtaaccgtagctcagctacttgaactggagttagcaggctggatcgcagctgtacccggcggctatgtccgattaaggagggcaagccatgttcgacgtactcatgtatttgtttga

SEQ ID NO: 3852 - DNA, 582 bp, Klebsiella pneumoniae
tcacagcatagaccgatgacaatgagcaaatcattacaaaaacccaccattctcaatgttgaaactgtcgcccgttcgcgcctctttaatgtcgaaagcgtcgatctggagttcagcaacggtgtgcgtcgcgtttatgaacgtatgcggccttccacccgtgaagcggtgatgattgtgccgattgtggatgatcacattattttgattcgtgagtatgccgtggggacggagtcctacgagctgggcttctccaaagggctgattgatccaggtgaaaccgtggatgaagcggccaatcgcgagctgaaagaagaggttggctatggcgccaacaagctgacgtttttgaagaagctcagtatggccccctcctacttctccagcaaaatgaatatcatggtggcggaagatctctatccggagtcactgccgggcgatgaacctgagccgctaccgcaggtgcgctggccgctggcgcagctgatgtcgctgctggatgaagaagattttaacgaggcccgtaacgtcagcgcgctgtttttagtgcgggaatggctgcaggcccagggccgactctga

SEQ ID NO: 3853 - DNA, 780 bp, Klebsiella pneumoniae
aggtcgtgcagatcgcatcctgaagcgcaccagccacatcactgtggttgtgtccgatcgctgagactctggagactagcaatgggtcagaaagtacatcctaatggtattcgcctgggtattgtcaaaccatggaactctacctggttcgcgaacaccaaagaattcgctgacaacctggacagcgattttaaagtacgtcagttcctgactaaagaactggctaaagcgtctgtatctcgcatcgttatcgagcgtccggctaagagcatccgtgtgaccattcacaccgctcgcccgggtatcgttatcggtaagaaaggcgaagacgtagaaaaactgcgcaaggtcgtagcggatatcgctggcgtacctgcacagatcaatatcgccgaagttcgtaaacctgaactggacgcaaaactggttgctgacagcatcacttctcagctggaacgtcgcgttatgttccgtcgtgcgatgaagcgtgctgtacagaacgcaatgcgtctgggcgctaaaggtatcaaagttgaagttagcggccgtctgggcggcgcggaaatcgcacgtaccgaatggtaccgtgaaggtcgcgtaccgctgcacactctgcgtgctgacatcgactacaacacctctgaagcgcacaccacttacggtgtaatcggcgttaaggtatggatcttcaaaggtgagatcctgggtggtatggctgctgttgaacaaccggaaccggctgctcaacctaaaaagcagcagcgtaaaggccgtaaataa

SEQ ID NO: 3854 - DNA, 612 bp, Klebsiella pneumoniae
gacttgagcagagagatgaaaaaaccaaaccacgcgggcagcggtcagatccgcatcatcggcgggcaatggcgcggccgtaaattaccggtgccggagagcccgggcctgcggccgaccaccgaccgggttcgcgaaaccctttttaactggctggcgccgtccattgttgacgcgcactgcctcgattgctttgccggcagcggcgcgctggggctggaagcgctgtcccgctatgcggccagcaccacgctgctggagatggagcgcggcgtagcccagcagctgcaaaaaaatctcgccaccctgaaagcggatcgcggcaaggtgatcaccaccaacaccctcagcttcctgagccagccggggaccccgcaccagatcgtgttcgtcgacccgccgttccgtcaggggctgctggaggagacgctacgtctgctggagacacaaggctggctggccgatgaggccctggtgtacgtcgaaagcgaagtcgaaaacggcttaccgccggtgccggctaactggcaattgtatcgtgaaaaagtggccggacaggtcgcctaccgtctttaccaacgtgaggcccaaggagagcaccatgctgattaa

SEQ ID NO: 3855 - DNA, 1050 bp, Klebsiella pneumoniae
ggtgttggcagattttcagcaaaggaagccaccatggcgaaagcggcgcgtgcaactatcagcgatgtggcgaaagccgcaaagaccggcaaaaccagcatttcacgttatcttaacggcgagaagcatctgctttccgacgacctgttatcacgtattgaaaaagccattgccgaactcgactaccgccccagcctgatggcccgcggcctcaagcacggccgaacccgcctcatcggcctgatcatcgccgatatcaccaatccctactcggtcaacgtcatgagcggcattgaagcagcctgccgggaaaagggcttcaccctgctggtgtgtaataccaataacgagctcgatcaggagctgcactacctggacctgctgcgcagctaccaggtggagggtattgtcgtcaacgcggtcggcatgcgggaggatggtctgaaccgcctgcagcagtcggccctgccgatggtgctgatcgaccgtaaaatccccgatttcgcctgcgatgtggtcgggcttgataacgcccaggccgccaccaccgccaccgaacatctggtggaaaaaggattcgaggccatcctgtttctcagcgaaccgctgggctcggtgaatacccgtcgcgagcgcctgagcgcctttcgcgccacgcttgcccgccaccacggcgtggtggcagaaaacgccgaggtgcagcttaacgacggcgcgatgctggacaacgtcctgcgtcagttccatgcccgccaccgcgggatgcgcaaagcggtcatctccgccaacggcgcgctgacgctgcaggtagcccgcgccctgaagcgcgtcggcctgatctgggggagcgatatcggcctgctgggcttcgacgaactggagtgggcggagctggccggcgtcggtattactaccctcaaacagccgacgtggcagatcggctacgcggcggtcgaacaggttattcggcgcattgccggcactaacgaccccatccgcgaacgggtattttccggcgagcttatcgtccgcggatcaacctcccgttaa

SEQ ID NO: 3856 - DNA, 534 bp, Klebsiella pneumoniae
ttcgtcggcagctgcatgccgcccgccagctcaaagcgaccgccgtcatcgctgatgcgcccttccagcaggttcatggccgggctgccgataaagctcgccacaaagcggctggctggcttctcatacacttccaccggggtgccgatctgctcggcaacgcctttgttcatcaccatcacccgctgggcgagggtcatcgcctccacctggtcatgggtgacgtacagcgaggtggttttcaggcggcgatgcagctgctgcagttccagacgcatctgcacgcgcagcttggcgtcgaggtttgacaacggttcgtcgaagaggaataccgccgggtcacgcacgatggcgcggcccatcgccacgcgctggcgctggccgccggacagttcccgcgggcggcgcttgagcagaccatccagctcaagaatgcgcgccgcctcctgcacccgctcggcgatcaatcccttacccatgccgcgaatcttcagcccccacgccatgttctcttccacgctcatatgcggataa

SEQ ID NO: 3857 - DNA, 507 bp, Klebsiella pneumoniae
tcggcaggcagggtaaagctgaccccaccctgtcgctggccgccgctgaggataatcccgtccggcatccccatctgcgccagattcagatcgcctccccagaccggagcgacaggaatgacctccggcgcggccgtgccgctcaccggcgggggtaagtccggcataaccggcgcaggggccgtcgccgccgcatcgccggcggtggcgggggctgccggagaggcgccctcctccggcgaggcagccggaggttcgtcgccgggctcgctgtccgccgcgtcgttgagctgcgggaagctcagcggggcagcggcgccggagcccggttcttcactgtgtagcgcaggcgcagagagcatccctgccagcagcgccagcgtggttaatcgcttcataacgtcccatcctcctgcgccgttttcgccactgttgcccgattgcgctggctgcgacgggttttccacgtcagccagaacagttcgaacacgcagcgtaaaatggtga

SEQ ID NO: 3858 - DNA, 1635 bp, Klebsiella pneumoniae
aaaaggggcagggagagtttagcgttttttacccatcgctgcggcgagggcatccatcatcgcgctgttgccggcaggctgcgcctcgcgaccgcggggtttggcggctttcgcggccgggcgatttccctgcgggcgctcctgaccaccgccgcggcgggcgttgctgtcgcccggctgctcgtcgagacgcatggtcagggcgatacgcttacgcggcagatcgacttccatcactttgaccttgacgatgtcgcccgctttcaccacggtgtgcggatcctcaacaaaccggtcagaaagcgacgaaatgtgtaccagtccgtcctgatgaacgccgatatcaacaaacgcgccgaagttggtgacgttggtgacggcaccttccagaatcattcccggcagcaggtcattcatggtctccacaccatcggcgaacttcgcggtcttaaactccggacgcggatcgcggcccggtttttccagctctttgataatgtcggtgaccgtcgggacgccaaacttctcatcggtgaagtccactgccttcaggtggcgcagcgcactgctattgcccatcagatctttcagcgcctgctgggtggcggccagaatacgttcgaccaccgggtaagcttccgggtgaacggtggaggcatccagagggttgtcgccgtggttgatacgcaggaagcccgcgcactgttcaaaggctttcggccccagacggctgactttcagcagctgctggcggttctggaactgaccattctcgtcgcgccaggcgacgatgttctgcgccatcatgcgggtcaggccggcgacgcgggtcagcagcggaacggaggcggtgttcaggtcaacgccgacggcgttcacacagtcttccaccaccgcgtccagcttacgcgccagctgggtctggctgacgtcgtgctgatactggccgacgccaatggatttcgggtcgattttcaccagctcggccaggggatcctgcagacggcgggcgatggagaccgcgccgcgcagcgacacgtcgaggtccggaaactcctgcgccgccagctcggaggcggagtaaacggaagccccggcttcgctgacgatcaccttctgggcggtgaccttcgggaactgtttctgcacgtcgaggaagaaacgctcggtttcacgcgaggcggtaccgttgccgatggccaccagctcaacgttgtacttctcacacagcgcggcgacggcgacggccgctttggcggcctggccggtgtggggatagatggtatcggtggcgaccagtttaccggtggcgtcgacgacggccactttcaccccggtgcgcaggcccggatcgagtcccatggtggcgcgcagcccggcgggcgcggccatcagcagatcgtgcaggttgcgggcgaagacgttgattgcctcgtcctccgcgcgttcgcgcacggtgcccatcagctcggtttcgagatgcatcaggactttgatccgccaggtccagctgacgacgcctttacgccagctgtccgccggggcgttattcaggcgcaggcccaggtggtcgataataatttgctcgccgtggctctctttcggcggctcgtcaaactgcgggtcagcgtttaa

SEQ ID NO: 3859 - DNA, 255 bp, Klebsiella pneumoniae
tcgcgccaaagcggcccttatcaatggctatttgccacaggccgtcgcggtctgccaggcgtacgttctgaatcaaccaaagcggcgctgctgtcatatcaccctctctattcaatacggcttgttttctgtctaaccccaatcgcggcttacccaattcttgtacacaaaatcagcaaaaaggaaaagtcagcgttttccatgacttataaaaatactgacaaatcaaacgcatacccattaagtggtaggtga

SEQ ID NO: 3860 - DNA, 1698 bp, Klebsiella pneumoniae
gcaaggcaaagcgaacaaatgacaaataaaaaaacgaccgcggcaccgcttccgctctggcagtactggcgcggccttggcggctggaacttctactttctggtcaagtttgccctgctgtgggccgggtatctcaatttccatccgatgctgaacctggtatttctcgcctttctgctggtgccgatcccgcgcgaaaagctacaccgtatccgccactggatcgctattccgctgggattcgcgctgttctggcacgatacctggctgcccgggccagagtcgatttttagccaggggtcgcaaatcgccggcttcagcgccagctatatctgggatctgattgtccgctttatcaactggagcatggttggcgccttctttgttttgctggtgctatggttgtttatcagccagtggctgcgcgtcaccgtgtttgtctcggcaatggtcgtctggctggcggtcagcccgctgctgccggcctttaccctatggccctccggtcagcccaccacggccgccgccacgaccgcacaggccaataccggggccaacgccgccgctggcgccgcgtccagccccgccaacagcgatattccgccgcagaccgagccgccgacctcagccaacctgaccaactggctgaacgctttctatgccgccgagcagaagcgcaagacgccgttcccggaccagctgccggcggatgcgcagccgtttgacctgctggtgatcaacatctgctccttctcctggtcggatattgaagccgccggtctgatggatcatccgctatggaagcactttgatattgtcttcaaaaactttaactccgcgacctcatacagcggcccggcggcggtgcgcctgctgcgcgccagctgcggccagctgtcgcatactaacctgtatcagccgtccggcgccgactgctacctgtttgaaaacctggcgaagctcggcttcaaccagcagctgatgctcggccataacggtctgttcggcgacttcctgaaagagctgcgttcgctgggcggtatgcagagtccgctgatggaccagaccggcctgccggtcagcctgcaggcgtttgacggctccccggtgtatgaggatctggcggtcctcaaccgctggctgaagaccgaagaggccagcagcaatccgcggaacgccaccttctataacaccctgccgctgcatgacggcaaccacttcccgggacaaagcaaaaccgcagactacaaagtgcgggcgcagaagctgtttgatgacctggataacttcttcaccgagctggagaaatcggggcggaaagtgatggtggtggtggtgccggaacacggcggcgcgctgaagggcgataagatgcaggtatctggcctgcgcgatattccaagcccgtcgatcactaacgtcccgacggcggtgaaattcttcggcatgaaggcgccgcatgaaggggcgccgattatcatcgatcagcccagcagttatctggcggtgtcggagctggtggtgcgcgctctcgacggcaaaatgttcagcgaggacagcgtcaactggcagcagtatgtcgccaacctgccgcagagcgcggcggtgtccgagaacgccaacgccatcgtcatccagtatcagggcaagccttatgtccagctgaatggcggtagctgggtgccttatccgcaataa

SEQ ID NO: 3861 - DNA, 4056 bp, Klebsiella pneumoniae
ccaatgaaaagaaaaataataataacgatgaaaaacacccgtcggctcaccacgttctgcctcaccggcgcgttgactctcgctgcctcgggcggcgcgctggcggcggggaacgacgcggcgctacaggcgctgttcgctcaggccaactactggcatgagaaatctcatgacgagctggcgatggagtccctgcagaaggtgctctcggtggatgccaacaacacccaggcgctgtatctgatggcgctctggtcgcagcagggcggcgatatgcaggcggcggcgcagtggcgcgcgcggctggcgaaagcggcccctgacagcccgggactacaggatctggacaacgccaaaaagatgtcgcaggtgccgcagggccagctcaacctggcccgccagcaggcgcgcggaggcaatatccccggggcgctggcgacctggcgcagcatgttcaatggcaatacgccgcctgccgggctggcggcggaatattacctgaccatggccagcgacaaatcgctctatccgcaggctatcagcgagctgcgccagtacgtggcgcagcatccgcaggagaacgccccgcgggtggcgttgggcaaagcgttaacctggcgggaagagactcgccgggaagggatcgccctgctcgagccgatggccagcggcaataaagaggcggacagcggcttgcgccaggcgctgctctggctgggcccgcaggccggggatgagcagtattacgacacctggatgcagcggcatccccaggacagcgaagttcagaattactttcgcgaacggcgcagcggtcaggcgcgcggccagggctacgccaatctcaacagcggcaataccgccgccgcgaagcagcagtttgaagaggtattgcagaccaacccccaggatgccgatgcgctggcgggcatgggctatatcgcccagcgcagcggcgactaccaggccgcgtcgcagtatctgagccgggccgcggacctcggcggcgacgcctcggctacccgtcgtcagcaggcggccgatgcgctgttctacggccagctggcgcaggcccagcaggcctataagcagggcaatatcagccaggcgctggcgctctccgcgccgttggcgcagcagagcggggcgcagggcgcctcggcgaagctgttccgcgccgatgtgctgcggcacaacaaagatttgccccaggcggagcaaacgctgcgctcactgttaaatgacgatccgcagaacgcggcggcgcgggaaaacctctattacgtgctgcgcgagcagaataaatccgccgaggcgcaggcgatgctgcagacgctcccgcagagcctgcggcaaaaactgcagccgcgggtggtggccggtatgccgggcgatgccctgcgccgtcaggcccaggcgcaggtcagcggcggtaacccagccggcgccattgccaccctgcgcgaaggcgtcgcccgctatccggacgatccctggctgcgcctcgacctggcccggctgctgcaaaaatcgggtaacggcagcgaggcctcttcgctgatgtcggcggcctatcgccccggcgccagcaacagtgcgctgtatgccgccgccctgtttgccagcgaaaacggcgcctggcagcaggcgcagacgctgctggcgcgcattcccggcggcagccagaccagcgacatgcgcgatttgcgccagcgggtgaactacaacctgcagttggtgacggccgaaaactacctggcgcagggcaataccatcgccgccagcaataccctgcgggcgatggcctccacgccgccaaaagccccggcggacgccggcaagctggcgcgtctgctggccgagagcggcgacctgaccaccgcggtctcgctggtgcgcaacaatatcagcagcggcgtatccggcaatgccggggattacgccgatcagatcgctgtcctgaatcaggccgggctgaccggcgaggcgcagaacctgatcagcaatccgcagctgcaggccagcagtacgccgacgcagctggcgagcattcgcaatggctatgtgatcaacgaagccgaccgcctgcgcgagcagggcaattacgctgcggcgtatgacaagctgatccgcgctatgcaaagcgatccgcaaaataccgatctgatgttcgccatggcgcggctgtaccagagcggcaaaatgaacaaagaggccggggtggtctatgactacctgatgacgcgcgatacgccgaaccaggatgcgcgcgccggggccatcgacgtggcgctgtcggcggggaacaacgatcgcgctgaacagctggccggcggtttgcgccaggataactccccggatcgcctgctgctgctggcgagagtggcggaggcccagggacatcatcagcaggcgatgacctatctgcgcagcgcccgcggcaaactgctgggcatgcaaagcaccaacagtagcgaaacgccgaccgtcggcggggtgctggcggcggataacccctttatcggcgtgtcgcaaacgtcggcgccgacgcggacggcctccgcctacgggcagtacatgccgtggcaggttgcccagtcggccgccgcgcccggttccacgctgccggggatccagcgcaccgatctgccggtggacaccgcccagacgcggatgctgcgtcaggtggacaccatgatggagtcgctgcaggagaaaaccggcagctggctgcaggggggaatggacgtgcgtggacgcgacggcgaatcgggcaccagcaagctgacggagctccggacgccgctgacctggtcatcctcgccgtttggcgactcgcgctttgactttaccgtcaccccggtgtcgttgaacgccgggaccgccagcggcgacgcctggcgtcgctacggcgctaacccgctggctaacgcggtctccaacatggtgagtaccgccaccagcgagcaggcggcgatcgcctcgatgaccgaggcggagcggacggcctatttcgccagcaatccaggggccgaggcgttaagcggcctcggcaccctgaacgcggcagatttcaatccgaccaccagcagcgggatggaaaacctggcgaagctcgggagctatgatgcggggcaggtggccagctatctctcttcgtccagccgcaagccgaacgttgaccagaccagcggctcgaccgattcgcagaaggccaacggcgtcgaactggcgctggcgttaagtggtgacgattaccgggtcgatatcggcagcacgccgctgggccaggatcttaataccgtagtcggtggggtgaaatggtcgcccaagctgaccaactatctgtcgctgatcctcaccggcgaacgccgctcgctaaccgacagcctgctttcctacgtgggtctgaaagacgcctattccgggaaaaactgggggcaggtgacgaaaaacggcggcaccctgcagctaagctatgacgacggcgacgcgggcttctatgtcggcggcggtggatacagctatctggggcagaacgtcgccagcaacaccagtatcaacgccaatgccggggtctatcttcgtccctaccatgacgaataccgccagctgcaggccgggttgagcatgagctatatggattactccaaaaacctcagctacttcacctatggtcaggggggctactttagtccgcaaaactacgtcagcgtatcgctgccggtcagtctgacggagaaatatgataactggaccatgaagctcggcggctcggtgggctatcagtcttacagtcaggataagagcgcctatttcccgaccaattcggagtggcagcagaccctggagacggcggtgagcaatgggtttgccaaggaagcctactactccgcgacctcgaagagcggcatagggtataccctgcgcgccggggcggattacaaggtcaacaaacaaatgaccctggggggccagattggctatgacaccttcggggattataacgaaagcaccgccgggctctatattcgctatatgttaggagatcattga

SEQ ID NO: 3862 - DNA, 1536 bp, Klebsiella pneumoniae
gaatgcggaagaggatgcacgccgcttctatcgctcagaggaaggtatcgtgctggtgacccgcgacatgctgcggaaattagggcacaaacaggagcgctaatgcaggtcttacatgtatgttctgagatgttcccgctgttaaagacgggcggtctggcggacgtcatcggcgcactgccggcggcgcaaatcgcggagggtatcgatacgcgcgtgctgttgccggcgtttcccgatatccgtcgcggcgtggtggatgcccaggtggtgacccgccgggataccttcgccgggcggatcacgctgctgtacggccactttaacggcgtggggatctacctgatagacgccccgcatctctatgaccgtccggggagcccttaccacgataccaaccagcacgcttatcccgacaacgtcctgcgctttgcgctgctgggctggatgggaagtgaaatggccagcggactggatccgttctggcgcccggatgtggtgcatgcccatgactggcacgccggcctgacgccggcctacctggcggcgcgcggacgcccggctaaatcggtgtttaccgtgcacaacctggcgtaccaggggatgttttactcctggcatatgaatgacattgagctgccttggtcgttctataacatgcatggcctcgagtttaacgggcagatctcgtttctcaaggccggcctctactacgccgaccatattacggcggtgagcccgacctacgcgcgcgagatcaccgagccgcagtacgcctacggcatggaggggctgctgcgccagcgccatcatgaaggtcggctgtcgggaattctcaacggcgttgacgacggtatctggagcccgcaaaacgatctgctgctgccgatgcgctacgatcgcgacacgctggaggagaaggcggagaacaagcgtcagctgcagattgccatgggcctgaaggtcgatgataaagcgccgttgtttgccgtcgtcagccgtcttaccagccagaaagggctggacctggtgcttgaagcgctgccgggtctgcttgagcagggcgcccagctggcgctgctgggcgccggcgatccggtgctgcaggaagttttcttcgccgccgccgccgaacacccgggcaaagtgggtgtgcagattggctaccatgaggccttctcccaccgcattatgggcggcgccgacgtcattctggtcccgagccgctttgaaccctgcggcctgacccagctgtatggtctgaagtacgggacgctgccgctggtgcgccgcaccggcggtctggcggacaccgtcgctgacagttcgctggagaatctggccgatggtctggcgacagggtttgtctttgaggacagcaatgcgctgtcattgctgcgcgctatccgtcgcgcctttgtcctctggtcgcgcccgtcgctctggcgctacgtgcagcgtcaggcgatgaatatggattttagctggcaggttgccgcgaactcctatcgcgaactttatcaacgcttgatgtaa

SEQ ID NO: 3863 - DNA, 399 bp, Klebsiella pneumoniae
agacagatgagcatgcaagatccgatcgcggatatgctgacccgtatccgtaacggtcaggccgcgaacaaagctgcggtcaccatgccttcctccaagctgaaagtggcaatcgccaacgtgctgaaggaagaaggttttatcgaagattttaaagttgaaggcgacaccaagcctgaactggaacttactctcaagtatttccagggcaaagctgttgtagaaagcattcagcgtgtcagccgcccaggtctgcgcatctataagaaaaaagatgagctgccgaaagttatggccggtctgggtatcgcagttgtttctacctctaaaggtgttatgactgatcgtgcagcgcgccaggctggtcttggtggcgaaattatctgctacgtagcctaa

SEQ ID NO: 3864 - DNA, 1323 bp, Klebsiella pneumoniae
cggccggtgagctggacatcgtcacgtcttcgggatgtgaaccgccagcgtggcgctggcaacgtgaagggaaacaacatgatgcgatggataagcctgctgcttctgctgctgccgctggcggtggcccccgccgcccgcaatgataaaccggtttcgctggtgattgacgatgcgccagtggcccaggtgctgcaagctctggccgaaatgaaccataagaacctcgtcgtcgcgccggacgtcagcggcacgctctccctgcgtctgcagaaggttccctggagccaggcgctgcgggcggtagcggatagcgcgggtctctctttgcaacagcagggtacggtcatctacgcgcacactcaggcctggcaaaaggcaaatcaggcgcagcgtgaagccgaacaggagaaacgcctgcaaaacctgcccctgcaggcggagagcgtgaccctgcactttgccgacgctgaggagctggctaaaagcggcggaaagctgctcagcgccaggggacacctgatggcggacaagcggactaatcggctgctgatccgcgatgatgcccggcacctgccggcgttgaaggcctgggcgcaggagatggatctgccggtcggccaggtggagctggccgcccatatcgtgtcgatgagcgaaaccagccttcgtgagctgggggtgaagtggcggcttgcggaagccggaagcccgccaggctccgggcaaatcaccaccctaagcagcgatgtatcggtaaacgatgccagcacccgcgcagggtttaacatcggcaagatcaacggtcgcttgcttgagctggagctatccgcgctggagcgcaagcagcaggtcgaaattattgccagcccgcgtttattggcctcccacatgcagcctgccagcatcaagcagggaagcgagatcccctatcaggtttccagtggcgaaagcggcgccacttcggtggagttcaaagaggcggtgctgggcatggaggtcacgccgacggtgctgcagcagggaagagtgcggcttaagctgcgaataagcgagaatacgccaggccaggtgctgaagcaggaaaacggcgaagcgctggccatcgataagcaggagatagagaccctggtggaagttcgcagcggcgagactttagcgttgggcggcatcttttcgcagaaaaacaaaaccgcccgcgacagcgtcccgctgcttggcgatatcccggtactaggacgtctgttccgtcgtgacgggaaagataatgaacgtcgcgaactggttgtctttattacgccacggattctggcagtacgttaa

SEQ ID NO: 3865 - DNA, 1002 bp, Klebsiella pneumoniae
agcagtaagaggttcgagatggcgttattgaatgtagataaattatcggtgcatttcggcgatgaaaacgcgccgttccgcgccgtagaccgcatcagctatagcgtgaagcagggtgaagtggtcggtatcgtcggggagtccggctccggtaaatccgtcagctcgctggcgattatggggctgattgactatcccggccgggtgatggcggacaaactggaatttaacggccgcgatctgcagcgcatttctgaaaaagagcggcgccagctggtgggggcggaagtggcgatgatcttccaggatccaatgaccagcctcaacccttgcttcaccgtcggctaccagattatggaagcgattaaggtccatcagggcggtaataagcaaacccgccgccagcgggccatcgacctgctgaacctggtgggcattcccgatccggcctcgcggctggacgtctatccgcatcagctttccggcggcatgagccagcgcgtgatgatcgcgatggcgattgcctgtcggccaaaactactgattgccgatgaaccgaccaccgcgctggacgtgaccattcaggcgcaaatcattgagctactgctggatctgcagcagcaggagaatatggcgctggtgctgatcacccacgacctggcgctggtggcggaagccgcgcataaaattatcgttatgtacgcgggtcaggtggtggagaccggtgacgcgaaagatatcttccgcgcgccgcgccatccttatacccaggcgctgctgcgcgcgctgccggaattcgcccaggataaagcgcgtctggcctcgctgccgggcgtggtgccggggaaatatgaccgtcccaacggctgcctgcttaatccgcgctgcccctatgccacggataaatgccgtagcgaagagccggcgctcgcggatctgaccggcggccgccagtctaaatgtcactacccactcgatgatgccgggaggcctggattatga

SEQ ID NO: 3866 - DNA, 648 bp, Klebsiella pneumoniae
ctgccgaagaggcgctggcgcgtctggcgacgttgcggagggagtatgagcgataaattcggcgatgaacgcgatccttatctctatccggcgctgaacgtgctgcgcaaccgtctcggcatccgccaggctaaaaatctgcagcaggccgcctttgagatgacagcgctgcgggcggccactctgccgctgggcccgcgggtgcgcggcttaccctatctgtgcgctattcatcatcagttgtatcaggatctgtttgactgggcgggccgcttgcgtgaagtgaacctctacctgggcgatacgccgttctgccactttgcccggatcgaggaggaggggaatgccctgatgcaggcccttgagcaggaggattatctcagtggcctgccgcgcgataccttcatcgaacgcctgagctggttctatggtgaaattaatgtgctgcacccttttcgtcttggcaatggcctgacccagcgcattttctttgaacagctggcgatacatgccggctaccttcttaactggcgtgacgttgaccccgccggctggagtgcggcctgccagcagagcgcgatgggcgatctggccccgctggtggcgatctttcgcaaagtggtaagcgaagcgcgggaatctgagtag

SEQ ID NO: 3867 - DNA, 333 bp, Klebsiella pneumoniae
aataattggagctctggtctcatgcagaaccaaagaatccgtatccgcctgaaagcgtttgatcatcgtctgatcgatcaatcaaccgcggaaatcgtcgagactgctaagcgcactggtgcgcaagtccgtggtccgatcccgctgccgacccgcaaagagcgctttaccgttctgatctccccgcacgtcaacaaagacgcgcgtgaccagtacgaaattcgcactcacaagcgtctggttgacatcgttgagccaactgaaaaaaccgttgatgctctgatgcgtctggatctggctgccggtgtagacgtgcagatcagcctgggttaa

SEQ ID NO: 3868 - DNA, 846 bp, Klebsiella pneumoniae
gtaagtcggaggagtaatacaatggcagttgttaaatgtaaaccgacatcttcgggtcgtcgccacgtcgttaaagtggttaacccaaagctgcacaagggcaaaccttttgctccggtgcttggaaaaaaacagcaaaatccgggggtcgtaacacccatggcccggattaccacccgtcatatcggtggtggccacaagcaggcttaccgtattgttgacttcaaacgcaacaaagatggtatcccggcagttgttgaacgtcttgagtacgatccgaaccgctccgcgaacatcgcgctggttctgtacaaagacggcgagcgccgttacatcctggccccgaaaggcctgaaagctggcgaccagattcagtctggcgttgatgctgcaatcaaagcaggcaacaccctgccgatgcgcaatatcccggttggttctaccgttcataacgtagaaatgaaacctggtaaaggcggtcagctggctcgttccgctggtacttacgttcagatcgttgctcgtgacggtgcttatgtcaccctgcgtctgcgttctggtgaaatgcgtaaagtcgaagcagactgccgcgcgactctgggcgaagttggcaatgctgagcatatgctgcgcgttctgggtaaagcaggtgctgcacgctggcgtggtgttcgtcctaccgttcgcggtactgcgatgaacccagtagaccacccacatggtggtggtgaaggtcgtaactttggtaagcacccggtatccccgtggggcctgcagaccaaaggtaagaagacccgcagcaacaagcgtactgataaattcatcgtacgtcgccgtagcaaataa

SEQ ID NO: 3869 - DNA, 2073 bp, Klebsiella pneumoniae
tgcaaaaggagcggagtagggatgagcagaacccgtaaaacgttggttatcatcacaggaacgatactattgctgatcgttcttttctttatcgtgctggccacctttgactggaaccggctgaagccgacgatcaatcagaaagtgtccgccgaacttaaccgcccgttcgccatccgcggcgatctcggcgtggtctgggagcggcagccggacgagcgcggctggcgcagctggatcccgtggccccacgtacacgcggaggatatcgtgctgggcaacccgccggccattccccaggtgaccatgatccatctgccgcgggtggaggcgacccttgccccgctggcgctgctgagcaaaacggtgtacctgccgtggatcaagctggagcagcccgacgtacggttgatccgccttgcggaagacaacaataactggacctttcagctggcgggcgataagcgtacttcgggcgacagcgcgccctccagctggtcctttcgcctcgataatattctctttgatcgcgggactatcgccattgacgacaagatcacccgcagcgatatcaccatcctcgtcgatcccctcggcaaaccgctgccgttcagcgaagtgaccggcacaaaggatcgccatagcgcggcgaaaccaggcgactatgtctttggtctgtcgctgaagggccgctacaagggccagccggtcaccggcaacgggaaaatcggcggcatgctggccctgcgcagcgcaagcgcccccttcccattgcagggcgacttccactccggtaacacccgggtagcgttcagcggcacggtcagcgacccgctcaacgtcggcggcattgacctgcggctaaaattcgccggcgactcgctgcgcgatctctacgacctgaccggcgtgctgctgccggagacgccgtcattctccaccgacggccgcctgcgcgccgactttacgcaaaaaaaccgcatgcgctttaactatcagaattttaacggccgaatcggcgatagcgacattcatggctccctgacctacaccaccggcaagccgcggccgaaactcagcggcgatatggagtcgaagcagctgcgtctggcggacctcgggccattaatcggcgtcgattccggcaaagggacgaagaaaagcgcttcgcgccaggcggatgaccggccgcagccggcgggtaaagtgctgccggcggaccgctttgaaaccgacaagtggcaggtgatggatgccgatgtgcgctttaagggccggagaattgagcacggcggcaccctgccgatcagcgatctgtcgacccatgtgattctggaggatggtgacctgcgcctgcagccggtgcgctttggcctggccaacgggtcgattgccggcagcgtacacctgcagggcgataaaaagccgctgcagggtgaggccaatctgcaggcgcgacgcctgaagctgaaggcgctgatgccaaacgtcgagatgatgcagaaaaccctcggcgagatgaatggcgacgtccagctgcgcggcagcggcaactcggtggcggctctgctcggcaacagcaacggtaacctgaagctgctgatgaacgacgggctgatcagtcgcaacctgatggaaatcctcggtcttaacgtcggtaactacctgatcggccagatttttggcgatgaggaggttcgggtgaactgcgccgcggccaatatcgacgtaaccaacggcgtcgcccggccgcagatttttgccttcgatacagaaaacgcgctgatcaatgtgaccgggaccgccagcttcgcctccgagcagctggacctgaccatcgatccggaaagcaaaggctttcgggtgatcaccctgcgttccccgctgtatgtccggggcacctttaaatcgccgcaggcgggggtgaaggccgggccgctgattgtccgcggcgcggtagcggcggcgctggcaaccctggtgacgccggccgccgcgctgctggcgctgatctccccggcggagggcgatagcaaccagtgtcggaccattttgtcgcagatgaaaaagtag

SEQ ID NO: 3870 - DNA, 324 bp, Klebsiella pneumoniae
cctgcgcctgggcctgacggcgcagggcatcgcccggcataccggccaccacccgcggctgcagtttttgccgcaggctctgcgggagcgtctgcagcatcgcctgcgcctcggcggatttattctgctcgcgcagcacgtaatagaggttttcccgcgccgccgcgttctgcggatcgtcatttaacagtgagcgcagcgtttgctccgcctggggcaaatctttgttgtgccgcagcacatcggcgcggaacagcttcgccgaggcgccctgcgccccgctctgctgcgccaacggcgcggagagcgccagcgcctggctga

SEQ ID NO: 3871 - DNA, 315 bp, Klebsiella pneumoniae
ggagatgctggcatgattcgtgaagaacgtctgctgaaggtgctgcgcgcaccgcacgtttctgaaaaagcgtctactgcgatggaaaaaacaaacaccatcgttctcaaagttgctaaagacgcgaccaaagcagaaatcaaagctgctgtgcagaaactgtttgaagtcgaagtcgaagtcgttaacaccctggttgttaaagggaaagttaaacgtcacggacagcgtatcggtcgtcgtagcgactggaaaaaagcttacgtcaccctgaaagaaggccagaatctggacttcgttggcggcgctgagtaa

SEQ ID NO: 3872 - DNA, 306 bp, Klebsiella pneumoniae
cgaccggctggagaaacaggcgcaggctctggagagccagggcaactgggcgcaggcggcggaagttcagcgtcggcgcctggcgctggatccggacagcgtctggataacctaccgtctggcgcgggatctggtcagcgccggcgaacgccaggaggccgacgcgctgatgcggacgatggtcaaccgccagccgcaggacgccgaacgggtctacgcctcgggactctacctgtcggggaacgaccaggacgatctggctctggcgcaaatcgccgctctgccgcgcagcgcgtggacggataa

SEQ ID NO: 3873 - DNA, 345 bp, Klebsiella pneumoniae
tatttcttcggaataagaaataaattcttaataaacagtatgataggagttttttatggcagaaatttgacggagatgcgttcctgtcacgaaaaagagaacaggaacgcaatagttgaaattaaacgagaactaaaccagttcacaatttattattctgtcattgtcacgcttaatgacaaaaagttagcgcagatcacaaagttatttctgctgaattacaaatttgcaggaaaatccgcaggcaattcgctcgccgggcaattaatgacctcgtcattatccgcgccacagtcgcgaatgaaggtgatagtggcgaactcgtcaatcacttccgtcgggtag

SEQ ID NO: 3874 - DNA, 318 bp, Klebsiella pneumoniae
ttgatcgtcggcttcagccggttccagtcaaaggtggccagcacgataaagaaaagaacgatcagcaatagtatcgttcctgtgatgataaccaacgttttacgggttctgctcatccctactccgctccttttgcatcacgtcagtcctgaatatagtcaaaaagcggcgtttatcctggaaatgcgcttttcgtcacattacgcgcgtcaggtcaaaaaaataatggaacgatgttttaatatgattgaccagcaaaacagcgcagcgcacactagcgcttatatcgattccattgcaggttctggctatgtctaa

SEQ ID NO: 3875 - DNA, 615 bp, Klebsiella pneumoniae
ttcaccgtcggcagcccccgctgccagccgatggcgatcgttacgccattgcccttgggctggcactgggaggcgggcggcatgacgcatgtcgttaatcttcttccctggcgcgacctgcgtcgccgccagcgcctgcgctacgtcctgttgttaaccatcggcattgtgctgctgggcgggatgggcctgctggtgagccgaacggcgcgtctgcagcgcgacttcctggcgacgcttcacacgacggccgacgcgcagctgctcgcttcgcttaagcagcgcgagcaggcgatgcgtgaggcgtggcagcagcatcaacggcagcgccagcagtaccagcgcagatcggcgatcgccgcctggcaacccaggctgcaggcgctggcggcagatctgcccgcgcaggcgtggctgacgcggctggagtaccagggcatactcctcacgctggacggcctggcccttaacctgcaggcgttaaccagcgtggaggctgcgctgactcgcgtcgcgggattcgcgccggcaaaagccggcgggacccagcgcgacgccgaggggcgttggcagttcagttttaccctgacgggagcgcgcgctgatgcggattaa

SEQ ID NO: 3876 - DNA, 1407 bp, Klebsiella pneumoniae
tcaaacgtcggaactaatgggtcactgcagatgaagattattattctgggcgccggccaggtcggcggcacgctggcggaaaacctcgtcggcgagaacaatgatattacgctggttgataccaatggcgaccgtctgcgcagcctgcaggataagttcgacctgcgtgtcgtccaggggcatggctctcaccctcgcgtactgcgtgaggcgggggccgatgatgccgatatgctggtagcggtcactagttcggacgaaaccaacatggtggcctgccaggtcgcttactcattgttcaatacgccaaaccgcatagcgcgtattcgtgcgcctgattacgttcgtgatgcggaaaagctcttcaactctgaagcggtacccatcgatcacttaatcgctccggaacaactggtcatcgacaacatccaccgtctgatcgaatatcccggcgcgctgcaggtcgtgaacttcgcagaaggaaaagtcagtctcgcggtagtaaaagcctattatggtggcccgctggtggggaatgccttatccactatgcgggagcatatgccgcatatcgatacgcgcgtggccgccattttccgccacgatcgccccatccgcccgcagggctcgacgattgtcgaggccggagatgaagtcttctttattgccgcctcgcagcatattcgcgcggtcatgagcgaactgcagcgactggaaaagccgtataagcgtattatgctggtcggcgggggcaatattggcgcgggtctggcccataagctggaaaaagattacagcgttaagcttatcgaacgtaatcagcagcgagccgctgagctagcggaaaagctgcagcatactatcgtcttctacggggatgcatcggaccaggagctgttggctgaagagcatattgaccaggtggacctgtttattgccgtcactaacgacgacgaagccaatattatgtcggctatgttggccaagcgaatgggcgcgaaaaaagtgatggtgctaatccagcgcagagcctacgtggatctggtccagggtagcgtcatcgatattgcgatttcgcctcagcaggccacaatttccgcactcctcagtcatgtccgtaaagccgatattgtcggcgtctcctccttgcgccgcggcgttgcagaagcgattgaggcagtcgcgcacggcgatgagagcacctcccgggtagtcgggcgttcgatcgatgagatcaaacttccaccgggcacgatcatcggcgccgtcgtgcggggcaatgacgtgatgatcgccaataataatctacggatcgagcagggcgaccatgtgatcatgtttttgaccgataagaagtttatttccgatgtcgaaaggctgttccagccaagtcctttcttcctgtaa

SEQ ID NO: 3877 - DNA, 360 bp, Klebsiella pneumoniae
gcgtatcccggttactctggtggaggaaaaagcatgagccagtgggtaaatatctgcagcatcgacgacatcctgccggccaccggcgtctgcgccctgctcggtcagcagcaggtggcgatcttccgtccctaccatgacgacagggtattcgccatcagcaacattgatccgttcttcaacgccagcgtactgtctcgcgggattatcgccgagcatgacggcgcgctatgggtcgccagcccgctgaaaaaacagcgcttccgcctgagcgacggcctgtgcatggaagatgccagccactctatcgcccgcttcgacgcccgcgtgaaagacggacacgttcagcttaaagcgtaa

SEQ ID NO: 3878 - DNA, 1656 bp, Klebsiella pneumoniae
aggtccggcggatatatgcaaacaacatcacaattttggagcagaataatgagtatttccttgaagaaatcagggatgctgaagcttggtctgagcctggtcgccatgaccgtcgccgccagcgtgcaagcgaaaaccctggtttattgttctgaaggctcgccggaaggatttaacccacagctcttcacctctggcaccacctatgatgccagctccgtaccgatctataaccgcctggtcgaatttaaaaccggtacgacggaagttattccaggacttgctgagaaatgggaagtcagtgcggatggcaaaacctatacttttcacctccgtcagggtgtgaagtggcaggataataaagactttaaaccaacccgtgacctgaacgccgatgacgtggtgttctccttcgatcgccagaagaatactaataacccgtaccataaagtttctggcggcagctatgaatactttgaagggatgggcttaccggacctgattagcgaagtgaagaaagtggacgataataccgtccagttcgtcctgacccgtccggaagcgccgttcctcgctgatctggccatggacttcgcctccattctttcgaaagagtatgctgacaacatgctgaaagccggcacgccggaaaaagtggatctcaatcctatcggtaccggcccattccagctgctgcaataccagaaagattcccgcattctgtataaagccttcccgggctactggggtaccaagccgaagatcgatcgtctggtcttctccatcaccccggacgcttccgtgcgctatgccaagctgcagaaaaatgagtgccaggtgatgccgtacccgaacccggcggacatcgcgcgcatgaaggaagataagaacattaccctgctggaacagccgggtctgaacgttggttatctctcctttaacaccgagaagaaaccgctggacgacgtcaaagtacgtcaggcgctgacctacgcggtcaacaaagaagcgatcatcaaagcggtttaccagggcgcaggccaggcggcgaagaacctgatcccgccgaccatgtggggctataacgacgacgttaaggactacacctacgatccggagaaggcgaagcagctgctgaaagaagcgggcctggaaaaaggcttcaccatcgatctgtgggcgatgccggtacagcgtccgtacaacccgaacgcccgccgcatggcggagatgattcaggctgactgggccaagattggcgtccaggccaagatcgtcacctacgagtggggcgagtatctgaagcgggcgaaagcgggcgagcaccagagcgtgatgatgggctggaccggcgacaacggggatccggataacttcttcgcgaccctgttcagctgcgccgcggcgaaagacggctccaactactcgcgctggtgctataagccgtttgaagatctcattcagccggcccgcgctaccgacgaccacaacaagcgtattgaactgtacaaacaggctcaggtagtgatgcatgaccaggctccggcgctgatcattgctcactccaccgtctatgagccggtgcgtaaagaagtcaaaggctatgtggtggacccgctgggcaaacaccacttcgataacgtctctgtcgaataa

SEQ ID NO: 3879 - DNA, 1638 bp, Klebsiella pneumoniae
tttcattcaggagtgcttatggctcattgcgcccacatccccgcttttgttttacatcaggtcacctgtcagtttgcgacgggacagaccctgtttggtccgctcagcgtctcgctggaaccgtccctttgcggcctggtcggccggaacggcgtcggcaagacgcgtctgctgcgtctgctggcgggccttgattctcctgccggcggccatattgagcgtgccgccgccgttgcctgggtagcgcagcagccgacgctcacgccggagaccaccctcgctacgctgctgggctatgcgtcggtttttgccgccttgtctcgccttgaacagggccaagggctggccgacgatttcgatctgttagatggtcactgggatctcaccgatcgcctgagtttagcgttccgtgaagccgatctcccgccgttctctgccgatcgccccgcgttttcactcagcggcggcgagcggatgaaggctctgctgtgcggcgccttcgtctcgggcgccgattatctgctgctggatgagcctaccaaccatctggaccgccaggggcgggagtggctctatcatcaactggaaagctggcagggcggggctctgatcgccagccacgaccgcgagctgctgacgcggatgccgaggattattgagctgacgccgacggcgctgcgcagctacggcggcaactatgatgaatatcagcgccagcgtatggcggagcagcaggccgcgcgcgcggcgctggagcatgccgtgaccgaccgacggcgcacccgcgcgcgaatgcaaaaggagcatgacgccgcccagcggcgctcggctcagacgctgcgtaccgttgatacgctaaatatcgcctccttcgaacgcgtgaagtacaaaggcgcggcaaaagagcgcccgggagcgctgcgccgtcagcatcgtgaacagaacagcagtctgaatgccgccgtgcagcaggcgcgggagcggatagaagacgacaatccggtgatgttcaccctgccgggtagcgaagtggccgccggcaagcaggtgctggtggtggagtcattacagctcgaccatgcgccggctgcgccgctgaactggcgtatcgatggcccgatgcgcatcgcgctaaaggggccaaacggctgtggcaaaaccactttgctgaaaacgctgttggggctggagcaggccgcgtcaggcgatgtccggctttcggtgagcgccgcttacctcgatcaacatctgacgcagctggatttatccctgtcggtaatggcgcacctgagcctggaagataccccactggatgagggcctcctgcgcacccgcctggcgcagctccagctgggcgcggataaggtcactctgccgctgtcggcgctcagcggcggcgagcgcctgaaagcggcgctggcgtgcgtgctctggcgacgcgagcctgcccaactgcttttgttggatgagccaaccaaccatctcgatttagcatcgacgcaggctattgaaagcgcgctggcggcgtttcccggcgcgatgctggtggtgtcgcatgatgaagcgtttttacaaggtctgaagctgacccatagtctggcgtggcgggagacgggctggcacttttccctgctctga

SEQ ID NO: 3880 - DNA, 234 bp, Klebsiella pneumoniae
aaggagtcaggcctggtcgcgcaacgaggtaaaacgagtaagacagctatgaaaaacgggccagcaggcccgttttcttatgactggattatttataaacgtcagcgttcgcgtgtacggttttttcgtttttctgcccggcaatcaccacaaagtatttcccacccagctcatcggcttttttcgacagatcgcgtcgggcatccatcggcgacgtcgtcctggaggtcgtaa

SEQ ID NO: 3881 - DNA, 357 bp, Klebsiella pneumoniae
gctgcaccaggcggtcgacgctggtggcgcccgccgctacccgttccccggcctgacgctccaccggcaccgactcgccggtcagggcgctttcatcaaagctggcaaacggcgacagcagctggccatccgccggcagacgcccgccggcagccacttcaatcacatctccgggacgcaggtcgcgctgggcgacggtttcccgcacgccgttgcgcagacggatggcggtgtcgggcttcagcgccatcagcgcgctcaccccctgccgtgcgcggctggcggcccagccttcgagacgctcgccgatcaggaacagcagcaggaccatcgccgcctccgcggtggcgccgataa

SEQ ID NO: 3882 - DNA, 3492 bp, Klebsiella pneumoniae
ctggaaccaggaatgcgcaagctcacactaagtttactcacgctgtccctcggcgttgcgctgctaccgttagcgcaggcgacgacgacgcctgcccaggagcatctgctggagcaggtgcgcctcggcgaggccagcaatcgtgaagacctggtgcgccagtcgctgtaccgtctggagctgattgatcccaacaacccggagctgattgccgcgcggatgcgctatctgctgcgtcagggggatgccgccggggcgcaaaaagagctggaacgactgacgaagctggcgccggactccccggagctgaaggcgtcgcgcaatgagatgaaaagcaacaccggcgagggccgccaggcgctgcagcaggcgcgactgctgggcgtggccgggaaggtcgatgaagccatcgccgcctatgaaaaactgtacggcggggtgccggatgacgttgacgtcgccattgaatactggacgctggtggcgcgcctgccggcccgccatagcgaaggcgtcagccagttgaaaaaactgaacgccagcgcgccgggcaacgtcagcctgctgacttcgctggcgaagcagatgttcgccgataacaaaccgcaggaggggttcgcctatctggcggagatggcccgatcggcctcgggacgcggtatcgccgccgatatgtggttcagtgaggtgaaaagcatgccggtgagtaaggccagcgtgcaggcgttgcagcaatttcttctgcagtttcccaccggctcggtggcggcgaacgcccgcgttctgctcgaccaacagcaggcgcagctgcaggatccgactttccgcgcccgctcggaagggctggcggcggtcaagtccgggaataccacgcaggcggtcgcggatctgcagaaagccgttcaggccgacagccgcgacagcgacgcggtgggcgctctcggccaggcctattcccagcgcggcgaccgcgcgcgggcagtggcgcagctcagtaaagcgattgccatggaccctgacagcccgaaccgcggcaagtgggacagcctgctgcaaactaaccgctactggctgctgataaagcagggggataacgccctgaaagccggccagctttcgcaggcgcagaactattatgcccaggcgcagcgggtcgatcgcaccgacagctatgccgtgctggggctgggggacgtcgcggcggcgcgcaaagaggcggcggcggcggagcgctattaccagcaggcgttgcgcctggatcgcggcaataacctggcggtgcgcggcctggccaacctctatcgcgccgaatcgccggagaaagccagcgcctggatcgccggcctccctcccgctcagcggcgcagtatcgatgatattgagcgcagcctgactaacgaccggctggagaaacaggcgcaggctctggagagccagggcaactgggcgcaggcggcggaagttcagcgtcggcgcctggcgctggatccggacagcgtctggataacctaccgtctggcgcgggatctggtcagcgccggcgaacgccaggaggccgacgcgctgatgcggacgatggtcaaccgccagccgcaggacgccgaacgggtctacgcctcgggactctacctgtcggggaacgaccaggacgatctggctctggcgcaaatcgccgctctgccgcgcagcgcgtggacggataacattcgtgaactcgaagcgcgcctgcaaagcgaccgggtgctgcgccaggccaaccagctgcgcgatagcggcgacgaagcgcaggcgatcgccctcatcaaacggcagccgtcttcagtgcgctatgacctgacgctggccgactgggcgcagcagcgcggagacagccagacggcgattgccgactatcagcgggtgctgcgtcaggaggccgacaacggcgatgcgcgcctcggccttgcggaagtctacctggccgagggcgataaaccggccgcccgggcgcaggtcatgcagctgaaaggcgcagagaccgaatccatgaacatgcagcggcgggtggcgctggcgcgagctggccttggcgataccgctgacgcgcaacggatttttaatcagattgtgccgcaggcgaaggcgcagccgccctcgatggagagcgcgctggtgctgcgcgatgccgcgcgctttgccacccagagcggggcgccgcagcaggcgctgacgcactaccgggaagcgatggtggcctccggcattacccccgcgcagccgcaggataacgatacttttacgcggctgacgcgcaacgacagccatgatgactggctgaagcgtgggatccgcagcgatgccgccgacctttatcgtcagcaggatctgaacgtcaccctggaacacgacttctggggttccagcggcaccggcggctattccgacctgaaggcgcataccaccatgctgcaggtggatgctccgctggcggatggccggatgttctttcgcaccgatctggtcaatatggatgccggcagcttttccacccacagcgacgggagctactcgcccagctggggcacctgcggggagatcgcctgtaccagcggcagtaaaaatcagaccgacagcgggaccagcgtggcggtcggctggaagaatgacacctggagcggggatatcggcactacgccgatgggcttcaatgttgtcgatgtggtgggggggctgagctacagcagcgacgtcgggccggtggggtacacggtcaacgtccaccggcggcctatctccagctcgctgctctcctttggcgggcagaaggacagcagcagccataccggcgccacctggggcggcgtccgcgccgacggcggcggcctgagcctgagctacgatcgcggggaggctcacggcatctggtcctcgctgggcgccgactcgctgaccggtaaaaacgtggcggataactggcgcgtgcgctggatgaccgggtactactacaaggtcatcaacgagaataatcgtcgcgtcaccgtcggcctcaacaatatgatctggcactacgacaaagatctcagcggctacaccctcggccagggcggctattacagcccacaggagtatctctcgttcgccgtgccggtgacctggcgtcagcgcaccgagaactggtcctgggagctcggcgggtcggtgtcatggtcccattcgcgcacccagacgcaagcccgctatccgctgctgaacctgatcccgtccgactaccggcagcgcgccagcgagctgacggaggaggggagcagcagccatggattcggttacaccgccagagcgctggtggagcggcgggtgaccagcaactggttcgtcggcgccgcggtcgatattcagcaggcgaaggattacaccccgagccatgcgctgctttacgtccgctactcggcggccggctggcagggggatctggatatgccgccccagccgctggtgccctacgccgactggtag

SEQ ID NO: 3883 - DNA, 1455 bp, Klebsiella pneumoniae
aacgctgcaggaaccaggcgccgacgagagcgatgtgcttatcgtcgatatcgaccagccgctggaaggcgtggtggccagcaccatcgaggtgatcaacaaaggcagtcactagtgagtactttaacgcttgttttaacagcagtcggctcggtattgctgctgctgtttttagtcatgaaggcgcgaatgcacgccttcgtggctttgatggtggtttctattggcgccggtctcttctccggcatgccgctggataaaatcgcggcgacgatggagaaagggatgggcggtacgctgggcttcctggcgatcgtcgtcgcgctcggcgcgatgttcgggaagatcctgcatgaaacgggggcggtcgatcagattgccgtcaagatgctcaaatcctttggccacaatcgcgcgcactatgcgattggtctcgccggtctcatctgcgcgctgccgttgttcttcgaagtggcgatcgtactgctgattagcgtcgccttctcgatggcgcgccataccggtactaacctcgtgaagctggtgatcccgctgtttgccggcgttgccgccgccgcggcgtttctgttgcctggaccggcgccgatgctgctggcgtcgcaaatgcacgccgactttggctggatgatcttgattggcctgtgtgcggccattccggggatgattatcgccggtccgctatggggcaacttcatcagccgctacgtcgaattgcatattcctgacgacgtcacggaaccgcatctcggcgaaggcaaaatgccctccttcggcttcagcctggcgctgatcctgctgccgctggtgctggttggcctgaaaaccatcgccgcgcgctttgtgccggtgggttccactgcctacgaatggttcgagtttatcggccacccgttcaccgcgatcctggtggcctgcctggtggcgatttacggtctggcggtacgtcagggaatggcgaaagaccgggtgatggagatttgcggccacgcgctgcagccggccgggattattctgctggtgatcggggctggcggcgtcttcaagcaggtgctggttgactccggcgttggcccggcgcttggtgaagcgctgaccggaatggggctgccgatcgctattacctgcttcgtactggcggcggcggtgcgtatcattcagggctctgccaccgtggcgtgcctgacggcggtcggcctggtgatgccggtgattgagcagctgaactacagcggcgcgcagatggcggcattgtctatctgtatcgccggcggctcgattgtggtaagccacgtgaacgacgccggcttctggctgttcggtaaatttaccggcgccagtgaagcccagacgctgaagacctggaccatgatggaaaccatccttggcaccaccggggcgattgtcggtatgatcgccttccagctgctgagctaa

SEQ ID NO: 3884 - DNA, 1365 bp, Klebsiella pneumoniae
ggacatatgggcatgagcaaacattatgattacctcgccatcggcggcggtagcggcggtatcgcctcaattaaccgcgcggccatgtacggccagaagtgcgcgctgattgaagccaaagagctgggcggcacctgcgtcaacgtcggctgcgtgccgaaaaaggtgatgtggcatgcggcgcagatccgcgaagcgattcatctttacggcccggactacggtttcgataccaccatcaaccattttgactgggagaagctggtcgccagccgtagcgcctatatcgaccgtattcatacctcttacgacaacgtactgggtaagaataaagtcgacgtgatcaaaggcttcgcgcgctttgtcgatgcccacaccgtggaagtcaacggcgagatcatcaccgctgaccatatcctgatcgccaccggcggccggccgagccacccggatattccgggcgtcgaatacggtattgattccgacggtttcttcgaactgccggcgctgccgaagcgcgtggcggtggtcggcgcaggctatatcgccgttgagctggcgggggtgattaacggcctcggcgccgaaacccacctgttcgtgcgcaaacacgcgccgctgcgcagcttcgatccgctgatcgttgagaccctggtggaagtgatgaacgccgaaggcccgcagctgcataccaatgcgatcccgaaagcggtggtgaagaatgccgacggcagcctgacgctggagctggaagatggccgcagccagaccgttgactgcctgatctgggcgattggccgcgaaccggcgaccgacaacttcaatctggcggcaacgggcgttaaaaccaacgataaagggtacatcatcgttgataaattccagaacaccaacgtgccgggcatctacgcggtgggcgataataccggcgccgttgagctgacgccggtcgccgtggccgcaggccgtcgtctctccgagcgcctgtttaacaacaaaccggaagagcatctggactacagcaacatcccgaccgtggtcttcagccatccgccaatcggcaccgtcggcttaaccgagccgcaggcgcgcgagcagtacggcgacgacgccgtgaaggtctacaaatcttccttcaccgcgatgtataccgccgtgacctctcaccgtcagccgtgccgcatgaagctggtgtgcgtcggcccggaagagaagattgtcggcatccacggcatcggcttcgggatggatgagatgctgcagggctttgcggtggccctgaagatgggcgccaccaaaaaagacttcgacaacaccgtcgccattcacccgacggcggcagaagagttcgtcaccatgcgctaa

SEQ ID NO: 3885 - DNA, 2841 bp, Klebsiella pneumoniae
cgatctgcgggtcggcagccagctgcaggaagatctctaccagctgtggctggagagccagccgcgcatcctgccggtgacgattcaccgcgacgaggcgatggccgagtgcctggcggcgaaacagcctctcggggagtatcgtcaggattcgctggcggcggaagaggtgctgaccctggcgaactggtgcctgatccactattccgccgggagagcggcatgatccgcctcagtacgctgctgctggccccgccggtgggggagcggctgcgtgcgcgctatgatgactatcggcagcacggcgcttcgtggctgtcggcgtcgcttggctgtctgtgggcgtcgctggtctgggcgctgatgccgctggagacgccgcgctggcaggcgattctggcccgccatgaaacctattttccccacataaatccgcatcgcccgcgtccgctggatccgctgcgctacctgctgcaatccctgtggttactgacgacgcgcgtgccggagccggagaaaaaggtcaactggcgttcgctggcggcgctggaaggggtgcacggtcgctatacgcagtggctggaaaaattacctgagcagatgaacgcccgcaccggccatctggataaacagaaagagctggcgcacctcaatcctaaactgcgccgggcgatccttgggggggcgaccttctgctcgctggtgctggcgctgatgtgtattacgcagccctttaacccgctgtcgcagtttatcttcctgatgctgctgtggggcgtggcgctgctggtgcggcgcatcccgggccgtttctcggcgctgatgctgatcgtgctgtcgctgacggtatcgtgccgctatatctggtggcgctatacctcgacgctgaactggaacgacccggtaagcctggtgtgcgggatcattctgctgttcgcagagacctacgcctgggtggtgctggtgctgggctacttccaggtggtctggccgctgaatcgccagccggtgccgctgccggaggacatggatttgtggccaaccgtggacatcttcgtccccacctataacgaagatctcaacgtggtgaaaaacaccatttacgcctcgcagggtatcgactggccgaaggacaagctgaacatctggatcctcgacgacggcggacgggaagcgtttcgccagtttgccaaagatgttggggtgcactatatcgcccgcaccagccacgaacacgccaaggccggcaacatcaataatgcgctgaaatatgccaaaggggagttcgtctcgatctttgactgcgaccatgtgccgacgcgctcgtttctgcagatgaccatgggctggtttctgaaagagaaagagctggcgatgatgcagaccccgcaccacttcttctcgcccgatccctttgagcgcaaccttggtcgttttcgcaaaacgccgaacgaagggacgctattctacggcctggtgcaggacgggaacgacatgtgggacgccaccttcttctgcggctcctgcgccgttatccgccgcggcccgctggatgaaattggcgggatagccgtcgaaacggtgaccgaagatgcccacacctcgctgcgtctgcaccggcggggatatacctccgcctatatgcgtattccgcaggcggcggggctggcgacggagagtttatccgcgcatatcggccagcgcatccgctgggcgcgcgggatggtgcagatattccgcctcgataatccgctgtttggcaaaggcctgaagctggtgcagcgcgtctgctacgccaacgccatgcttcactttctctccggtattccgcgcctcatcttcctcacggcgccgctggcctttttgctgctccatgcctatatcatttatgcgccagcgctgatgatcgcgctattcgtgttgccgcacatgatccacgccagcctgaccaactcgaagattcagggcaaatatcgccattcgttctggagtgaaatttacgagacggtgctggcctggtatatcgcgccgcccacttttgtggcgctgatcaacccgcataaaggcaagttcaacgtcaccgcgaagggcgggctggtggaagaggagtatgtcgactgggtgatctcccggccctatatctacctggtgctgctcaatctggtcggcgtcgcggtggggatctggcgcttcatgtacggcccggaaaatgaaatcctcaccgtctgggtgagtattgtctgggtattctacaacctgattattcttggcggcgcggtggcggtctcggttgaaagcaagcaggttcgccgttcgcaccgtgtcgaaatgagcatgccggcggctatcgcccgcgaagatggccacctgttctcctgcaccgtccacgactattccgacggcggactggggatcaaaattaacggcgatgcgcaggtgctggaaggccagaacgccaggctgctgctcaaacggggacagcaggagtatgccttcccggtcagggtcgcgcgggtcaacggcagcgaagtggggctccagctgctgccgttaaccaaccagcagcatatcgattttgtgcagtgtacgtttgcccgcgctgatacgtgggcgctttggcaggatagcttcccggaagataagccgatggaaagcctgctggacatcctcaagctgggctttcgtggctatcgtcacctggcggagttttcgccgccgtcggtgaaggtggttttccgcgcgctcacttcgctggtggcctggatagcgtcgtttgtaccccgacgccctgaacgcgccgcgccgacgctctccgcagacccggcaatggctcaacaatga

SEQ ID NO: 3886 - DNA, 249 bp, Klebsiella pneumoniae
ctctttcagggaaaatcgattcaactcgcgaataaattaaaagtcaggcacaacgcgacaaacaacattgccgccctgtgcctgagaaagatgcggggattaatgaacctgcggatcggccggagaggcgttattacggatctcggcaatatccatggcattgaagatatagtggttaccgcagtagtcgcagtgcatatcaatttcgccttcgtcggcgaggatgctatcaatctcttcatccggtag

SEQ ID NO: 3887 - DNA, 720 bp, Klebsiella pneumoniae
ttaatacagggaaatcgtatccccactaaaaacacagcaatattgccgattcggctcttttctggagtcgcattaatgataataaagaaatgcaatggcctccgggggttcttgatcccggcgagcgtatccgtctgggtgtcatgtgtctctggagcgaatgcctggcaacaggaatatatcgctatcgatacaaaaagtaatacgtcggaacgctatacatgggatagcgatcaccaaccacgttatgaagatattctcgccgagcggatgaagtcctctgagacgcccggcgggctggcgttaaaccaggggctggcgccgccggacagcggccgcggcctgagcgttggctggaattatccgctggcaaacggcgtaacctccgggccggtggccagcctgcgcagcgacgtcaccgcgccgacggtgagaaacgcaggcgaggcgggctacgttaacacgctcggctggcgcatggattatcaggcgctgtggggcgtgcatccctgggcgcaggtgagctataaccagtcgctcgccagcgatgtctgggcgccgatgacccgtgccagggagggaggctggagcgatgtcaccctgggcgctgatatgcggttgggatcccacgtggcggcatgggcaacgctatcgcaggcggataacctgccgtcaggggaaaatacgctctatttgatgggggtcagcgccaatttttaa

SEQ ID NO: 3888 - DNA, 645 bp, Klebsiella pneumoniae
cagatacagggacttactatgctttggtcatttattgctgtctgtttctccgcatggctttatgtcgatgcatcctatcttgggccggcatggcgacgctgggtttttaaacctgtcaccctgattctgttgctgttactggcctggcaggcgccgatgttcaatgccatcagctatctggtgctggctggcctgtgcgcctcgctgctcggcgacgccctgaccctgctgccgcgccagcgggtgatgtacgcggtgggcgctttcttcctgtcacatctgctgtataccatctggttcgccagccagctgacgctgtcgttcttctggccgctgccgctggtgctgctggtattcggcgccctgctaatggcggtgatctggagtcggctggaagagatgaaaatgccggtgctgacctttatcggaatgacgctggtaatggtctggctggccggcgagctgtggtttgcccgccccaccaacaccgcgctgtccggtttcgccggcgcagccctgctgctgctgagcaatgccgtgtggctggtgagccactatcgtcgccgcttccgcgccgataacgccatcgccgccgcgttctactttgccggccacttcctgatcgtgcgcgcgctgtacctgtaa

SEQ ID NO: 3889 - DNA, 642 bp, Klebsiella pneumoniae
gttcagcagggcacgcgcggtaccagcctgagcccaaccgtctgcgtaaccatcacgcggaccgaaggtcagtgcattatctgcatgtttaacttcaacagcatcgttgagagtacgagtcagctcgccgtttttacctttgatcgtaataacctgaccgttgatttttacatcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagaccggccataactttcggcagctcatcttttttcttatagatgcgcagacctgggcggctgacacgctgaatgctttctacaacagctttgccctggaaatacttgagagtaagttccagttcaggcttggtgtcgccttcaactttaaaatcttcgataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtga

SEQ ID NO: 3890 - DNA, 573 bp, Klebsiella pneumoniae
cgcatcgagggcggccagcaggtcatcatcaagggtcagggttacgcgctgcatggcatggcctcgttaagcagagtggcaggaaaaggggggagcaccgcctgctggagcgcctgtccggcaggggaacgcaggcgtagcggtagactaaccgttgcggtttcgacgatgcgcccgtgctccatcaccagcactcgctggcaaaagcgctccaccagccgcaggtcatgggtgatgaacaggcaggcggtgtcaaactgcgcctgcagacgcttcagcagggcgataatctccgcctgcagcagcagatcgagatttgaaaccgcttcatcaaggatcaacagctgcggccgtaccgccagggcgcgtgccaggcagacgcgctgcagctgtccgccgctgagctgcgccgggcgcttatcgagcagcgacgacgcgaggtcgacggccagcagcatctcttccacccgccgcgcacgcgcctcacgcgacaagcacaacagatggcgcagcggctcgctgacgatctcgcgcaccgttttgcgcggattcaccgcgctgaaggcatcctga

SEQ ID NO: 3891 - DNA, 519 bp, Klebsiella pneumoniae
gccagccggggaccccgcaccagatcgtgttcgtcgacccgccgttccgtcaggggctgctggaggagacgctacgtctgctggagacacaaggctggctggccgatgaggccctggtgtacgtcgaaagcgaagtcgaaaacggcttaccgccggtgccggctaactggcaattgtatcgtgaaaaagtggccggacaggtcgcctaccgtctttaccaacgtgaggcccaaggagagcaccatgctgattaatttaggccgcctgctgatgctgtgcgtctgggcctttctgttattgaatctgtttcagcccttcccgaagccgctgaatatctttgtcaacgtcgcgctgattttcatgatcctgatgcacggtctgcagctgacgctgctcaaggcgacgcagccgaaagaggcgccgccgctgagccgctttgagcaaatccgcatttttattttcggcgtgtttgagctcgtcgcctggcagaaaaaactgaaggcgacgctgaaaaaatag

SEQ ID NO: 3892 - DNA, 570 bp, Klebsiella pneumoniae
tatgaaatttttaaaatcatgaggttatcaatgaaccattatgatgatctgcagcgctttcaagaaaaaacgcggacgcaaaacctcaactttcaggatctttcttcgcaagccgccacgcgggaacacggcgactgggcgatcctcaatcagctaaatcccgggaccgagaaatcctcttctctggcgctgggaggctcggtctccgcgccgttgccgcagtcggtgcctgcggatctgttccgccaggtagaggcggccgtagcagcggcgccaacctctgatcctgttgtgtctgccgcttcggccgcgcctgctacttcccagccggtcgtggagaccgccgcagccgcaccggagccggtcaggcaggagcctgcgccgacccctgcgccttcaattccggcgtcggaaccggccatggcgccgccgccgagaatggccccccgacccgcgcccgccgccgagaactatgcccacctgttcgccgcgaaaagcgcggagccggtggcgaaaaataaagaccagcctttgaaatcacttctggaaaggatcgcgacatgccgttga

SEQ ID NO: 3893 - DNA, 585 bp, Klebsiella pneumoniae
tggccgtttatcgaaaggaagatgtcaatgcgcaatttggttaaatatgtcggtattggcctgctggtgatggggcttgccgcctgcgataacagcgattcaaaagcgccaaccgttggcgcagcagcggagagcaatgccagcggccaggcaatcagcctgctggatggcaagctgagcttcaccctgcctgcgggcatggccgaccagagcggcaaactgggtacccaggcgaacaatatgcacgtctactctgacgctaccggccagaaagcggtcatcgtcatcgtcggcgacagcaccaatgaagatctggcggtgctggcgaaacgcctggaagatcagcagcgcagccgcgacccgcagctgcaggtggtgagcaataaaccgctggagagtaaaggccataccctgcagcagctggacagcatcatctccgccaaggggcagaccgcctggtcttccgtgatcctcggcaaagtggatgacaagctgctgaccctgcaggtcaccctgccggcggataaccagcagcaggcgcagaccgaagcggaaagcatcatcaacaccctcaccatccagtaa

SEQ ID NO: 3894 - DNA, 201 bp, Klebsiella pneumoniae
tgggtacttatgaatgtggcaatgagacaagaaccattcaagggtagggtctgtttgcggtttgccaagcaccatgcgcggttatcctctgttataagctatctccgggcgccgacactacacggcgtccgggcatgcaatcgtattgtttccctatacctgggaagctggctgatgatttttcgacagcccgtaatgtga

SEQ ID NO: 3895 - DNA, 321 bp, Klebsiella pneumoniae
atatgcttcttaccgaacttattgataagcgtggtggcgatacgctgggcgccgccgcagtctgccagcagcttaccgagcatagcgccgaagcccatgatcagcgcgaggctgccaagggtgccgccaacgccgtttttgatggagacgatcactttatccagtggcataccctgcattaatccgacggcgagcgccaccagaaccagcgcaatgaagccgttcattttgaaacggatcattaacagcaacaacagggcaaccccgatagcaacgatgactaatggcatgatttacctggccttaatttgttatgggtaa

SEQ ID NO: 3896 - DNA, 981 bp, Klebsiella pneumoniae
agacgagttatccctccgcccgcgatccgcgggcggtttgaaaaaggttaccttatgtccgagcagtttctctattttctgcagcagatgtttaacggcgtcacgctgggcagtacctatgcgctgatcgccatcggctatacgatggtgtacggcattatcggcatgatcaacttcgcccacggcgaggtctatatgattggcagctatgtctccttcatgatcatcgccgcgctgatgatgatgggcattgacactagctggctgctggtcgccgccggattcgtgggcgccattgtgattgccagcgcctacggctggagcattgagcgcgtggcctatcggccggtgcgtaactccaagcgcctgattgcgctgatctccgccatcgggatgtctatcttcctgcagaactacgtcagcctgacccagggctcccgcgacgtggcgctgccgagcttgtttaacggccagtgggtcgtcggccacagcgacagcttctccgcgacgatcaccaccatgcaactggtgatctgggtggtgacctttatcgccatgctggccctgacgctgtttattcgctactcgcggatggggcgcgcctgccgcgcctgcgcggaagatctgaaaatggccagcctgctcgggattaacaccgaccgcgtcattgccctgacctttgtcatcggcgcagcgatggcggcggtggccggcgtgctgctggggcagttctacggcgtgattaacccctacatcggctttatggccgggatgaaggcgttcaccgccgccgtgctcggcgggatcggcagtatccctggcgcgatgatcggcggcctgatcctgggtattgccgaggcgctctcttccgcctatctcagcaccgaatataaggacgtcgtttccttcgcgctgctgattctggtgctgttagtgatgccgaccggcattctgggccgcccggaggtggaaaaagtatga

SEQ ID NO: 3897 - DNA, 198 bp, Klebsiella pneumoniae
atttgctctatgtcacaaatttcgacattggctgagaatgggaaaaaatcgcaggcaggactggtcggccgcggttttcaggcggtagctggcggagtgtgggtagatttattttacgctaagagtagttgtttgtttttattaaattattgtcagcgatttcttagaagtaatcttttttgcgggtcaatgcgatga

SEQ ID NO: 3898 - DNA, 1332 bp, Klebsiella pneumoniae
gaaagatctatgcaagccacagccaccactctcgaaaacacgcaggaaaccgccccggtcaactcacgcaacaaggttgttgtcgcctcgctcattggcaccgccattgagtttttcgacttctacatctatgccaccgccgcggtcatcgtcttcccgcatatctttttcccgcagggcgatgccgctgcggccaccctgcagtcgctggccaccttcgccatcgccttcgtcgcccggccgatcggctccgcgctgtttggccacttcggcgatcgcgtcggccggaaggtcaccctcgtggcctcgctgttaaccatggggatctccaccgtggtgatcggcctgctgcccggctatgaaagcattggcattgtcgcgccgatgctgctggcgctggcgcgtttcggtcagggccttggcctcggcggggaatggggcggcgcagcgctgctggctacggaaaacgccccggcgcgcaagcgcgccctgtacggctccttcccgcagctgggcgcgccgatcggcttcttcttcgccaacggcaccttcctgctgctctcctggctgctgaccgaccagcagtttatggagtggggctggcgcgtgccgtttatcttctccgcggtgctggtgatcatcggtctgtatgttcgcgtctcgctgcatgagaccccggtcttcgccaaagtagcggcggcgaaaaaacaggtcaaaatcccgctgggtaccctgttgaccaaacacgtccgggtgacggtgctgggcaccttcatcatgctggccacctataccctgttctacatcatgaccgtctactcgatgaccttcagcaccggcgcggcgccgaatggcctgggtctgccgcgtaacgaagtgctgtggatgctgatgatggcggtgattggctttggcgtaatggtgcctgtcgccggcctgctggcggacgcttttggtcgtcgcaagagcatgattatcatcaccacgatgattattttgttcgccctgttcgcctttaaaccgctgctgggctccggcaatccgctgctggtcttcgccttcctgctgctgggcttaagcctgatgggactgacctttggcccgatgggcgcgctgctcccggagctgttcccgacggaggtgcgctacaccggcgcgtcgttctcctataacgtgtcgtcgatcctcggcgcttcggtcgcgccgtacattgccgcctggctgcagggtaactacggtctcgcggcggtcggcacctatctggcggcgatggcggcgctgacgctgatcgccctgctgctgacccacgagacccgccaccagtcgttgtga

SEQ ID NO: 3899 - DNA, 363 bp, Klebsiella pneumoniae
ggtaacactatggataagaaatctgctcgtatccgtcgtgcgacccgcgcacgccgcaagctccaggagctgggcgcaactcgcctggtggtacatcgtaccccgcgtcacatttacgcacaggtaattgcaccgaatggttctgaagttctggtagctgcttctactgtagaaaaagctatcgctgaacaactgaagtacaccggtaacaaagacgctgcagcagctgtgggtaaagctgtcgctgaacgcgctctggaaaaaggcatcaaagatgtttcctttgaccgttccgggttccaatatcatggtcgtgtccaggcactggcagatgctgcccgtgaagctggccttcagttctaa

SEQ ID NO: 3900 - DNA, 585 bp, Klebsiella pneumoniae
gccaacgctatgatccgtatttccgatgctgcacaagcgcactttgccaaactgctggcaaatcaggaagaagggacgcaaattcgcgtatttgtgattaatcccggcaccccaaacgctgagtgcggcgtatcctactgcccaccggatgcggtggaagacaccgacacggcgctgaaatttgaacagctgaccgcctatgtcgatgagctcagcgcgccctatctggaagacgctgaaattgatttcgtcactgaccagctcggctcgcagctgacgctgaaagcgccgaacgccaaaatgcgcaaagtctctgacgatgccccgctgatggagcgcgtcgagtacctgctgcagtcgcagattaacccgcagctggcaggccacggcggccgcgtatcgctgatggagatcaccgacgacggtctggctatcctgcagttcggcggcggatgcaacggctgctcgatggtcgacgtgaccctgaaagaaggtattgaaaaacagctgctgaacgagtttccggagctgaaaggggttcgcgatctgaccgagcatcagcgcggcgagcactcctactactaa

SEQ ID NO: 3901 - DNA, 627 bp, Klebsiella pneumoniae
atctggtatatattccaggctaaattgttacaaagcatatttaacagcaggttaagtatacatttaatcataagacacagtatttatcctgtcggtattattacgcgctacaaattgtgcgcaacgacagacagtcagaaggttgaactcacgatgaaaacgccgctgatcacccgcgagggatatgaaaaactgaagcaggagatggactacctgtggcgccaggagcgtccggaagtgaccaaaaaggtgacctgggccgccagcctcggcgaccgcagcgagaacgcggactaccagtacaacaaaaagcgcctgcgggagatcgatcgccgggtccgctatctgaccaaatgtctggaacagttgaaaatcgtcgattactcgccgcaacaggaaggtaaagtcttcttcggcgcctgggtagagattgaaaacgatgaaggcgatatcaagcgctttcgcatcgtcggttacgatgaaatttttggccgcaaagactatatctccatcgactcgccgatggcgcgcgcactgttaaaaaaagaggttggcgatctggccatcgtcaacacgccggcgggcgaagccagctggtatgtcaacgagatcgaatacgttaaatag

SEQ ID NO: 3902 - DNA, 2232 bp, Klebsiella pneumoniae
atgagctgtatcgcgaccaggaggcctggacccgcgcggctatcctcaacaccgcgcgctgcggcatgttcagctccgaccgctcgatccgcgattatcagcaacgtatctggcaggcgaaacgctaaaggaaggcctatggagagtaaacgcctcgataatgccgcgctggcggcgggcatcagccccagctatatcaacgcgcacggcaagccgcagtctatcgcggctgtcaccaaacagcgcctgctggatgcgatgcatcgctctaccgccgccacgaaagtggcggttaacccgctgccgaacgtgaaaattttcactcacggcaaaaaaatgtcgctgccggtggcaggacgcggtgagtatcagtggatcctgactactgaggacggtaagcagtatcaagggaaaacccgcggcggcgagacgctgccgctgccggccaaactgccggaggggtaccactccctgaccctcacccaggagggggagcgctggcactgccggactatcgtcgcgccagcgcgctgctatgagccgcagccgctgaaagaggggaaaaagctgtggggcacctgcgtgcagctgtataccctgcgctccgagaaaaactgggggatcggcgattttggcgatctgcgggccatgctgccggaaatcgcccgccgcggcgggtcgtttattggccttaacccgattcatgccctctatccggcgaacccggagagcgccagcccctatagcccgtcttcacgtcgctggctgaacgttatttatatcgacgtcaacgcggttgaagatttccagcgtagcgaagaggcgcaggcgtggtggcagtctccggcaacgcagcaggcactgcaggcggcgcgggaaacggacgatgtggattataccgccgtcactacgctgaaaatgaccgcgctgcgtatggcatggaaacaattctctcgtcgtgaagatgagcagatgacagcgttccgcgagtttgttctgcgcgaaggggaaagcctctactggcaggcggctttcgatgcgctgcacgcctggcaggtacaacaggacccgctgcgctggggctggccggcctggccgaaggcctttcaggatatcgacagcccggaggtgaaagccttctgcgtcgagcatgaggatgacgtcagtttctatctctggctgcagtggctggcctggagtcagtttgccgcctgctgggaaaccagccagcgtgacggcatgccgatcggcctctaccgcgacctggcggtgggcgtcgccgagggcgggtcggaaacctggtgcgatcgtgaactgtactgcctgaaagcatccgtaggcgcgccgccggatattctgggcccgctgggccagaactggggtctgccgccgatggatccgcatatcattgccgcccgcgcctatgagccgtttatcgacctgctgcgcgctaatatgcagaactgcggcgcgttgcgcatcgatcacgtgatgtctgtgctgcgtctgtggtggatcccgtatggtgaaaccgccgaccatggcgcttacgttcagtatccggtcgacgatctgctgtcgcttctggcgctggaaagccagcgtcatcgctgcatggtgatcggtgaagatctgggcacggtaccggtggagatcgtcagcaagttacgcaagagcggcgtctattcttataaggtgctctattttgagagtgatgcagagaaaacgttccgcgcgccggcgctgtacccggagcaatcaatggctgtggcgacgacgcacgacctgcccactctccgcggctactgggaaagcggcgatctgacgttaggtaaagcgctgggcctctatcctgatgaggtggtgctgcgcggactgtaccaggaccgcgagctggcgaaacaagggctgctggacgcactgcataagtacggctgtctgcccaagcgcgccggccataaggcctcgctgatgagcatgacggggatcctcaaccgggggatgcagcgttatattgccgacagcaacagcgccctgctgggcctgcagccggaagactggcttgagatggcgacgccggttaacattccgggcaccagcaccgagtacccgaactggcgccggaagctgtccgtcaccctggagcagatgtttgccgatgaacgggtcaataagctgattaaggatctggataaacggcgcaaggcggcgagcaagaaagccgcctcctga

SEQ ID NO: 3903 - DNA, 486 bp, Klebsiella pneumoniae
caacggagtatttccatgccacgtcgtcgcgtcattggtcagcgtaaaattctgccggatccgaagttcggatcagaactgctggctaaatttgtcaatatcctgatggtagatggtaaaaaatctactgcagaaactatcgtatacagcgcgctggagaccctggctcagcgttctggtaaatctgaactggaagccttcgaagttgcgctcgaaaacgtgcgcccgactgtcgaagttaagtcccgccgcgtaggtggttctacttatcaggttccagttgaagttcgtccggtccgtcgtaatgccctggcaatgcgttggatcgttgaagctgctcgtaaacgcggtgataaatccatggctctgcgcctggcgaacgaactcactgatgctgcagacaacaaaggtactgcagttaagaaacgtgaagacgttcaccgtatggccgaagccaacaaggcgttcgctcactaccgttggtaa

SEQ ID NO: 3904 - DNA, 1203 bp, Klebsiella pneumoniae
ttagctatcatatgcttttcctatcggtataaacaaaataatgcgctaataaacaacatcacaacaaatgcaaaaaccataataatggggagcctcaggatgaatatgaagggtaaagcgttactggcaggatgtattgccttagttatgagcagcgcggcgctggcggaagatatcaaaatcgcggtagtcggggcgatgtccggcccggtggcccagtacggcgaccaggagtttaccggcgcagagcaggcggtagcggatatcaacgctaagggcggcatcaagggcaataagctgcagatcgtcaaatatgatgacgcttgcgacccgaaacaggcggtagcggtagccaacaaagtggtcaacgacggcatcaaatacgtcattggtcacctgtgttcctcttccactcagccggcgtctgatatctatgaagacgaaggcattctgatgattaccccggcagcgactgctccggagctgacggcgcgcggctataagctgatcctgcgcaccaccggtctggactccgatcaggggccaaccgcggcgaaatacattctcgacaaagtgaagccgcagcgtatcgcagtggtacatgacaaacagcagtacggcgaaggtttggcccgtgcggtgcaggatggcctgaaaaaaggtggggcaaacgtggtcttcttcgacgggatcaccgccggtgagaaagatttctccaccctggtggcgcgcctgaagaaagagaatatcgatttcgtctactacggcggctatcacccggaaatgggccagatcctgcgtcaggcgcgcgccgccggtctgaaaacccagtttatgggcccggaaggcgtagcgaacgtctccctgtctaacatcgccggcgagtcggcggaaggcctgctggtaaccaagccgaagaactacgaccaggtgccggcgaacaaaccgatcgtggacgcgatcaaggcgaagaaacaggatccgagcggcgccttcgtctggaccacctacgcggcgctgcagtcgctgcaggcaggcctgaatcagtctgacgatccggcggaaatcgctaaatacctgaaaggcgcgacagtagacaccgtgatgggcccgctgtcgtgggatcagaaaggcgacctgaaaggcttcgagttcggggtctttacctggcatgcgaacggtacggcgaccgacgccaaataa

SEQ ID NO: 3905 - DNA, 912 bp, Klebsiella pneumoniae
ggggccatcatgtcacaagttactgaaaataaagttatcgctgcgccggtacccatgactccgctgcaggagttctggcactatttcaaacgcaacaaaggggcggtcgtcgggctggtatacgtggtggtgatgatcgtcatcgcggtattcgccaacttcctcgccccctataacccggcggatcagttccgtgattcgctgctggcgccgccgttctggcaggacggcggcagcatggcgcatctgctcggcaccgacgacgtgggccgcgatattctgtcgcgcctgatgtacggcgcccgcctgtcgctgctggtgggctgcctggtggtggtcctgtcgctgatcctcggcgtggtgctcggcctggtggcgggctatttcggcggagtggtggactcaatcatcatgcgcgtcgtcgatattatgctggcgctgccgagtctgctgctggcgctggtgctggtggcaatcttcgggccctccatcgtcaacgcctcgctggcgctaaccttcgtggcgctcccgcactatgtgcgtctcacgcgcgccgcggtgctggtggaggtcaaccgtgactacgtgaccgcctcccgcgtagcgggcgccggcgcgatgcgccagatgttcgttaatattctccctaactgtctcgcgccgctgatcgttcaggcgtcgctgggcttttccaacgccattctcgacatggcagcgctggggttcctcggcatgggcgcgcagccgccgacgccggagtggggcaccatgctttccgacgtgttgcagttcgcgcagagcgcctggtgggtagtcaccttcccgggcgtggcgatcctgctgacggtgctggcatttaacctgatgggtgacggtctgcgtgacgcgctcgatcccaaactgaagcagtaa

SEQ ID NO: 3906 - DNA, 579 bp, Klebsiella pneumoniae
ggaatttccatgctcaaatcaacactggcggcgatggctgccgttttcgctatttcagcgttctccccggccatggcggcaaagggcgatccgcatgtgctgctgaccacttcggcaggtaacattgagcttgagttaaacagccagaaagccccgatttccgtggataacttcctgaagtacgtcaacagcggcttctacaacaacaccacctttcaccgcgtgatcccgggattcatggtgcagggcggcggctttaatgaacagatgcagcagaagcagcctaacccgccgatcaagaatgaagcagacaacggcctgcgcaacacccgcggcaccatcgcgatggcgcgtaccgccgatcaggatagcgccaccagtcagttcttcatcaacgtggcggataacgccttcctcgaccatggccagcgcgactttggctatgcggtattcggcaaagtggtgaaggggatggatgttgcggataagatctcccaggtccagacccataacgttggtccgtaccagaatgtgccgaccaaaccggtcgttatcctctctgcgaaagtgctgccctaa

SEQ ID NO: 3907 - DNA, 807 bp, Klebsiella pneumoniae
tgcaatcccatacctgagcgttcagcccccagccgtgcagcagcacaagatgacaatctccttcgccgattgtttgccaccagatgtcgttcatccgttaccgttctctttttactggacagaaggccaaatatgctaacagcacacagcttatgctggctatgccaaatgccgctggcagtcgcctgctgggggatctgctcccgctgcagccgcgccctgctcgcctgtcccccgctctgcccgcagtgcggcctgccggcggcggcatcccgtcacccctgcggccgctgcctgcaaaagccgcctccctggcatcggctggtggcggtcaatgactatcgcccgccgctaagcggtctggtgcagcagctgaagtttcaccatcgcccggagctgggggccgccctcgcgcgtctgctgctgcagcgccttctgcagcgtgacgatttgccgccggtagacgctctggtcggcgtgccgctatggcatcgccgtcgctggcgccggggttataatcagtgcgacgaactgtgccgaccgttagcccgctggcgaggatgcgtctggcatcgcgaaggcctgactcgccagcgagccggcgccgtccaacattcgctcaatgcccgccagcgcaggcagaacctgaaaaatgcctttcagcttgaatttgccgtgcagggactccatatcgctctggtggatgatgtcgtcacgaccggcagcaccgtcgccgagatatcccgcctgcttttgcgaaacggcgccgcgacggttcaggtatggtgtttgtgccgtaccttgtag

SEQ ID NO: 3908 - DNA, 1563 bp, Klebsiella pneumoniae
agctgcgccatgaataaacagcgaggagtgtggtcgcaaatggcaaaagagaaaaaacgtggcttcttttcctggctgggctttggacagaaagaacaggcacaggaaaccgagacagagcaaaaagtagaagaacagcaagcggttgccgaagagataccggcggttgaaacccctgctgagccgagcgcgccgaaagcagacccggaggcgtttgccgaagacgtcgtcgaagtgaccgagacggtggtcgaaagcgaaaaagcgcacctcgcggagcctgccagcgcgcaggaagaagagtgggtggaaacgcctgctctgaccgaagaaacgcctgttgttgaaccggagcccgcggtcagcgaaccgcctgaacagcctgcggtggttgagccgctggcggaagaggttatcgccgaaccggtggtggcggaagccgtagcagagcagcctgtggaaggcatcgttgtccagccgcaggagacagaagcgcccgaagaggacgcgccgttaagcgatgaagagctggaagcgcaggcgctggcggccgaagcggcagaagaggcggcggtagtggtgccggcgcccgaggacgaggcgccgcttgaagcgctggctcaggagcaggaaaaaccgacaaaagaaggtttcttcgcccgcctcaaacgtagcctgctgaaaacgaagcaaaatctcggttccggatttatcagcctgttccgcggtaagaagatcgacgatgatctgtttgaagagctggaagaacagctgctgatcgccgacgtcggggtggaaaccacccgcaagatcattaccaacctgacggaaggcgccagccgtaagcagctgcgcgatgcggaagcgctgtacggcctgctgaaagaagagatgggcgagattctcgccaaagtagacgagccgctgaacgttgaaggcaaaacgccatttgttattctgatggtcggcgtgaacggggtggggaaaaccactaccatcggcaagctggcgcgtcagtttgaacagcagggtaagtcggtgatgctggcggcgggggataccttccgtgcggcggcggtggaacagctgcaggtctggggccagcgtaataatatcccggtgatcgcccagcacaccggcgccgactccgcctcggtgattttcgacgccattcaggcggcgaaggcgcgccatgttgacgtactgattgccgataccgccgggcgtttgcaaaataaatcgcacctgatggaagagctgaagaagattgtccgggtaatgaaaaagctggacgtcgacgcgccgcacgaggtgatgttaaccattgacgccagcaccgggcagaatgctattagccaggccaaactgttccatgaggcggtaggtttgaccgggatcaccctgaccaagctggacggcaccgccaaaggcggcgtgatcttctcggtggccgatcagttcggcattccgattcgctatattggcgtcggcgagcgtattgaggatctgcgtccgtttaatgcgggcgactttattgaggcactttttgcccgagaggattaa

SEQ ID NO: 3909 - DNA, 837 bp, Klebsiella pneumoniae
ttaggcagcatgaaaaagaatcgcgcttttctgaagtgggcagggggaaagttccccctgcttgacgatattaaaaagcatttgccggaaggcgagtgcttgatcgagccctttgtgggcgccgggtcggtatttcttaataccgacttttctcgttatatcctcgcggatatcaacagtgacttaatcggcctgtacaacatcgtcaaactgcgcaccgacgaatacgtcgccgccgcccgtgagatgtttaccccggaaaataacgtcgctgagcgctactacctgtatcgtgatgaatttaaccaaagccaggatccgctgcgtcgcgcggtgctgttcctgtatttgaaccgtcacggctacaacggcctgtgccgctacaatctgcgcggcgagttcaatgtgccgtttggccgttataaaaagccctatttccccgaagctgagctctatcatttcgccgagaaggcgcaaaacgccgagttttactgcgaatcttacgaagagtgcatgcaacgtgcggatagccgcacagtggtgtattgcgatccgccctatgcgccgctaacggcgacggcgaactttaccgcctaccacaccaacagtttcaacctggaacaacaggtactgctggcgcaaaaggcggaatcgctgatgaaaaagcgcatcccggtgctgatttccaaccaccgcacgccgctgacgcaggaatggtataaaaacgcggcagaaacgcatattgtgaaggtgcggcgcagcatcagcagcaacggtggtacgcgtaaaaaggtggacgagctattagcgctctaccgtccgcctaagaccaaataa

SEQ ID NO: 3910 - DNA, 909 bp, Klebsiella pneumoniae
gcgatcggcatggataaaattcatgcaatgcagttattcattcgcgtagcggatctggagagcttctcccgcgccgccgagaccctggcgctacctaagggtagcgtctcgcgacagattcaggccctggaaagccatcttggcgtgcggctcctgcaccgcaccacccgccgggtccagctcacccaggatgggatggtctactacgagcgggcgaaagatctgctgagcaacctcgacgaactggacggcatgttccagcacgatccggcgagcatcagcggccggctgcgggtggatatgccggtcggttttgctaaaaaaatggtgatcccgcatctgccgacttttttacagcagtatccgggcatcgaactggagctgagcagcagcgatcggctggtggacgtgatccgcgaggggtttgactgcgtggtgcgcgtcggcgcgctcaaagactcagggctgattgcccgcccgctgggcaagctgacgcaaattaactgcgccagcccggactatctggcgcgttttggctatccgcaatccctggaggatctggcggatcatgccctgatccactacgccagcaccctcggggtccgtccccccggctttgaggtaatgatcgacggcgcggtgcgctgggtaaaaaccggcggcatattgacggtcaacagtacggaaacctatcaggcagcctgtatcgccgggctggggattattcaggtgccacgcaccggcgtgcgcgaggcgttacgcgccggcgacctgattgagatcctgccccagtaccgcgccgagccgctgccggtctcgctgatctacccgcaccggcgcaatctctcccgccgggtaaatctgtttatggagtggctgggcggactgatgaaagcgtatgtcgattga

SEQ ID NO: 3911 - DNA, 315 bp, Klebsiella pneumoniae
ggttacttaatggctaagcaatcaatgaaagcacgcgaagtaaagcgcgtggctttagctgataaattcttcgctaaacgcgctgaactgaaagctatcatctctgatgtgaacgcaaccgacgaagatcgttggaatgccgttctcaagctgcagactctgccgcgtgattccagcccgtctcgtcagcgtaaccgctgccgtcaaacaggtcgtccgcatggtttcctgcggaagttcgggttgagccgtattaaggtccgtgaagccgctatgcgcggtgaaatcccgggtctgaaaaaggctagctggtaa

SEQ ID NO: 3912 - DNA, 243 bp, Klebsiella pneumoniae; identical to SEQ ID NO: 3601

SEQ ID NO: 3913 - DNA, 2592 bp, Klebsiella pneumoniae
actgcccaaataaaactaaatgggaaaacaccggtgaagttcgtaaagtatctattgatccttgcagtctgttgcgtactgctgggagcaggctcgatttttggcctctacaaatacatagagccgcaactccccgacgtcgcaaccctgaaggatgtgcgtttgcagatcccgatgcaggtctatagcgccgacggtgagcttattgcgcagtacggcgaaaagcgccgtatccctgtgacgttgcagcaaattccccccgagctggtgaaagcgtttatcgccaccgaagacagccgcttctatgagcaccacggcgtcgatccggtaggtattttccgcgccgccagcgtggcgatgttttcaggccacgcctcccagggcgccagcaccatcacccagcagttagcgcgtaacttctttctcagccccgagaagacgttgatgcgtaagattaaagaggcctttctggccatccgcatcgagcagttgctgaataaagatgaaatccttgagctgtatctgaacaagatctacctcggctaccgcgcctatggcgtcggcgccgcggcgcaggtctattttggcaaacctatcgaccaactgaccctgagtgagatggcggtgattgccggtctgccgaaagcgccttccacttttaacccgctctattcgatggatcgcgcgaccgcccgtcgcaacgtggtgctgtcgcgtatgctgagcgaaggatacatcacccaggcgcaatacgatgaggcgcgcagcgaacccatcgacgccagctatcacgcgccgaaaatcgccttctccgccccttacctgagtgaaatggtgcgccaggagatggtgaatcgctacggcgagcaggcctacgaagatggttatcgggtctacaccaccattacccgtaaaaaccagcaggcggcccagcaggcggtacgcaataacgtgctggattacgatatgcgtcacggctaccgcggcccggccagcgtactgtggaaagtcggcgaaacgccgtgggagacgaagaagatcgtcgattcgctgaagcgtcagtctggctacggtccgcttttcccggcggtggtcacctccgcgaatgcccaggaggctgtcgcgttgttggctaacggcgactccgtttcgctgacgatggagggcgtgcgctgggcccgtcgctttatctcagatacgcagcaaggggcgaccccgcgtaaagtcaacgacgttgtgcaggccgggcagcagatctgggtacgcaaggtgggtgacagctggtggctgtcccagctcccggacgtcaactcagcgctggtctccattaacccgcaaaacggcgcgattattgcccttgtcggcgggtttgactttaaccagagcaaattcaaccgcgccacccaggcgctgcgccaggtcggctccaacattaaaccgttcctctataccgccgcgatggataaaggcttaacgctggcaagtatgctcaacgatgtgccgatctcgcgctgggatgcgggcgcaggttccgactggcggccgaagaactcgccgccgcagtatgccggtccgattcgtttacgccagggcctggggcagtcgaaaaacgtggtgatggtgcgcgctatgcgcgccatgggcgtagactacgccgccgagtatctgcagcgctttggcttcccggcgcagaacattgtccacacggaatcgttggcgctgggctcagcctcctttacgcccctgcaggtcgctcgcggttattcggtgatggccaacggcggcttcctggtcaatcctttctttatcagtaagattgagaacgatcagggcggggtcctcttcgaggagcgtccgaaaattgcctgtccgcagtgtgatttaccggtaatttacggcgatacgccaaaatccaacgtgctggaaaacaaggatgtggaagatgtcgccacctccgcggaaccgcagaatggcaacgtgccgccgcagccgcagctggagcaggccaaccagtcgctggtcgcgcagagcggcgcacaggaatacgcgccgcatgtgattaacacaccgctggccttcctgatcaagagcgcgctgaacagcaacatctttggcgagccgggctggatgggcaccggctggcgcgccggacgcgatctgcagcggcatgacatcggtgggaaaaccgggaccaccaacagctcgaaggacgcctggttctcaggctacggaccgggcgtggtgacctcggtttggatcggctttgacgatcatcgtcgcgatcttggccggaccaccgcctcaggagcgattaaagatcagatctctggctatgaaggcggtgccaaaagcgcccagccggcctgggacagctttatgaagagcgtgctggaaggcgttccggaagaaccgttaactccgccgccgggtatcgtcacggtgaatatcgaccgcagcaccggtcagttggcgaatgggggcaatagccgggcggagtactttattgaaggaacccagcccacccagcaggcagtccgtgaggtgggcaccaccctgactgacggcggcggtgaaacccacgaattgttctga

SEQ ID NO: 3914 - DNA, 237 bp, Klebsiella pneumoniae
caacgtaaaataatcatttcgtgtcattcccgccgggcgggaatgacctctaattatgcgcaggaggccgtactccagcaagggagtacgggcctaagaggaggatttaagaggataattcgtgcgttttgttcgccggaacacggttattcagaacgtcatccatctgtttggcatccagttctttcacccatttcgccaccaccaccgtggcaacgccgttacccaccaggttag

SEQ ID NO: 3915 - DNA, 900 bp, Klebsiella pneumoniae
cttcaacgaatacagcatgttaatgctcggcggcctgatggtgctgatgatgatctggcgtccgcaggggcttctgccaatgacgcgcgtgcagttgaagctgaaaaacggtcaggcgaaaggagagcaggcatgagtcagccattattatccgttagcggcctgatgatgcgtttcggcggtctgctggccgtcaacaatgtgtcgctggagctcagagagcgcgagatcgtctcgctgatcggccccaacggcgccgggaagaccaccgtctttaactgcctgaccggtttttacaagcccaccggcggcactattctgctgcgcgaccagcacctggaagggctgccgggtcagcagattgcgcggatgggcgtggtgcggaccttccagcacgtgcgcctgttccgcgaaatgacggtgattgaaaacctgctggtggcgcagcatcagcagctgaaaaccgggctcttctccggcctgctgaaaacgccggccttccgtcgggcgcagagcgaagcgctggacagggccgccacctggctggagcgtatcggcctgctggagcatgccaaccgtcaggccagcaacctggcctacggcgaccagcgtcggctggagattgcccgctgcatggtgacccagccggaaattctgatgctcgatgaaccggcggcggggctgaacccgaaagagaccaaagagctggacgagcttatcgccgagctgcgtaaccatcacaacaccaccatcctgcttatcgaacacgatatgaagctggtgatgggcatttccgatcgcatctacgtcgtgaaccagggaacaccgctggccaacgggacgccggaagagattcgtaataacccggacgtgatccgcgcataccttggtgaggcataa

SEQ ID NO: 3916 - DNA, 189 bp, Klebsiella pneumoniae
ggacgcagaattttagggcggtgccgaaaaggtgtcaagaaatatacaacgatcccgccatcaccaggccaactgaccggcatgtttgactgtgagtctgacgaaatcagtatagctaaccctgccgacactgtccgcaatttgaccagccagcccgcgggcgtcaacgtcgtcttgcagcacgtatag

SEQ ID NO: 3917 - DNA, 588 bp, Klebsiella pneumoniae
gagtgcggaatgtgggatccattcccggaaaatgccttttgtgctgaatgggagaggatgagcatagtgacgcaatgttcatcgatcattgcggggtcaactatgctcgccgccctccccttcttgctgtgctatagcggtttgaccgtggcattatgccaccaggatctgcgccacggtctgttgcccgaccgttacacctgtcccctgctgtggagtggtttacttttttatctctgtctggcgccgcaccagctgcatgatgccgtctggggggcgatagcgggctatctctctttggctgcgatttactggctataccgcggtatccgcggctatgaagggttgggttatggagatataaaatatcttgccgccctcggcgcctggcatggctggcgattgctgccgcagttggtcctggttgcctcgctactcgccggcatagcgtgggcaggagcaggtttatacgccagttgcggcaggaagagcaaatggggaagaagcaacccgctgccgtttgggccattcctggcggccgcgggtttttggtgcgggtggcagacgctggctaatctgacactttga

SEQ ID NO: 3918 - DNA, 2784 bp, Klebsiella pneumoniae
tcaccgaccttattagatattaattacgaagcgcaaaaaaaatcgcaacctctctcttgcacagcgaaatgtagaactatgttgattccgtccaaattaagtcgtccggtccgccttgaacacactgtggttcgtgagcgcttactggcgaaactttccggcgcgaacaattatcgtctcgtgctgatcaccagtcctgccgggtacggtaaaacaacgctcatttctcagtgggccgcgggtaaaaacgatcttgggtggttttcgctggacgaaggcgacaaccagcaggagcgttttgccagctatctgatcgcggcgattcagcaggctaccggcaaccactgcgcggccagtgaagcgatggtgcaaaaacgccagtacgccagtctctcctctctttttgcgcagctgtttattgaacttgccgactggcagcgcccgctgtatctcgtcattgatgattaccatctgatcaataatccggtgatccatgacgcgatgcgctttttcctgcgccatcagccggagaatatgaccctggtggtcctgtcgcgtaacctgccgcagctgggcattgccaatctgcgcgtccgcgatcagcttctggagattggcagtcagcagctggcctttacccaccaggaggcgaaacaatttttcgactgtcgtctgacatcgcctatcgaagccgacgacagtagccggctgtgcgacgatgtcgccgggtgggccaccgcgctacaactcatcgccctctccgcccgccagaataactcctccgcccaacactccgcccgccgcctcgccgggattaacgccagccatctgtcggattatctggtggatgaagtgctggataacgttgacgcccgcacgcgcaactttttgctgaagagttctctgctgcgctcaatgaacgacgcgttaatcgtgcgcgtcaccggcgaagagaatggccagatgcagctggaggagatcgaacgccaggggctgttcctgcagcggatggatgattccggcgaatggttccgctatcacccgctgtttggcagcttcctgcgccagcgctgtcagtgggagctggcggttgaactaccggagatccaccgcgccgcggcggaaagctggatggcgcaaggtttccccagcgaggccatccaccatgcgctggcggccggcgatgccaaaatgctgcgcgatatcttgctcaatcatgcctggggcatgtttaaccatagcgagctggggctactggagcagtcgctggcggcgctgccatggtccaatctgctggaaaatccgcgcctgatcctgctccaggcctggctgatgcagagccagcatcgctacagcgaagtcaataccctgctggcgcgcgccgagcaggagatgagtgtggaaatggacaccgcgatgcatggcgacttcaacgcgctgcgcgcgcaggtggcgattaacgatggcgaccaggacgaggcggaacgtctgtcaatggtggccctggaagagctgccgctggccaactattacagccgcatcgtcgccacatcggtgcatggcgaagttctccattgtaaggggaagctgaccaaatccctcgccgtgatgcagcagaccgaacagatggcccgccgtcacgacgtatggcattacgccctgtggagcatcattcagcaaagcgaaatcctcttcgcccagggcttcctgcaggccgcctgggagagccaggagaaagccttccagctggtacgcgaacagcatcttgagcagttgccgatgcatgagttcctgctgcgcatccgttctcagctgctgtgggcatgggcgcgcctcgacgaggctgaagcttgcgcccgccaggggatggacgtgctatccacctatcagccgcagcagcagctgcagtgcctggcgctgatggtccagtgctcactagcgcgcggcgatctggataatgcccgcagccacctgaaccggctggaaaacctgctcggtaacggtcactatcacagcgactgggtctccaacgccgataaggtgcgagtgatctactggcagatgaccggtgataaaaccgcggcggccaactggctgcgccagacgccaaagccggagttcgccaacaaccacttcctgcagagccagtggcgcaacattgcccgggcgcagatcctgctgggcgatttcgaaccggcggaaatggtgctggaagagctgaacgaaaatgcgcgttcgctgcgtttgatgagcgatctcaaccgcaacctgctgctgctcaaccagctgtactggcagtcaggacgcaagagcgaagcgcagaaagccctgctggaagccctgacgctcgccaaccgcaccggttttatcaaccactttgtgattgaaggcgaggcgatggcccagcagctgcgccagctgatccagttgaacacgttgcctgagctggagcagcatcgcgcccagcgtattctgcgcgacatcaaccagcatcatcgccacaaattcgcccactttgacgaagggttcgtcgagcgactgctgaatcatccggaggtgccggagcttatccgcaccagcccgctgacccagcgcgagtggcaggtgcttggcttaatctattccggttacagcaacgagcagattgccggcgagcttgacgtggcggccaccaccatcaagacccacattcgcaacctgtatcagaaactgggcgtcgcccaccggcaggacgcggtacagcatgcccagcagttacttaagatgatgggatacggcgtctga

SEQ ID NO: 3919 - DNA, 2058 bp, Klebsiella pneumoniae
tgcacgacctttggtcagagaacgcagctgagttgcataaccgaacatttcggacagcggtacttcagcgtggatcttaacgccggttacttcggattcctgaccgcgcagcataccgcgacgacggctcaagtcaccgataacgtcaccagtgttctcttccggagtttctacttcaaccttcatgatcggctcaagcagaactggttttgctttcttaaagccttctttaaaggcaatagacgcagccagtttaaacgccagctcagaggagtcaacgtcgtggtaagaaccgaagtgcagacggatacccatatcaactaccgggtaacctgccagcggaccagctttcagctgttcctggatgcctttatcaacggccgggatgtattcgccaggaattacaccacctttgatgtcgttgatgaactcgtaacctttcgggttagagcccggctccagcgggtacatgtcgatcacaacgtgaccgtactgaccacgaccaccagactgcttggcgtgtttaccttcgatatcggtaactttcgcgcgaatcgcttcacggtaagcaacctgaggtttaccgacgttcgcttcaacgttgaattcacgcttcatacggtcaacgatgatgtcgaggtgcagctcacccataccggcgataattgtctggttagactcttcgtcagtccatacgcggaaagacgggtcttctttagccagacgacccagagccagacccattttttcctggtcagctttggttttcggctcaacggcgatggagattaccggctcagggaattccatacgctccagaatgatcggcgcatccgggtcacacagggtgtcaccagtagttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtacacgcggaagaaggtcaggttacccacgaacgggtcggtagcgattttgaacgccagtgcagagaacggctcgtcgtcgcttgcgtgacgctcagccggggtatctttaccgtcgtccaggataccgttgatcgcaggtacgtcaaccggagatggcaggtaatcaattaccgcatccagcatcgcctgaacgcctttgttcttgaacgcagaaccacaggttaccaggatgatttcgttgttcagaacgcgctgacgcagagcttttttgatctcttcttcagtcagttcttcaccacccaggtatttttccatcagctcttcagaagcttcagctgcggattcgatcaggttctggtgccattcatcagccaggtcctgcatgtcagccgggatatcttcgtattcgaaggttacgccctggtctgcatcgttccagttgatggctttcattttcaccaggtcaacaacgccggtaaaaccttcttcagcaccaattgccagctgcagcggaaccgggttcgcgcccagacgggttttgatctgaccaacaactttcaggaagttagcgcccatgcggtccattttgttaacgaacgcgatgcgcggaactttatatttgtttgcctgacgccatacggtttcagactgcggctgaacaccaccaactgcgcagtaaaccattaccgcaccatcaagaacacgcatggaacgttctacttcgatagtgaagtcaacgtgccccggggtgtcgatgatgtttacgcggtgcggttcatactgtttggccataccagaccagaatgcagtagtcgcagcggaagtgatggtgataccacgttcctgctcctgctccatccagtccatggtagcggcgccgtcatgaacttcaccgattttgtggtttacaccggtgtagaacagaatacgttcggtagtagtggttttaccggcgtcgatgtgcgcactgataccgatgttacggtagcgtgcgatgggtgttgtacgagccatttgattcctcgtttatttctttag

SEQ ID NO: 3920 - DNA, 1617 bp, Klebsiella pneumoniae
ctggggctgatgcccgccgccagcgcggcattatcgaggcgtttactctccataggccttcctttagcgtttcgcctgccagatacgttgctgataatcgcggatcgagcggtcggagctgaacatgccgcagcgcgcggtgttgaggatagccgcgcgggtccaggcctcctggtcgcgatacagctcatctacccgtttttgcgccgctacgtaggcttcgaaatcggccagcaccaggtacggatcgccgccctgcagcaggctgtgcagcatctgatcgaaggcatgcttgtcgccgttgctgtaggtgccgttctccagctccttaagcaccgcatcgagcagcttgtcttttttacgccatttcagcggatcgtagcctttcgctttcagggctttcacctcttcaaccgtgtggccgaagataaagatgttctcctcgcccacctgctcagcgatttccacgttagcgccatccagcgtcccgacggtcagcgcgccgttcagcgccagcttcatgttgccggtgccagaggcttctttacccgcggtggagatctgctcggagatatccgccgccgggatcagtttttctgctgccgatacacaatagtccggcaggaagaccaccttcagcttatcgctgactttcgggtcgttgttgatcgcttccgctaccttattgatggcaaaaataatgtttttcgccagatagtagcccggcgccgctttcgcgccgaacaggaagacgcgcggtacgcggtcggactgcgggttttcgcggatctctttgtacagcgcaaggatatgcagcaggttaaggtgctgacgcttatactcgtgcagacgtttgatctggatatcgaagatcgcctgcgggttgatctcaatcccggtacgctgcttcacaaactcagccagatgaactttgttggcctgcttgatatcgcgataagtctgacggaacgccgcatcgtcagcatatttttccaggttgatcagctggtcgaggtcattggcccactcttttttcagcgtctcatccagcagcgaggccagcgccgggttgcactgcttgatccagcggcgcggcgtgatgccgttggtcacgttatggaatttgttcggccacagctggttatattccgggaacagatcttttaccaccagatccgagtgcagcgccgccacgccgttgacagcaaagccgcccaccacgcacatgttggccatccgaacctgtttgtcatgcaccaccgccagcttcgcccagacctgcttatcgcccggccaggttttgtccaccagctgtttaaagcggtcgttgatctctttaatgatctgcatatggcgcggcagcagcgctttcaccagcttctcatcccagcattccaacgcttccggcatcagggtgtggttggtgtaagcaaaggttttgctggtgatcgcccaggcgtcgtcccagctcagctggtgctcgtcaatcagcacgcgcagcagctccgggatggcgatggtcgggtgcgtatcgttcagctggatcacttcgtaatccgccagctcggccagcttgcggcctgccagatgatgacggcgcaggatatcggccactga

SEQ ID NO: 3921 - DNA, 276 bp, Klebsiella pneumoniae
ccacgttcgatttcttcacgtttgataccacgcagcagaacacctacgttctcaccagcacggccttcgtccagcagtttgcggaacatttcaacgccagtacaggtggttttcgcggtttctttgataccaacgatttcaacttcttcacctactttgatgataccgcgctctacacgaccggtaacaacggtaccacgaccggagatggagaatacgtcttcgatcggcagcaggaacggcttgtcaatcgcacgctctggttccgggatatag

SEQ ID NO: 3922 - DNA, 654 bp, Klebsiella pneumoniae
cgctgcgttttccaggttagttggagaaagaaaatggcaagatatttgggtcctaagctcaagctgagccgtcgtgagggcaccgacttattccttaagtctggcgttcgcgcgatcgataccaagtgtaaaattgaacaagctcctggccagcacggtgcgcgtaagccgcgtctgtctgactatggtgtgcagttgcgtgaaaagcaaaaagttcgccgtatgtacggtgtgctggagcgtcagttccgtaactactataaagaagcagcacgtctgaaaggcaacaccggtgaaaacctgttggctctgctggaaggtcgtctggacaacgttgtataccgtatgggcttcggcgccactcgtgctgaagcacgccagctggttagccacaaagcgattatggtaaacggtcgtgttgttaacatcgcttcttatcaggttaaagcgaatgacgttgtcagcattcgtgagaaagcgaaaaagcaatctcgcgtgaaagccgctctggagctggctgagcagcgtgaaaagccaacctggctggaagttgatgctggcaagatggaaggtacgttcaagcgtcagccggagcgttctgatctgtctgcggacattaacgaacacctgatcgtcgagctttactccaagtaa

SEQ ID NO: 3923 - DNA, 1041 bp, Klebsiella pneumoniae
ccgatgacgatgtcactcgcgttatctccgcactgcgccagttgtcaggacgttgatatgcttacttaccctcccgtgaagaaggtctcggtggttatcccggtttataacgaacaggatagcctgccggaactgcttcgtcgtacggatgccgcctgcgccaccctggggcggcaatatgaaattctgttgatcgacgatggcagcagcgacgattccgcgcgcatgctcaccgaagccgccgaggcggaaggcagccacgtcgtcgccgtgctgttaaaccgtaactacggccagcactcggcgatcatggccggcttcagccatgtaaccggcgatctgattattaccctagacgccgatctgcaaaacccgccggaggagatcccgcggctggtggcgaaggctgatgaaggttacgacgtggtgggcactgtccgccagaaccgtcaggacagcatcttccgtaaaaccgcgtcgaagatgatcaaccgcctgatccagcgcaccaccggcaaagcgatgggcgactacggctgcatgctgcgcgcttaccgccgccatatcatcgacgccatgctcaactgccatgagcgcagcacctttatcccgatcctggcgaataccttcgcccggcgcgcggtcgagatcccggtgatgcacgccgagcgcgaattcggcgactccaaatacagctttatgcgcctgatcaacctgatgtacgacctggtgacctgtctgaccaccacgccgctgcgtctgctcagcattttcggcagcgtgattgccctgctgggcttcgccttcggcctgctgctggtggtgctgcgtctggcctttggcccgcagtgggcggcggaaggggtgtttatgctcttcgccgtgctgttcatgttcatcggcgcccagtttgtcggtatgggcctgctcggggagtatatcggccgcatctataacgacgtgcgcgcccgcccccgctactttattcaacgtgttgttcgccagccggaaacggcatctaaagaggaagatcgttcatga

SEQ ID NO: 3924 - DNA, 843 bp, Klebsiella pneumoniae
agaccagcctttgaaatcacttctggaaaggatcgcgacatgccgttgatttgcgtctgttcaccgaaaggcggcgtagggaaaacgaccctggcggccaatttagcctattcgctggcgcggacgggcagcaaagttctggcgctggattttgatgtccagaacgcgctgcgtttgcattttggcgtaccgctgaacgatgagcggggctatgtggcgaaggcgctggagctgcacgactggagccagtgcgtgttgagcgccggcagtaatattttcgtcctgccatatggcgaagtgagcgaggcgcagcgtcaggcgtttgatgagcaactgacccataatgaccatttcctccagcgcggtctgtccgcgctgcttaattatcccgggcttatcaccatcgccgatatgccccctggaccttcgcccgcgctaaaggcgctgacggggctggcggacctgcatcttatcccgctgctggcggataccgcctcgatgtcgaccctggcgcacgtagaaaagcagcgcctgaccggcgcggcgctgaatcataagcacgggcactatttcgtcattaaccaaagcgatagccgtcgccaggtcagccgggacgtcaccagcctgatggaagagaaactgggcgagcgactgcttggcgtgatccatcgtgatgaaagcgtggtggaggccaatgcctcgcagaagtcgatcctggactttaacgcttcctcggcagcggccttcgatattgaaatcatggctaaaaaaatatcttcgctgttgggtattcatattggcgatggcacggtgcacagccagccacgcatgtcagggcgttaa

SEQ ID NO: 3925 - DNA, 513 bp, Klebsiella pneumoniae
aggtgtaagatggctcacatcgaaaaacaagctggcgaactgcaggaaaagctgatcgcggtaaaccgcgtatctaaaaccgttaaaggtggtcgtattttctccttcacagctctgactgtagtaggcgatggtaacggtcgcgttggttttggttacggtaaagcgcgtgaagttccagcagcgatccagaaagcgatggaaaaagcccgtcgcaatatgattaacgtcgcgctgaaccacggcaccctgcagcacccggttaagggtactcacacgggttctcgtgtattcatgcagccggcttccgaaggtaccggtatcatcgccggtggtgcaatgcgcgccgttctggaagtcgctggggttcgtaacgttctggctaaagcgtatggttccactaacccgattaacgtggttcgtgcaactatcgacggtctggaaaacatgaagtccccggatatggtcgctgccaagcgtggtaaatccgttgaagaaattctggggaaataa

SEQ ID NO: 3926 - DNA, 342 bp, Klebsiella pneumoniae
gaggaagagatggaaactttagctcaacatcgccatgctcgttcttctgctcagaaggttcgccttgtagctgacctgattcgcggtaagaaagtgtcgcaggccctggatattctgacctacaccaacaaaaaagctgctgtactggtcaagaaggtactggaatctgccattgctaacgctgaacacaacgatggcgctgacattgatgatctgaaagttgcgaaaattttcgtagacgaaggcccgagcatgaagcgcattatgccgcgtgctaaaggtcgtgcagatcgcatcctgaagcgcaccagccacatcactgtggttgtgtccgatcgctga

SEQ ID NO: 3927 - DNA, 1251 bp, Klebsiella pneumoniae
aagctggttgtcgaaatctggtggaacctgatgcccgaacccgtcgccgaaccggcgcttaatggactgcgcctcaatctgcggattgtctctgtcgttatctttaactttgccagctacctcaccatcggcctgccgctggcggtgctgcccggctatgttcatgatgtcatgggctttagcgctttctgggccgggctggtgattagcctgcaatatttcgccacgctgctcagccgcccgcatgccgggcgctatgccgacctgctggggcccaaaaagattgtcgtcttcggcctcggcggctgctttttgagcggtttgagctatctgctggccgcctggggcagcggctggccactgattagcctgctgctgttatgcctcggacgggtgatccttggtatcggccagagcttcgccggcacaggctcgacgctgtggggcgtcggcgtggtcggttcgctgcatatcgggcgggtgatctcgtggaacgggattgtgacctatggggcgatggcgatgggcgcgccgctcggcgtgctgtgctattcgcacattggcctcagcggtctggccggggtcattatggcggtagcgctggtggctatcctctgcgcgctgccccgcgcggcggtgaaggctgccaaaggcaaagcgatgtcgtttcgcgcggtgctcggccgggtctggccctacggcatggcgctggcgttggcctccgccggctttggggtgatcgccacctttatcacgctattttatgacgccaaaggttgggacggcgcggctttcgcgctgacattattcagctgcgcgttcgttggcgcgcggctgctgtttcccaacgccattaaccgactcggcgggctgaacgtggcgatgctctgctttagcgtggaggcgatcggcctgctgctggtcggctttgccgatacgccgatgatggcgaaaatcggtactttccttaccggggctggcttttcgctggtcttcccggcgctgggggtggtggcggtgaaagcggtgccgcagcacaatcaggggtcggcgctggcgacctataccgtgtttatggatttatcgttgggcgtcagcgggccgctggccggattgctgatggcgtggaccgggatctcgatgatttatctcgccgcggcggggctggtgatggcggcgctgctgttgggctggcggctaaaaaaacggcccccggttagcgaaccggaggccagcgcaccaggccagtaa

SEQ ID NO: 3928 - DNA, 1383 bp, Klebsiella pneumoniae
ggttattctgtggatcacttacccatattctgccagttgcgccagcgcgattgtttactggttggcggcggggatgtcgccgaacgcaaagcccgtctgctgctggatgctggcgctaacgtcacggtcaatgcgctcgacttcacgccccagtttcaggtgtgggctgattcacagatgctaactctggtgcagggggagtttatcccctcgctgctggataactgctggctggccatcgccgctactgatgatgagacggtcaaccagcaggttagcgaggcggccgaagcgcggcgtatcttctgtaacgtggtggatgccccgcgccaggccagctttatcatgccgtcgatcatcgatcgctcgccgctgatggtcgccgtctcctcgggcgggacatcaccggttctggcgcgcctgctgcgcgagaaactggagtcaattctgcccctgcatctcggccagctggcccgctatgccggccatctgcgcgcgcgggttaagcagcagtttgccaccgtaggcgagcgtcgccgcttctgggagaagctgtttgttaacgaccgtctggcgcagtcgctggctaatgacgatcggcaggcagtcgcggataccactgagcagttgctgacggagccgttggagcatcgcggcgaggtggtgctggttggcgccggccccggtgacgccgggctgctcacgctcaaaggcctgcagcagatccagcaggctgacgtggtggtctatgatcggctggtctccgatgacatcatgaatctggtgcgccgcgatgccgatcgggtgttcgtcggcaagcgctcaggctaccactgcgtcccgcaggaggagatcaaccagatcctgctgcgcgaagcgcaaaaaggaagacgcgtggtccggctgaaaggcggcgatccctttatctttggccgcggaggggaagagctggagacgctttgcgaggcgggcatccccttctccgttgtgcctggcattaccgccgcctccggctgctccgcttattcggggatccccttgacccaccgcgatttcgcgcagggcgtccgcctggtcactggccacctgaaaaccggcggcgagctggactgggcgaacctggcggtggagaagcaaaccctggtgttctacatgggtctgaaccaggcgccggcgatccgcgagaagcttatcgctcacggcatggctgaagatatgcccgccgccatcgtcgagaacggcaccgctgtgacgcaaaaagtggtcagcggcaccttaggacaactggatattctggcgcagcagatggccagcccggcgctgatcatcgtcggccgcgtggtcggtctgcgggataaactgaactggttttcgaaccattaa

SEQ ID NO: 3929 - DNA, 1617 bp, Klebsiella pneumoniae
gtttactctgtcggtttcgctagtaaacttattcagtgtcaatcagggcgcacgagggatgccgtggataatgtatttactttgggtatttcatcattatgggatgaagtgtgccatatgccggtcggcggagtatggtggctcaacgtcgaccgttatgccgatgccgtcagcctgtttaatcagacactggccgcgcaggcgaaaaacagccacgttgccgcgctggttatgggaaacaaacccaaggatatcatttcattagatcatattcacggtccggataatatcgcgctgttcaccctgccgaatcgcccgcaggcgctggaggaaatacaccgcgatttagtctgctccctcgaacctggcaattatttgtttattctgctatgcgctgaaaatgcctggcaaaatataaataatgaaaagttatgcgcctgggtagaaaagaccagccgctgggcgcaatatcaccgttgcgcgttcttagcgatcaattccgcgcaggatatcgatcggcagctgactcccttattacgtgagtaccgctccctttccggactggcaagtattcgttaccagggcgaccggcatatctttgatattgcctggtggggaagcgataagggtatcagcgcccaacagcagctgatggtgcaacatgatgacgccggctggcgattagcgcaggacgctgaaaccagcgtgcagccgcgcagcgacgaaaaagcgatcctcagccatgtgcgcgtgctggaaggcgccccgccgctgtcggaatactggacgctgtttgacaccaacgacgaggtcttcaacgccgggcgcaccgcgcaagcggcgacgatcctcttctccattacccaaaatacgcaaattgaacagctgggccgctatattcataccctgcgtcgccagcgcggtacggcgctgaaaatcatcgtccgtgaacaaaccccgagcctgcgcgcgaccgatgagcggctactgctcagcagcggcgccagcctggtgatccccagcagcgcatcgctctcccgctgcctgacgctaatcgaaagcgtacagaaccaaaagttctcccgccatatcccggaagattttgccaccctgctgacctggagccagccgttaaagctgcgcggctaccagaagtgggatgccttctgcgaagcggtgcacaacgtgatgaccaataccctgcttccacccgacagcaaaggcgtgatggtggccctgcgcccggcgccggggctgcgcgttgaacaggcgctgacgttatgcaaacctaaccggatgggcgacatcataaccatcggcaataaccggctggtgctgtttttgtcgttttgccggatcaatgacctcgataccgcgctaaaccacattttcccgctgccgaccggcgatattttttctaaccgtatggtgtggtttgaagacaagcaaatcctctcggaaatcgtaatcatgcgcggcgtcgagccggcgcgctggaacacgccgctgcctctctcagtcggtaaaaacgagaccattaacgccacccacgatggacgccactggcgacgctaccccgaaccacaccggttaaccacccgcgaggagcaagcctga

SEQ ID NO: 3930 - DNA, 249 bp, Klebsiella pneumoniae
ggagggactgtggcgtcgttaatggaagtccgcgatatgctggccctgcagggccgcatggaggcgaaacagctcagtgctcgcctgcagacgcctcagccgctgattgacgccatgcttgagcgaatggaagccatgggtaaggtggtccggatcagcgaaacgagcgagggctgcctctccggcagctgtaaaagttgccctgaagggaaagcggcgtgccggcaggagtggtgggcgctgcgatga

SEQ ID NO: 3931 - DNA, 204 bp, Klebsiella pneumoniae
gacggtgatgtaatgaaagcaaaagagctgcgtgaaaaaagcgttgaagagctgaacgctgagctgctgaacctgctgcgtgagcagttcaacctgcgcatgcaggctgcaagtggccagctgcaacagactcatctgctgaagcaagtgcgtcgtgatgttgcacgcgttaagactttactgactcagaaggcgggtgcgtaa

SEQ ID NO: 3932 - DNA, 282 bp, Klebsiella pneumoniae
accggagatgtggctggaaagacgcattcccgactggttaaaccgctggctggaggttcccgcatgattattccctggcaggatctggatcccgaaacgctggataacctgattgaaagctttgtgttacgtgaaggcaccgattatggtgaatatgaacgttcacttgccgataaagtcgccgatgtaaaacagcagctgaaacgcggagaggcggtccttgtgtggtcggaactgcatgagacggtcaatattatgccgcgcgcgctgtttaacggctaa

SEQ ID NO: 3933 - DNA, 237 bp, Klebsiella pneumoniae
gctgtatacgtcctctggtttaataataaatttcgaacggacagagatatgccagcaaaagatcctgcggtacccacggacgccacgctggggtacacctttcaaaatgattttctggcgcttagccgggcattttccctgccggatattgattatcatgatatttccaggcgcgaacagctgaacgcggcgctgaagcgctggccgctgctggcagagtttgcagagaaaaaataa

SEQ ID NO: 3934 - DNA, 222 bp, Klebsiella pneumoniae
acttacaacgtcagctggcacaaggagaataaaatgagttttttaaaagagtttcgcgaattcgcgatgcgcgggaacgttgtcgatttggcagtgggtgtgatcatcggtgcagcattcggtaaaattgtttcatcactggtcgcggatattattatgccgccactcggcctgttgattggcgggatcgattttaaacagtttggccgtcacgctacgtga

SEQ ID NO: 3935 - DNA, 864 bp, Klebsiella pneumoniae
cgttccgacgtattactttttgtatcgatagcgatatattcctgttgccaggcattcgctccagagacacatgacacccagacggatacgctcgccgggatcaagaacccccggaggccattgcatttctttattatcattaatgcgactccagaaaagagccgaatcggcaatattgctgtgtttttagtggggatacgatttccctgtattaactattatctttatctttcagccgtcaaggcgggcgtccacttttttagcgcagagggagaaacagctatgcagcgttgcggatgggtgagtcaggatccgttatacatcgagtatcacgataccgaatggggtgtggcgcaaaaagagggtcgccagctgtttgaaatgatctgccttgagggccagcaggccggtttatcgtggatcacggtgttaaaaaaacggcagaactaccgccaggcttttcaccagttcgatccggtgcgcgtggcggcgatgggtgatgacgatatcgagcgactcctgcaggataccggcatcattcgccatcggggaaaaatccaggccattatcggcaacgcccgcgcctatctggcgatggaagaaaatggcgagtcgttcactgattttgtctggtccttcgtcgacaatgcgccacaggtgacccgcgctgcgacgctggcggaaattcccgccacgacgccggcttccgatgcgctgtcgaaggcattgaaaaaacgcggctttaagtttgtcggctcgacaatctgttattcctttatgcaggcctgtgggctggtcaacgaccatgtcaccggctgcttctgtcaccctggaggtcaggatgatccgcaagtgggacactga

SEQ ID NO: 3936 - DNA, 420 bp, Klebsiella pneumoniae
catattggcgtttctttaccgcctgacggtacactacagggtaaaattgggccggccatcgcccgtcatgacaagaaagagaatagaatcatggaacagtttgaatgcatcaatgttgaagaagcgcaccagaaactgcatcagcagacggcggtactggtcgatatccgcgatccgcaaagctatgcgatgggtcatacgccgggcgcgtttcatctgaccaacgatacgctgggcgcgtttatgcgtgacaacgactttgacacggcggtgatggtgatgtgctatcacggcaacagcagcaagggcgccgcgcagtatctgctgcagcaggggtttgataaggtctatagcgttgacggcgggttcgacgcctggcatcgccatttcccggcggaagtggcgcgcgggacgttttaa

SEQ ID NO: 3937 - DNA, 2202 bp, Klebsiella pneumoniae
cactgcagcttgacgttagtcttcacgttcaccgacgatttcgtaagaaaaaataactttgatgggatgggcatgggcacctttctgatattccttacagctctgctaatctgcgtattgctcatcggatggtggtatcgcgctcacgccagacgccgccgactccccctactgcacgcctttagcgacgctaccacgcggcagcttcctgcggatgagcgccaggctattgagaagtatgttgccgagttgagccacgcccagcaggtgccggcgtccggtgcgaccagcgcgcctgtcgctctggcgctgaacgaacagagtgataccgtctatgcggtgacacgcgccatcacccgctacgggatcaccaccgacgcgccaaataaatggcgctatttcctcgattcggttgaagttcatctgccgccgttctgggaacagcatatcaacgatgaaaacagcgtcgagctgatccccaccgacagcctgccgctggttatcacccttaacggtcatagcatgagcgactatcgccaggaagcgcaaagctacgccctggaacgcgcttcggcctcccaggcctccattcgcggcgaagagagcgagcaggtagagttgcggcagatccgtcgggaaacgcctgaagaacacgctctgaatcgcccggacgggctgcgcgaagcgatcctgatcgtcgcctcctttctgttcttttatttcagcctgattgggccagctgtctttaccccctggctggtcgccgcaggtttgttgctgctcgcagccggactgtgggggatttatgccccgccgcgtcgcgccgcgctgcgcgaaatccattgcctgcggggcgtccctaagcgctggggattgtttggcgaaaacgatcaggagcaaatcaataacatctcgctgggcattatcgatctcatctatccgcgccactggcaaccctggattgcccaggacctggggcagcagaccgatattgatatctatctcaaccgccacgtggcccgtcagggacgctacctgtcgcttcatgatgaagtgaaaaacttcccgctgcagtactggctacgcagcgcgattatcgccgccggcgccctggtggtggtgattatgttgtgggccagcgtaccgttgaatatgccgtttaagttcaccctgtcgtggctgaagggcgcgcaaacgattgaagccactaccgtcagccagctggaaaaagcccatgtgcgcattggcgatacgctgcgcctgaccggtaccgggatgtgtaatatccgcacgccgggcagttggtccgccaaagaggattcgccgttcctgcctttcgattgttcacagattgtgtggaacgacgcccctcctctgccgctgccggagtctgacattgtcagcaaagcgaccgccctgatgcagtccgtccagcgccagctgcacccggaaaccgacgatgattcccgcgtcagccctgccctacgctccgccattcagaaatcaggcatggtgctactggatgatttcggcgatatcgtgcagaaaactaacgatctctgctcggcaaaggatgattgcctgcggctgaagaatgcgttggtcaatcttggcaatacccgtaactgggaaacgttaaccaagcgcgccaccgccggcaagctggatggcgtgaacgtgctgctgcggccggtcagcgccgagtcgctggagaatctggtgaccacctcaaccgcgccctttgtgatacgcgaaacctcgcgggccgcgcaggcgctgaacagcccggctcccggcggttttcttatcgccagcgatgagggcagcgtactggtcaatcagccgtggccggcggtgagtctgtatgattatccggcccatgagcagtggggcgaactgcggcggctggccggtatgctcatgcatacccccttccatgccgaaggtatcgttaccaacctgtttactgacgccaacggcacgcagcatatcaacctgcatcgcatccccgaccgcagcggcctgtggcgttatctgggcatcaccctgctgctgctgtcaatggtggggtgcacggcttaccacgccgtgcaggccctgcgtcgttatcaacgccatcgtcagcgtatggaagagattcagaaatattacgaaagctgccttaatccggttttgctcccctcatctgactcgcaagattaa

SEQ ID NO: 3938 - DNA, 2145 bp, Klebsiella pneumoniae
agaagaagcttgcctggatcccatgccggcccagcagctccagcagccgcggaacgccgtcccgcgtgccgcgaaaggtatcgacatctatgcgtaagccgacctgtttcatggatttttatcgtccaccagttcaaccgtgcgcaggaagaagtccagcgtgtgttcgaccgtttcttccatctccaccttcggctcccagttcaggcagcgtttggcgttgcggatgctcggcttacgatgctcaacgtcctggtagccctttccgtagtaatcgctgctttccacttcacggaagccggcgaacggcgggaagcgatcgcgcagcggatgacgttcgaagcaggcgagcagcatttcggccagctctttgatgctcgcttcgttatccgggttgccgatgttaatgatctgcccgtcgcagcggccgtctttgttctcgatgatgcggaacagcgcttcgataccgtcgctgatgtcggtgaaacagcgcttctgcttgccgccttcgataagcttgatcggcgacccttccaccaggttgaggatcagctgggtgatagcgcgggagctgccgatacgcgcggcgttgaggttatccagccgcggccccatccagttgaacggacggaaaagggtgaacttgaggccattcttatcgccataggcccagatcacgcgatcgagcagctgcttggagaccgagtagatccagcgctgtttgttgatcggccccaccaccaggttggagctatcttcgtcgaagtttttgtcggtgcacatgccgtacacttccgaggtcgacgggaagataatgcgcttattgtatttcacgcagtcgcggatgattttcaggttctcttcgaaatccagctcgaacacgcgcagcgggttgcgggtgtattcgataggcgtggcgatggccaccagcggcagcaccacgtcgcatttcttaatgtgatactcgatccactcagagtgaatgctgatatcgccttccacaaagtggaaacgcggacagtcgagaaaacggctgatggcgtcggagccgatatccagaccgtaaatctcatagttgtcgtcctgcagcaggcgctcggtcaggtggttaccgataaagccgttgacgccgaggatcagcacccgggtgcgacgcttaatcgccaccaccggtttgctgctgatcaccgccccggacaccaggcccagcgcctgcgccagctgagcgccctgcatgtacacgccgcgttcggtctggccggtgacaatctccagcgccccgtcctggcacgcgacgatcagcggagcaatggagagcacggtgcccggtttagctgctggcaaatcgtggcgaacgcgggatttccagacgataaacttgttcgctccggcgtagccgaaggcgcccggccacggatccgagaccgcacgcaccagattgtgcagggtctgcgccggcagctcccagtccagccggccatcttccggggtacgacgccccacataggttgcctggctgtgatcctgcggacgctcatcggtggtgccggcgaggatcgctggcagcgcccggctcagcagctcagtggcggcagcgcacagcttacgatgcagcgtcagggcggcgtcatccgcgccaatcgccacggcctgctgggcgacgatatcgccagcgtctgcgcggttcaccatccggtgcagggtgacgccggtttcgctttcgccattgaccagcacccagttcagcggcgcgcggccgcgatattttggcagcagcgaaccgtgcaggttgaacgcccctttcggcgccagattgaggatctcatcgcccagcaggttgcgatagtagaaggagaacagcacgtccggtttcatctcgcggatacgctcaatccacagcggatggttcacgtcttccggggcccacaccggaataccctgctcggcggcaaggcgcgccacggagccaaagaaatggttttcgccagggttatccgggtgggtgaaaatagcagcgatatcatacccggcgtccagcagggactggataccggtgcagcccatatcgtgataagcgaagactacggctttcatgaacgatcttcctctttagatgccgtttccggctggcgaacaacacgttga

SEQ ID NO: 3939 - DNA, 366 bp, Klebsiella pneumoniae
gagtgcatagtggcccgtatagcaggcattaacattcctgatcacaaacataccgttatcgctttaaccgctattttcggtatcggcaaaacccgttctaaagccatctgcgctgaaacgggcatcgctgaaaatgttaagatcagtgagctgtctgaagaacaaattgatattctgcgtgaagcagtaggtaaatttgtcgttgaaggtgatctgcgccgtgaaatcaccctgagcatcaagcgtctgatggaccttggttgctaccgtggtttgcgtcatcgtcgtggtctcccggttcgcggtcagcgtaccaagaccaacgcacgtacccgtaagggtccgcgtaaaccgatcaagaaataa

SEQ ID NO: 3940 - DNA, 639 bp, Klebsiella pneumoniae
ccgcgcatggtgcttggcaaaccgcaaacagaccctacccttgaatggttcttgtctcattgccacattcataagtacccatcaaagagcacgctgatccaccagggtgaaaaagcagaaacgctgtactacatcgttaaaggctccgtggctgtactcatcaaggatgaagaaggtaaagagatgatcctctcctacctcaaccagggcgatttcatcggtgaattaggcctgtttgaagagggtcaggagcgtagcgcctgggtacgggcgaaaaccgcatgtgaagtggccgaaatctcttataagaaattccgtcagctgatccaggtgaacccggacattctgatgcgtctctcttcgcaaatggctcgccgtctgcaggtcacgtctgagaaagtgggcaaccttgccttcctcgacgtgacgggccgtatcgcccagacgctgctgaacctggcgaagcaaccggatgccatgacccacccggacggtatgcaaattaaaattacccgccaggaaattggtcagatcgtcggctgctctcgtgaaaccgttggtcgtattttgaaaatgctggaagatcagaacctgatttccgcgcacggtaaaaccatcgtcgtctacggcacccgttaa

SEQ ID NO: 3941 - DNA, 861 bp, Klebsiella pneumoniae
gccgcggcggttccgaagagccgatggagctgttcaaacgcttccgcgggcgcgagccgcagctggacgcgatgctggagcattacgggatcaaaggctgattgctacgtgaagatctgcttaattgatgaaacaggcgccggtgacggcgccttatctgttttagccgcccgctgggggctggagcaggatgatgataacccgatggcgctggcgctgacgacggagcatctggagctacgcaagcgcgatgagcccaagcttggcggcatcttcgtcgatttcgtcggcggggcgatggcccaccggcgcaagtttggcggcggccgcggcgaagcggtggctaaagcggtgggtattaaaggcgattacctgccggatgtcgtcgatgcgacggccgggctgggacgcgatgcctttgtgctggcgtcggtcggctgtcgcgtgcggatgctggagcgcaatccggtggtcgccgcgctgctcgatgatggcctggcgcgcggctatgctgacgcggaaatcggcggctggctgcaggagcggctgcagctgatccacgcctccagcctgacggcgttaaccgatatcaccccgcgtccgcaggtggtctacctcgatccgatgttcccgcataagcagaaaagcgcgctggtgaagaaagagatgcgcgtctttcagtcgctggtggggccggatttagacgccgatggtctgttggcgccagcgcgtcagttggcgaccaaacgagtggtagtcaagcgcccggattatgcgccgccgctggcggatgtcgccacgccgaacgcggtggtgaccaaaggacatcggtttgatatttacgccggtacgccggcgtaa

SEQ ID NO: 3942 - DNA, 783 bp, Klebsiella pneumoniae
gcgacatttttccagggatatttcatgaaacaaacacaacgtcatgacgccattatcgagctggtaaaaaaacagggttacgtcagcacggaagagctggttgagcagttcgcggtaagcccgcagaccatccgccgcgacctgaacgatttagccgaacagaaaatgatcctccgccatcacggcggcgcggcgctgccctccagctcggtgaacacctcctggcacgatcgcaaagcgacccagacggcggagaaagagcgtatcgcccggcgggtggccagcgagatcccggacggggcgacgctgtttattgatatcggcaccacgccggaagcggtggcgcacgccctgctcgatcacaacgatctgcggattgtgaccaataaccttaacgtcgccaacacgctgatggtgaaagaggacttccgcattattctcgccggcggcgaactgcgtagccgggacggcgggattattggggaagccaccctcgactttatctcgcagttccgcctcgacttcggcattctcggcatcagcggcgtagacagcgatggctcgctgctggagtttgattatcatgaagtgcgtaccaagcgggcgatcattgagaattcacgccacgtgatgctggtagtggaccataccaagtttggccgcaatgcgatggtcaacatgggcagcatcagtatggtcgatgcggtctataccgacgtgctgccgccggccggcgtgctgaaggtgatcactgataacaaccttcagctggagctgtgctaa

SEQ ID NO: 3943 - DNA, 327 bp, Klebsiella pneumoniae
cgcctgcaggttaagggccaggccgtccagcgtgaggagtatgccctggtactccagccgcgtcagccacgcctgcgcgggcagatctgccgccagcgcctgcagcctgggttgccaggcggcgatcgccgatctgcgctggtactgctggcgctgccgttgatgctgctgccacgcctcacgcatcgcctgctcgcgctgcttaagcgaagcgagcagctgcgcgtcggccgtcgtgtgaagcgtcgccaggaagtcgcgctgcagacgcgccgttcggctcaccagcaggcccatcccgcccagcagcacaatgccgatggttaa

SEQ ID NO: 3944 - DNA, 2586 bp, Klebsiella pneumoniae
atcgttaaggtaggcggtaatagaaaagaaatcgaggcaaaaatgagcaaagtcagaatcgctattatcggtaacggcatggttggccatcgctttatcgaagagcttctcgataaggcgcctgccggacagttcgacattaccgtgttctgtgaagaaccgcgtatcgcctacgaccgcgtccacctgtcgtcttatttctcccatcacactgcggaagaactgtcgctggtacgcgaaggtttctatgagaaacacggcgtcaaggtgctggtcggcgaacgggcgatcaccatcaaccgccaggagaaagtgatccactccagcgccgggcgtaccgtgttctacgacaagctgattatggcgaccggctcatacccgtggatcccgccgattaaaggcgcggaaacccaggattgcttcgtctatcgcactattgaagatcttaacgccatcgaatcctgcgcccgccgtagcaaacgcggcgcggtagtcggcggcggcctgctcggcctggaagcggccggcgcgttgaaaaacctcggcgtggaaacccatgttatcgaattcgcgccgatgctgatggccgaacagctcgaccagatgggcggcgagcagttgcggcgcaaaatcgaaagcatgggcgtgaaagttcacaccagcaaaaacaccaaagagattgttcagcagggcaccgaggcgcgcaaaaccatgcacttcgccgacggtagcgagctgcaggtcgatttcatcgtcttctcaaccgggatccgcccgcgcgataagctggccacccagtgcgggctggcggtcgcccagcgcggcggcatcatggtcaacgatagctgccagacctccgatccggatatctatgccatcggggaatgcgccagctggaacaaccgcgtctacggtctggtcgcccccggctataaaatggcccaggtggccgtcgaccatctcctcggcagtgaaaatagtttcaccggcgccgacctcagcgccaagctgaagctgttgggtgtggacgtgggcgggatcggcgatgcccacggccgcacgccgggcgcccgtagctacgtctatctcgacgaaagcaaagaagtttataagcgcctgatcgtcagcaccgacaacaaaacgctgctcggcgcggtgctggtcggcgacaccagcgattacggcaacctactgcagctggtgctgaatgccatcgagctgccggaaaacccggattcgctgatcctcccggcccacgccggcagcggcaagccgtccatcggcgtggataaactgccggacagcgcgcagatctgctcctgctttgacgtcagcaaaggcgacctgatcgccgctatcaataaaggctgccacaccgtggcggcgctgaaagcggaaaccaaagccgggaccggctgcgggggctgcattccgctggtcactcaggtgctcaacgccgagctggcgaaacagggcatcgaggtcaacaacaatctgtgcgaacacttcgcttactcccgtcaggagctgttccacctgatccgcgtggaaggcattaaaaccttcgacgaactgctggaaaaacacggtcagggctacggctgcgaagtctgtaagccgaccgtcggttccctgctggcctcctgctggaatgagtacatcctcaagccgcagcacacgccgctgcaggacagcaacgacaacttcctcgccaacattcagaaagatggtacctattcggtgatcccgcgctcagctggcggcgaaatcacgccggaagggctggtcgccgtgggccgcatcgcgcgtgaattcaatctgtacaccaaaatcaccggctctcagcgcatcggcctgtttggcgcgcagaaagacgacctgccggagatctggcggcagctgattgaagcgggattcgaaaccggccacgcctacgccaaagcgctgcgaatggcgaaaacctgcgtcggcagcacctggtgccgctacggcgttggcgacagcgtcggcttcggcgtagaactggaaaaccgctataaaggcatccgcaccccgcacaaaatgaagttcggcgtctccggctgcacccgtgaatgcgcggaagcgcagggtaaagacgtcgggatcatcgccaccgagaaaggctggaacctgtacgtgtgcggtaacggcgggatgaaaccgcgtcacgccgatctactggccgcggacctcgatcgcgatacgctcatcaaatatctcgaccgctttatgatgttctacatccgcaccgccgataagctgacccgcactgccccgtggctggacaatatggaaggcggtatcgactatctgcgcagcgtcatcatcgacgataagctgggcctgaacgatcaccttgaagaagagctggctcgcctgcgtgccgccttcgcctgcgagtggaccgagaccgtcaacaacccggcggcgcagacccgcttcaaacactttatcaacagcgaccagcgcgacccgaacgttcaggtggtgcccgaacgtgaccagcaccgcccggccacgccgtatgagcgtatcccggttactctggtggaggaaaaagcatga

SEQ ID NO: 3945 - DNA, 1263 bp, Klebsiella pneumoniae
aaaatagaggttttaatctgttttttagtgaaaaactgcgctaaaccattaaactcaatggtaaaaatggcgttgtttaataaaagcacagaatgctttttaaccataaaaatacaaaacatttacaccacatcacgaacggggttctgcagcatgaaaaggaacgcgaaaaccatcgtcgcgggcattgtcgcattagcgatgtcgcacgcggcgatggccaaggatattaaggtcgccgtggtcggcgcgatgtcggggccggtggcccagtggggcgacatggagttcaatggcgcgcgtcaggcgattaaagacatcaacgccagcggcggcattaagggcgacaagctggtggccgtcgaatatgacgacgcctgcgatccgaagcaagcggtcgcggtggccaacaaaatcgtcaacgacggcattcagtacgttatcggccacctgtgctcctcttccacccagccggcttccgacatctatgaggatgaaggcatcctgatgatctcccccggggcgaccaacccggagctgacccagcgcggataccagtacatcatgcgtaccgccggcctcgactcctcgcaggggccgaccgcggcgaaatatatcgtcgagaaagtgaaaccgcagcgtatcgccatcattcatgacaagcagcagtacggcgaagggctggcgcgttcggtgcaggacaacctgaagaaagccggggccaacatcgtcttcttcgatggcatcaccgcgggggaaaaagatttctccgccctgctggcgcgcctgaagaaagagaacatcgacttcgtctactacggcggctactacccggaaatgggccagatgctgcgccaggcgcgctccgtcgggttgaaaaccgtgtttatggggccggaaggggtcggcaacgcctcgctgtccaatatcgcgggcgccgcggcggaaggcatgctggtgacaatgccaaaacgctacgatcaggaccctgccaacagcgccatcgtcaacgcgctgaaagcggagaagaaagatccgagcggaccgtacgtctggatcacctatgccgccgttcagtcgctggcgcaggcgatggacagaaccggcagccagcagccgctggatttaatcaaagatttgaaagcgcacggggcgaaaaccgtgattgggccgctgacctgggatgaaaaaggcgatctgaagggatttgagtttggtgtcttccagtggcacgccgacggctcttcgagcgcggcgaaataa

SEQ ID NO: 3946 - DNA, 651 bp, Klebsiella pneumoniae
aaaaagcgggtttccccgcttttttgtcgtcttcgtgccgaagcgcaaagattagtggcagccgcagccaccgtggccgccgcagccgcctttaccatggtcgtgaccatgatcgtggccgtggccgccgcagcaaccgtcatgaccatggtcatgatcgtgatcgtggccatgcgcgccgtgcacgtgaccgtgctccagctcttccgcagtcgcttcgcggatggcgacgacttccacattaaacttcaggttctggccagccagcatgtggttgccatcaaccacaacgtggtcgtcttcaacttcagtgatttctactggtaccggaccctgatcggtttccgccaggaagcgcatgccaacctgcagttcatcaacgcccatgaagacgtctttcggtacacgctgcaccaggttttcgtcatactgaccgtaagcgtcgttagcgccgacggcaacgtcaaatttgtcgcccacttcgtggccatccagcgcgttttccaggccggaaatcagggagccgtgaccgtgcaggtaatccagcggcgcgcttaccggagattcatcaaccaacacaccgtcttctgtacgtacctgataggccaggctgaccaccaggtcttttgctactttcatgatatctcctga

SEQ ID NO: 3947 - DNA, 810 bp, Klebsiella pneumoniae
caggaaagggtatcctgcgaggccgagctggactatccttgtcagcgtctggcacgtgtgtgccgttgtgcgctttttttggctgaaaggagtaaaaaaatggcgacaggaaagtcctgctctcgctggtttgcggctatggcggccttattgatggtggttagcctgagtgggtgttttgataaagagggcgatcagcgcaaagcgtttatcgacttcctgcagaatacggcgatgcgtagcggtgaacgtctgccgacgctgaccgccgatcagaaaaaacagtttgggccttttgtctctgactacgcggtgatctacggttactcgcagcaggtgagccaggcgatggacgctggtctgcgcccggtggtggacagcgtcaatgcgatccgcgtcccgcaggattatatgacccagcgtgagccgctgcgtcaggcgaacggcgcgctgggcgtgctcagccagcagctgcagaatgcgaaaatgcaggccgatgccgcgcatggcgcgctgaagcaggctgacgatctcaagccggtcttcgatcaggtttacgccaaggtggtgacggcgccagccgacgcgctgcagccgctgatcccggccgcgcagatctttacccagcagctggttcaggttggggattttgtcgctcagcaggggacgcaggtgagctttgtggccaacggcattcagttcccgacctcccagcaggccagccagtacaatgcgctgattgggccgctggcggcgcagcatcaggcgtttaatcaggcatggacggcggcggtgaacgccacccgttaa

SEQ ID NO: 3948 - DNA, 426 bp, Klebsiella pneumoniae
ggcgatttattacgtgtttacgaagcaaaagctaaaaccaggagctatttaatggcaacaattaaccagctggtacgcaaaccacgcgcgcgcaaagttgcaaagagcaacgtgccagcgctggaagcctgcccgcagaaacgtggcgtatgtactcgcgtatataccaccactcctaagaaaccgaactccgcactgcgtaaagtttgccgtgtgcgtctgactaacggtttcgaagtcacctcctacatcggtggtgaaggtcacaacctgcaggagcactccgtgatcctgatccgtggcggtcgtgttaaagaccttccgggtgttcgttaccacaccgttcgtggtgcgcttgactgctccggcgttaaagaccgtaagcaggctcgctccaagtacggcgtgaagcgtcctaaggcttaa

SEQ ID NO: 3949 - DNA, 1320 bp, Klebsiella pneumoniae
atcatgccattagtcatcgttgctatcggggttgccctgttgttgctgttaatgatccgtttcaaaatgaacggcttcattgcgctggttctggtggcgctcgccgtcggattaatgcagggtatgccactggataaagtgatcgtctccatcaaaaacggcgttggcggcacccttggcagcctcgcgctgatcatgggcttcggcgctatgctcggtaagctgctggcagactgcggcggcgcccagcgtatcgccaccacgcttatcaataagttcggtaagaagcatattcagtgggcggtggtcctgaccggcttcaccgttggcttcgccctgttctatgaagtgggcttcgtgctgatgctgccgctggtgttcaccatcgccgcctcggcccgtattccgttgctgtacgtcggcgtaccgatggcagccgcgctctccgtcacccacggcttcctgccgccgcatccgggtccgaccgcgatcgccaccatcttccatgccgatatgggcaaaacgctgctctacggcaccattctggctatcccgacggttatcctggcgggaccggtgtttgcgcgcttcctgaaagggatagataagccgatcccggaaggcctgcataacccgaaagtgttcactgaagaagagatgccaggctttggcgtcagcgtctggacctcgctggttccggtgatcctgatggcgatgcgcgccgtggctgagatgatcctgccgaaaggccacgccttcctgccaattgccgagttcttcggcgacccggtgatggccaccctgattgcggtactgattgccctgttcaccttcggtttgaaccgcggccgctccatggagcagatcaacgataccctgacctcttcgatcaaaatcatcgccatgatgctgttgattatcggcggcggcggcgccttcaagcaggtgctggtggatagcggcatggataaatacatcgcctctatcatgcacgaatcgaacatgtctccgctgtttatggcgtggtctatcgccgcggtgctgcgtatcgcgctgggttcggcgaccgtagccgccatcaccgcgggcgggattgccgcgccgctgatcgccaccaccggcgtcagcccggagctgatggttatcgccgttggctccggcagcgttatcttctcccatgttaacgatccgggcttctggctgttcaaagagtactttaacctgaccatcggcgagaccatcaagtcctggtcggtgctggaaaccattatctcagtctgcggcctggtgggctgtctgctgctggggatggtggtgtaa

SEQ ID NO: 3950 - DNA, 906 bp, Klebsiella pneumoniae
ataactgcattgcatgaattttatccatgccgatcgcctattgttgttgttaatgaaacagtaaaacgcaatgtagcgtatttattgttgcatgagcagttaataagctacaacacaatcacaacgcaacctgaaaggggtcttctgatgacacaacgtatcgctttagtgaccggcggcagccgcggtctgggtaaaaacgccgcgttgaagctggcggcaaagggaaccgatattcttttgacctatcacagcaaccgccaggcggccctcgacgtggtggcggaaatagagcaaaaaggggtcaaagcggcagcattagcgctgaacgtcggcgattccacaacattcgacgcattcgccagcgaggtggcgcaggtgctggcgcagaagtggggacgcactacctttgattatttactgaacaatgccgggatcggcctcaacgcgcccttcgccgagaccagcgaagcgcagtttgacgagctgatgaatatccagttcaaagggccgtttttcctgacccagcgtctgctgcctctcctgcaggatggggggcgtatcctcaatgtctccagcggcctggcgcgctttgccctgccgggctatgcggcctacgccgcgatgaagggggcgatggaggttctgacccgctatcaggcgaaagagctgggcggacgggggatatcggtgaacatcatcgcgccgggtgccattgagactgactttggcggtggggaggtgcgcgataacgccgaggtgaatcggcatatcgccgcccagactgcgctggggcgcgttgggctgccggatgatatcggcgacgccatcgccgccctgctcagcgatgagctggcgtggatgaacgcgcagcgtgtggaagtctcgggcgggatgttcctctga

SEQ ID NO: 3951 - DNA, 2367 bp, Klebsiella pneumoniae
tccctgttttttgaccctaaagatgaattaaaagccatgatgaatgattcgctctgccgcattattgcgggtgaacttcaggccagagccgaacaggtagaagctgccgttcgcctgcttgatgaagggaacaccgtgccgtttattgcacgttatcgtaaagaagtcaccggcggtctggatgacacgcagctgcgtaatctggaaactcgcctcggctatctgcgcgaactcgaagaccgtcgtcaggcgatcctcaaatccatcgctgaacagggcaaactgaccgacgcgctggaaaaagccatcaacaccacgctcagcaaaaccgaactggaagatctctacctgccctacaagccgaagcgccgtacacgcgggcagatcgctatcgaagccgggctcgaaccgctggctgacctgctgtggaacgaaccggcccacgatccggaagcggaggccgcaaaatatattgatgccgataagggcgtagccgacagcaaagcggccctggacggcgcgcgctatattctgatggagcggtttgccgaagacgccgcgctgctggcgaaggtccgtgactatctgtggaaaaacgcccacctggtctccaccgtcgtcagcggtaaagaagaggaaggcgctaaattccgcgactacttcgatcaccatgaaccgatcgccaccgtgccgtcgcatcgcgcgctggcgatgttccgcggtcgcaacgaaggcgtcctgcagctctctttaaacgctgacccgcagtttgacgagccgccgaaagagagccacggcgagcaaattattatcgaccacctgggcctgcgcctgaataacgccccggcggacagctggcgtaaaggcgtcgtcagctggacctggcggatcaaagtcctgatgcatctcgaaaccgagctgatgggcaccgtgcgcgaacgcgcggaggacgaggcaatcaacgtcttcgcccgcaacctgcacgatctgctgatggccgcgcccgccgggctgcgcgccaccatgggactcgatccgggcctgcgcaccggggtgaaagtggccgtcgtcgacgccaccggtaaactggtcgccaccgataccatctatccccacaccggccaggccgccaaagcggccgtcgccgtcgccgcgctgtgtgagaagtacaacgttgagctggtggccatcggcaacggtaccgcctcgcgtgaaaccgagcgtttcttcctcgacgtgcagaaacagttcccgaaggtcaccgcccagaaggtgatcgtcagcgaagccggggcttccgtttactccgcctccgagctggcggcgcaggagtttccggacctcgacgtgtcgctgcgcggcgcggtctccatcgcccgccgtctgcaggatcccctggccgagctggtgaaaatcgacccgaaatccattggcgtcggccagtatcagcacgacgtcagccagacccagctggcgcgtaagctggacgcggtggtggaagactgtgtgaacgccgtcggcgttgacctgaacaccgcctccgttccgctgctgacccgcgtcgccggcctgacccgcatgatggcgcagaacatcgtcgcctggcgcgacgagaatggtcagttccagaaccgccagcagctgctgaaagtcagccgtctggggccgaaagcctttgaacagtgcgcgggcttcctgcgtatcaaccacggcgacaaccctctggatgcctccaccgttcacccggaagcttacccggtggtcgaacgtattctggccgccacccagcaggcgctgaaagatctgatgggcaatagcagtgcgctgcgccacctgaaggcagtggacttcaccgatgagaagtttggcgtcccgacggtcaccgacattatcaaagagctggaaaaaccgggccgcgatccgcgtccggagtttaagaccgcgaagttcgccgatggtgtggagaccatgaatgacctgctgccgggaatgattctggaaggtgccgtcaccaacgtcaccaacttcggcgcgtttgttgatatcggcgttcatcaggacggactggtacacatttcgtcgctttctgaccggtttgttgaggatccgcacaccgtggtgaaagcgggcgacatcgtcaaggtcaaagtgatggaagtcgatctgccgcgtaagcgtatcgccctgaccatgcgtctcgacgagcagccgggcgacagcaacgcccgccgcggcggtggtcaggagcgcccgcagggaaatcgcccggccgcgaaagccgccaaaccccgcggtcgcgaggcgcagcctgccggcaacagcgcgatgatggatgccctcgccgcagcgatgggtaaaaaacgctaa

SEQ ID NO: 3952 - DNA, 1533 bp, Klebsiella pneumoniae
gggatccaattgcgttcgctggtgggtgacctggtgctggtccgtctgcaggaagagcgggatcctcttctgcacaaacgcttatataacgcgctacgccgcgcgatcctcgacggttcgctggcgccgcaaagccgtctgccgccgtcgcgggacctggcgggcgagctcggcgtatcaagaaacaccatattaacaacttatgaacaattgctggcggaaggatatgtggtttcccgtcggggaagcggaacattcgttgcccaaaccgcccctgagagctcattgacggctaaagaagagcgggaaaacaacagtcttgcggcaccgacggcgcatctttcacgccgaggccagcatctgctcggccaggtcagcgccagcccgcgccagtggggagcgtttatacccggcgtgccggacgttaacgcctttccccacccgctgttcagtaagatccaggcccgcatcagccgtcggcccaaaccggagcggctcagctatagctgcaacggcggcaccccggaactgcagcaggcgctggtggattatctgcgcgtgtcgcgcggcgtccactgtcagtcagatcaaattcttatcaccgaggggatccaccaggcgatcgatctggtcacccgcatgctgtgtgataacggcgatctggcgtgggtggaggagccttcctactgggggatccgccacgtgctggcgatgaacgacgttcgggcagagcccctgaccgtcgatgccaacggcctgtgcccgccggagacggttgacgatgcgccgaggctgatcttcgttacgccttcccaccagtatccgctgggcgcggtgatgagccttgagcgccgccagcggctgctggcgctcgcccgtcagcaggggagctggatcgtcgaagatgattatgacagcgagtttcgcttttccggtcagccgatccccgccctgcaggggctggtcgccgacgccccggtggtctatatcggcaccttcagcaagacgctctatcccggcctgcgcctgggctacgtggtgatcccgcggccgctggtcagcgacctgaagcacgcccatgctgagctttaccgcggcggccattcgctgatccagatggcgctggcggagtttattaccgccggccactattcggcccatatccgccgtatgcggctgctctacagccgtcgccgcgcctttttaactgagcttatccagcggcactgtatgccgtacgccctgtctgactttagcgataatgccgggctgcatttgatccttaatttgcccgcagaggctgacgatgtggcgatcgccagagaggccaatgcgcggcacattctggtgcggccgctgtcgcgctactacctgacggcggcgcgcaagaaaggattactgatgggattcgccagccagcccgaagagcagatggcgtcggcgttcagcgtcttactcggctgcctgcagacgcactgcccgcagatgctcctgctccgggaggacgcagaaaaacaaaacgccccaacctga

SEQ ID NO: 3953 - DNA, 510 bp, Klebsiella pneumoniae
gcagcaatttcaggttatgccgggaggcgaccgggcgcggcgacagaccaccgcgccgcgggaggattagggcagcactttcgcagagaggataacgaccggtttggtcggcacattctggtacggaccaacgttatgggtctggacctgggagatcttatccgcaacatccatccccttcaccactttgccgaataccgcatagccaaagtcgcgctggccatggtcgaggaaggcgttatccgccacgttgatgaagaactgactggtggcgctatcctgatcggcggtacgcgccatcgcgatggtgccgcgggtgttgcgcaggccgttgtctgcttcattcttgatcggcgggttaggctgcttctgctgcatctgttcattaaagccgccgccctgcaccatgaatcccgggatcacgcggtgaaaggtggtgttgttgtagaagccgctgttgacgtacttcaggaagttatccacggaaatcggggctttctggctgtttaa

SEQ ID NO: 3954 - DNA, 309 bp, Klebsiella pneumoniae
ttttgcgtttctgaggcccccatgctccatacgctcagtgtttccccctggcatgccgacatcgcagcgatgcttcgtttgatggagcacggcgacgatctggtactactgtctgacggcgtcaccgcggccatcgccgatggtcgcttccttgagatcctgcaatccgcccccataaccctatacgtgctgcaagacgacgttgacgcccgcgggctggctggtcaaattgcggacagtgtcggcagggttagctatactgatttcgtcagactcacagtcaaacatgccggtcagttggcctggtga

SEQ ID NO: 3955 - DNA, 1041 bp, Klebsiella pneumoniae
cgttcagtttctctactaccatccataaagagtgaatttatgcccctgcgtgctttagtggcggtgatagtgacaacggtagtgatgctggtgcccagggcgtgggcggatacggcctgggagcgctataaggcccgttttatgatgccggatggtcgtatcattgataccgccaatggcaatgtgtcgcatacggaaggtcagggcttcgccatgcttctggcggtggcgaataacgatcgtccggcgttcgacaagctgtggcagtggacggacaacaccctgcgcaacaagtctaacgggctgttttactggcgctataacccggtggcgccggaccctatcgccgataaaaacaacgcctccgatggcgataccctgatcgcctgggcgctgctacgcgcgcaaaagcagtggcaggataagcgctatgcgattgcctctgacgccatcaccgccgccctgctgaagtctacggtggtgtctttcgccggtcgccaggtaatgctcccgggtgtgaaagggttcaacctcaatgatcacctgaaccttaacccttcctatttcatcttcccggcctggcgcgccttcgcggagcggacgcatctcaccgcctggcggacattgcagagcgacggacaggcgctgctggggcagatgggctgggggaaatcacatctacccagcgactgggtggcgctgcgggcggatggcaagatgctgccagccaaagagtggccgccgcggatgagtttcgatgcgatccgtatcccgctgtatctctcgtgggccgatccgcacagcgccttgctcgcgccctggaaggcctggatgcagagttacccgcgcctgcaaaccccggcgtggatcaacgtcagcaccaacgaggtggccccctggtatatggccggcggcctgctggcggtgcgcgatctgacgctgggtgaaccgcaggaggcgccgcagattgacgacaaggatgattattactctgccagcctcaagctgttggtctggctggcgaaacaggatcagcgctaa

SEQ ID NO: 3956 - DNA, 207 bp, Klebsiella pneumoniae
acgggagtttctatgtacgtttgtttgtgcaatggcgtcagcgataaaaaaattcgtcaggttgtgcgccagtttcaaccgcaatcttttcagcaattacgtaagtttgttcccgtgggaaatcaatgcggtaagtgtgttcgtgccgcgcgtgaagtgatggaagatgaattaaccaccatgccggaattcaaagaaatcgcctga

SEQ ID NO: 3957 - DNA, 285 bp, Klebsiella pneumoniae
caatctccttcgccgattgtttgccaccagatgtcgttcatccgttaccgttctctttttactggacagaaggccaaatatgctaacagcacacagcttatgctggctatgccaaatgccgctggcagtcgcctgctgggggatctgctcccgctgcagccgcgccctgctcgcctgtcccccgctctgcccgcagtgcggcctgccggcggcggcatcccgtcacccctgcggccgctgcctgcaaaagccgcctccctggcatcggctggtggcggtcaatga

SEQ ID NO: 3958 - DNA, 714 bp, Klebsiella pneumoniae
accagcgcttcgttgaaatcacgaccgaaggtagtttcggaaacagtcagcgcgctctgcgcgtctttcaatactaattccattgctatctcctcacgccttcacagctggtttaacgatcaggtcgctaccggtcgcacccgggacagcacctttaaccagcagcaggttgcgctcagcgtcaacacgtactacgtccaggctctgaacggttacacgctcattacccagctgacctgccattttcttgcctttgaacactttgcccggagtctggttctgaccgatagaacccggaacgcggtgggacaaggagttaccgtgagtagcgtcctgggtacggaagttccagcgcttaacggtaccagcaaaacctttacctttagaggtaccggttacgtcaacttttttaacgtcagcaaacagttcaacgctaatgttctgacctacggtgaattcttcgccgtcagccagacggaattcccacagaccacggccagcttcaacgccagctttagcgaagtgacccgcttccggcttggttacacggttagcttttttagcaccggtggtaacctggattgcgcggtagccatcgttagccaggtctttaacctgagtaacacggtttgcttcaacttcgattacggttactgggatagaaacgccatcttcagtgaagatgcgggtcatgcccacttttttaccgactaa

SEQ ID NO: 3959 - DNA, 642 bp, Klebsiella pneumoniae
gccagcgcttcaagcggcgcctcgtcctcgggcgccggcaccactaccgccgcctcttctgccgcttcggccgccagcgcctgcgcttccagctcttcatcgcttaacggcgcgtcctcttcgggcgcttctgtctcctgcggctggacaacgatgccttccacaggctgctctgctacggcttccgccaccaccggttcggcgataacctcttccgccagcggctcaaccaccgcaggctgttcaggcggttcgctgaccgcgggctccggttcaacaacaggcgtttcttcggtcagagcaggcgtttccacccactcttcttcctgcgcgctggcaggctccgcgaggtgcgctttttcgctttcgaccaccgtctcggtcacttcgacgacgtcttcggcaaacgcctccgggtctgctttcggcgcgctcggctcagcaggggtttcaaccgccggtatctcttcggcaaccgcttgctgttcttctactttttgctctgtctcggtttcctgtgcctgttctttctgtccaaagcccagccaggaaaagaagccacgttttttctcttttgccatttgcgaccacactcctcgctgtttattcatggcgcagcttcatcagaagctgaaaaaatga

SEQ ID NO: 3960 - DNA, 2307 bp, Klebsiella pneumoniae
gtaaggaattccttacctgaaggtgggacggagcaggaggatgctgagagcactgcgccgttcaggtcaaaaaaagtcgccagttacaggaatgagcgacacttacaacaggatgaaagcatgtctaatcatattgatagagacgtgattaatgcgctaatcgccggtcatttcgcggatcccttttccgtgctcggcatgcaccgtactgacgccgggctggaagtgcgcgcattattacccgatgccaccgatgtgtgggttattgaaccgaaaaccggacgcaaagtcggcaagctcgaatgtctcgactcgcgtggtttcttcagcggcgtcctgccgcggcgtaaaaacgcttttcgctatcagctggccgtcacctggcacgggcagcagaatctgatcgatgacccttatcgctttggtccgctgttgcaggaccttgacgtctggctgctgtcggaagggacccacctgcgcccttacgaaacgctgggcgcgcacgctgccaccatggacggcgtcaccggtacccgtttctcggtgtgggcgccgaacgcccgccgcgtatcggtggtggggcagtttaactactgggatggccgtcgccacccgatgcgattccgcaaagagtccgggatctgggagctgttcgttcccggcgcgcacaatggccagctgtataaattcgaactgattgacgcccacggcaatctgcgggtcaaagccgacccttacgcctttgagtcgcaaatgcgtccggaaagcgcctcgcttatctgcgacctgccgcccaaagtggaacagccagcggaccgcagagcggcgaaccagtttgatgccccgatctctatctatgaagtgcatctcggctcctggcgccgtcataccgataataatttctggctgagctaccgcgagctggccgaccagctggtgccctatgcgaaatggatgggcttcacccatctcgaactattgccggttaacgagcacccgttcgacggcagctggggctatcaacccaccgggctctatgcgccgacccgccgcttcggcacccgcgacgatttccgttactttatcaatgccgcgcacgccgccgggctgaacgtcattcttgactgggtgcccggccacttcccggcggatgattttgcccttgcctcgtttgacggcacttcgctgtatgagcacagcgatccgcgcgaggggtatcaccaggactggaataccctgatctacaactacggacgtcgggaagtcagcaactacctggtgggtaacgcgctgtactggatcgaacgcttcggcatcgatgcgctgcgggtcgacgcggtggcctcgatgatctatcgcgattacagccgcaaggcgggagagtggatccccaacgaatacggcgggcgggagaatctggaagccattgagtttctgcgcaacaccaaccgcatccttggcgaacagacgccgggcgcggtcaccatggcggaagagtccaccgattttgccggggtgacccgtccgccagccggcggcggcctcggtttctggttcaaatggaacctcggctggatgcacgacaccctggattacatgaagctcgatccggtgcatcgccgctaccatcatgacaaaatgaccttcggcatgctctacaactacaccgagaattttgtgctgccgctctcccacgatgaagtggtgcacggcaaaaaatcgattctcgaccgcatgccgggcgatgcctggcagaagttcgccaacctgcgcgcctactacggctggctgttcgccttcccggggaaaaagctgctgtttatgggcaatgagttcgctcagggccgcgagtggaaccatgacgttagcctcgactggcatctgctggagggcggcgacaactggcaccacggcgtccagcggctggtgcgcgacctgaaccatacctaccgtcatcataaagcgctgcacgagctggattttgacccctacggcttcgaatggctggtggtcgacgaccatgagcgctcggtgtttgtctttgtacgccgtgaccgggcgggcaacgagattatcgtcgccagcaacttcacaccggtgccgcgccacgactaccgcttcggcattaaccagccgggccgctggcgcgaggcgctaaataccgactccatgcactatcacggcagcaatcagggcaatggcggcgtggtggaaagcgacgctatcgccagtcatggccgcgaacattcgctgtcgctgaccctgcccccgctggcgacgatctggctggtccgggaggcgcaatga

SEQ ID NO: 3961 - DNA, 198 bp, Klebsiella pneumoniae
aggcatcgttcccactgcgatgcttggttgccaacgatcagatgccgttgggcgcattgcgcgctaattaccaagtcccggctgcgcgttggtgcgaatatctcggtagtgggatacgacgataccgaagacagctcgtgttatatcccgccgttaaccacccatcaaacaggattttcgcctgctggggaaaactag

SEQ ID NO: 3962 - DNA, 279 bp, Klebsiella pneumoniae
atgtcacgttcagcagataaaaccacttcctctacgaatgcaaaacgtgcataccggaaaggtaagccaatgtctgccagtgagaggcagcttgctgcaattgcgcggaaacgcgaaactcataaagaagttaaggtttttgttaaaaacccactaaaggacgtgatgatagcggtttgtgaggaagaaggtctgacacaagcccagtttatcgagaaactcctcgagcgagagcttacagaacgtggtcttatagatgtaaagacttcacattcttga

SEQ ID NO: 3963 - DNA, 1092 bp, Klebsiella pneumoniae
gtaaaacgttcaacctttacgcgtatgagcctaagtcgagcaaatggctggggggctggacattactgtactggggatggtggctttcatggtcgccgtttgtggggatgttcatcgcacgggtcttcccgcgggcgaaccattcgcgagtttgtcaccggcgtgctgtttgttcccgcgggttttacgctaatgtggatgacagtgtttggtaacagcgcgatctatctcattatgaaccagggggccacagacctcgccaatactgttcagcaggatgtggcgctggccctgtttaatttcctggagcatttcccgttctcttccgtgctgtcattcatcgcaatggcgatggtcatcgtcttctttgtcacgtctgctgactcgggggcaatggtagttgatactctggcaacaggtggagtggcaaacacacccgtctggcagcgaatattttgggcctcgctcatgggcattgtcgcaattgcgcttctccttgccggagggctaagtgcgctgcaaacagtgacaatagcgagtgcattgcctttctcagtgatcttactgatatccatatacggacttttaaaagctttgcgccgggatttgaccaagcgtgaaagcctgagcatggcgacaattgctcctacggctgcacgtaacccaattccctggcagagaaggttacgcaatatcgcgtatctgccgaagcgatctcttgtgaaacgttttatggacgacgtcatccagcccgccatgacgctggttcaggaagagctgaacaagcaggggacgataagccacatcagtgacgcagtcgaggatcgtattcgtcttgaagtcgatttgggtaacgagctgaattttatatatgaagtgaggcttcgcgggtatagctcaccgaccttcgcgctcgccgcgatggataataatgagcagcagactgaacaacatagatattatcgcgctgaggtatatctcaaagaaggcggtcaaaattatgatgtgatgggctggaaccaggagcagctgattaatgacatactggaccagtacgaaaaacatctgcacttcctgcacctcgttcgttaa

SEQ ID NO: 3964 - DNA, 339 bp, Klebsiella pneumoniae
tccttcaactcagcaaaagttcgatttattcaacaaagccattttgggactggatattcctctctcaactatctaagagaatttccatttgatgcgattaagttagacagaacattcattagtggtattgcccacgttgcacgggacttatctattgtaagaagcatagtgtctcttggaaaagctttcagtttaggtatagtcgcagaaggtgtggaaaataatgaacagtttgaattgctaaaaaatatgaattgcgatgaatttcaaggttattattattcgaagcctttgtcaggtgatcaactgattgattttttgaggggccaaaaaaaatag

SEQ ID NO: 3965 - DNA, 720 bp, Klebsiella pneumoniae
ttggaaagattgaggaagtctttacccgccaggcccaatttctctgctgatatcgcgcatgagatcagaacgcccatcaccaatttggtgacgcagactgaaatcgcactgagtcaggatcgaacacagagggaacttgaggatgtcctctattccagtcttgaagagtataaccggatgaccaaaatggtcagcgatatgctgttcctggcacaggcagataataatcagctgatacctgacagggtcatgtttgacctcagagcggaagtcatgaaagtcttcgagtttttcgaagcctgggccgaagaacgcaatatcacgctcaaatttaacgggatgccctgcctggttgagggagatccacaaatgttcagaagggcgatcaataatctgttatccaatgccctgcgttataccccggagggacaggcaatcaccgtctcaataagagagcaggagagcttttttgaccttgtgattgaaaatccggggaaaccgatccctgaagaacatttatcaaggctgtttgaccgtttttatcgggtggatccatccagacaacgaaaaggagaaggcagcggcatcggccttgcgattgtgaagtcaatcgtggaagcacatcacggaagagtgcaggtggaatcagacgtacgctccacgcgttttatcttatccgtgcccagactggagaaaatgatcccggaaacccaatgctga

SEQ ID NO: 3966 - DNA, 204 bp, Klebsiella pneumoniae
tcattcgaatcgctgtccgtcaggggcacctgccccttcgtaatgtcagcaatgccattaaaaacatcacctccgagaatcttgatgcgcgactggaaccgacacgcgttcccattgaacctggaacaactggttatctcgttcaatcatatgattggaaagattgaggaagtctttacccgccaggcccaatttctctgctga

SEQ ID NO: 3967 - DNA, 939 bp, Klebsiella pneumoniae
gatcgattgttggtggtatttatcttaggcttttgtttaaacgccggtgcgccagcagtagaggcatttatcgagaaagacagccgtcgcagtaatttcgaatatggtcgcgcgcggatgtttggctgtgttggctgggcgctgtgtgcctcgattgtcggcatcatgttcaccatcaataatcagtttgttttctggctgggttctggctgtgcattcatcctcgccgttttactctttttcgccaaaacggatgcgccctcttctgccacggttgccaatgcggtaggtgccaaccattcggcatttagccttaagctggcgctggaactgttcagacagccaaaactgtggtttttgtcactgtatgttattggcgtttcctgcacctacgatgtttttgaccaacagtttgctaatttctttacttcgttctttgctaccggtgaacagggtacgcgggtatttggctacgtaacgacaatgggcgaattacttaacgcctcgattatgttttttgcgccactgatcattaatcgcatcggtgggaaaaacgccctgctgctggctggcactattatgtcagtacgtattattggctcatcgttcgctacctcagcactggaagtggttattctgaaaacgctgcatatgtttgaagtaccgttcctgctggtgggctgctttaaatatattaccagccagtttgaagtgcgtttttcagcgacgatttatctggtctgtttctgcttctttaagcaactggcgatgatttttatgtctattctggcgggcaatatgtatgaaagcatcggtttccagggcgcttacctggtgctgggtctggtggcgctgggcttcaccttaatttccgtgttcacgcttagcggccccggcccactttctctgctgcgtcgccaggtgaatgaagtcgcttaa

SEQ ID NO: 3968 - DNA, 246 bp, Klebsiella pneumoniae
ataggttgcccggtaagtctggctgacggtattttccgtcatgatctgtgcggtagtcggtgtcattgtgttttctccttcctgcagttgccgcccctcgcggggcggctcacctcatcagttaaatgcgcgtttcagttccagcgtgcggagtacctgcccgagggcggaatttttcatcgcggggatgtggacaccgcgccctttgcggtgacttctggcgatatgacgcccgaaagctcttag

SEQ ID NO: 3969 - DNA, 612 bp, Klebsiella pneumoniae
aaccgcggccccggcaactcaacgggtgatggttttaaaaggcaaaacaacggattaaggagattcatcatggcagcacgtggcgttaacaaagtcattctggttggacatctgggacaggacccggaagtgcgttacatgcccaacgggggcgcagtggccaatctgacgctggccacgtctgaaacatggcgtgacaagcagacgggagagatgcgcgaaaacaccgagtggcaccgtgttgtcatgttcggcaagctcgcggaagtggcgggcgaatacctgcgtaaaggcgcacaggcctacatcgagggccaactgcgcacccgcaactggcaggacgatgccggagtcacgcgctacgtcaccgaggtgctggtcgggcagaacggcaccctgcagatgctcggcggccgccgtgaatccggagtgcctgagagcgccgcgcagccgcagaatcctgccaccccggcacaacctgctcaggccgcagctaaatccccgaaagcgaagggcggtaagaaaggccgtcaggatgccgccccgtctcagcaaccgcctcagcctctcccgaatgatttcccaccaatggatgatgacgcgcccttttaa

SEQ ID NO: 3970 - DNA, 702 bp, Klebsiella pneumoniae
tcccggaaacccaatgctgaaaataaagatgtaaatgacaaagatgtcattagcctgtcatgcagcaaacagaagccattcgatataattagtgcaacttatcaggaaggctggattgcttcatcaatacccggcgtcagagtacgccaggaaatgaatatccagccctcttccggagaaataaacgctgccgaacttgtttcagttatggaactgaaaacaccggttgtacttccccggacatcactaattcagaaatggagagttatcatgaaaaatatcgtattagcatctttgctgggctttggtttaatttcatcggcctgggccactgaaaccgtgaatatccatgatcgcgtcaacaatgcacaggctcctgctcaccagatgcagtctgctgaggctcctgtcgggatccaggggactgctcctcgtatgaccggtatggaccagcatgaacaggccattattgctcatgaaaccatgacgaacggctcggcggatgctcaccagaaaatggtggaaagtcatcagaagatgatgggaaataacacggtatccacgaccgtcccgtcaacgtcttacgcggcgatgaatgagcatgaaagagcagcggttgctcatgaattcatgaataacgggcaatccggcccacatcaggccatggccgaagcgcaccgccgcatgatcaatgcaggctga

SEQ ID NO: 3971 - DNA, 609 bp, Klebsiella pneumoniae
agctcgccgttcttcccgtcgttttctcgctcaggtttcgctctaaaaccgtccagaccagcttcgtgctttatctgcgctgcggcctccggtgtcgcccttgcatcttccgctttccgccgggctgtcgtgtcggcacggcacaacccggtgccgcaatcttatgaacctgtggaggttgctatgtatcatgcccgtcaaaccatgctgaatgtagaggagtccgaccgtctctcgttcctgccggatctgtttggtaacgattttctggccggagagatgcaggtctatgcgctcgctgagaaacacatcaccgattactgcggaggcttctggcatttcatccgtattccggagggcggcggctacatgatgcctgacggtgaccgtttccatctgactaacccggataactggtttgatcggtccgtcagcgcggatgcggccggagttatcattacggcgctggcgatcaaccgccgtatctggctgcaccatgaacgcggtgatgctgccctgacacgccacctgatgctgcgggaatcgcagctgtggaatttcattgactctcatgacgaatgcgctgctatttacgcggctctggactga

SEQ ID NO: 3972 - DNA, 1392 bp, Klebsiella pneumoniae
catactggaccagtacgaaaaacatctgcacttcctgcacctcgttcgttaatagcaacatgccgtcctgggggcggcaattatttatcccggccgcaatatgaggaatgcagaatgatttcacgctggaaatggattctgaagcagacagttaaaaagctatggttcagggcaacgttattcgccattgtcgcgataataacggcccttttatcaattctttttaaatcaatgatacctgagtcggtttccgtgaaggttggtgcggaagcagtcgataacattctgaacatactggcatcgagtatgctggcagtgaccactttttcgttgagtatcatggtcacagcctacggttcagccactactaatgtgactcccagagctacgcgtttagttgttgaagacgtaaccacacaaaatgtactggccaccttcatcggttcttttctcttcagtctggtagggattattgccctcagtatgggagcttatggagaaagggggagagtcattttattcattgtcacactggttgtcattgccttaatcctcatcacattgcttcgctggatacagcatttgacctctctgggaagggtaggtgagacaacggcaaaagtagaacaggcggccatcgaaacatttattgcgagagcaagaaatccctgtctcggcggatatccatggcttgagaacaatgaacagccgaaaggaacggttgcagtttatccgaagaagattggctatgttgaatatattaatatggtgaaacttagcaagctgctgaccaatgatccccgtcatgtatacctcgtggcgcagccaggcagtttcatccatccatccatgcccgttttgtacctgagtcaaggccaggagtcatcaatcagcgccgatttacttgagacgattattgtctcggatgtacgttcatttgctcaggatccccgattttgtcttagcgtcatggccgaaatagcctgccgggcactttcccccgcagtgaacgatcctggaaccgccattgatgtcattggcagaggtgttcgtatactttccacttacgcgcagaataaatctgatgaaatagaagtgaaatatccttcagttcatgttgcaccacttcagaataacgatctactggaagactttttctcacctgtcgcgcgcgatggtgccggtatgagggagatacagataagagtccttaaaggactgtctatgctgagtaagggttggcctgggatattttctgaggccgcgcataatttagcatttgaaacattagagcatgcaatacgtgctgaccatatagattctgacagatgtctaataaaatcaatttattataatttatttagtggtgaagactctaataaaaaaccatag

SEQ ID NO: 3973 - DNA, 1404 bp, Klebsiella pneumoniae
ggtgagccgccccgcgaggggcggcaactgcaggaaggagaaaacacaatgacaccgactaccgcacagatcatgacggaaaataccgtcagccagacttaccgggcaacctattcaccagatgataataaattgcgactttacgcatcattacggctcgatgaagaaacgtattccctgatcaacaaagcaggctttcgctgggcgcccaaacaggaactttttgtggcgccagcctggacgccggggcgggaggatgtcctgctttccctcgccggtgatatcgaggacgaggacagcaccctgtttgatcgccaggagcagcgcgccgggcggttcagtgactacagtgaccggcgggcggttgaatcggagcaggcgcttgcgcatgttgattcgctggcatcggctgtcccgctgggacagccgatcctggtaggccaccacagcgagcgccgcgcgcgccggcatgcgcagaaaattgagaacggcatgaaacgtgcggtgatgctgttcgagcgcgccgaatactgggaacagcgcgcgcaggcctctctgcggcacgcgaaatacaaggagcgtccggatgtgcgttaccgccgtatcaaaaaaatcgaggcggaattacgcaagtcccaaaagcacattacccggtctgaagagtatatgacgatgtggcgtgcgcagacgctcgatctgaaaatggcgttactggtcagtaattatgaccatatttatgcctgcttcacgctcgacaaatacccccgcccggcagagaaaagccagtatgagggctcgatgtctctccattctgccctgtctgaggagatcattacttttgaacaggcgcgtgatattgcgatccgctgtcatgagcgcacgattagccaccaacagcgctgggttaatcattaccagaaccgcctggcctacgaacgcgcgatgctcaatgaaaatggtggcgttgtcacccgaacacaggaatttgaaccaggcgggcaggtactgagccggggagaatggttaaccattctccgggttaaccggagtaagggggaggtgagttcagtcgaaacgcccggttatcgctttctgggctacagcggcacgatgaaactcacgcccgaccgtatcacggactacaaagccccgacagcggaggaagccagcgacgcgaagaaagcggcgaagcgcccaccgatcgtcaattatccgggggaagggttccgggaaatgacaaaagccgagtgggcgaaattacccgctgattataaaggcgtgcggggtgctgcagaaaccgaaacacacggcgcctaccgcttccgccggtgcatgacgcacggttgtacgctcgtgaatgtgtatatcacagacatgaaaaccgttgaaattccgaaaaaataa

SEQ ID NO: 3974 - DNA, 603 bp, Klebsiella pneumoniae
ttgctgaagccgaaaaagaggagaaagcctgtgaaaaacagcctgaagaacctcgctaagacgccgctggcggcactggctctttcccttgctctggccgggatggcacatgcgggaacgctcgatgaggtgaagtcgctctgggatccgcagggaatctccggtactgaaactgcttccccgcagagcagcactccccaggcggtgagcggggcatctcagcctcgctggttacgactcagcaacggaaagcaggtggacctgcgcgactggaaagtggtgctgttcatgcaggggcactgtccctactgtcataaatttgacccggtgctgaaacagctggccggacagtatggcttctccgtgttttcttacaccattgacggacagggtgatgatgcgtttcctgaagcgctgccggcgcctcctgacgtgatgcagacctttttcccgaatatcccggtggccaccccgaccacgtttctggtgaacgtaaacacgctggcagcgtacccgatcctgcagggcgccacggatgcgcagggctttatggccagagtggatacggtatttcagatgatggagaacccgaataatggataa
